United States Patent 9,567,581 (SELECTIVE REACTIVATION OF GENES ON THE INACTIVE X CHROMOSOME) - sequence listing, part 5

SEQ ID NO: 623 - DNA, 531992 bp, mus musculus
aaaacctggagtcttggggaaaagaaaagagggaaaaaaaaaaaagcctaggctgtgaagctgtcaaaccgggcatgctcagtagacagggcaggttttttggtctcgagtagcggagaaacattttttgcacaaccgcgaccagccttagagcgcggcggcggcggccagggcaacatcagcacagccatcagcggtgcagacgcccggcacccggccgcgcggcgagctccggctcagcctggagttcacctcccagtgcccaggaggcttgtcttatcccttctgatctctctgtgtctctcttcctgtgtgcctctctccgtgtctctttctctctgtttctgcctgtctctctgtctctttctctctctttgtctctttgtctctgtctctctctctgtctctctctgtctctctctctgtctctgtctctctgtctctctctgtctctctctctctctctcacacacacacacacacactcattcactcactcacttccatacacacatacacattatcttgaagaagaaaaaaaccgacccccaagcaaataccctcctgggcagcgatcactggcacaacagtagccaggttcggttcctgcccagaagcgaccgcgggctgagagctccgccactgccagctggaggagagcgatgcgggggcccgagcggcagctcgaacagtaatgtggatttacagtcatttcccgcaggaaccagcaaagacgccctaagtccagcgcacttacagcacaccagcagagctgagtacctggcaaggaggcgggggaccgcacctgaggacatcactgaaacttgcgcctggactaggtaggtccgcttcttctggcttacttccttcccgcttgatcctgcctgccttccgccccaaggactctgggcgaacttcccccctaggatgtgatagaatgcatttgcggattgtgactcctgatcttgaaaagctggttgcgcccgctctgggactcctggtggaggaaacagagcctctgcaaccttttctctgggtctccttctgcccccagggatctggacctctcaggagagatgggagattggccttgttgttagtttaggcttccagcgggcactagggacactgtcctttgaaggtttcgtgggtttcccaggtggcacttttaccatccaactccttcagtactgtaagagggctgttcgcctccgctttcgcgcagaccaaagcactctaacaagtggaccaagatgtttggagtggcaggtggggaggctgtaccccccaaaagaaggagatgatcacctccttcattacttccacctggagcatccaccaaggttctgccactcggggtcacctactactctctctgaaagaagatgcccaagggctagaacatactgtagaacctgtttgcttccgaattgctattccaccctcacttggggagttccagctctaggagaatgccaggaccctcactgaggccccacccaatgtgttatccaatctcccaatctgtgtcaaaggaaataatcctaacggggcactgggtgcttcagtagccatcggcgttggctttaaccatacgctcatctgtgcgggattgtgtgtttctgcatttcatcctgaaaacctggtgtctagaattcagcaatagccagtacatctgccgagagccaagcacccgctaggcatgcctggggaaatgtaacctcagcttctcccattccgggaacaggcggattgccaattcagttttaagatgctttgcctagaggtgtggaaagaaccttagcgctacttggtgagcggatgtgctagaaaccagtagcctatttaaacatttcagcaaaccgggtgcagctgattgtttacaattgcagagacagccgatctcactccactagtggatgtcctgtccatgtctgtttcgccactggcagaataggggcgggggccagagctggcttgcagctagtacttgcatttggcagcattgggtttagcagatctgcatcactgctgctggagacatgctaatatggttcaaaaaaaaaaaaaaaaaaactctacttgagtacaaagcaattggtcaggatttgtctcaaacttctcagttttttctgagcacactaacctagtcgtatatttatagtggtccaaagaaacaggaagagaagttccctgtgccacaggagagaaattaaatgtcatttgaatgaagacaccaaaagcaaaggatgtgccccagagaactttaataggtatccttagatgagcatttaattgatcatatttccggtaaggattacaggcagcttccttgaattggagattgttgttttataattataattagcaagccaggtacactgcactgtaagcatcaattgctactttagtctgttccgtgaagacattgcaaatgtctgctctattgtacctttggttgaaaaaaaaatcctatataccttcatcctctgaaatcttctgacctgtagcagagggcacgggaatagtgtcaaatgatagcacaacctaaaagggtttgaaagctcatttttaatgaaaagactgtccacggctttaacttcttctcagtaattatcctgcacttgtttacttgcttacccctgccatgtattctatgtatctcccaatgtgtgtgtatgaggggatgaatttgcataaggcttcatatggctcttaaaagtagataccagaatagcaaaacccaagttttgacatttttatccaaatttgaaagacttttaaaatgatatgttgaataatttactattgcaaagttcttaaagggtagtcaaagattttcaggtatgctaaaataaggttgcaaacttttgatgctaataaaataaagccataaagtgcatttgcaaagtggttcaggtattttctaaaatgagcccatgctctagatattaattaaaactttacaggttgttcatcataattttctaaaaaaaaaaatcaggtgtttctgctaaacaactatataaatgaatactcaacataatacatttgataatgacaataataaaatttgctttctagaacaataacagaaatttaggggaaacacgggattaaatgatatggtgtttacaattagagcaaggactcaattatagagtaagaatagatagacatagcagttgataaattagagagaaagcttaaaggaaaacattgttttgtagaatcatggtgctgtgatgatggctaactgaacatccaaatattcaaacatattagtgtactgaaaaggtaaatcatagtgtatggaattatcaactacctcaaggccctgcttcaaagtttgaatgtcctaaaggtctcagtgattgagttctgctatcatatgtttaagtaacattgacatgatcatagcttcccttatcattgtacctttctcctgcctttatacagattcttgctgaaagagaacaacatagccgtcacattcattctgtatgatactatttttgatgatcaaactgaaaattactatttgatgttacttttgaaaacaaaaacaatgggattttattttctatgacagttttagaaacttaaaagcggtgagaaattttagtgacaactaacataaaaaaatgtttttgattttatgctggagataggctttcagaattcatgcaatgttcgcctgaagctcccagttcctgaaagcccatcagtttccgatttaagtaaagctcttaactcttcagtatacattttgattgatcatttccctaaggtttgcaaaaatatgttaatttattagttatgaatatatttacttatgaatgacttgaggtcaagataacattggtactttgagtacctgattcaaagatatttttaattgaaatatttttatcatattagtcatacttgttacatcctcatacccacccccccccccccacacacacacacacacacatacactttcttggaaggaatcgtccaagatttcttagctatttctattcattggcttattttatttacattacatgtatataattcttaattttctgaattttaaagccaaatgtaatgatttgtgaatattttacaaagcttccacatcacttatcatttggtaacaattctgagttgggttataagcacaactacaggtagataaaatgataaaagctattgccatatgactaccagcatatatccataacttcaaatgtgagtgctataatgaaaattaaacaaatttacatttcagaattgttccacataaacaataactgatttcaatcacctgcagactactaggttagatccttctttttaatggaggttgagcttatgttttcgtcctttaagaaatgaaacaaccttcttacgggatataatgcttagctattgttaataaataaaattaaggcctgaatcacctggcttaagtttatttatatttcttttagtttttttttgtttgtttttctgtttttgttcctgatgattgctgttaatgcagagaacagtaaatactaactagcaccatgtgcagttagagcaggtgaatgttataaaaggttttacccagcttttgattattgtgaacaatcttgatggttcaaccatagctgtctcctcagtatcagtgttcaattatgtagcttatagtaatattgtagtttgctacatgtggtttagtatgattaagcaaatccaaagatattgtttaaatagaaaactcatagaaaataggactgaataaatttaaatataatggtatgaactgaaaatcattgtaaaacatacatgttcatttatctgctaatatttgcattaataattcaaccaactcattttatttagtcatagcaaaaaattacagttgatgaggatcactgatattttaaaaatagtaacattaataaaaatttaaaactataaaattcatatgtaactttaattcttatttctagacctgaaagtataatcttggataatttataactttaaaaatattctgaattatatttcctgcccaagcacctacttttggtaaacaatagcatatggtaaaatgtgtgtatatgccaaatagccactacctcctggatgatgtttttaaagtgatgtaatgattctgaaatattaggcttttctctcctaccctaatctaactgtaagaatgaagagttaactagaaaatcaagacatcaatatgtattaagaaactgttatcagattagtggatcatttttttgaatttgtttcttaggagccttcttatttgtgtttctcagaggtctgtaacatgattaatatgctttctgggtatttatgattgtatctgagactctatgattataccttggtaagacccaaatgtctgcatgcaacagccaactgtttgggacaattcagactaacctctgattgatcaagaaaatgttttcctcagggtctgagtgttttggaatcatttaacaggacgatgaccactgatatctttgcaggaaaagaaaacatgcaaaacaaaaaatggcgtcctagagccttctctgaattatataagatgctactggcatcccccaactaatacaaaaccaaaagcatactgactggtctttgctagaacagagaaaatgcaacaatttaactttaatctgtaattcttatacatcaccctccaccccgtgatttatcagtttagaaattaaattaatgggattgatatgttagcttcttatgattttctatatctcatttcccaacagtccttctactgccatggaaactagatggcacagacagcggagagtcactcattcagaacaggagcctcctttttaatttcatgtcagcctgttggtccctgaaagtaactgaaaaggttggaacaatgaatttgtcagaaatatattattaagcggagcaaaatttctgccaattttttcttaggattttatttgtaaacctcttctgtttctactcatcaagcagttctttcaaagtagtcatagaaatagaggtttgatttgactattcttgttggtatttatgtagtctacaactcatttttgttctaatagagcattcacagctttaaaatagtttcgtaataatgattacattggaaaatatgttctttcaaattttgagtctgtagactttgaagaaccctacttagttatcacagtaaaactaaatacaagtggtacttgaattttccagtactatgggttattttccctttttaaatagaaaagcagttctgttaaaatatctatgtcccacttttttttttattagagaccacatgtatttgaatgcatttatttggaatttgtagaattattgtactcatccctataaagcatgcagattgttttaattttaatcaactaagttgtcatttgataagtagtcaacaatgaggaaattgccttttaatgtttctcatattttgttctaacatttttgtggctgattaaaacttataaaattgaattttagaatcacagtctctaatatgagctgaactgaatctcatgctgtcttttgcaatgccagctatacgttctgagaatctaatgggttttcttgcaaattattgtttcaaacttttttttaatattatagctaagaaaaagcaattccttagtgaagattttttgtaatgaaaaaaggcatatttgtttgtcatataaagatcagaaggtctttaatgttttaaatgaatacacacacacacacacacacacacacacacatatatatatatatatatatatatatatatatatatatactagacagaattatgagtgatagaatagggtaattatttaaaattttagaaaaaacagttgtttacagttttgtataataggaaatattgagaatattagtatcctgtggctggattttgaaatgcatatattttattagctgttttgttgctattttcttatttgagctaaagctatataatgacaaaaccaaaaactaggtcactcatcactgctgcacatgtagagtacctaatacttgaatcatctctatcactttgatttttttaaactttatgcaaatacttgacagtttaggggaataatgaaatagtatattaactatttggctcaaactatctgataaatcacattttgttgtatagccaaatgctcaagtttggagaaatgatagccttcatttctcgtttcaaagtataatatacttactattcaattgttttcctatttagatgaaatatattatcaatattgagtgtgctgatgcagatagagtcactctcagtagaattcaaatatggctatattaaagaaactcccattttcacttttttgggaaatagtttagtgtttttagctgcctatatgaatgagggtttgtatattggccaaaataaaagtaaattactctccatttgcatacttaagggaaaaatcttattactggctaaggtcacagagaaaatttcccagttgcatggtttttgtctaattggtggattctaagtacaactattacctctaatgtttctatctggtttagacacctgtcaaagagaaggtgccagattaaatggacaattggtttattagatatcaccacccctgcatcccagctgcatgtagacatttaaagaaaattcttccatttttcagctaaaatagaaaaaaatactacagatggcccatctcaataatccacattttttcaggtacatttaaaattaaatgtcctaagagatgattaattcaggaaagttattgataatgaactcatcttatgctacacatcctttgcacccatgatgatgccttattaaaggtgtctcaatcttgctaattaccacctgtgtttaaatatagaggtgtataaatacactacaactgcacagtggctggaagcattctaaacctgaaattttggctctattcctagctaacttagttcctatcaacaaaatgtttctgatcaagattttcaatttatagtctgcacattatgtcccttacttttaatgttagtgatttccttttctaaagctgctttgcttaattgcaaacatttgagagatattgatgtgtgatctcctgctttattaagtagccccaaaatataaatgtgtttgcttgtgtgtgtttgtgtttgtgtttgtgtgtgtgtgtgtgtgtgtgtgtgttcataagattgctttctctggggaatatttattaaaagtatatatatacatttcacatcaatttcacaaacattgtgtacagacacataacaatctcctctgttgctactatatactataaaggactatgcttctttgactgagcctccactacatctataaagctttaagcagcataagacaatttaggtagaatttctaggcaagtcaaacaaagaaaattattttgagaagatagttttaattttactaatgagatctagttacctttaagaaaaagggctatgcaattgagtaggaggtgtaacaacatacacattttctggatttgaattcttttcatgttacatttttttatatttatgtgtgtgcacatgtagaaatatacatatgctatttgtaaaggtcagaagacaaagtaaagaagtaagaattctattctacttgcaccatgtgggtattgaaaattggactcaggccactgggcaggatcacaagtgcctttcctcctgagacatcttgccagccctggatttatattctttattgaaggctttactttgagtatacttcttaaaatatttcatatttttgaatttctgatggttagtatgagaaaatcacatcatgtaggtgtaacaccatttaaatttggattggaatccaagaagtgttaacaccagcatgctactttttaattatcatcattttgtcctggtctcctatttaagatttaacaacttgtgaaagtgagataatttcaatgtaaacaattagaatccagtacaagggaaatattttaatggttaacttatcacaacaaaaggaattttcacaatgtaggttttgaatatggaatacaacatagttaggcaaatgtataaaatatgagagaatacttgtcccacagattcagtaaaatacttagtgggacttggctgctaaaggcacagagcaatataattactatttacagaatttaggaataattggttttatatttccattcatttcctctaaaggagctttagttgtcatgtggtgaccccttcttttaacaaaagcttcagttttacataaattttgtcatataccaaagaacactcttcatgaataaagcttttcatgtgataatttttaatgtacttgataaacttttacacatgcctctatttagctaactgtacaaacttattcaaaagacttacctatttttgaagacaaacatatataggtctaatatgatcatgtaaggaattctctaaaagcaataaccagaatattgtgaaaactcaaacatgataaagctttataaaggatagactgcttaaattaattctttttttagatttgtaaagtctctctcgctcttctctctctctctcctgttctcaatctcgctctcgctctgtgtgtgtgtgtgtgtgtgtgtgtgtgtgtgtgtatgtgtgtgtgtgtgtgtgtgtgtgtgtgtgtgtgtgtgtgtgtgtgtgaaatgtgtattcaggagcccatggaggcccccaaagagtgtcagataccctgaaaccattacaagtatttttgaggtgcctgatatggatgctaataactaaaattgaatcctctagaggagtaatatacgttcataatggccaagccatttttcctgtatccttaaattaattcttactgagtacccctggatattttagttagacctgtgcttctcaaccttcctattgctgaaacattttagtacagtcagttccttatgttatggtgacccccaaacataaaattattttgttgctacttcatatctttaatattgctactgttatgaattttaatgtacatatctgatatacaggatatttgatatataactcagaaaggggtaataatgcacatgttgagaaccactgatagagactagaaagactcccatcctgcatggtataagggctatgaaagggcacaggctaagctagatacagagcatacctactcaggataaaagtactttctatctaggtttgaagaacaagatcaaacataatttctcatttggtattcctgcatgtgcctagtactggtgtttagtacttacatacagaatggatcaacttatttgtatggagtgttattctagaaaaagtaattttcctgatgcttatttaaaaaaaacaaacaaacaggaaagttgctatatttaaaagcagaaattatctatattgttgaattggtggaaggttttaagatagcattggggtgaccacttatactaatttactctcttaccgtgattaataaaatgaccaaaagcaaatcaggaaggaaaggttctattttaacttacagattatattaatcgttgagggaagtcaggacaatagctggaggcaagaatcaggagataggaacagactcaaaagccagagaggaaggctttttactgagttgcaccctaagacatgcttatttagcctcatcatacaacccaagctaggtgccacgcatagtgggctgggccttcctagaccaattagaaatcaagaaaatgccacatagacatggccacaagctaacctgattaaagcattcccagagttgagttgtttcttcctaggagtgtgattcttttaaaaaggtaattcctatatggaggataggttaaactggattaagagtgagatatgtgaagagactatactgcaagtgtaaaagtttctcaggatgtggaccaaaacgtgacagtgacaatgaagagaagagaatatggaacctactgtaaaactcattatgcaatataaggactgcaaaagaaaaaaaaatgtttgagtgggcaatgaggtgaggtttggatttatttaatgggcaatagcacaaagacatccagacagaattagattttagattatttaaattgaattatcagttctgaaggtagatatttgggtaccatcagcaaacacagtcattaaacttccaagaatgagtacttaggatcccctacagactgtagagaaaataggaagggaacagtttcagaaatattgcactaaggatgttagaaacccaagaggaagtattccatgggaagttatgatataagccaggaggaaaacaaaacaatgaaataaaaataaaatctaagtgcacaaggttttgtacatgccactaggtaaagggcatgaaaaatataatgcatgagagaaaacacaaatgcaaattgttctttttaaagtcaaattttgccgggctgtggtggcgcatgcctttaatcctagcacttgggaggcagagccaggcagatttctgagttcgaggccagcctgttctacaaagtgagttccaggacagccagggctatacaaagaaatcctgtatcaaaaaaagcaagcaagcaaacaaacaaaggacaaatttcagtaatcaaaagaaattctattatatatctgtgaaatttcagatgtgaaaagtgaataacttcttatgatgtgtatagatatgcatgtatacttgcaatatagaaacaatacagaaaactatatatgtgagaaatttattaataagataatacagttgtgcaaggccgaattcttaagagtcattcctcgggcatggtggtgcacacctttaatcccagcacttgggaggcagaggcaggtgaatttctgagttcaaggccagcctagtctacagagtgagttccaggacagccaaggctacacagagaaaccctgtcttgaaaaaaacaaaaaacaaaaacaaaaaacaaacaaacaaacaaacaaaaccccaaacaacaacagcaacaacaaaagtgtcattcctgccaggtaaaacctataatcaaatcaattaacaaatggctaactcatttgattctacctgcaaactctagtgtttaaaaatgagtcattttttcccctgctaatcattaacactctcaaccaagccattgttttttaattaggactgggttatagtattcacaaagattcatccatcgattgttgtccctctatgattttcgacaccacagccagtatgatttttaaatttcattaagctctgtgtttttatctcttctttacttcaatcttcatcctacaatctacaatcaaacataccacttataagatacaatttaaatatttaagaaaaaatatcaaggccttcattattttgctatcagactatgtactgtatttcctatccaaacttgctcaaaaccttctatacactttgtcttctgctttgtttctgaaacataccatgaatggtttgtcactcaggaactttaggcatgcattttcttctcttagtttgaaatatttttccatattcctactggttgtatttctcattttattcatacatttaaattattatcctttcatcataactgtatcctctcccttttgcattgatttgtgttatacttcttcattttctctcccattctctacctctattttctttcttattagttagaactacttggaatcttactgtggtttagtttgtttataatttatcaactcctctagcatacgggatccatggggccatgagctacttgcctttttatttaccactacatccatccatataaaatagaatagtgccctacatgtaggaagtgcttaggaaatatcactttaataagagataataaagacctgatggaacactaattggtagagatttgacagttttctgcaaaataattaagaattttgtacacagcaactatggtggtagattaccagtggaacatttgtctagcatatgtagaccctgtgttgtagtaccacaaaaacaatattgttatcacttgtcccaggaactttacttctgagaatctgtcctaatgtaagataaaattcatttgcaaagtttttttttcacagaacatattttgtaatggtagaatacatgttcaacaaaggaattgctaaatgattatctgttgagaaaatacaatattttatgtgtactaaagatgatgtttacaaatattctatgtaaaaggaaaatgtgcatattatattgccaagtaacatagtcagataagtaaatgtttgtgccccatatacatgtagggaaaaagataaaaaatggatgcacaaaattattaaaaacaaaaagactgttttgggaggaagtagataggaggcagcatttaattttttctttcctctgctttatatagtaatagactatataacttcaattatcagattatatgtacaagagaaagactaaatacaatgcacaaataattactggtgcattgcagtaaagtttacatggtagcttagtataaacctttctccttgggcggtatagctatagcagtggttctcagccttcctaatgtcgtaacccttagtacagttcctcatgttgtggtgactcccaactataaaattattttgtccctactttataactattttttgctactattatgaatcattgtgtaaatatctgaaatgcaggatataagatgtgcgacccctaaagagagaaccaatgaggtagaggtaaacaaatcaggtagaaatgttctctggaagttttgtttaaagaggtccacaggcaagggtaataattgaaagccactaatgcaatttagtcttcatttactagagaaccagagagagctgagtgtattctgccagtatttgaacaggatgttaggggaagattaggcaagctaagccttctacatattgctgtgaaaagcactagcaatttgcttcatgtaaagcagaagtgattactcactatatttcttcatgtcgtgtagtaataacaattaagagaagttagactacagattacttgacaagtcagccacagtcacctctaatggaaaagaagaaaaatagcattgacaacttttggcaagtctcatcattagaaatgcccatattgccagaaagaaaagaagctgcatccaataatgtaaaccaaaagttctttaggccctgaggaaagaagtgacaatccgaagtagagaggcattaattgtcgaggagcacagatcattgtaatggggaaactgtctctgttattaacacaattattttctacaaggtccttgagtaaaggttcctttggaaaaatcgcatccgagttttcaaagcatgggaagcaacaccgaaagatatcgtcattagtaaaatcaagtatactgatttgtacgctacctaagggccttgtaaataggaactgtgttcatataccacctacagctaaaatttatcaagaaattgaataattaaatgacaattttcttaaattagtagaagttattcttttcaaatccattgaagatagcaattccatatacacacatgtatattttatatatgtatatccataaattgatatattaacattttgaatgagatttttaaagtcttatctgcacaccttcaattcactaattacgtctccatttatggatggcaattatttagagatactaagcacctcctttgtgaagacagtagaatattattcttttcataggatcaaacaagaggtcatagaatctgaagtctggactagatagtctcttaatgagctgtctagatttggatttataacttggctgtcaagatgtagcccatttctaaatcataagtcagttctgtgggctgtctttctaatgtttatggcttctgctattttgcatctggtatacattatttgcttcattccagtgccaatactctcaaatattctaacttctttttgttaagtggtggttagcacacataaagtcattgaacaatttcttccatttagaattgaactcttgggtgagatagagatttgtaaaaacgaagggatgtggaacatgttggcaacttgtaagcaatggcatggaacctggggtatctgacatagatcaacctatacactggccttctataatcttaaatggggtgattcgcttctaaatgctgaagcaggaaagcaattctgaagtgagcagagaagagctatatctttttaaagccagttttcttctcatttctctgtgtacctcaccaagccaaaatgctacatataggacagtttattttttcaagtacattttttttgctagctttcttgcacaatcagccttatgggtatgaagccaatttctacagaattactctggtatgttcagcagaagagacaggaataattttgtagtctagatgtcagtacgtactgaagtatcttcccttgaaagattctaacttagcactattatggaaccacttcaacacttgagcagaactatgccttttttttgagcagcattaacaatgataaaaaatgcacatagagcaattagattgcaactaatcaagagcacttcttcagtttactatgaatgatttatacatagtacattgggcatggaaatcattagtaataatatcatactctattatcattacaaggtcatcttagtgatttttttccaaaggtgacaatgttgtttgcctacattcttttttatttctttgtttgtttggttttggtttttcaggacagagtttctctgtgttgccctggcggtcctagaactcactctgtacaccaggctggcctcaaactcagaaatctgcctatctctgcctcccaagtgctgggattaaaggcatgcaccaccattgcccggcggcctacattctttaaaagtgtatttaaatattgtcttttatcttgatatactcatagcatttttgaaagatgtgttctcatgtttgagaatttccaaatataaaataagtagatttgagaattagttgattgataaattggtgtcacaagattaactaatgtcaatcataaaatatcaaaatgttaaagtttaaagttgacattttctttttcttatgctttgatttacaatactaccttttctacaatggaaattttaaggaattaaaatatatctactaatacaaggtaatacattcattaaagaaatgttagataatggaaatatacacaaaagagaatcatgtattttgaatacagttttctatactgatcacattttaaattactttattacatgcattgtatttaccagtattttgataataatttctaagttaataaaaaaatatatatggagagaaaagcagtaaaaaaataatagcccaaaagagatctaacacacttcatcgaatggccccactacatcaggctgcagtggcaaagagccaccctctataagtgcctcaaagtccctcctgccattaccgagttcacccaggccctggacaggtaaacaactactcagctgattaagcttgcccacaagtacagtccagaaacaaagcaagagaagaaacaaaggctactggcacatgctgagaagaaagctgctggcaaaggctacgtcccaactaagagaccacctgtcctcggaactgaagtcaatacagtctccaccttgatggagaacaagaaggctcagctggagtgattgcccatgatgcagacctcactgagcttgtgattttcctgccttccctgtgtcaaaagacagggatgccctactgcatcatcaagggaaaggccaggctgggaagcctggtgtacagtaagatatgcaccattgttgtcttcacacaggttagctcggaagataagggtgctctggttaagctggtgggagctattagaaccaattataatgacagctctgaggagatctgccactactggggatgcaacatcctgggtcctaagccctgcctcacattgccaagctggaaaaggcaaaggctaaaggactcaccactaaactgggttaaatacacagtgctaagttttctgtacataaatataattatatatgtaggaaaagatcaaataaactgcatatcttaaaggattaacatctactgatatgctgctctccaaaaatgtatccatatgcattgcttatgagggtggggtgttgtaaagttcatatgttaactatcattagattacatattgaataaattatgccacagcaaaatatgtatctttcaagtagagcatattagtgtggccccttttatgatagtaaacctttggtccaagtgctaagttgttgatatgtgttaaaaatattttaccttcatttttataagtgctgtataaagatagcatgtgagtcattgaatcaaagaataaagcaaaaagaaaaagacacacatcttgatgctagctctgccatgtaccatttatattattcagtgcagtaatgctagctattgaagatctatgaaccctagttttccaaacttaaaacaattactaggagaaatagattaagtctgtataagaaggttttcagtaagtacaagtaactattatactttaagcaattattgttagcatagacttcatgttgttaatgacattgtgatatcatatcatctcaaaaggtttagtataaattaaatgaggttgtatggggagtagacataaattccatactattctatgtatatacactgaaattaaaatactctttagcctagaatgtgacttagtggtagagtgcttgcctacattcctaagaagaaaagttccataccatgtacagcaaaacattaaaacaaaactccttctattagcagtgcagttaatataatggaagtttaaagcatacctttagtcaagaaacacaattctcatgtgaattagaaaataagctaccctagagatggaacaacattatgaactaaccagtaccccggagctcttgactctagctgcatatgtatcaaaagatggcctagtcggccatcactggaaagagaggcccattggacttgcaaactttatatgccccagtacaggggaacaccagagccaaaaagtgggagtcggtggataggggagttgggggagggtatgggggacttttgggatagcattggaaatgtaaatgaggaaaatacctaataaaaatattaaaaaaaaagaaaataagttacagtgtatatatagtcccattatatagagtgtatgtatagtcagtccctctcagtatgtatgtgtgtgtgtatgtatatttccctcatggaggaaatgcactggacctgtttgtacatctatatgaaagataatttggtctaatttttttacaggaattacaagagcgacttttattctgtgtaacttctcttctggatctaacaaggtatgtttaatctatgctgaatcttttaatataatagtatgtattattgagttgattttagctgaaatgcatagtttaatttttggaatttatttttctattttatatataaaatgtttatagaatctattattatgagagagtatttgcaaaaccaaatgttcaaactgtctgaaaagtttgaattattaattctgcaacattttctatacatagtaactaaccttaggagtttctataactagtgatatcctctgtagagtgagtaggaatagcagttaccaataacgaaatttgcaaaattatttaatagttctcgtggactataataaaatgacacttttccctatcaatggaacaaatatttctatttagaagatccagaacaaaatttgcctccagaaatgtatgtcatgattctttaagaagtagcaagtgaaatatttagatttgcatcttttgtttaacattccatttttcttcttttcttctacccatctatccaaccacatatttgtccaatgaacattcactaagaaaccatcaaaaatcactgcaccctttcttctgataaataactaatgtagctatagttcaattagagtatcgattaagtgcttttagagtcagtcctctggtggaatatatacaaaaatgtggcaagatttgtaacataccttacagttattaattttattaaaacattagtcattattaagttcttagtaactagggaagagatagtattgctcttttaaactttggtccctatctgtgatagtgctatacaccattaatcaaatattaattctcattccaagtggaaacaatgaaaggatgatctgaatttgaagtaaggtgttaagtctttgacatcacatagtacttttaaagtaaactatataaatatataagtatagaaaaaaagaaacagaaatccctcaaatcttaggatttgtatgcagtttgaaaaatatactaaatgtaaaaatattctaaatatataattagttagagctcaactagttataattattctaaacatgaacttaaaatatattagccaattgttaccatattaaacataacttcatttaccattcatctagatgtattatctttaggagaataataatatgacaaagtttagataattctacaacaaaaattataatcagataaccaaatgacaaaattaaaagaaaatttccttagagaactattcaagattttcacatattatgtcatttgtgaatttggaagttgtctatgtgccctaatatcattgcatgctattaacatatctttcatactaagaaagctttatagttaatgtaaagtaatatagtataattaaggcgaaacatccctggaaaaacttgaaagatgcacacttacaaaaagatattggcactgattacatagttcagagaacgtctaggtttgcttctttagtgagaaagcatgccatggcagaaggcctgaactctattgctactcttctattaacaatacatttctgcttaggtcatttctctttagtttcctcatctatgctaaaacattgtgatgaataataatgtttctccctggtcaaaaatcctgtagtttaaaatcgataggtagttgttagggcttgaaacatggataccttagtaagtttcttctatcttaatcatgaggacctgaggttaatcttctaaactcacttttcaaaaacaatgtacattgtattactttggaacatacctggggctggcacatagaatctaactgaatgagtaagatctatacaggttcagcgagtgatcctgtcgaaaaaaataaggttcaaagtgattgaggaagtgtgatggtttgaatgacctatggtctccatagggtcatatatttgaatgtttagttcctagttggtagaaccatttataaaggattaggaggtatagccttgtgggaggaggaatgtcactaggattgggctttgaggtttcagaagatctctgttttagctctcttgctctgactcatgcttgtctgtttgcctgctgccatgctccctgccttgctgatcaaggactcaaggacccacccacagaaaccatgagaccttacaataaaagctttgttctataagttgctgtggtcatggtgttttatcatagcaatacaaaatagtcactaagacaggaagacagctacccttgacctctggtttccataggtacatacaagcacatgcacccacgaatacattcccctaacacccccctctcacaaaccaggattcttctcaggtatgtgtatgagtcagtattggttgttaggttggaaaatatacacacaaatcagctgtccaaagatttcctgttaagtggttaaaatgaattagtaataaaatacttgtttctctttgaaacaaagtagctatgtattcttaaatgattagcacccacttacctctctccataacaatacttgtactggcattatattaattagactgaagtctaagtttaactactagtttcaaagtttttttttcccccttggtaaaaaggtttaaattagtggtggcatattcccatgctggttctctttgtgtctcttaaaagtttagcaagctctatgtttcttgccttttgcttaggtggtcattcaaggtcaagcatctctctgtaccttgaaagcagccaagtgcataacccgatgacttcaaactccaatgctttcaatctggcacctttcatgagcttgtgttcatattaaagcattcaaaatatattctccttcatctacatatcacagcaataacatcctgggccggacagtgcctgggagcaaataaccacttggagttaatgatctgaggggcagctgaaggaccattgactcttcctagtcttttcttcatcccaataaaatgtctattcctgaagtgccaagccttcaataattttccatcacacatcagattaagtagtggctataaataatagtatttaatacataataatgagatgtggcgatgcagtaaaataccaacaattcaagtgctatataaagatggctattctgatcaaacccaaaaagcagcagtaaatgaagttctcgaatcgtaatgttttagaagtgactttcatcttattgatttgaaatgaaatataagtaaaaattcatgtggtataagggaatagtttactttcttttgtcccatattccattgatgaatgattcagtttaaaaataattttataatgcctctgacatatccttttaaatggattttaagtagtataagttcatctccatatttagaattagattcatgcttttgaaatatatatagctgtgaactaagtaacaaatgctagtatacgatggttcccaaacgaactttcacttactttatttattacagtgacacccattaagtttccacaatggggcatggtactaagttctagtgaaataagaatcagcaaggggcaggttctacagtcagaaccacatgatatgtagttgagggctgaaattatgcatttatgtaccaggtaatcagtgttgttagtatgtattacataaatacatttgttttggacattattcttccaagtgaaaaggattcatacatcaaattcctacttggtaaagcaataatatatatgattgcaaataactccacattcaaaaaggaatcacaccttatgtgaggcataattccctgtacaagctcatcttttaatctgtagaatttgtaacaatgtcatgccatatgtatgaaagaattaagaattagaggtgctaatcagatggccttaaataacagaggaatatctgtatagaatcaatgaagttataaggtccttaaaagtagaagaaggtgacagaacagagctgcagaaagcatgaaaacaacctaacatggtattggcagctttaagatagaggaagggaccatgaaatatggataacctctggatgctaaaaaaggcaaggattcacattatatgtaccctggtgcctcatttgaaaaattcacccttctatcatcctaaatttatcctatcaagaactgtttaagatttcttttttgttaatttatttttttatcctttaatccttttttacagtacagacttcatacccctccctgtgtgcctcctgaccactcaccattccatacctcctctctatccatctgactccaagagggcaaccttcctcatcgcctcccccaacccatcacaagggcgccccattccttggggctcaagtctcttgagggttaggtgcatcttctctcactgaggccagaccaggcagttctctattgtatatttgttgggggcctcatatcagctggtttatgctgcttggttggtggttcagtatctgagagatctccaggggccaggtcatttgagattacgggtcttaatatagagccaactcctcctcagcttcttccatctttcccccaattcaaacacaaggtcctggcttccatccctttcttgggtgctagtatctgcatctgactctttcagctggttggggcagccatgctaggcttctgtctgaaagcacatcacagcatcagtaacagtgtcagagccccaggcctccctctgagctggatcccaatttgggcctgtcactggacctcctttttctcatgctcttctccatttttttttcctgcagttccttcagacaggaacatttctgagtcagagcttttgacagtgggatggcaaccccatcacttcacttgatgtcctgtcccttcactggaggtgaactctacaagttcctgctccccactataaggcatttcatctaaggtccctctctttgagttctgagagtctcacacctcccaggtctctggtacattctagagggtccccccagcccccacctcctgaggttgcctgtttccattctttctgctggccttcagggcttcagtcctgttccccctaatccctgatcatgttcttcctttctcttcctttcttctctcccgcacaggtccctccctccctccctctgtcctccttgactgctttcttcttccttccaagtgagattgaggaatccttacttgggtcatttggcttgttaaccttcttgagtcctgtgggttgtttcctgggtattctgtgcttttttggctaataaccacttattagtgagtacataccatgcctatccttttgggtctgaattacctcactcaggatgatcttttctagttctatccattcccctgcaaaactcatgatgtccgcattctttttttaaatatttttaatatttctattaggtattttcctcatttacatttccaatggtatcccaaaagtccccgataccctccccccaccccactcccctacccacccactcccactttttggccctggcgttcccctgtactggggcatataaagtttgcatgtccaatgggcctctctttccagtgatggccgactaggccatcttttgatgcatatgcagctagagtcaagagctccagggtactggtaagttcataatgttgttccaactatagggttgcagatccctttagctccttggatactttctcaagctccttcattggggccctgtgatgcatccaatagctgactgtgagcatccactactgtgtttgctaggcatagtctcacaagagacagctataccaggatcctttcagcaaaatcttgctagtgtatgcaatggtgtcagcgtttggaggctgattatggcatggatccttggatatggtagtctctagatggtccatcctttcgtcacagctccaaactttgtctctgtaactccttccatgggtgttttgttcccaattctaagaaggggcaaagtgtccacactttggtcttcgttcttcttgagtttcatgtgtttcacaaattgtatcttatatcttgggtattctaagtttctgggttaatatccacttatcagtgagtacatatcatttgagttcttttgtgattgggttacctcactcaggatgatgccctccaggtccatccatttgcctaggaatttcataaattcattctttttaatagctgagtagtactccattgtgtaaatgtaccacatttttttgtatccattcctctgttgaggggcatctgggctctttccagctattataaataaggctgttatgaacatagtggagcatgtgtctttcttactagttggaacatcttctgggtatatgcccaggagaggtatagcaggatcctccagtagtactatgtccaattttctgaggaaccgccagactgatttccagagtggttgtagaagcttgcaatcccaccaacagtggaggagtattcctctttctccacatcctcaccagcatctgctgtcacctgaatttttgatcttagccattctgactgctgtgagatggattctcagggttgttttgatttgcatttccctgatgattaaggatgctgaacattttttgaggtgcttctcagccattcggtattcctcaggtgagaattctttgtttagctctgagccccatttttaatggggttatttgattttctggagtccaccttcttgacttctttatatatattggatattagtcccctatctgatttaggataggtaaagatcctttcccaatctgttggtggcctttttgtcttattgacggtgtcttttgccttacagaagctttgcagttttatgaggtcccatttgtcaattctcgatcttacagcacaacccattgctgttctattcaggaatttttcccctgtgcccatatctttgaggcttttacccactttctcctctataagtttcagtgtttctggttttatgtggacttccttgatccacttagatttgatcttagtacaaggagataggaatggatcaattcgcattcttctacatggtaacctccagttgtgccagcaccatttgttgaaaatgctgtcttttttccactggatggttttagctcccttgtccaagatcaagtgaccataggtgtgtgggttcatttctgggtcttcaattctattccattggtctacttgtctgtcgctataccagtaccatgcaatttttatcacaattgctctgtagtacagctttaggtcaggcatggtgattccatcagaggttcttttatccttgagaagagtttttgctatcctaggttttttgttattccagatgaatttgcaggtttctctttttttttaaaaaattaggtattttcctcatttacatttccaatgctttcccaaaagtcccccataaccaaccacccccactcctctacccacccactccccccttttggccctggcattcccctttactggggcatataaagtttgcaagtccaattggcctctctttccagtgatggccaactaggccatcttttgatacatatgcagctagagacaagagctcaggggtactggttagttcatattgttgttccacctatagggttgcagttcgctttagatccttgggtactttctctagctcctccattggggaccctgtgatccatccaatagctgactgtgagcatccacttctgtgtttgctaggacaaacaagagacagctatatctgggtcctttcagcaaaatcttgctagtgtatgcaatggtgtcagcgtttggaagctgattatgggatggatccctggatatggcaatcacaagatggtccatcctttcatcacagctcctaattttgtctctgtacctccttccatgggtgttttgttcccaattctaagaaggggcaaagtgtccacactttggtcttcgttcttcttgagtttcatgtgtttagcaaattgtatcttatatcttgggtatcctaagctttctgtcccaactggtaagaaggacacatgctccactatgttcatagcagccttatttataatagccagaagctggaaagaacccagatgcccctcaacagaggaacggatacagaaaatgtggtacatttacgcaatggagtactactcagctattaaaaagaatgaatttatgaaattcctaggcaaatggatggacctggagggcatcatcctgagtgaggtaatccaatcacaaaggaactcacacgacatgtactcactgataagtggatattagcccagaaacttaggttgttctttctaattcgttgaagaattgagttggaattttgatggggattgcatttaatgtgtagatgtcctcattcttaatagctaagtaatatttcatagtttaaatgaatcacatattttgtatccattcttcaattgtggaacatctggtttgtttccagcttccagctatcacaaatatggctgctgtgaatacactggaacatgttgcccctgttacccatggtgtggcatcttttggtcatatgcccaagagtggtatagctgggttttcagatagatctatttccagttgtctgaggatcctccagattgatttccagggtggttgtaccagtttccagttccagcagcaatgaaagagagttcctctttctccacatcctctccaacatatgttgtcacttgtagttttgatcttagccattctgactggtgtgaggtggaatctcaaggttgttttgatttgcattttcctgatgactaaggatgttgaacatttctttgcgtactttcagcccttccagattcctctgttgtgaattctcttagttttataccctacttcttgattgggttgtttggttttaaaaacaatttggtattggtacagagacagagaggttgatcaatggaatagaattgaaaatccagaaataaaaccacacagagaaacttcatctttgacagacaagccaaaaatatacaatggaaagaagaaagcatcttcaataaatgatactggtataactggcaatctctatgttgaaaaataagaataaatacatatctgtcaccttgcatgaagttctagtctatgtggatcaaggacctcaaaataaaaccagatatactaaatctaatagaagagaaagtgggaaagaacctggaactcatttgcacagggagaaattccctaaacagagctccaatggctcaggctctaagataaaaaattgataaatgggacctcataaaactggaaatcttctgtaaggcaaaggactcagttaataggacaaaccagcaacctacagattgagaaaatattttcactatcctcacatctgatagagggctaatatccaaaatataaaaagaacttatttaagactcctgacttattcgactctaagagaattctgtgttgtttcatatcataatatcctcactaatttatcagagtgaagtccttgagaaaacatggaagtgtctagttgtaatccaaacataattactaatagacatggctcatgttacttctgagatatttcatccagtgatcatctccaaacccccagatatcctttaggacattccttctgagaaggaatttgttaggtctttggaaacccattctcattttcagggagaatttggacctttccccattccattttctgtaagctaggtgttaaactaatgaccttcaaatagcatcttgttttcactagggatcttacagatatcagttgaaacaatataacttagataattcaatcatgttttatgaaaatgcaccagctacctatttttgtcccatattcattcgcatatctgcatatgtatttgaattctggatgcattttaaaggacacagctgactagatcttccttggaatagaaatgatagcaactatatcattcagtcttttcaaaataagctattagaagtcacagaagttcccattgtccttaagtttatctaattctgtaacttcctttgttaaaaaacactgtgattgatgctataatatttttactcagcttaccacaacatcctgtaggatctgtcattgtgtcattcgttctaatttgtaccaaaattatagttttaatcataagtgtgcatgaagttaatgctcattttactgctgacagtcctttgaggaggtggaagacagcgctgaaaggagatcctttggtaatcctaagaaaggctgattttctgttaagtacatttttgtaagtcatttttgtcatttcgtaaacatgaaatgattattccttcagacagatgaaatattcattaagaagagaagtgaggaaatcacagtactattaaagaatagcaaatgagtgggatggctgtcaagcatcccctgacctgaggaaaaagaaatcagagtgccatagagagggaccatagaatgaaaacttttttaaaggttatttccataaagtctgtagaaatcttggcttccattaagatttttgtccctgagagcctaaactgtaagtatggtatgtgctttgtctgcagaataaaaaagaagatcttcacttaatcattatcctgggagctgaacagcctgctaaatttgaataaaaatgcctccttcattactgatgggaacacagagttccatgtatcagtgatttatggagagcttactaacagggctaacttataaatgaatggtcagtttaaagaataatacaatttgttaatgtgtctagcatcaactgagatacattatgcttccaaattcaaagggaaaaaatgctaccaagtgaacactgccagtgaaaatttttactttgctttccatatagagtgagggatcatagccaaccatctctttgtaaagttcatttctctgtttcatctcggtccttctgagatggcctccttccactttatatagtttaacaccttattagtaccttcccaaagcttgacgtttttctttgcttgtagcattgccagtgtattttgttttcgttgttgattgagtttattcttcctgtaagaagaaccaagttacttcgaaagcaagctttttggtacatcttttcttctaggagagtttttctctctttgggaagttgttgtgtatattttatcagaatgactatcatatacttgccttttatgaaaagaaaagggaactggagagatagttcagcaattaggagaacttgttcttccagaggtcccaggttgggttgcaaacattcaaatggtagcttacaaccacttgtagctctagctcttcgggcctctgagggcactgtacacatatggtgcacattcaagcttacaaacactcatacaaaggaaaaggaataaatgaataaatctgtaacaaaaaggacaggaacaaaactgacgcacttatactgctttagatggacaatcagaacattttatccaacaagatcagataaaaagcttcatagaagtagtaaccatatgtattttatctttaatgactagcaagtgcctagaacagcatctcacacttgtagatatttagcaaacacgcgtttaatgctttaatgaatgaatctcagaaacagaactgttctaacccaacagaggggaataaaagtctcctcttgacttgccttattcacttcaatatattacactgtacctaacatgctgagattttcccacatagtcatatatttaaggtaataattgaatatctcagtgcaatttatgcccatgctaaattatacttcttgtgggacagcatggcaggattctactcagggtactacaaattatattgatagggtgaaatgtgttttcatgtctgtttgtaaaatgtggaatattattgaattactttaaatgtcatgtttgagatgagctcaggctggtttctttgggcttgacacatttcagtctgtcatcttgtccttagagatgctgaaaattaaatggggatctttaaataatttaccttataagtttgcttatagctatgtgttttgtcaagccagatgtcagtaccctcagatgctgcttgaacataaattaaagttggtgctgcatatcaaagaacagcatgcaaaaaaagaaagaaaccactgtaatctgtgctaggaaggatgttttcttctttaaactgttagataatgtggaggagaaaaaaaggctaatcattcataaaagaatattgcttaaatatcatgggaaatcctgttccctgtatatataatgacgtaactcatatgtctggaactggaagtctataatagatatcatcttattctagttccacgcctttctatccttagaagacatttttttcctattctttttcaaatgcaatagacctagtgtaggttttatgattatagcatcaacacttccagtttatggttaaaaaaaaatggtctagacgatgttttaacagggcgttttattctagtgagaaattatgcatctgagctcatcttccctgacataaatggaaaacaaacaacagccttctatgtaatttaagcaaggttgtgggagatgacttaaaatgatagaaacaaagcagattcgttcccagcactgcacacatccacagtgggacagtcagctgctatgtctgggtttgtttctcaaagaaggtgaaaaatttaggatgaatcatctctcaatttccttgcatgcccagagttctttgagaagtagtagagtcttaccaacctctatctgaactctttgttttattaaattctgcctatgtgttaaggcccataacagatttacaatgatcctaattcttccatgattttcttaattttcctaaagtatatacataatcaggaaggcatattttccatgtttatgtcatcttgcttatccaatttttatctagttatctgatgtattttttcatattaaaattgtctccccaaatatattgcacaagactttttttttttgagacaaggtttctctgtggagccctggttgctggctgtcctggaactcactctgaagatcaggctggcctcgaactcagaaatccgcctgtctctgcctcccaagtgctgggactaaaggcgtgtgccaccaccgccctggctcatgagacttttatatacagcattatgcctaataccaattcctgcatggaatctgggacattatgaggtatgacaaaatttgtcaagtattttagatgagattctaatcacttagcattaggagaccaactgacttggtagctaaaagtataaaggcctgtgtatccatttatatggacttctacaaacaaaattactcattctctcgtggcttataaaaaaaaagaagagaaaatttaattcttacagttctggttgctaggaggtggtccatgatgatggtgctaacaaatttgattcatgtcctaactggccatctgcttcacagacaacagcttctcactattcttcatataatgtcaagggtgaaaggtctctctgaggccttagtttaagggcatttattcaattcaggagagcaaatccttatggtatagtcagtttccaaagaccgttttcctgatatccaccctggagtttaggatttaagcatattaaatcagtgggcctaggaagggacaaacacttagattctatcacttcctctgaaaatcattgccctagactcctacattgaaaggatattataattaattcgatctttcatggctacaaagatctatctggatatagcatttttgagaaataagtccttcttttttcaggaaggttattatttctgtcatttttcttttctggaattctgacatcaaaaataccttagttatgatttcttttactatgaaataatagtatgaccaaaagcaacttcatgaggagagggtttaagtggcttatacttccatattgcagtccatatttgaagaaagtcaggacaggaattgaagcagaggccatcactgaattctgctaacaggcttgctcccagaggcttgttcctgctttcttatacacccaggaccaccttctcatgggtggcagcatcttccattgcctgccctctcacagagatcatcgattaagaaaacacctcccaggcttgcctgcaggccaagctgacagagatatcttctcaactgtgattcactgttcttagaaaactcaagctggtgtcagattgaaaaacaacaagaaaaacagcaaaccaactgactaatgaagtccactcagcttcaagaaaggccatattatgacctactgtgatagccactctagtgagcatgaggacagttagtgtgcatagagtgtcttagttagggttttactactgtgaacagacaccatgaccaaggcaagtcttataaaaaacaaacaaacaaacaaacaaacaaacaacatttaattggggctggcttacaggttcagagattcagtccattatcatcaaggtaggagcatggcagtatccaagcaggcagagctgagagttctaggtcttcatccaaaggctgcctggtcttctactagccattggagaaggtatagcctcagctgcagttgatggcccaagactgaaggggtcatgcaacgaatttgaggcttggcaccatgaagagagcctatgagaggctattggtgaagcctagttggagtggaacaccccagtatattggagatgtcagtaccatgggatgattaccaagaacagcagccttagtggagtggattaatctgagcttagagtgctacagagggcagagctggagtagtgatgccagcccttaggaggagtccaaaagatcaagtggaatcctagacactgaaacaagaagctgtaacattgaaattgcctttgagactcaaagatgttaaagatgccagagccatgggatacatgttgaggaaagctgctaacagggagtggagcaaacccaggagaaagcagtttgttgcagtcaacaaagatgaaaaagtagtggagatctgaagactgctttgacatcatctatggagatgcagagtttagagtttgcccagctggtttcctgccttgctttggggattacagttaattatttggatgaatctcagaagagaccttgaactttggacttttaacattgctgagactgctatagactatgaggactttgaaagttggactaaatgcattttgcattatgctatgtttaagtatggcccccatagactcatgtttttgaataagtctatgagggccagggagtggaatgtgatggtttgtatattttcagaccagggagtggcaccatctggaggtgtggcctggttggaataggtgtatcactgtgggtgtgggcttaagaccagctccagctaaccagcatcaattgtcccagtagttccttccattcttaactctacagccagagccacatggctgaatctgtcgagttctgctgcttgcaggaattagaacatgacccacttgtactattacattgtcactggctttctgttttacaaatccttcactacttaagcttggctatcctgggtcttgctctgtagattggccttgaacgcagagatcaacatgcctgactcctgggattaaaggtgtgaatcaccatgcctggatctaaatttagctgggtaggatcttgccctgaggtcccactcttttaatctgttatcttctagaatataggattttgctccatttcacttcctggtacccctttaatactcgaaccatatattttatattttccctttctaagcttgctatgcttgttcaaacttctcttcataagacttaaccagagaacaaagtctctgctgagcttttttgaaactttctttgtcagtgcaattaatctgagtctcttcaccttagcctcaggcagacttttcaggcaagggcaaaaagtagccacattcttcaccaaaataccacaaaaacagtctttatgccacattctgaaattcttctcctttgaaatctcttgggccaggtcaacacagttcaaattactcccagcaacaaagttttccatattcctactaggatgacccattgaatcccatttaaagcattccactgctttcaaattccaaagtcccaaaatccacagtctttcaaataaaagcatggtcaggcctatcacagcaataccccagtccctggtaccaacttctgtcttagtgttttactgctgtgaacagacaccatgaccaaggcaagtcttataaaaacaaacaaacaaacaaacaaaataaaaccatttaattggggctggtttacaggttcagaggttcagtccattatcatcaagataggagcatggcagtatccaagcaggcatggcgcaggcagagctgagagttctatatctgctagtagaggactgacttccaggcaactaggatgagagtcttaaacccacacccacagtgacacacctattccaaccaggccagatgttgccactccctggtctgagaatatacaaaccattacatagagtatactccatgtgtttgcagtgaagaagatgggacataaaacaagcacacaaaataatttctatattatagtgtaatgaaatcatattaaaagtatatatgagctgaactgcaatcagagacaagtgggcttctggctttcttttggtttatatattagaaagtacatccaaaatgttacaatgatttgagctttagaaaatgttagaacatggactttaggagatggaacaaagtacattcaaggctgaatgattcgaataaggaaaatcataaagacacacaactgatatgtctgcctgaccacctggttttgttagattagagaaacggttggaaaaacattttagaagatatgcgtcaaatgacaagacttttcctgacttattattcacctttcaggttcatttaattccctcacaggaatagattctaaaatgaggaagaccatggttttgaacagaagcgtagctcttcaaagaattgtattttaggtaagcaaattaagatgggctgtggatgtatgcgtttgagataagaccaaagctgtttaaaaaacatctgagggtcagatataaacgagatatcccagttcgtttaaaagcaaagccaaagcctgactgtgaaccaaattaagaaagaggaaaataactctgatttatgccagccatgtgttggccactatagccagtttgttagtcagttctttgtaattggatttctgaattatttgttcttcctacattattgccatctttaggaggaatgtggtcatttttcagcttcctgcattgataagtaggtatacaactcccactgtttttcatgtgtgtctaatttttgccactctgctgaaaaatatgtgacaaatcagaagtcggtatattgcattttacatccttagtaggaaacagtttcagcaggaggtacagtataatacagaatactcaagtagaagcaattcatttaagcctgcaagcattcctgtggtacagtggtccaagcactagccacagatagaggggcaaaagatgcagcttttccctcacgtacttactcttaaggatgaccggaacacatacatgttgtattcattttctctggctaaagaaggaactcatgatctaaacgactgataatgaaaccaatttattatttcacaaattttgcaagtcaaatgtatggacgtgacttaaactgtttttcttctcagagtctcacaaggctgtagtgcaatgttggcccggcttattttcttttgaaggttgagtagggaacaatctacatccagttcttgcagaacaaatttcttcataaatgcaagtacatagcagtgtatttcttctgatcaaggaatagaaaggatctgcagtgattctcctatctaacatcagtgatgacctagacaccctttgaaaggactttttggattatactaggcttaacccagtataaatgatcttttgatgaagccaaagtctactaattggggacttaattactcctgaaatattactttgcctttgccatattctgttttctacaaatatttcacaacatcaacacatattcaaacaaaggacattaatacaagggcatgacttactatcattcttttgctgtcacatcccatacaacgtacaaaccatgaaaataaaaatccccctgtatgactggatttttaatcacagtggaaattatgtgtaataactgaggaaacacaaagcaaaagtatatgtggggatgacttacttattcaggaaatgcttaaaacaaatctatccatgtatcctttgatccgatgctaacctctatggctgaagcaagtgccacataccaagtggcttagatacatctttacagcattccaagatttcagaactctaaaatatgttcctgtctagaaaaaaaaaagcaaagaaaaagaaaaaagtaaagaaattctacaaaattagatgacaacaaacatatttctttatagctacagattccacatatttagttgtgtaagtaaagcttgcttttatgtgacagacgtttccatcagagatgcaatggacttgtttattcacttgagaaagggaaccctaactagaccaaagcaacagctgtgcagatgtacattcgggatcactgagggattttgtttgtttggttggttggttggatttggtgttttgttttgttttgttttgttttgttttgttttgttttgttttgtttcagtgggttggtttgtttgttttgctcattggacttattaacttgtggctgaggggttacatacaaggagatgttccttataactaaaattggttgcatcaccaaaaaagcctaccattacactgatgtggacttctgtaaacctgaaaccctggagtttttccctggagcattcaggcatcttgctatctggatatctctttctctgcagtttggctgctcagaatctgtgaccctacgcttctgtttcctcttttttataatgtggagtgggagccttcaagaatgttccagttgtattctccaggatgtgtaacctttgtttacctcctgaggtcgaagagcctcctctttccttcctagagctaatgtttcaatttggaggaaatgttgcaattcaggggaaatgttacaattcagataaaatgtcttagaaggacatacaaaaaccacaccaacagaagtaatgaaagtgtacttgaatgggtagaataagcttaacatatgtcccttgacaccaaattgtgattgatttattggcttctctatttactttgtgtggaacacagaaaattacaatgttcaaaccttggatttggaaatcttgctctctggtgtattcaggtaatgagcatgaatggggagcaaagcgacttctcagtacattccttgtagtcacagattgctgaaatttggtttgaacttttttcttctattatggtgctattgaatcagagaaccaagccaatcacacctacagagcaacatttagcactcccattttacaaaattgcttatatagatctggataagtagaatggtgaacaacatgaccttaaatataggtcctatactccaaacgcagactttctttcagtgtgtttatgagttaatgaggaagtgtgacagaagagcaatcgatacagaaaacaatagcatccaacctctttagttcttcattataataaaaggtcctgtgtttggtgcgctccctttgcattgttcattttaagctccaaatagtggatgattgtagactcaaagtatttatactgcaaagattaaaaaaatacatgatattgtttctaaaaggtattgttaaattccaatagaaagacaacttaagtaggttctctttgccccattagtgaattgatccccttactcagagtggaattttgcaagcatccttttcctacagtaattgtaatgatgtgagcatttgacctctgggaatgaaaaagcaatcgcaaaatcatttcatataggttattgcacaacagacaggatattacatttctaggcaatgttgaccatttgttcaaagctactttggaatgttctctgtctattcaatttcaccagagatttctgttatttttttttttttttctactcaggctactttgggctaaaggttaggataggtttttttttgtttgtttgtttttgttgttttgttttagattttgtctttgtttttattcttaatgactgtttagtcaccccaagttgctctattttttttttaataaaatgtgttgggcatcagttccaaaaaggaacagatattgccactccaagttgtttgcaaatctcccctgaagtgaaaacagtggtgttacttcagtctgcaaagctttatccctcagctgatagttatggtgatgtcattatgtcaatatgaagaagatgaaagttgtgatcctatagtttacattatcagctaacatgcaatttgatctacttttaattataggcaagtcatttcagagacatattaaatatataccaacctttctatctaagcatcctgttacctggtaaacagcaaaatcatattgtcataaaattatatattttgtaatctctgtatttaatgtgctggagcatatgtatcataagcttcttaatttacaccatcagtacatcaaacatattccagggccttgattgttggtttctaactttattacagttattagtagtataatgttgagaaattcatatattatctctaggcctcagtatttcagtttatttttcaaaggtttcctgacaaaacaaaaactaagatcttcatataatcatacacacacacacacacacacacacacacacacacacacacacacgagcttcagtgatcacaattgatagcatgaagaaatgttagcaacttggattagcctgatgattaaacttattatatggtaaaaacttgtagatacttctggaactggggagatgacttagtgggtaaagcacctgttgtgcaagcactaatatttgaacacagactccattgctgcttgtgtctagctccagcctttgagaggaatgaggagatggagataagaggaattcctgaagctcattggtcaacctattccaaatgcatgaacttcagtgtcagtgagactgtctttgaaaacaaaaagtggagaggaattcaagaaagacatctgactttaatctcagttcttcacacatgcatgcatataaccacttatctatacccatgtgcacccatgcacatgttatatacatgcctcacataatcaaatctctgataactccctagtataaatatgggaatttaagtattttatataaacttaaatgttctgtaagaaggtcacaatgccttataattgaaatgcatacttaaaaatagactagggtttcaaaattccaaatgtattttatataaagtactgtgtgtaattatagtttactctttaacaagaaacttacagaataaagaacagatattaatgtgttgtgttggaaatgctattatatatctctgtgtattttcaagacatattatattacatatctgaaactcaagtgccattgacactaaatcatttgagttattacttatacaagttactttttctccaatggcagaaactttggcttttaaaagcgcttggaaagtaggtcaggacaacatcctttaggcacttggaatttaggtatctaaattttttccatgaatttttccatgctacatagtaaaataaatttcgatttcctatgtagatggcatcttgtaagtaaaagagtattttagatatacatttacatttctcagtagtctcatataatgatttctttatgaatcatggatatagtgactattgcaagagccagagaatgtttaaaaactccaacttcctctatatttctgctttatatacaaaatcaattcttttttctactgtccttttccaacttctcttgctgtgtctttccatcctcataatggtaataagaactggtataatttcattaagtagagattatgcaaattaatgtagagttcttcttgtgatgacctagatagaatgagtgaaaattgttttgtcactgtaaactaatgtgttgggatagacactcagtgtcatttgtgacagctttaccaactcttgccctgtagtatggagtttgttttctagtcataatcatgattttcttttatgactagcatttggtaagaagctgaagggaagtaatatttgattgttaggagtaaggaacttcctttctagaaactttctgtactcaggaccaaagaagattaactccactttcgtgtgtttatagcagttcctacatttaatggtggagatatagtccaacttaatgagtcagtacagaaatatgtggctagggaactgtgggttggggtggggcgagtcggcccagagcaaaagtcagggaggagtaggatcattaccaccctgctccacgcctacctgacccagtagccctgcacccccacctttgcccactggaagtggtagcaatgttaaactttctctctccctttataagttcataatgctgcacctagaattccttcgtatgataatgaggcatcctcaataccctggcctggccaatgatgtaccctcatccccaaatccactcgccacccccaaaggtttaagtagccttcgtgccccaacactcccattaaataacctatttcattaaatctccctcccagaatctcttgtccccgtgctcactactgcccttctcacaatccactggttgtgattgctgctgatcatggcacaatgggctgggaagatatgtcaaagaaagaaaagaaaagaggatgtgtgtttcactaatatttacacaatgaaatattattttggaggtcattagtataccgaagacacattcgctgagaagtatcagtctttggttatagacttgctattcattcaggtacaaaatgatctctttaaaatgttaacctcctttactttaaactgcaagtttctacaaatccagaaaagagaaactaagtgtagcttatagagataatgggtcttaagaaagctctgaaatgtaaagactcataaatgaaagcacaatactgaatagacaagaagcaactgagtggagtatttttgggtacgttgaaacagcattaaaggagatagtggggctgggcagatggctcaataattattagcacttactattctcacagaaaatccaggtttagctccacgcacccacacggtggctcgcaattgtccattactccagtgccagcagatctgacatgatcttttgacttctataagtgctaaacatgcacttagtgttcagaacatgtacataggaaaaacactcatatatctaaataaaaataaatgaatttttaaaaaaattactctaataaaggagatattgagagtggttgggaaaggatgaagttttatcatttagaaggatattgccataaggcttgcctatgagacatttacacaaatggcaaatttaggcgttgtgtacacacatggctgaaattaaggaactactacttttggaacaaactgacttagaactgttctgtgaacaatcattttggttgaatttacctctttctctcaaaatcaactcattattagagaagaacagataaaataagctcattccattgttgatagataaaccagttagtaaattaccttgaaaatttggctcttcaactataagtttcagtgtggtattgataggttaagagtcatataaatattggctggtggtagtaaaatatttagacttaataggtattttcaaacagacatgccaaaataaatgcttatgcaagaatgtcacaaaataatatcatttgttttattacattattttcagtggttcagaatttgctaacttataaataaaaaaattagagaataaacaatattgggaagaaagtgacaaaaggcacattttatatgtcacatttaaatgctgggtattgagaaacaaagctcttatttggagaatggtatttctgaacagatagcttgcatttgtcaaaaaaaaaaaaaccagaaaggttaatatcagacataacattaagcagacctgaatgtcatttcaaacttacatttctcgaaagattaaagacagttttatccttaacaacactccagggatacagatatttttgcttcttcaagccaactttacaaaaagttatgctgattccttttgataattagttcctaatactttctaaatagcagttacagcaatgtaaatgatgttgtgaagactacctggttgtgacagcctttagcaaagatagctcacgagcaaatgacactgatgacagtgtgcagaggacaatgtgagacaagaaattccctttgggaaaagaaccactttttggtggcaattcttgcccaacagccatatacagctgctattgatttttcttcagcttccagtttatagctgtaacagtaacaacatccagagagactggaggcaggagtgccatttaccagtccactagcacagacctaggaaacatggagagtaacttgaattaaagcaatagccatagggattgtaaaacatggacacatggtatggacaatatgatggttcaaattttcaagtgatggtgactttggaatggtggaatataacaattaaaggtgggaaactcaagctgactctaaggaagtttcagtcatggggatcgaacgtgctggtgctgatgaatgaaagtgagcttacatgtgctagggtagctgtttaactgagtaagtccatcctttctgcatatattgcctctaatatggccataattataacttctgaggtgtttgcatttagtgtgtgtgtgtgtgtgtgtgtgtgtgtgtgtgtgtcaggggagggagggcagggaaatggttataatatatgagaatcataggtatcttcaaaacttaggctttatttcaggtgatagcaactaacgaaactgcccatacaagaaataaagagacccttagtaagtaagtaagtaagtaagtaagtaagtaaataagtaactccaagaaaagtatttaaggtactattacagggaacatagccaatgaaagagttacagcaaagataagcagactgatatagatcacgaatataagtcattcgtttaagtccttatgcaacacaaagacctgatttcaataccctgaacccacataaaaagccaaacatgatggtgatctcctgcagtccctgcaccagggaaaatgaaataggtaaatcattatggcttattagcctgccatcctatttccttggtgaattataaaccagatatcaaaaaccagaggaatgacacactcagttatctgctgctttacacatgcatgtgcttgtattcgtgcacatgcatacacacacacacacacacacacacacacttgcatgcatatacctgtgtacacatgcagttgaacacacacaaatatccacttagtacacgcgtgatagaagaaaaccatgatgatataatgctttggaatctaaaagaagagagaatcaaggtgagttatgatttagcatcatccatctgatgatgcacaaatattgaacaggagattggaaaaaaaggaacttagatttgacaccttggggaacagttttgcaaaaacagtgcatatgagataacaatgagttactgaggaagaagacctaggaaatatattctggggcacatactgttaatggtaggagccaccatgataaagcaaaaaatacacgtaaaaattgacatatgtttacgtattttaattctaactgtgcacagatgcttcatttggtggcatctccagttgatgctgtttacccaccatgatttaagtgcagcactcaaattctgtcaacaagcattagatgtttaatagcttagaaagcaaagaaacactcctgtattaatgccctgcattatcacaatagccaaattggactccacctatatctctgtcaatgcatgagtgaattaagaaaataaaatatatacatccaatatgatagtattcagtcttgaaagggaagaaatattgtcttttgtgacaacatgggtagattttaagagtattatgctaaagaaaatcaataaaacatagagagacaaaagaaactgtatattctaattcacaggaggaatgtaaaatgatcgaagttctgaagttggagaaaagaatattgtatatatgagaggggatgaaatgaatgaagccattataatcaaacatattagattagtttccagatcaattgaataggatcaggattattgctagtaaaaattgtgcacatttcaataatgctgtcatcaaatccactctctcagaggaaaagagaagggggtatggggacagggactctgggaggaggaaccaggatatggagcaggatttttgatgtaaaaaaaaaaaaactgcatagaaagcacatgaaggaagcaaggtacatcttattcaaaataaatgttagtactttaaacatgctgaatacataagatggtgaatatgttggctagttcaatcagtctagattgcattaaaatattaatacagatttttcccacaaaactaggacattcgcatgcacacacacaattataatgtgtaattgtataatcaaaatggaagcaacagagatgaagtcaagtaagttatccttactgagtcctttttttttggggggggggctttctttgagtctcacagcaccaggaagtactaggcaatcagatcctatcagtgttgaattggataaaatcccccagagattctatattttaacacactgattgcctcgggagaaaacagtgaaataaaaggtttcttgctggccaaggccagccatgcggccatgtcagagggaaagaaatggacattcaacttccttagtatcatcaaattctaacccatggctagtagtaaaataccccccccccccgccccccgtttcttcattatctacgttcagagaaagctttaaagaaagtatgagtttcttctatgtcaggaaatggccttaacaccgttcttaaacacacacacacacacacacacacacacacacacacacacacacacacacaagcacataaccttaaagtatattctgaaatcaataattttatgccttggaatgaggatgtaaatttagcctgttttcattaaaattttgtaattccactgacaaaaaaattgctgacattattttctctaattggtttatcatttcgatttaagcacatgcattctgtctatttaactagacgattatgattataagtacttgtaaacttacatttatagtgcttaaatgctaatgatatttgtcttttgtctgtattatattaaaatttctttaatctcaacttctgtaagaaaatacactttctgggagacttgctaaacaatgacaaagaggtaagagacagagatgaggaaaccacatgcttcattccctgaagtttaaatactgtagaaataattattttccaatagtttgatggtaaagtttattgttacataggattgatgagcacaacatatgacttaaaagggactttttaacctttaaatgaatatttagtcatttcaagtcattttggactaagatctaatataataaattgcattttattaccttgaatatgattgactacaagttggaaaaaacaacactgaaacaataaaaacatttattatcttacatgctatcatattggcacattctaaggcggtgttaatcatttttatgcctcaagtcatttatttcctgttattccagccaaagtgttcagaatatgttgtcactcatattatctacattgatagaaatgcttctggcatgacatgttcataaaacaatgtaaaaagatgcataaagcatgttttttctgactcttcaatactaaggtatatatctatatttataaattcctttatttaaagaaaccttttcacatttcactggctaaagattaggtcaaatgaatcttccttagccaatctctgggcagataataataataataataataataataataataaaaacggtagtagtaatagaaaagaaaagaaaagaaaagaaaagaaaagaaaagaaaagaaaagaaaagaaaagaaaagaaaatgtagattctatattcctttacacttctggtgtattaatactagcacttccattggaaacagtgctgtgactgagcatagaatcttttcatacaatttcattgtgatacaattgcacataataaaatttgacttttgtaatttagtaatttactagcactggtctacttataactttgtgtatccattaccacaacaattttaaattatttcatggttgccacaatagtctacacctgttagacaatcacatcccacacctgattctcactgccactgacaaatactaatatacattttgtttgtgtgtagttttctttgttggatactttatatgaaggtgaccgtataatatttggctttgatgacaggtttcttcacctcagcagaaacaggttttatttatttatttatttatttatttattcttacccgcgttcacgaccggccaggaagaacgcagcaaaccggaatcttctgcggcaaagctttattgcttacattttcaggagccagagagcaagagagcaagagagcaagagagagaaaaggaacaagaacaagaaagcaagagcaagagagagaaaaagcaagaacaagagagagagaacaagagcaagaagaagaacaagaaagcaagagagagaaaaagcaagaacaagagagagaaaaagaacaagaaagcaagagagagaaaacaagaacaagaaagcaagagaggagagagaaaaagcaagaacaagagagagagcaagaatggcaaaaccccgtcccttttaaggagaattatcctccgcctaggacgtattactccctgattggctgcagcccattggcccagttgtcatcatgagaaaggcagaacacatggcgggaaaactgcccctgcacgtgtgcagattatgtttaccacttagatcacagctgtcagcgccatcttataatggcaaatgtgagggcggctcccaacatctcccccttttcttttaataagagcaataggccacccatattaatgagagtggagatagaggtcaaatccccagtgtgcaggtaaaggagccatgtacaggattagctcttaggctcacaggcttttacccagagcaaccctgacctgctcccgtgtcgtttttcctggggagaaggacacttggacactcaaccttcttgaaaaatgacatgtctccctagaataggctcatatatgccgcagagcccttctactgcagtgcttagccgtgcaactctctcgggctgctgaagcacactcactctatcccgtgcaatgagactagcctcgtggggtgcaagagctgaatggccagcgacctattgcttaagcatagataaccatatatcaggggaagcaccatgttctagagctgcaagtgcctgggcaataaccaccttgtctctcctagtttgggccttaagcttacagaccaaccaaagaagcaacactaatccacagcaaagtgtatctccaaataatcccacccatacccattctttaaagaaggaaaatgctgaggagatccaattgggtaatcctttgatcagggacaggtccaagcgcgtggagttgacctgaatgatggcaattctcaattcccgaagggtctgttcaaattcagccgtccaattctgtaacatatactgagaaagactttttgacaaattagctgccctagtaaatttctcatactgaatggaagtaacgcacaatcccggaaacttttattcacattccagctgagttatttgccataatacatctagttgtttctggacaagatatatgcgttgattaatttctgcccatggagcatttttgggattggaggatggcggccgctaagcctgcattggtgagaggtcccccaagctcccgacaaaccctgagccagtcttgtaaacctttgttctttcttggggctatggccgctctgcattcctgcgtggcttgctcataaataagctattctaccagaggtgcggcttgctccaaatctgcaaaaatacgctctgctgcctctgtcattctggccacaaaatctgagaaggactcctgaggtccctggacgatctttgttagttgtccagtggcttcacctgctcgggagagcgccttccaggccctaatagccttttcatctgattcagaactattaagaactggctccttgagctcatctagtgatgagtataggctttttctcctagaaacctccgctgattgatcttttttcttttcttttttcttttccttccttccaatctctccccaggtattcttacctgacctaaacttttcctcaggttcaagacccgtggaaaggcctgtatacttattttgtgtaccatatttcctctttgctccaactctctttccctgctttacttctgatagattgccctgaatttcatccagaattttcagccctgccttaaccacttgataacatgtgaaaaggaacaaaaaggctcctaacactagagaaagttcaaggccaaacataccttgtaaagctatttcccactttacttctgatagactgtcttgaatttcgttagaaagttcaagaccagacttaccttgtaaagctatttcccactttacttctgatagactgtcttgaatttcgttagaaagttcaagaccagacttaccttgtaaagctatacttacgggtaccctgttccccagctgaagagttctgaattcacgcagttgaatccttctcaacagtctgttttacgggaacactttattaccaccattccccagctgaagagttctgaattcacgcagttgaatccttctcaacagtctgtgttgtgggaacactttattaccaccgttccccagctgaagagttctgaatccaggctggatccttctcaacagtctgttttacgggaacctttatgaccgtgacccgcagttctggttccggaatgagggatcttccttgcgccagtgatggttaactcccgtcccgagttttcttgtcccaggatttctcgtcccgggttttctcgtcccaggtcttctcgtcccgggtctcagcaccaactcttacccgcgttcacgaccggccaggaagaacgcagcaaaccggaatcttctgcggcaaagctttattgcttacattttcaggagccagagagcaagagagcaagagagcaagagagagaaaaggaacaagaacaagaaagcaagagcaagagagagaaaaagcaagaacaagagagagagaacaagagcaagaagaagaacaagaaagcaagagagagaaaaagcaagaacaagagagagaaaaagaacaagaaagcaagagagagaaaacaagaacaagaaagcaagagaggagagagaaaaagcaagaacaagagagagagcaagaatggcaaaaccccgtcccttttaaggagaattatcctccgcctaggacgtattactccctgattggctgcagcccattggcccagttgtcatcatgagaaaggcagaacacatggcgggaaaactgcccctgcacgtgtgcagattatgtttatcacttagaacacagctgtcagcgccatcttataatggcaaatgtgagggcggctcccaacaatttatttatttatttatttatttatttgtttgtttgtttgtttgttttttctgtcactgttgcaaacactactatttcattattttcttatgtttgaatgatattttgttttatggatgagacacattttaaaatatgtgtatcaattaatgagcaagagaattgtacccacactttgactgtcataaaaatgctagtataaacaattgtgtactgtatatttataaaatttgttttcaattatttttttggtgatatagatacttagaagtggaactccttcattattggacaactctatgattaggattttgaggcactgccaaaggcatatccagagcgtgtggatcattttccatccctataggcaatttaggtgtatcttattgcaatttcttcacatcttctaaaaaggttgttattgacttttttattatgatagtcaaattgggtatcaactactattttattattgtttcacagtctttcttgaagtgtgtgcatgcacaagtagaaaccaaatgaatcttccaaaactatgagatgatattgacaagaaagtactgggggtggctgtcaaagactaatatcacagtctgattacaaacatatacagaaagcatccttatttaaataaatttaacaacactatttcttgtattgcaacttaactgtttacctatttttaagttctcagagtttctcacttgttcactggagaaataggaatattgtgaataaatatttctagatataatcatttttaatacttaagtatgtttttaaaagtatgttattatagttatcattgtatgtatgttcacattcatataaagaaatctattaacctttaatatacaaaatggatgatataatatctgacccacatctcattagttctcagaaaactacatttttaaatctcattttatcagaagcctatgagttagtttttaattgttttcatttcatgtgtgctttgtccattgaggcacgatgatgcaatggatcccctaggactggaattacagaccattatcaactgtcatgtgagtgagagaaatttaataataaccctctgaaagtatagcaaataccagccccaggcatgagagctggttttgataaggaatcacaaaggaaaaaaaacatattttaattacaaaggacatacaccagaggtaaagccaaagccaaagttaaatttagtgtgaaatctggtagcaagatttcattgcttctttatgataaacatttggactcctatagaattttgtggatctctttgaccaattacactatactatactcatactttcttctgaacaactcaattgcctgattgttttaaaaattggcagtctcaaaatcatattatttatggaatcgtagagtgtttctttcaccatggccctaagcaatttcaacctatgaaagctcactctaatcctccttatgaatacaagcatgctgtatttatttacgattagacactgctatttctttatctaactgtttacatctccttcattttaaacacaatgtgagagttttaggctttctgaaatgctagagttgtaagtatcctcaattttgtcaatggaaggaaatgtagaactcatttaccccctcattttctaagtatacaaattgaattccagcatattccttccacttgccctgacacacatctatcacagacattggttagtacacatgtcagcaaatgtataaagtttcttggctgcctgacaccggtgaaaccatcagcatagatgaatcaagtagaaatactgcataaacttttgccatctcttggtaacctgttaaatcataataactggagatgaaatccaagaaatggcatactgccaactctgtagtctagttaaactatgaatgtggtattcagaacctgtaagctagctgaacatccaataacactgttttgagaagcctaggtattaatatttttggctacaaccctaaatccactaggtacaaacatttaaacaactatgacccatcattcctgttctaaagggctgttccttcatttctctttataaactgactgacttgatttttagttttctttcatttctatttattgcaactttgtttcattttaacacttagttacaaacaagggacattttaaatgtttcatactacctgaaggtgctgtgcacacttagggagaagaaaactcatcatccatcttacttatttgtgaactctgaaaactgtaattattagctagatatgatatgtccacggggacaatagtggcacaaatgttgtactagtaaccaaccagtttctgattccatttaaggccacatccataagatgaaacttatatctagcaccactatctgtgccaagagcctgtgtctgtacaggtcataggccctagggaagaacgtactactactactattattctaaacagggagaattaagttaatttctattaattgtcattacatcatagagtaatacatctcttaagcctcatctgagatgcttctgttcacaatagatgacaacacagacccctaaaactgcccaaggtgctgagaagaagatacactggaatgctcatccctatgtgggacaccaatatcacacttcccaaggcacagcattaagttttattccctgggattgaacttgcactttaataatacattctaaacatgataacaagtatgtctcatttatagttcagtcatctggaaataaaaaaaaaaaaatagctagttcctaccaaataggcaagtagggagaccagccattgtggaaaattattcccaggagaaacatatattatcaggtttcattaattgttttttttacataaagtacacacacacacacacacacacacacacacatccctcaaaatacctataactgtaacaaaagcatactatccgttgatagataaaaaagcaggtgtaatggataagcatgaacattgtctgaacttaaggttctcttgtgatcttttggtttcttcttacattacatagacatagaaagtcacatacctcatggtgttattcaaatgtagtactatagaaaaattgatctcacaacagctgagaaaagttggtagttactagaagacagagaatggtgagaagatgatttctgtattaagtcataattagtggatgtagggctgatgttctattgaatagtcgggagactatagatagctgtaatatactttatattttaaaaactatacaaaaagaattttcaaaagcttcacaaaacaatgaagaaatgtggagatatatatgcttacacttatttaaacaaaacagtatgtatatgtttcagaatatcacatataccacataaatttatgtataaattttattgtcatgtattacttaaaatatttactttaaataaagtaaaattataattttgagcaaattatgtcagataggtctgctttttttgcttttcacaatgttatgaagaggtagaaggcaaaaatatattacacatcaaaaacctttgtagaatttacaagaaaatttccaagcctgttggcacaatgttgtctctcagttaaacttcttttattttgttcttctacttccttttcattaattaattagtttattcattttacatcctgacaactgtagcctcttctcctcctcacagttctagcctcacaacctccctctcttcattatcccctccccttcacctcagagtaggggatcctcccatctggtaccaacccaccctggcacatcaagtcccagcaagcctaatcacacccctcccactgaggccagacaaagcagcctggctactggaaagggtcccaaaggcatacaatagaataagagacagccaccaccactccattttagggactcaggaagaccaagctgcacatctgctacaaatgagtaggaggcctagatccaggccatctgtgcactttggttggtggttcaatctctaggcacccatagacccaggtgagttgactctgtaggtgtccttcctggggtgtcctcgactcctccacctccctcagtccttaccccaactcttccacaagacagcccaaggtctgcctaatgtttggctgtgggtctctttatctatttctgtcacctgctggatgaagtgtctcagaagacagttatgctaggcttctgtctgcaagcaaagcagagtcaaggattagttatctcccatgggatgggtctaaacttggggtagttctatctttattcctgcacatcttataggcaggaaatatttttggttgaaggttttgtgggtggattgatgtctcctttcctccttggaaagtcctatctggttacaggaggtggctacttcagtctctatataggaaactcccctagccccacccaccatagattcctgggaacctctctgtccaaagacttcagtttgtccctgagatgcctcccagtcctcttctcccccccccaatactgtttccacacctgaccccaacccccaaccccagtttcccgccccaccctgtttcctaccagtttcctccttccacccaccccgatatctgttttatttccccttttgagtgagattgaaacatccttccttggaccctccttgatacctagcttcttggggtgtgtggtttgtagcatggttatcctgtactttatttatggtaatatccacttatatgtgaatacataccatgcctgcctttctgggtctgaattacctcactcaagatgatattttctaatttcatccgtgtgcctgcaaattgcatgatgtctttgatttaatggtgtttagcttacaatcctgagatccagtacactcttaattgggcctcaaaaacttttccgaacagaaaactatcctactagtttctatcacttaccctttgtcatgacttcaatgacttcagagtcttatgttaaaccccaaggttatgactccaacttaaatatgtaaatttaagggttttaatgccagtgccctttctttttagtgtagattggctccacacagtggtgtagctggaatttaataatttgataattactgtggcctattgtaaatctagttgggtagggaatcaggtaacacttcactaattgattatatttccctctttattaattacatgtttgcagctgagttgagttatggatcaagcagtaaaaacactgagatgctttttgaaaatgctgttatattttatcagtgtcttttaaaacctaatgtttagagatgacgtgagggttgaaatgcagctttagctgaagcaagaaatactccttgataatagttgacacaacatgcatgtagtgaaaatgacaatcaagtgttctattaagtgcagaaacagatgtcctgtataaaagatgtcagtgtcactgctagggaacgtgtgtgtgcattattcatctctgctcaggcacaacattccaaacctttccacggattcctactgaattactgtctccgagtttgtgctttacatttaacactcaatttgacttttcacagaagcaggatagcaaagtagcatagaaactaagggtcaaagcatagcttaatcagaaaatcctagctttgtgcagttgggtctaagagggctgcagtctgttctttgtgaatgtgaaagctctgtcgatgttggatggggttagttttactcatgcaaactgggcattaatacagcacaagttttgctgattattacactttctcaaattacccatccaaaaaatatcaaggtaggaaaaacatgacaaaaatcaactttggttgtattagtcttacctaaggaatttcagtacttaggggttttgttgtttgattggcttctttttactcaagggcattaattcggttcccatgtatatgagcaaaagacttttctgtaagagctgaactagtatagaaagatttttaattaatacagtaagtgattctggaaattgctttccaatagaatcacctcatccccgccccctctaccagtcatctacaccaagggcattgtaatggtacaggatcaaggaactaaaggggccttctttcacttcctcttgttcaaagagaacacttggtggcagtcctctttaagaaccagctcttcttgattaagctctttcttgggggaaaaacaaaagacttccctggtggttctcaagagctcctaacaaattcctttctccttgaaacagcaaggagctatcactaagacaattgctccagtgcagaaacaagagccaggggatagtagatattttttttttcccctggaggcacaacttgcttagggaggagctttatctttgggctttaaagacactactcctttgcactacccttcatttaattgtttgttttccattccttttctctctgctgtttagccactgtctcagacagtctgatttggattaagcttgtcatgctgcccttgtgactgaataatatatatatttttaaatgctgagggtattttgcaatgccttctctttacaacaaaaccatttgtgtaaactattcaggccaatctgtttttgggtcttttggttttgtatgtttagggtagttgcttttcccttatgtgtttttcttatgggaaagtattatttacttctctccccgttgtaattaaatattagataagaaccaacatgtaggaagaaggaataattccaatgcacagtttcatggcaaataaattatggtggctgggatctgacctgagtttgggtatttgagactcttcagaccttgacagcagaaatgcgagtgggggacataatacacaatgggttagagggagggaaggagggagggagggagggagagagagaaagaaggagagagtgagagagaaagcaactttgaacaaagagattgccttgccctttaattaatatactcttcttccatgggacatgagtggcattgcatatgtgtgacttttcccttttaatttcaccagtagtggtcatctctttccttttaaacctataggcactctaacctgttcctctgaccattcacacgttgcaatcctcacatcctctcaaagagtagataaatacatacagtgattttattgtaatgtgttccaggaaaacccctcaaaataaaactaaagtcaacttataggcaaaaccatcttttaatattttaaaagtgcttaacagaagctctaagatgcttgggcatgacatccaagatgacattctttatagttattgtcagttcagattgctctaagattttagtagattcacttagggcagagttcttccacctcagcaatattgtcatttggggcaagatacgttttgctgtggaggggctgcacttcgcattatagaacattaaccaccatctctggcctgaaactactgcgtggtagtcatgtcccttttctgaacttgtgatagtcaaaactttttccagtgctgccaaaaaaaaaaaaaaaaaaaaatgaagatgagaggcccaaactgatctccactttgacatattgactttgaattcctgtgatttggtttctaactaaaaagatccaattgcatctcaatataaattatacaagcaatttttcaatacttctagatattctatttgtactattctcgtgatccttaatatcattcatatacaaggattttttaaattagttaattaacttattcattcactttacatcccactcactgcaactcctcccagccccccataccctttgtaccccctccccttctcctctgagagaatggaaattccccctggatattcccttaccctggcacatcaagtccttgcagacctagacactagccaagttaagggaatggattccacagaccatcaacagctttaggggtagtccccactccagttatttaggacccacatgaagaccaagctgcatatctcttacatatgagggggaggcataggtccagcctgtgtttgttctttgcttggtggttcagtctctgagagccccgaaaggattcaggttagttggctctgttggtcttcctgtggagttcctaacctcttcaggcccttgatccttctcccaactcttccatgagtcccaaagctccatccactgtttgtgtgtgggtctctgcatctatctaagtcagctgctgggtggagtctctgagaggacagacatggtgggcttctgttttatactgaattctttaaaaaaaatacctgaattcttaaaaagaatgtcacctattttccatgattatgaactaagtagtcaggaatctataacatccttaaccaaccaaactcctttcattcctattatctcttacaagatagtaacttcctgaatatcatcaatgctttctcagtactttcttatgtatatgtttctactattatgctaaacagcaattttaaagcagggctgctgaactattttgtctacattcactgctttgtaactttaatagaaagactgaaaaaagccatttattttaatattttgggtatttttcttaaaatttttaatctagccctgctgttaaatatatgatgtttatgtgtttgtttatttatttatttatttatttatttattcagtctactctttcagcatagcttctgcagtgaacttgagatgaagcacacactttaaaacttatagatccactgaaatgttgattcccttagcctttccagcaatagtacacagatgcattttatatttaaatatattttgatttctttttataaacatcattgtaccattttagcagtaaatattgagcatgaactaggtacattttctgctgagaagtgctaaaaacctttaactagaaaacagtagtaattgtcaaacattgaaccacgagcttaatgaagcaatttctcttaggaaaactttcatcacacagacattttatccttgttcaaatttggccagaagctatgtatggctaaaatctcttatgatgccatatggagcttttttttcactattttatgaataaaatgggtgtgttttagtgtgctactagcttcaaacttagtttatctcatctacatatatatttgaagtcaaagcttaagtttcatttcaggtcaggggctcattaggcaaggtacttttctttgggaaaagtgaccattggtaagttgttcatgactctatacatatgctcacatgggagcactaactgaactcagtgggttatttaaaaagaaaaagatggaggccatgaagttgctagagatgtggaagataatttaccagggagagatgaagtgatagaagtcaggaggatggatattcaaggtgtattgtaaacatttataaaattaaaaattagaacaaaacatataaatagtgtgtgatcacttgctttaaggaagtaaatgagagttctctccaataagatgctaacatcctgtcatcttgtcagtctgtgcctactacccaaggccagttgtcttacaagagactacgtgaaattagcataagcttgtcaaagatcatacagtggtgtgacacatttagagttatgttagccaccagattttcttcttaactatttttgccacaatatgctgctctcagtgagttttagctaagagttcattgttatcatctatataatagctatttaagacaataactcatactaatatcattcattcttacttctgaacaacatagtcggcatgtattaagtatgaaattaccctttacagctaaccaccattttaaatattccactagccttccttgctttcctcattccctttcttctttccatccttttgtcctttcttgaattatttgtttgatcctcatgtacaattttgcccttcagtcttgattagattttgaaatccctgtgtaggtactacaaacacagatttcttgctaacacaatggtctaattaaaataaaaataatgttggatgtgttggaccatcagatagaggttgtaatttaactgtatttacctcttgtatacttgcatctcaattaacagtaattgagcaagtggaaaatgaagaacaggactagtgaggtagttcatgttgagaggaggtcatgagcctgaggagaaaacttattctgctaaaggaacatttgcaatagaatgactcctaaggatacatactgctagtcctatagatcaaagcatcactcagctctcaccagtgagtctactttatccagtagataggaattaaaagagacctacaactggttgatgtgcagagagtgaacacttttggaacactcaagcaggcctaagtaggacggatgtctttatcagactccttacctcaaggtacagggatctatgcagaagagccagaggtgataaactccagtgacataatcttgtcctagcacaatagggtggtgcatacatgagctcatagagactgtgtcagcaggtacaaatcctagacaagttcaaaacatacaaaattccatcactgagaagggcaagtgagtacaaagtcccatcataaccaagaagcaatttataattaatacccgtggggaaagggaaatttagttttctacaatggagtgccactggctatattacacacagttcgggtagcccacatgcttaggagtacttggccaacacaaaactgactccgtgtgtgtgtgtgtgtgtgtgtgtgtgtgtgtgtgtgatacttttcatgttgttttggtttggttttgtataattttgtcttgatttgttgtgtttgttgtatttgttttgattttcattctgagacactgatagaaaacaatgtgaagttgggtgggtaaggacgtagggagactataaaaggagtagacagttaggagagtataataaaaagcatattatataaaaataagaaaaagaaagaaaattactatagaatatcaggcattttggaccttgcaacttgcatcaggacaaacatcagagttagagacatagacttaggggtaattattatagattaaataatggaaaatatggacccaagtaaaataacaggattagagtatatattctgaaagcagaacagaaacatggcatatatcaaggggaaagacatactttatagaattggcagaaaatcagaagcaggcaagaagtagtaattgtactagggaaagatcaaaatataatggtagtgagggagtaaaagaataactagaaatggaaataaagagacaagaaataaattaaaggagaaagtaatatgggtagaagaattaaacaatttaggaataataagaaagattaggtaaagtgtgtgccttagatggaagagcaaacatggtggtggcacatctatagtgtcagtactccacaggtgaagttaagagaatcagaaggtcaaaatctcatatgtattctgctatagagtaaggacaatgccagcctgggttctacgagatacccagggtcaataaagaaccgcatggtagtggtggggggagtggaggagaaggaggaagaggaagaggaaggaaaaaaagatattgaatgatgaaagaggaaggggaagaagtagaagagagactgatataaatgagtcaaaagagaagaaaagggagtgagtgagggagagatggaaggaggaaggtagggagagaaggagggagggtggaaggaaaggagagaaggagggaggagggagagagagagagagaaagagagatttctatctttatattttctcatcttctataagtttttacagctgcactcacagtcacatgcttcacaggagtttaaagattcttttcatgtgttactcaacattacattttagttttaaaaattagttgagccataaaagattttctatttaaatccacaggactctaatctcataattagactctaaaatatacttcttcactcccaatgaatctgaaatcccatcttaacgggatcatcaattgtatccctacttctgagttcattgtccacttcttcctgacttcccttctgttccttcctgatccttaccagtagacctgggtctgcttttccccttgggatatctaggcaccctagtatatgggactggactggaaacaatggagcttagccaggttggtgtatgagacaggatgtcttttgtcctcagtgagggtgaaatagccttctccggaaataatttttcatgaaacaactttttattagagggaaaaggggctatataaaccttggagagcggagagggttttgggggtgagtatatattgttggctggagttgaggtgctgaggtcctggaaatacttcatttgcatgtagagaaattccaggtggtaactggatcttataaagagagggagtttaacttgaaatctgcccaacagactgtgtgactacctcaagagtggtggaggtgggagtcttaaggtttatgtgtgccaatttatgcaggcccttttcaaagtcctactcctgctgctcccaggatgagaatttgggggtttggacatgtcttgacctcactctttccctggttatggggctttctgaccttgaactcagaagtgctcatgagttccttatgtactttactatatatatttgacctatcaattctgcttactttttccccacaatttgtttcttctattaagaagcagctggaaaaaaaggaaaatcatttctcctggctgttgactcccaacgcacatgcattatatatcacacatttggatctcaaactcctatcactgaaatgtattttaatataaactgggagtataatacacattttattcatttgatttatttaatacactacaaatagagaaaatgtggacaagtctgtgttaagtaaaaagtgaaagactggacctgtgaaacattcctctcgtttatttggtgctattgtaagatccattataagtaggcacagaattgaaggtgatttagtaatatgcaagtaatggttagtattcaaacacagtcagctgggtatggtgtgtcacaccaataatgtgaaatgtttggtgagacataataagaaaaatgatgtttattcacccccaggtatggtagtaatgacagaacaaaagaatgactctactcagcttgtgaaagtctagttattttttttttttgtcaacttgacacaagctagaattatctgagaagagggaaccatattgaaaaaaaaaatgcctccatgagactgacctgtaggaaactatgggggaaaaatttatattgattgatgtgtgaggactctgctccccattgatggtgccacccctagggaggtggtcttgggacatctataacagcaggctgaggaagccatgtgaaccaagtcagtaagctgagttcctccatgatctctgcttcagttcctgccttgagttcctccccgataaagtgtgacctgagagtcgtttcatgaaataaatactttcatccccaagctggttttgctaatggggttttatcacagcaatagaaaccctaagttagtaaagcaataagtgagtttactgggtttactttacaggaatatgggtgactgaaaaacatatccaactttgaggcttcttgattcattaaagttgtatttctgtagctccttgcacagactgcaggtgataccaaggagataccctcttcccatgatttgtttactacatatataataacaagaagatgggacttagaagttttgaaactttctgagcatctcagtctcttaaagttttcttactccttgagatttattatcctccttccatcctccagaaaggattaagttcaaagaaaagaactacaaaagatcccaacactttgaaaggtgatacaggaagactggccctagttcaatgacagccatgattacatagtgaaatccagaccagcctggactagaaagtttcagaacaaacacaacaatatgtaacggtggtcaactgtgacctgtttgtgtatattataattattggggaacaaaacaaagccatgagcaagggacagctgacttgataaccataagttatttaacattttaatgtcttaatgatatgtcatcatgacatctaatgtaaattagatccatgttacttaagacatatttttctttgtttttattaagtatatatatattcatatgcacattttatttatttttatatttaaacaactttttattagatatttttttcatttacaattcaaatgctatcccaaatgtcccttatgtcttcccctcgccctgctccccaacccacccactcccacttcttggccctggcattcccctgtattggggcatagaatctttgcaagaccaagggcctctcctccctttgaaataaaatctcatcatttcatccctccaaaccctattcttcctttcaaatcttcccatgtttccctctcaaattgaaggcctttttttattattgttttatatacacaaatacatgcacaaaatatttatgcatgcaatatatatatgcatacatgcacaaatatataaatacaatccactaagtctaattttgttgttttgtgtgtaagaccaagcactttttattggataaacaatatgagggcccatctttgagaggggctaattctatctctctgctctccttagtttcacgttctttgtcaaggggcagaattgatgaaatttttctccctccacattttcatgtttggtaatattgtcattgttcaggtcttcttaagcagcatttctagaagacagtctcatagctagctagcatcctggtcttccagaacttatggactttctgcctcctcttctgtgatataagctttaggtgtagaagtgatattgaagatatattagttgtggctgaactcataatgttttgctaaacactgcattgtgtatagttgtatttttccgtagttgtctttatttttctgtaaaaaaaagaagtgtctttgatgagggatggctgctacacttctctgtagatataagaataacttttagatgtagttaaaattatgctggtcaagtaaagtggcagtagtaagttctctacgatccatgaactcattggcctgaggtaattgactttctaataccagacatgatttccctttagttggcctttagtccaactaaatatctattggtttcgatgaaataatatcactattgaacttttaaggatatcttgccatgctgaatcttgttccagttcattggcatcatatcttggtcaaaatatatatatatatatcttccctctcttggtagcttgtgttaggccatgcccattgtgatattattggagtaagactaagcaaaagatgggtttcctgtaacccatcttttgcttagtcttactctaataatggctaagatcaaaaattcaagtgacagcagatgctggcgaggatgtggagaaagaggaacactcctccattgttggtgggattgcaagcttgtacaaccatcctgtaaatcagtctggtggtgccttagtcagggtttctattcctgcactaacatcatgaccaagaagcaagttggggaagaaagggtttatttggcttacatttccacactgctgttcatcatcaaggaagtcaggactggaactcaagcaggtcagaaagcaggagctgatgcagaggccttgctgttcatcatcaaggaagtcaggactggaactcaagcaggtcaggaagcaggagctgatgcagaggccttggagggatgttctttactggcttgcttcccctggcttgctcagcctgctctcttatagaaccaagactaccaaaccagagatggtcccacccacaaggggcctttcccccttgatcactaattgagaaaatgccttacagttggatctcatggaggcatttcctcaactgaagctcctttttctgtgataactccagctgtgtcaagttgacacaaaactagccagtacaattgaccccttgtcaacatgacatacaaacacatcactagtaagcctcaacccttagtttcttattcatccccaagatctaaacaactttaaaagtcccacagtctttacatattaaaagtcaatccctttaaaatgtccaatatcttttaaagtctaaagcctttttacaattaaaagtctcttaactgtgggatccactaaaatatttccttccttcaagagggaaaatatcagggcaaagtcacaatcaaaagcaaaaatcaatctccaaccatccaatgtctgggatccaactcacgatcttctgggctcctcgaagggcttgggccacttctcctgctatgccctttgtagcacacatgtcatcctctaggctccagatgcctgtactccactgctgctgctcttggtggtcatctcatagtactggtatctccaaaacactgcatgaccccttcggtcctaggctgtcaattgcaactgaggcttcaccttcaccaatggccttccatggcctctcacagtaccgagcctcagctgctctgtgtgaccccttcatgccttcaaaaccagtaccacctgggtgacccttacacattaccaagtcccactgcagcagaagtacaacctttgctatctctggaacacagcctctttgtgctttcagaaaacacttcccagaagatgtcacctcaacaatgctggtctcttcttaatcaccgctaatttcttagctccagctaaccagcttcaatggtcccagtattgcaaagattttgctttagtagttctggtatcttgttaatcacagctgattcttcagccccagctaaccagaaccacagaataatcaaactccaaaatagcaatggccctgaaaaaagtctttaattttccctctgaaatttcacaagccaggccttcatcttttgcactgttctcaacattatcttccaagctcctacacaacatctgacagagctcttaacactgagtggatcttctagcccaaagttccaaagtccttccacagtcctccccaaaacatggtcaggttgtcacagaaatacctcacttctggtaccaatttgccttagtcagggtttctattcctgcactaacatcatgaccaagaagcaaattggggaggaaagggtttatttggcttgcatttccatactgctgttcatcatcaaggaagtcaggactggaactcaagcaggtcagaaagcaggaactgatgcagaggtcttggagggatgttctttactggcttgcttcccctggcttgctcagcctgctctcttacagaaccaagactaccagcccaaagatagtcccacccacaaggggcctttcccccttgatcactaattgagaaaatgccttacagttggatctcatggaggcatttcctcaactgaagctcctttttctgtgataactccagctgtgtcaagttgacacaaaactagccagtacaggcagttcctcagaaaattggacatagtactaccagaggatccctcaatacctctcctgggcatatatccagaagatgttccaactggtaagaaggacacatgctccactatgttcatagcagccttatttataatagccagaagatggaaagaacccagatgcctctcaacagagaaatggatacagaaaatgtggtacatttacacaatggagtactactcagctattaaaaagaaagaatttatgaaattcctaggcaaatggatggacctggagggcatcatcctgagtgagttaacacaatcacaaaagaactcacatgatatgtactcactgatatgtgtatattagcccagaaacttaaaatacccaagatataagatacaatttgctaaacacatgaaactcaagaagaatgaaaatcaaagtgtggacactttgccccttcttagaattgggaacaaaacacccatgaaaggagttacagagacaaagtttggagctgagatgaaaggatggaccatctagagactgccatacctggggatccatcccataattagcctccaaacactgacaccattgcatacactagcaagattttgctgaaaggaccctgatatagctgtctcttgtgagattatgctggggcctagcaaacacagaagtggatgctcacagtcagctattggatggatcacagggcccccaatggaggagctagagaaagtaaccaagtagctaaagggatctgcaaccctataggtggatcaacattatgaactaaccagtaccccccttgagatcgtctctagctgcatatgtagcagaagatagcctagtaggcctcagtggaaagagaggcttattggtcttgcaaactttatatgcctcagtacaggggaacaccagggccaagaagcaggagtgggtgggtaggggagtggggggagggacgggggacttttgggatagcattggaaatgtaaatgaagaaaatacctaattaaaattaaaaagactaagcaaaagaggctttcaggtccataataataataaaattaagaataaaattaaaataataataaaaattaataatagcttgaatcttatgcctaaaatatgtgatacatggaggcttcagcaataaagacataccctcaaccaagggcaacagcagtaacctataatatttaggagtcacatagtctgtcctcaccaacaacttggaaggcagtgtctgatgcttggtgctgaggtgtttgttaagtaatcaggtgctattgtgactagcactttctcaagtcattttaggtaaagctaaaacaatactattcacttatgctttgttaaataacgtaggtgtacttctcagtctgtattgaccttccttcttcctccccagttatattccctctcccattttctcctcaatattgcccatatcctgctatctccctccagagcctcccattcattgccctttatacttgcatggtttctcttgttactccctgttctacaattacatctgaaaatttaggtttatgaaccacagatgaaagagaacatgagactttttttttctctgcatttggattgtctcactcagtatgactctttctagttccacccatttacctgtagattatttttctttacagatatatagtattggttgggtatatgtatcacattttcattatgtattcatctattaaaggacatttagagtgttcccatttactagcttttttgactaggtcagctataaacatgggtcagcaagtatctggggagtatgatgttgaattctttgggcatgggccaagtagtagaatagataaactatatggtagatttatttatttttctctttttgaaagttctccctactgatttctatagtggctgcatcagcttgcagtcccacccacagtaaatgagggcttccttttcctcacatccatttcagcatttgttgttagatgttttgttatacattgccatttttgcctagggtataaagaaatcacaaagttactttgatgtgcatttttctaattgctaggaacaatgagcatcttttgcgatggtgtttcttagtcattttcttttcttttcaaggtcttgggcccatttttaatagggatgctaattttattgacattttgggttttagtgctttatgcattataagtattaaccctttgttagatatacagctgccgagattctttcctactctgtgggtttgacttgtcaattgttcttaattcctgggcaatcaaagcaatcctagtcaggaagaccttttctacctttatcttgtggggtagtactcatgttttcttatagcagttttaacctttgagctttcaaattgaagtattttttctacttggagttaagttttgtacaggaagagagttatatgtttaatgtcattcttctgcatgtggatagtcacttttctcagcaccatgtgttttagttatatttctttattgaataagaaatatactgccaaaatatagcaaactgatggatatacttgagatagcatgttgacttattgacaagagtcttctattacatcatttcaaccaatacacatgacacaagagacttatttctcattgtgtgactttttttttgggggggggactcatgaaaaagcatccattgtcttcagatggggcatttaagcagaccaaagaaacagccctattcaagtctagattgactttacttcttttttttgatggaattatattttaattttaaaagaatttttaagtacagtcatatacgtcaaatctaggaatacattatattttgctataacattgtgcacatgttcttttatcttttaaaacaacagaaaaaagaaaaaaaaagaaaaaaaaagaaaaaaaagaaaaaaaagtagatatgctcaagtacaaagcacaaggcaaattataatccctcagataaacacaattacagctagaaaaaaatattaaataatggacaaataccttaagctacattagaactttctcttcatagtaaaagaacttttgaaatttcaattaaaatataaaaatgtaatatctctttatagtatttttaaatacatttaaaattagtgcacattaatcttcaagtattttcatattagaaggcaagaagactgtataaatctatgattatcatttacattaaaagaacttagcaaatggtttaaaagttaaaacgcactaggattgcacaccaaagcaatacattccttattggtgtgtttgacagccaataaacattcatggtgtgtatattttgtattcagattttgttataaatttggctttatttctttgtttttaggcataataaatcataatttagaagaaatgtttattttcaggttgatatgaaaatgtgtgcctattgactttacttctttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtttgactttacttcttaaggaggattacttatggcagcaagagtatgttttattcacaggtttacatgtatgtctgatgcctgccttggtatgtagctaatacacacagtgatactacattggagaaaagtgattttttttcctaactggtatcaatagtaaatagcttcttggttaggggtgggactttgctatttcctcctctcagtatcagctggaaattgtttgataaacatgaaggggaatcttgcaagtttgtgagcttcctcagtctttgtctttctcttttcctttctccaggatgaaacattattttttgtatattacattttatatttgaaaccaaaatacaattagattataatataaaggtatcatttcctcttcccttttctcactcccaagcctagaacatatccttcttgttctccctcaaaatcatggcctcttatttctagcattgttacatacagcaaaagctatagtccatctaacaaaattacactcctgtgtctgggaaacattctgtggcattcttggtcaagaaagaagtttcaatcgagaacaaacaggtatagaataaaaacatctcctttgtgcagtaacattttctattgctttattcaacatgagtgggactaaccttgtgtttgtatataatttgcatataagtaaaatttgtggataatttatttcaattagtagctaatatctgaatataaaagttctctttataaggtcataatggtttgattaactatcatcatttcctggattaatatgattttcatgattaaaaaagttagaaaatcagttgtgctattaaatgtgtcctcggctagtcaagccaacctcagtcaaacctatttaaagttccaaaaagctactttttcttattatgttttccacttgatttccctaagttgaagtgaaggggatgaataattttaatttatcatttttgcattcaaatataaaaagtcattgggtgctagttgaaaatttatgaagtgacagtcttgttaataaagataaatgagaaggcttgttttattaatattaatgttgcacataatatagctttctaagtaaatataggcttacattttgcaaactttgcaaattatgtatctatagcaataacagagctaaaacccaagttgtatctttcgggtttcattttatttgtaggaagtctttaaacagagaaaagcaaggatgcatttgaaatatatgtgagatgtttactaacagtatttctgatttctggtattttcactgatatcttatcatacttgtaagagtgagaactaatgaatggtatttgagtagctgaaacgtgtctggtttaatacaagtcaatccagttattatgagttccaaaagagtgttactttgggagagttacagtaaaattcttgctgtcatgagaaagaaaggcgaccttcctttttgtgggagaaagtatttaaattgacagaggtaataaaaatgagaaaaaggaaggacttggacaccccatcactcgttacttcttccttccttccttccttccttccttccttccttccttccttccttcctttctttctttctttctttctttctttctttctttctttctttctttctttctttctttctttctttctttctttctttcttccagagcctctactatgtaccaaaccttgtcttgtataaataagaaagatgagaaaaataaatagtcatcccccacacatattcagccctttacttctcaagtacagaagcttctgtagtcctatagtattctcttatttgttggaagtatgctggacatttctagtctctgtgttaacttaataaggtgattaatatgttgggatagagaaaaggggttagtgttatagttgggtagggctggtaaagatgtcagtcattctctcctttatctctcatcacttgaatagtgtttgactttctggatcaaggtcatcacactcattatagtattttccaggtccatccatttatctgaacaaaattgtgcctgtgtgtgcgttcataccaattcaccacttcatgatcttgtcaatcaccatatatgtaggtatctctgtggtaatatgtttattccttggtatataatagtagtatagctgggtcataaggtagttctaagtttagctttctaataacttttgtactgagctccaaattgctgtgtaaactggtacaggcatgtttttcagggaaagatggcatgggatttcaatatacaaattatttagaaaatggagtttactcgtttagaaagaattgatgttcagtctgtcatctgatgtaccttctgtttgacctcttcttcacagcatttcacagccctttgtgaacttctgtaatttcctagggatatgagtaataagaactaaaaccactgtggtgcttttatgatcttaatatctgttcactgatcatggcttatatttcattttacatttccaaactgtgatgttaattatttcgcaaaaaatgttaatttgaatagaaatcagcttatcttcagatattacatatgcataaaataaatgtaatgctaaggaatttgaaaggtaatttctatgtcatacccatctaactcctatgtttactagagaaaattagtatttgataagctgatatgatttgtcaggagatcagttgaaccactctagtctttttatttttttcttcataaaaggtctcaagatggaccatgaaagtaaaagttctgttttatatataatgcaaatttcacacactagtggagataaagaaattagtgtcccaagctaggaaacaggatatggattattagtcataattcagttgttctcagtgcatattttcattctcccagttttctactctctttttaataatttattttgcataggcagagatatattaaaaggaaatcaatcacaaggtagttctgagaaatatttgtaaagatatatttgttaatacatataatattatgactggggttttctgtctaattctctgagtcctgagacttctcagagttttacctttgccatctgtatatcgccatgtttgttcatcttcgtctgatttatttgcagtatactttaaatacccccttttcacccatcttctcccattctcctctctcttcttctttccctggtctctctattgtcatctccacagggatcagagccttcccatacttgagtcagttaggctataatgaataacaattcagttaagataggaaactaccaagttattaaaagaatatagagacacctcacaagatgccaatgcaggatgtaagtgtcatggcaggaagtgaggtggctttttccaagtctgggaatacatagcttttcatgtctgctgctctctcatggcttttctctgcacatctgctccaacttcctctcatttttttcttattacatctttatttcagtttgaatcccttctatgtgaatgtccaagtcctaaatctaaaggaactttcagacctagtaccggaacagacacatccagtatcttttctcttacactggacatttacaaatacatttatgtggactctccatccttttacacaaattacattttagaacaaaaagtcctctgaagttataaagatttataaaattaaaaacaaaacaaaacaaaacaaaacacaaccactaacaacataaaaccaaaacagactgttctactcaaaacttgtaagaaacatgtttagttcaaacatgcttgggtgtcatcccagtctgtggcaaacatcttcagaaacgttcacatagaaataagcaggattttgtccttcggcaattgctttaaaataagcttgatccttacttggaacatatatttgagttgaaatcaacatcatgaattgtctttcctgtgaagcacagttgtttgagatatgggtcagaaagaaagatattgcccaccatgcttgatggtgctatcttattcaaataactgaaattatgtttctgtgggaatgatgttctaaatattctatactcagaactaaagaatctataatgctgctgtgggtatagtagtaataatctgtgttgtaactctaaaaggttcaggactatgtttatgtcattgaccatttgtctaacacagtgcctatcacatgaaagatctcaatatatatttgagagatgaatgagataggaacagtagagcactattatctgtgatttttaagaaaaacacttatgctatgtttttaatcctgctaaaacatgtaagaaacctagtatagtgatttctgtgtaaatttggttaatttaaggaaagttcatggagaaaacaataaggagcatgagtaaaacacacaatacaaaaaaccctcacacaggcatttgaaaagaatcgttaccaatgttcaacatagttaaagtatccttgtcattagcatacaatataatcattttcacatattgaacatatgcaagcatacctgcttctggttagtgtcatttcgcaattaattgttatcctgtcttctaactatcattagatttgcccatttttcttttatattagtggagccatgtagtctcttcttttctaactctatgactttgagagtcaaccactggtcactatggttacatgtactacctttaattcttttaaaaatgaacaaataaggtacaaaagaaaatgaggggacatgatagtggtaaacagaacttcaatgatcatatgtagtgaaaattaaagatttattgaagtgacacatgttctattcaatttaatgtgccttctgtgtcttctccatcactgcttctcaaattctaatgatgcaacttacaaatatttgtccctaggaaaattacttactgaaccatacataatgtatctcttctactgaggaaaaaaaattttgaacctgtgttctctccctgagatgtgtcagtaggtgctatttctttttaccagaggcagtgtttaattattgattctccatgcatatgtcctgaaagtgtttattaaactgaggttagggacatagttctttccacctcaatgcatgaagttatgagacgacctaccaggaaggggtaatgaaaaaagtgattaagtttctagactgttacatagaattaggtaaaaaaaaaatagtagagtatgcatgatttaaaattggcaagggcaggcattcagtatgaagaaatctttttaagttattaatcatatttttatgacagcaaaagtgaaaggctttaattaaatacatcttactaatgctcccttaaaaaatcctttctaaaataaatgtggtatcaaataatctatggaaggtgtgaggttgattttctatatccctgcatagtaagacagcccttgctgacaaagaaggttgccaggcacttacacagattactaaagaagactggggaatcaatgaccatctgttcaacatggttctcatacaagtgtatgtggagccagaaggctagatgacatgaacttttagaaggaaaaatattttttccctgtttatttaacaattatcacatttgtgtgaaacagaaattcaaataaaatgcttaaaacaagaaataaaatgaagggtttcttttcttgaagtaatttgttggtctctttctaaagcatttcagaattgatgctgaaaagcacttggagatgaaaaccatcctttatttcactgcttctctttctagcaccacacgttgcaagaaaataaaatgcacactacattgttgcttggataaagagctattatttactgttgttcattttcaaatgtttttattgcttttcaaagtggtcaagatgacacttttaaaacccacaattttgtttgacctgaatattgaaccactctagacactacttgaaaggtctctgtaggccattgtggctccatacaaaataataatcaataacacttagacaatgtactgggtgcatactaggtgccaggaactgctaggcaatttatatatgttatcacatttaattctctcaataccctgcaaaacagatatcgctatcatttgcagtagtaaatgagagagccttgattaaaacaagtatgtagtccttactcctaacactaattcttccaagcactgatttatgaacttaggcctgttaccattactattctgcaccatattttccaaagttttgagaaccttatctcaattctaataggactttgaaacttgcatgtctttagatagtgatacatttctgtcttgttctggttggtcaattttgacatggtggataatttaggatttagaaatacttagacctagacttggaccttaccttcgcaacttgacagctgtgtaaccaagctaattcaccaaccctctctgaatttcagatttgtacttgtccaaacttttattgctgtgataaatacttaagaggaacaatttgaatgagaagagttttatggttctcagttttggaggtttcaacctctggttggatacttccattgtttctgagcctgcagtgaaacagaacatcagaaaagaagtgaatgcagtataaatattagttccctatgatggttaggaattatagaggaagaggagggaactaagaacaaaattcagattccaagaatatgcttccggtgactcactgcctcatgaactgtttaacacaaacatagtaatatcaaaatagtaatatcagttgcgtaccaagtcatcaacacatgagcacttagggatataatagtgaagtccctattctatgaagtcaattgaataaaaaagctagatttagaggtgatgtaaagataaaggagatcaaataactgaaaacatatattaaagagctggagatagcttcatgagttaaaagtacttgtagatttttcagaggacccaagtttgattcccagtatccacacagttgcttgtaaccatttataactccagttccaagtgatccatcaccctcaactggccccaatgtatactgcatgtatatggtatatagacatacatgtaaataaaatacacatacacaaaaaaatttaaaaggataaaaaatatcaaaatgacaatgtgtggtagacattcaagaaaaagtaacagcactattaatgttttttttttcaaatttgtaagatcttggcaatgcctctcctcacaaagaaactaacagtattatttctatccattcagatgttagatttggtgattggatataggttatcattacaaaataatcttgattcttgtatatggatatttttagcagcctgtcctttcctccataataagtaaacaatatatgggtatgcattaattttaggaaacttctatatgtaatttccttatgactttgaagaaacccttaagtattatttacccctctccatattctctccatcaatccccagattttctagccgactcctgaatttaacccgttttcttccattattttccttcaacccttatgaagttaccttaaaataggatgataatgctcttactagacagtataggctaacaaaagtctcagtgtcaggaatggcacggcttaccacttttggagttgtgggctagttgggtttaatagaccctcaaatattgagggctattgccagtgttcttgtttgccagccagaccttgacagtaagaccctcttgctgaagacactacattattgaatcactgaacacagatatatcaagctagtagtgacctgaaaatttcattcttactggaaacctttcaaggctttggaagacgccatatttactgctaatggaaaagtgaaacaattggtttttcgacctctggaccctgcacactgcaaaaatgactggcctggttatacatgagatttgatacaatactagcaggaacatcatggaattcatcattatttcctggctggatttaagtccctctccacaaaataaaacacacacacatactctctctctcactctctctctctctctctctctctctctctctctctcacacacacacacacacacacacacacacacacacacacatatcctcattgttgtagttatatttttgttactgttacgcgacaccattaacaagacagcttataaaagaagccatttcatagggtgagttgatgaccatcatgataaggagcatagaagccatggcactgagacaacagctgggagcttatatgttgaaataacaaccaccaggcaaagaaagtacaaactagaatggtgtgggcttttgaaacatcaattccacccccagttctcatccctactccaacaataacccatctactccaacaataccatagttcctaatcctcgccaaagttttttactgctgtggatctattcaaacatataagcgtctgcgggtcattttccttgcatcagaaatgcattctgtgtaccattatatgttgggaaagtaactatagcacaggtcataggcactagaagagaacctgctactatcattctgcaaaatgaatatatcaaaataataaataaaataaaaataagtaaaagaataaataatggcttggatatcattgcagaagagggcacagaaacagtgtaagagtcaaaggcagtagatgacatcattaatatctattacattgcttctaacttgaaatcatatttttgcttagtaattattgcttaccatcacaggtagacctcctattagtgcaaattagaacttacacaagcatatgctttatatattttttatgtcaataaaagtgatgcatatttagaagtgggggaatattattagccacacatttggtaaacatcattcgacagtcattctgtttatctgaaactctacatataaccaatgagatttataatgaagaatttaacttttaagctttctataaaattatttcaatctttgtcacacaatatttgagagctaatattatagaatatgcttcatgaatttatgttagaaatagttacattcccagagagattgcagataatgtatatatcatggttttcttttattttagctgtgagattagcgtttgttgggaaattgtggttagagtgaacatcagtaacttttaatgatttttaaaaatgtattttaatctagtattcatggactagtcacatgcaactttttcctctgatgtttagaaataatcctattttatgtgaatttagagaaaggaatttaaagacagtacatgttaataaggttcctttaacaattttctaatcatctgtgctttcttctgtttatggccctgtcagttttttcttttcctatctaatttcgtctacctgttcttaaagagattgccttgttagtaaaaaatgactcatttctactagtggcaagatagccttttcatccaccactatgagctagcaataatctgctaagctttcgtaaatttcactgtgaaagaacttaatttgtttccattatgagaacttttgagcactttaagttattacaactaaaaggaacataactacatctgtgctagaccgagagaattagagagattttctgccatctgagtgcccacagttacaaagagtaaataccacaatatatggattgttgcaaatgttaggatggtgcaagatcctacactggcgttagcatctgaatatcatgtgaaaatagcatacctgtttcacacaaggacatttttactgtaactaagaacatattgtatgtccaggagtaaagcagaatctaggttatggcatatacagtgtggaactgaatctagaagatcaatgactaaaagaggatccatgtcaaagtggtatccaagcatacaagaaaattggtcagaattcatagtaagcaaggggaattggtagagcaatatgccagcaatatgatctattagtgtaaaaatagagtaggtattttcctagggtctcaggttcttagtttcatcaacaagtgtcagctatgaggtctgtctcagggaataggccttaagcccatttttacaaatttgtcagttacttctataacactcatgaccctactgcaggactgggcacagtttgtagacagacctttattgtagcttgcagtttcacggccaagtgagattcgtgattccttttctcctctggtggcatctataatgcctttcagtgctataaatgctatctagtaagggtgaagctaccgtaagttgagtatcagctagatttttccacatttaatcaattaagtacgtggaatcttcagcaataggctcttttccttacgttgtggaaggcaattaatagcattggcaatggcttataatttttttggagaagggttctctgggattcttttgacctatgactcaaaaggatgtaacaattcctcatattggaggttttatttgctaggatatgctgcttagttgggcttttgttcctctcttatgtggtaaatctacttaaatggtctatctatctatctatctatctacctaccaaccttttctacagtagtagattgccatgtagcttttcaaaaagagtttattgttagctatctctcctcatcctctctcctctaccctatactcacattctagtatgttatttatcttattataatactatatcatatttccttttccttgagagagtgtttttttttacttcatttttctgcaataaatccattcattcacttagctatagacttttatttggatttctagtcatcatttagttttatgacattgaccactatactgatattgccaaggacagtgatgctatttctgcaaaatattgagtagtctaataaacaaactatatttctctatgaagtaaagtcaaatatagaccccagtgagtgtaaaaggtgaagaaatagattttaaagtgtactaagtatgttattaattactattgatatgagtataactctttatatgtattagaggattacttatggcagtttttcctggtatttctgttgcaattagttaaaaaataaagtgagaagtacatgtgaaaattaatagtgaatagaatatagagaggtttttggccacttgctaggatactatgcataaatcatttactagtatgatagaatcttgataactgctcaaaagattaactgttctgcaaccattgttatcatcatcctaccatcctcgaagtatcaaatactaaaaccaatgttgttaaaataaaggataaaaggaacttgctgtttctactagaaggccattggccagcaattgtcttagatacgatcttttgtatgtcttacagtagaaaaccattttctttctgaaccctaaagtctttagattatataaggggagtatatcactgataatccaagtattggataactttccattaagctatgctataaaatgtacctatgtggatttcatctaataaatctggggcctcattcaaagatgcctaaacactcattttagatcatacccacacaaagagaaaaatggtcaacctagcatgtttatctctcttaatttctgtcacttatggaacactatgaatgattaattataaagttatacattgactttgttggacctctaaataatcctaacttccaggtatatcaggtttcacggatttcctatgtacccaaatttgcccaaagcagaaatatttttgtacaaaatgttatgctgggcttctttaagttttatgaactttgatgtttcttatggataatctccataatctccactcaaaatgctcaattgtgtgtacctttcagaataagaataactgcgacaaatccaggtccgtaggaaaattaattttaagccagatggagctaaatttgccttatggatttatcttccctgcaaattaattcatttttcatttaaaaataaaatgatagtaaaagaccgttctttcttgtttctctagtaattgctcaccatttgtactgaatcattctcagcctctcattcagtccccaaagggaagtagccagatgccttctacttgacaaatctctggtcccacgttttaataaccttgatgtttgttgaaatccatacaaacaaaaataattgaaaaaaaatcattgtattagtaaggattctctatagcacagaacttagagaatgaatctgtgtgtgtgtgtgtgtgtgtgtgtgtgtgtgtgtgtgtgtgtgtgtgtgattcattggaatgataggtgcagtttatctaatccgaaaatgtttcactgagaatggaaagtccaagaatctagtagctgctcagtcctacaagactggatgtcttagctggtcttctgtatatgctggaatcccaaagaagcagacgccaatgccagagaagtaatggatgtgctagcaaggtgagagccagtaggcaaagagtgaaagcctccttttttcatgtcttttcattccagcagaaaatgtggcccagattaaaagcataccttctgtcctcaaattcatgatcaaaggtgtgtatcttatacctctcaaagatctgaaacagaagtagattcacccacttccaaccaagcaaatcccaggtgtgttttccttttctggattgtagttcattccagatatagtcatattaacagtattaacagttcatcataattatcaatatggattttaaccttttgaaacctagtgggactttttaaaaattggatattttctttatttacatttcaaatgttttcccatgtccaggcctttattggacctctaaataatcctaaacttttaatttcagggcagaaaaattttgccatcctgagacttagacttttgaccctactgggcagctaaattagtaagaaaaacagcaacctcttactctcactagatgttaggaacttcttactaaaaatgtaaggaactgcaacaagtacatgtttagatcattgtatcataaaaactgtcttttatagaaaagtgaatgcatgagaacatgagacatgacatgctaaaacagaatttatgagggaattaatcatttgtgttaaacaaaacaatttaggatttaaagcaagcagagcaagataaataatacaacttagaagaaataccacactggatcgacttaaaatattttttctctgtgcttctgaaagtttacttctttcaaatctctgtcaaaatgtcatttcattaacaagttatactccttctaatatgctataatccctaattgtggctgttttttttataacaacaattactatttcagtgcaacattgtattttacttggttgtttatgttttgcacgcctttcttttcccttgcaggataaaagatccttgggaacaaattcttgtttgtttgtttgtttgttcgttttttgcatgccatctttccagaataccggctggcacataatggatgattaatttatttttattgactgagtagatgaatgaccataaagaaattactgtaagcttaagctgacttaaaagttcaatttggaattattaattaaaattaaatccaattaagtataatataaatcacataggttcaaagtaaattattttataatatacaagctctagtctttttctttattcacaaaaatattaggtattattttctaaagaaataagtcttaatgttaacaattaatgatagctaagttaattgatttttaggtaataatgcctaatttattttctcttctcataccatcaatcaatataatgaaccctgtcattgataacaggacaacttagtagtattttggtggttaattttaggtttttggttttgttctgagaagttgtgaaatatttttgagaatttaataaaaatagatcagccaccatcagatatactttctcctgtagtagatgggaactaatatagagacctgcaactgagaattttcagagagtgagagattttgaaacactcagtcttaaaatgggatgttttcatcctacccctgatctcaggattcaggcaattgtgcagaagaggaggtagaaagattgtaaaagccagatgagatggatgatccagggaaacagtgctttccagacacatctggactaatgcacagtcatagagactgtggcagcatgcacaggacctgttcaggttccagccagattgggtcattggacaaagagggtgaagttgacatgagctcccacccctaaccaagaagctttctccaattgacatttgctcacaaagaaaattaactttcctcaatagcatctaacggggtatattaacctgatttacgggtagacccaggcccaattaaaatcctggtttgtttgtttttctatgcttttttgtttcctaaggagagaaaggaaagttatagagttgagtgtatggggaagtgaagataatctgaggagagttgggggaaaagaaatgtgaaaaaaatttcaataaaactaaactaaaatattttctagttccatccatttgcttgcaaaactcaagatgtccttgttcttaattgctgagtagtattccattgtgtaaatgaaccacattttctgtatctattcttctgtcatgggacatctaggttgtttccagcttctggctatcacaaatgaggctgctatgaacatagtggaccacgtgcccctgtggcatggtggggcatcttttgggtgtattcccaaaagtggtataactgggtcttaggtaggtctatttccaaatttttgaggaacgtccagattaatttccagagtggttgtaccagtttgcaatcccactagcaatggaggagtgtttctctttctccatatcctctccaacatgtgttgtcacttgaggttttgaacttagccattctgattggtataaggtgcaatctcagggttgttttgatttgcatttcagatggaattgcagaggagtttgagaaaaacaagattcagtggcaggcccaaagtgcaattcagctcaaggggaggtcccaagtcctgaaactattactcacaaaaaggaacctataatgactgccctctgaaagacccagtaagcagctaaaagagtcagatgcagatatttgtacccaaccaatggacagaagcagccaatccctgttgaattagggaaggctgaaagaagctgaggagaagggtgatcctgtaggagaaccagcagtctcaattaatctggacccccaagatcgctcaagcactggaccaccaaccaggcagagcatacaccaggtgataggagccccccaacatacatacagtagaggacttctgggtctgtgttcattcagagattatatacctaacctcaagagactggaggctccagggagttcagaggtcaggtggggtggggggtagctccatccaagtggaggcagggagtggggaggaggcatgggatgtggagcagtcagagggtggatggggtggggtggggaatgaaatatggagtgtaaaaaataaatcaattttaaaaactaaaaaaagtagctacaaaaactggacaagtgaatttagagcatgaatatgtggacatttttaaatacccaactgcctctggaagtaaatcttaaaatgtttatttgagatgtgatagaatgttaccagagataactttttatagagcctgcattttctaatatgtaatctcatgataacattttctgtcctttactttctcaaaattactgttacatatcagaattcccttgtccaacacaaagtataatttaaatacaaagggccatatgatgatggtaataaaaagttttatttgcctagtgattattctcttagagttaagagattttacttgaaattatatgttattgtcaaatgcttaacatggaaaaaatagtgaacaacatatgttagtattaaaagaagcgcaacatcactgtacattggatgtactttctaacaatgaggtaatcagtgccaacttctgagtgagataaagaaacatgatagcttaaaagacactgaactttcctctttgggaggttattgatttcattaacacaaatgcaaactaaatttcaaaatgtccaagtttaggttgaaatcatgaggcagatgggaaatgttttattgcattttggatggtataagaagtttgatactcatcctagaagcttagacaaacttcctagtcataaactggctgattggcatgcgttagtgtgcttctgaatctgcctgcagaaaaatagtatcatgtgacaggtcaagttgctgctatcttagaatttattatgcattttgaaaatccttcaaggtttagaatacaagctaaaaacaaagatctatgaaaccagaacctcaatcaaagtagattatgactaaagtattatctacaaggctaaggtactaaggaaaaattctagcatatggccagtgatatcagatacttccaagatgctcatccatatgacatactctcctacttggttttgaagctcactgtcttttgactgcctatggacacatttcaagtagctgatccagtgtacataggaaatacctgtcatggggggaatttcaattttgtcatgtcttgatgattggaaacactttcaaataacagataaccattctaggagaaacatatgaattttgggtatattacaaggttcccattgcattgtccgaataaatatgacttactgaaaattatcttcagtagtgtaatatcctcttttagaactctaaaaacaattcatggcttagccaggaaattctgccatacaaaatactatataatagatgacttcattaaattaaatttatgttgtgttctgaaatctagaagtgaaaatttaactttctgttccattcaattttcaagaggaaggaagggttcttttttgtctcagggcaaatgctttctcaataccttcatgtattttttcttcttgggaagggtattgacaaatagtgattaaaggggcttggcatttgttgagaatctagtaatccctcagattagggacccacctttattacttcagttacattttatgagacccatcttcaaaaagttcactgtgggagctaggacttttacataagaatttcccagaccacaaatgctcaacctacaacaaacaccaagaataccaccatactaacatttatagtggttacttttctttgaacagttttgtaaatatgatagagtgatagagactttaagcgaatattttcagtattacttaagtcaaatattccatgaattgaatttattatgttcccattaattccaccaacagaagctcttttcaatgcagttatttaaaacccaagtcttaatatcttgtgggtcttgcctcctatgagcctttatatacttcatttaccagttgactaagtgccttagtaaggatttctattgctctgagagataccatggccatagcacctcgtgtacaggaaaacatttcattgtacctggccttacaatttcagaggttttgcccattatcatcatggcagtaaacttatagtatgcaggcagacactgtgctggagaaggatctgagagtgctacatgttgatcctccatcagaaaaggagactatgaggtgcactgggcataacttgagcatatgagacctcaaagacctgccccatagtggtatacttcctacagcaaggccacacttcttaatagttccactccttatggaccaagcattcaagcacatgaatctatattggccattcaaactaccacattaagtaaataaagtgagggtggcacatgggaacaatttataattcatcattaaaataatacttgatgaatttttattagtaataacttaattcaggactgtaactaattattgagaaatacagccactgtatatattgaacaagagataaataggggaatacaaatactcatgagaattagctgttttctcaaaccctcttgtaatcatcaaagcaaacaaatgatgtgggtgtgatcactgtctgtggggaaatgggctatgcacagatagcctggtctccagagttgaggttttgaaccacggtgcaaccccatgggtggtaatttccacctacatgggacagaaggctttcaatcatgtctcctgaacccctggctcctgtcaaagttactgcccccacagcccccacaagagaggcctgtggctagtagtcacatagataatgccccaagcttctggcattctggctagactcctccccacagttatctagcaataataagagagcaaagcccactattatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaaagaggggctgcttgtcccatcctcactctctttaagctttcttactctctagccctccttctctctctctttcccttcccatctctctctctctctctctctctctctctctctctctctctctctctctctctctctctctcagcttttacctctcttactctctagcctttcctctctctctcccctccccccttctctccacgtggccatagccagcctctccctttctctttctaccttctctctttcccccctgcctttctacaataaagctctaaaaccagattatctgtgatcatcaaggccagccatgcttgaactctgggatagactttctcctaaccccatgtctaacctccggacagaaggccttcctaagctgcagctagggaccagactaaggactctcacctgcatgggaaccaccccagtgccccactccctctgcccctcttcccttatctctggagcccagtgcctcccaggggccactattgtgttctcagtttctctgctgtatccagcatgggatgctggagactaagcacttggtacctggggctgccccttgtctaccacctgccatgtggggtcagtggcttaacacagccagatgaccacctgaagctgtgtagaaagtgtctggcagtcctcctggtctgcctgcccagagcactcccctctttcccacactcccacggtcccgcaattgtccatattctattaattaaaagtagggattatgttcaataaaagtttactggtaatctggatttgtagatttagcactataagtagctgagctgttctacgtgagccatgatattatttcactatgtattaatgttttgaaatgtttgactcttttcaaaaatgccttaacaaagtccatcaagtaatagatcaaagattttctttcacctttgtttttattctaaaggaacaagagagacaaataggaaaagtatcatgggggaaagagagaagagaaaagaaaatagtggcattttatgaaggatttgatgatgtttattaaactatgtgctatcttacatgtattttctaatagcaatttgttcaccattagggctctttcctacagtggcagtaactatacaggacctttgaatgattttatgttacaattatagtgttaatgatagggagttttaatataatagactcttcacaaaagagtgaagagagatatcatatatataccttttttagaattcaagtaagtctgtccatattggatacatgttggaaggacacaaactaggacctgacttcccaaagaggccctgaagtaatccaatataggaaagatgggagaaatgccttttcttcttgctaaatagttacagaattgaataataattattataggcttctacatgtttgttacatcctagacaatcttaaagacacctagaccagatttcctatccattgtactccattaaaatagtatattgattggtttaaatttttaacaaacatctcttttctgttctgtatcagttgaatacttcttttcttttggtacatatcataatagtagcatagctaggttgtactaacaaaccacagtatgtgaaaaaccacagtatatgaaagtacaggcttctaaaagtttccttcctatcaatcacatttggctcataaaatgtgaacatttatcaaaggtggtttaattcagaattagtaaaccactagaaggaattgtctataaaagaaaactgttctaatttattaagccaaatgtctccaatactataatactcctggtaggctttcaagctggtgacagacagaatgtgtcaatgagtttaaatgttttctttctatattaaggaaagcagcattctgagatgctagtagcacactttatcttgaaactgagaatgaagggttagagaacagttgaatgacttagtactttgttaaaaatcaagtcaggtttgtggcatgtgcataaatatgggcctaagcaagagttcctgaataatggtatttatcaggctttgttgataataacagtaatagcataataggtaaataaaaatattatacaagtcaaatctgccttaccaatccaaaacatcctataatctgagaaagcactgcaatcagacttgtagaactgaattagagatgtgtgggtattaaaatacccacatccaatccatttccacatgtaccatctgttgtttccagatgcactgcttcctagaggcagtattcatgaccatggtattataacactaacaaaccggcattcctagttctgggacttaatttccagaaatacaagttttcattggctagacttaggggaattagagtcttctgtggctggggacgtgccattacaatcatggtaacggaaatagaccaatacagagcttaaaaggcttcagggagctttcaaattgggagcagtacaaagtttctctgatgtgtctgtaacttaagataagtttagaagcactattaatgctcttcccttggtggatagatatgcctagttcattgtagataaggcgttagaggtacctgttctatgtaacttgtgataagggaagttagaaaatgctccaaagactcttgagtatatgcttcaagccacatatatagtccagcaccttcatctggtgctgtctgtaaagcaatgggctgtcacctccctcaagaccactgcttgcctcattaataccactggaacaaattatcacttcacagcccagaaatcttctatagcagttgtggtgattgatgtaacaaggctaaaaaataatgatgaaatgcatgttccagaagacagattcaaatggcaggagcttcaaaggcaattaaatgtgacacagaaggagtcttcatggaataaagtattttcaaataaatggtaagataagtgtgataatctcctagactcgcattacacataaattagtttcctatgaataattatttctgaaggcttactatgtgttgaagtaaaagcttaaaaacagacactttgatgcatatacatactacggttttaagatggtgtggggagcagtgttgtggcactgaaaaacttggctggacttgaatttatttttagccagacactttgaataacatcttttgttatgttgaaaggtgtcttgtttgttggaaagtaaagaatcatgactacagatgtcaagtttaactgctttcctccgaagcaagttaagcgatttcattctttcttttttcttttttcttttttctttttctttttctttttctttttctttttctttttcttttcttttctttcttcctttctttcttcctttctttctttctttctttctttttttttttttttgagacagggtttctctgtttagccctggctgtcctggaactcactttgtagaccagactggcctccaactcagaaatcctcctgcctctgcctcccaagtgctgggattaaaggcatgtgtcaccaccacccggccagttaagcaatttcttatgatgtattcattctttcctgctacatttctgtgttgtgggaggaacctgtctaatcaaaacataagacaggcacatcaaggttaatacaacatagaaacttaagacatggaagtaactgaaacaacttgacaagtttaaaactttctgacatatgctggcaaaggcagagtggggggaggggcaagtatgcaattatatgcatccagtggagttaaaacaaataaagtctggacattaattgtagaaaagatgaagctcaagctgccatgttgaatctataagtactactcccttcatgtcttgaaattagaacacagggcaagtaagcagaggattggctcagatgcaggaggatgtagcaagacagattcttttaataaatctgaagacttttttgtaaatcatgtctgagttgcatataagctaagtagaaccttcactgcagtatttaatattttctctttggcaattaatggtgacaaaatctgataaatgtatttaaagtatgaatgtgagttgttctaattctgaattttcttgataaaacttcatggaatactagtacaccttggtagcgcttttgtcaattttacaataggttgcccagtctttttaatgaaatgattaaattattcagatctttttctaattatacagaccaccattaacatacttgtttactctgagaaggttgaagtgtccttttgaaataaaaattaaaggccattttgacctagttttaaaacaagcaacagatacttgggtagtttataggatgcacaaagaaatatttgccaactatcaaaagaaacaaagacgtctatttgaggatgactgcctttcacaaggttagtcactgaatcaagaaacttgtcttataatttttcaattgacttaacttcttaaaaattgagttgcaacttaagaaatctgcaaattacttacctgtcttcctaattggttggaaattctgaaaatgtgatgttcgtcttatacatatggctagtatgacagctgcttaaaatagaaaaacagtaaaataaccgtgcttttatgacacatttatagtttggcaataaaagctccttcctaaactcattctcccatcacagcaccctggtgatttgtgtaattattattttatctacccttttaagcaatggaatagacaaaatatgaactaatgaaccaggattcattttatattttaaccattatttaacacatgcacagtaacagtcatttttaaggaaaactaattcttttggtccaatacaaatattatgctactaaatcttggatcctgtaccaagtgataaataataaagtatacttttacaatcatggctttaaacaactttaattgttgacttatattagaccattaaaatgtctagaaaagcctttttaactgaatacttggaattccaagttaattttataataatatattaataatggaaaagacacttgcatgtactgagtgcctcctagaaacaaacacaaccacaaacaaacttatttaacagcaaattcacaatattgtgcagtatttatttttctcaccaattttatgaagaaaggatattcagccttagagatatttagtatctcttttactgtcacaccagctttgcagtgtcagaaccaatattaattgtgaatctgcatagtcctaacaaccatattccatagctttttaataaatgggaaatatatttgaagacaatttctaattcaaaatatatagggataactcaacaagacaaatgcagtcattctacttcttaaattgtacccaagacatttgaatgcattaaatgcataatgatatgaaaatttagagaattatgtttattacattaattctgtttgatatgacttcataatgattttatataagaacacttacatattatttaatagaaatatgagggaaagataggttagttcaacctacacattcaaaagattattaaagctgtggtttctactgttaaaaaaccctcatatataaatcaagtcagtgccaaaatagaaaaatgatatggactcataactaaactatctgttgctagctataagggctaataaagacattcttgtatgaattactctgtaaaagagggcttaaattaagtatcaaaagttgtgaaatgttctttagactttaagttataatgcaatcaattatttcaccgtgattcagtatttacctatttctgttgcagccaaagtccaatcactgtgaaaagcaactatatgattctattctacatgggtagaaaatattgcagcataattatagtccttttatttttatactaaacatttctgaacacttaaattattttaagattttcattttcaatccaattttctttgcagaatatagaaaagataaacccagaagttactcagttatttactacaaactttaaatttcccaaaaagtcaagatagataaataaggctctattttgccaataagtcttcaatgagtagttttcataatcctttaagtatatgtgacctgatagatttttctagactttttctgagtctattattttataatctatggaataagatactatttccctggccttcaattattaaaggaatataaagtgtagaaaaataatagtactagtactattattattaaatattaagtatagaacaagtcataattataatagtattttactagtcaatagtatcaaactgctcttgaaatgtgttgtatatacaattcaacactctatttacttatttttgaaaaattcatacatacatacaacatatcttggtcatatcctccccccccactctgttcatctccctttactcatctccatttcatatcatttaaaaatttgacttaatatctcatgatctgcccatgatattgattttaaaaagtaagattttagatttcacttgggttgtatcagttccatttgacaacaatggtattaacataatactctctcttttactagtattataaagacaatgaatcataattaaaagacatcaagcatttatttcccttttaattatcttcacttctttaagatatttgtagcttaaaaaaagtagaataacctgattaaatttattcatccaaatcacaaggaattctagattatttccttttcaattctgggagaacttaagccatctgttgccttgaagcagagagatttagtaatcaggcacagcagtaagaagatatttgtctagggatgctattaattaacaaacttggaaagcattctgcatttcttaccttaaagtcaaacacccctcacaagtacattggacaattagattagaaaacccggtctgggtcagatgctccttatgctccaacaggaaaataactcaatggaaagggctaaatccataaagatagcataaaatgcagtaaatgataagaattgcgaggctccaaatatatgtatatttagaaaccttcagttattctaaatgactatgttctttcataatccatttttcttctcttagaaagacctattctagtgttctttgtacttaatgccaaaattttaaactggaaaatctgaacatgaaattttgagaaaacttgaacattaaaaaaaaattctcatttaaaataaattgtattttggtataattactttgcaacaaatgcgctcattttaaagtacatgtactaaagtgatttgaccaatgcacatctacagaaacattactaagatttatgtcatagaatgttccatcaccacttcagatgttcctacactttttggagtcaattgtcaccatccccttcctgaaggaaacacctaactactttctttcaccccaaagattatcttcatctcttctggcgtttcattccagaagagaaatacttgtattcttctttttgtatgatttatttcactaagaacatggtattgtgttatggtttattttctatttcattgtaatagtcaataatatcaacaatttgggtgtgtttgtttgcttgtttttgttttctgttgttgattttttgacacaaggtttcgctgtgtagccctggctatcatgaaactcactttgtagaccagactggcctcaaactcacagagatccacctgcctctgcttcctgagttctgggattaaaggcatgcgccaccatgcctaactgatagtttcaatcttttttttttttattaaagtattttatttgtttacattacaaatgctgccccctttcctggggcaccatccctgagttcttcaccccccatccgccatactccacctcggagagggtgctcctataccctcccacccaccctcacctcacctatgatagaagttctaaggactacatgttgttagttttgttctttagtctttgttttactaaggactaatggtgttcaggatcattttttgagacatacacagtattgatatgcaaagtatttgtgccatgcaaagtatttgcaccataggctggctttgaaatcaccattctccattttcaagcgcctgagcactgtttttgtttgtttgtttgtttttgttgtttgtttggtttttgttttttttttctcccattttagttctcaagagagggtttctctgagtagctctggctgtcctagaactcttccctataaaccaagctgggtacaacctcacagagatttgcctgcctctgcctcccaagtgctgggtttaaaggcatactacaccacgtgcagtctgaggctgttttaaaggtatggttcatatgtttttatatgtgtattgaccatttttgcttttagttacatattggttcttcaaatcttctgcctagttctttttaattaggtatttagctcatttacatttccaatgctataccaaaagtcccccatacccacccacccccactcccctacccacccactccccctttttggccctggcattcccctgtactggggcatataaagtttacgtgtccaatgggcctctctttccagtgatggccgactaggccatcttttgatacatatgcctagttttaatgctcactcttctcttttgttattagtggcttacaaatgtcctttaaatattctatatactaatgtccttcccacgctaaagtcacatgaaagctgctttcatattttgtagctaatcttatgaatttttgggatagatgctttggaagccttaacaaacatttgatcttgaagttcagcttagcagttttatcactgattgttgatgggctttgtttccatcttatttttatatctgccaatatcatgacagttttctcccgtgctttcctcaaggagttttacattttggtctgtagtatattttgagggttttttggcatattatgcgaggtaagtgctgaattgcaattttgccatatggttatccagttgtgctggtatcatttacataaatatgctttgtatcgaattttacttttgattgttattttaacatcatttgaacatatatttgaatatatatgagtgtattttagggttctctacattgtttccttaatctatacatctgtataattacgccagtattatactgtcttgcctactgtagctttacagtaacttctgaaatctgtttccaaagtctcgtgttctgaagttcgctgtaaatcatagcacttggaggaagaagaagaaagagtgccatgattttgaagccagtctgatctgcacaatgagtccctctctacaaaaacaaaatacaaactaaccaaaacaaagattccccccaatttctttttattttcaaagacatttaactatttgaaataatttgcattttcatatgatttttaaaaatgagttctgaggtttcaacttggtttacttagaatttatggatcattttgagcagaattgcaatattaacatctttaatattatttataatctactactatggcatattttccacatcttaggccttttattgtgttcaataatggttttagttttacagtgtgcacatcattttcttctgttaaatttacacttatgtattagattaaacttcaaaaaggggatttgaaaaggagagagaagaatttatctgcaatctttgttaggtaaatatgttactattatctggtatacaaaacatgagtttttagttttataagatacacaattgtaagcaaatgtgactctataaacaagacattgaataatggagctgacgaaagtttattctaaaagcacctaattggagagggtaagggcaggcatgtccttaggttatggctgaattggaggccttcaaatttactttcttacaacaggtggtataaataatcgaataaatattttaatgacagttatttacttattttgtggggtataaacacatgacagaatatatatggaccacaaaggacatcttgtaggatgatgtcctcttttccttctgtataaatcctagggattgaactcaggtccccaagatgatagccaacaagtttactgactaaactatcttgttagttgtttagttgttgttgttgttgttttaattttttaagtaaatatatttaaaattgttttatttattcacattcctaatgtttgcccacttcccaatcctccttctaagagttcttcacccccatccttccccctttcatctgtttttatacttgggaattatgggcacaatatatgctaaaactttgtgaaacttgtaaaatggaattgatttgagtttaggaccttgtgtatgttagaaaaacactctgtcaatattcccaagctctcatggagccattatcatttcttttttactcttaaaatggaacgtaattgatatataccaattagtgtagtgtagctcagtcactaatcgtactgactctgagctagactccttagatttaaaatgtgacacattcctttgctgattatatctttttgaatggtccttaccttaccatacatcagttatttttagaatgcagtgttgacacttaacatctgatattaatatgaagagaaattaatactgtgaatattaactatctcagtataaagcacacagtgaaacagtcaataagtgtttgcaaaagtcactgctatcattacatctccgatattctcctcactttctcaacctcttgaaattaccttggtatgctttgctttcactactgcccttttgagctatattcataaaattcataggtatgtcaattgtagtatacctcttaaattcttatcattgtaacaatattgtaaatggtataattagcaaactaatccagccaaaccacacaaatctattaaatatattgccagactgattattctttaactcaatgactgtataatagcatgttcaactactcagcaaacatttattgagtacataccacatgtaaagcataattaaatgcttagatcagtgaacaaagctgaaattcggtgcttgaaaaacttatgttctacaaacaacagtcattcttcacagctgtcttccatccatctgctcaaatttaaggcagagccacaggtctttggatggcccttaagaagtcttcaccataaggtcaaaagaaagataacaaataattgataaacagctatatatgctttcttgtctttagctttgtctctagagaaaaaagttggtgctaagaacctagcgttagagccgggcatggtggcgcacacctttaatcccagcactcgggaggcagaggcaggcagatttctgggtttgaggccagcctggtctacaaagtgagttccaggacagccagggctatacagagaaaccctgtctcaaaaaaccaaaccaaaccaaaacaaaacaaaacaaaacaaaacaaaagaacctggcattaggttgtaggtgtctccctctcactccccctccccctcccccactctctctttcctgctgtgtatgtgtattgtgtgttataaagagtacatacatcaagaacatgatttaaattcaagcttgtccatttaccaccttttaacttttggcaagttaattaaccattctaaatttttgcttcttcaagtcagcattaataaaagcactatatgtacatagttattgctactaatggatgaggatgaatgtaaggtccttactagcagacttacataaaagttttcctatgcattaattccattttttctcttcgggtctcctaaaattgacttggttctcaataaatacttaatgcacattgtctttcccaagtcagaagtatgtatgtgtgtgtgtgtgtatatatatatatatatatatatatatatatatatatatatatatgcattatgctatttcccaaaactatcttctgtatcacattgtactcagtcatacaacattcaatggctccttattacctcctatgatacattaaaattgtctaatactagtagtggtctctaaatatcagcctatttcttctcaaccatccaacataaatatttcatatgaacccagttactcaatattagtgtttctttagtaggcctgaaaactgactagtttctaatgagtgagaggaatttgattttgacagtggcaggggtgcaggaggttaatggtacgagtgctgatagtctttcatatatgggagtgccggatcactagaaatatgtccattttccctctaatctccttcctgttaaactatactttcattatgcattaaattagcatgtaaatgtttgtttttaatcaatcagttagttactaggcactaactctgtgtaagaaattttcctaggaatgaaaaccataataatcattttgttaaagacttaaataaaagaggagacactgtgaatacaagtgtgtgtgtgtgtgtgtgtgtgtgtgtgtgtgtgtgtatctgtcaaatggaaatgtaagaaattaatgtaggctatttactgggaaggtgacagttgagtgttatcttgaaatatttggcactttttagtgaatgtgaacattgaataatattaagagaaggaagacatttgaaatgggggaaacagaagatgcaaaaagataaagtgggaaaagtttgatttattcagtgaaacacagaaaaacatgcaataaggctgtaccacagggtgtgaatagtgagagaatacaaaacaatgaaaaatcatgtttagagttttaattaaaaccaatgtggagattatatcacagcaaattgtgattatcatttattcaacacctactatatgtaagggactatgtaaaatgttgtctgtgccttgtaaaaagctttataccattcatataagatgtattttatgtataaggaaactaagtcaatgtttaattacccaagttatcatttgagaatggcagagagaggattcaggctagaaatataagatcacagaatggggatccatcccatatagtcaccaaattcacacactattgtggatgccaacaagagcttgttgacaggagcctgatatagctgtctcctgagaggctctgccagtgcctgacaaatacagaagcagatgttcatagccaatcattggactgagcacaaggtccccaatggtggacctagagaaaggaccaaagatctgaaagagcttgcagccctataggaggaaccacaatatgaaccatccagaacccctgagctcccagggattaaaccaccagccaaagagtacacatggagggacacatggctctagctgcatatgtaggagaggatggccttgttggacatcaatgggagaagaagcccttggtcctgtgaaggcttgatgccctagtgtaggggaatgccaggctagaaagtgggagtgggtgggttggtgagcagggggaggaggagaaggggtagggggtttttcggaatggaaaccaggaaagggatacatttgaaatgtaaataaagaaaatatctaataaaaaaatcacagacttaagaaatatgattgaatgatatatgacaggcagtaagattgtgatagaatataagacaaccgcgaggaatatagtattaaggtggtttgcatttattaaagaagagcatataggcattagcatataggccatagttgagtatatatggctgtggaccaatttataaagataaaagaagattgtaccaaagatggagttcagcttccactgagaatttctagaattttacttgctaaataatacaagatccttagagttacatgcagatttgtaaaaatcccttttcatttctattggattattagccacttgaggacattaatttctacaaattaatcacatttatcagatattcctacacatagtataaatacatctttaactttttaaattatttatttgtggggtgtgatggtgaatggcatatatatgtgggttaatggacaacttgtcagagttggttttttccttctatcattttggtcttagggctcaaactccagtcatcaagattaatgacaagtgtcatcaccgtctgtgctgtcttgtatatcctcaattcattctgttttatttctctacagaatttatagaatgttgttagggatagagctgtaagacggctctaattaggatctttctgtttgtttcttttaggagcgagattttgaactatgtactggagtcaatgaatactagaagaaagtgcctactttgctccagtataaccaagagctaggatgctttatagcacttaaatgtgacaacataattatataaaaggttcaccaataattatatcaacggttcaaagacgttttattctcagacttagtttttgataaaattagatgtacgacaagataattttttttcaatttgaccttcttcattctaaattaaacctcctatcatagtaaataaaccaactgtcattaattttacattttacatcatatatgacatatatgtataatttatatacatatattatgtacgtatataaatataaaatacatataaatatgcattacaactgtgtatctgaacaattttttattattctaggatttgagaagacatggggctctaaataaaagctgagtactgtttcattgttgctaagagacaaaatcaatacttgattactctgaattagtatatccagccatgcaaatctttaacctcagattaactaaatgtaagaccacgacccaacccacaacaggaacatttagaagtagagcattagctggtgcagagcctatttgtaaagtgtgggtttgcactgctgcccaaaccagtttccccaccattattctctccagaggagctgcagaattatgccagcagaattttaactaattggcatttctgcgatccttccctgtatccctacttctattgttcatttcatgatacacttataaatgaggccaatctaccctcagctgtaccatgtcatattaaaaatacttccgtttgtccatattttaaattatttttatgaaagtcacaacagttggcctatccatatattttataaaggagaaaatatatgtaagcaaatcagatcatttcaaataatgatctagccaataaagacaacaaaaaatactataatgaaattactagtaaagaaagtgaccatgggtacctgaggaaaacactagaattcccataaagaaagctttctttgaagagctggcatttgagctgaaacatgtattgtggaaaatacttgatcaagcaaggataaggatttcagacaagagaattagcaaagtgtcgctagaatgtatgaaatatagtaagctttagggaggaatataaggttagaaatgggagaagcagtggaactagagcttgtattaaaagtctggcctctggcagccccaacaaactaagcttattccttgtcttgataggataattaaatacacagtaatggtaaaaagcagaaaaggagttattttatgaggccacatgtgtaagagaaacaaatgaaaggttacaataatgtcatgttcattttattttttgtttttttgatgtgaactttaggctttaataacagaagaattgaggtaaaaggtcaaatgtatacataaattaaaagtcctgctttagaagtggcctcaatattcattgtcattacttttatcctgtaaggtggattgaaagtctttattgcctgagggattcttagaagcgataatcaaacacaaaataaagacagaaattcagattttcatcttgtttttagttatcatggacacccaagtgggggactcaatgcttctctttcaaaagtgttttctaaatacctgtataagtatggggaaaatggattcctcagagcttaatggattatgccattaaagatagtgataagttgcatttactattctaggttctgaaatttaccttagtgaatcattgtttcttcagtgtcacttcttcctatagtaaatggtgtttgcttttcatcctcctacaagagtaactggaggtgcattgctttagacccatcattttcatgttcttgttgctcctctccaattttaaatttctctctcatagatttcattgcagattcatttttattctcatcaaaaagcaagtctagaattctgaaattagatcaggatactatggaccccttgaatgaaaagcagcactaattttctgatgtaggctattaggaatttttgcatcagtcttcatgagtaagagctgtgaatatagagatgtgttcccagtagatatccatcatagagggaatcaatagaggtacctgtatcatccctgatttcaacatgtatatcatgacaaactgtaaagatgatgcaagttttttatatctaaaaagctgaactaatgatcatagtttaggagaaagaagggagggaaagggatgagattggggaacaaaagagacagagagagacagagagagacagagacagagagaaagagacagagaaacgctgtcaggtgccaatgaatccttttaaaagcaattcttgaccattaactttgtctgaatgtgggaaaattgtgtatagaactatctagctctacttttgccagttctacatgttccaatcctatgtctatcaaaagatattcttaggatcaaaactaactactctgaactataatcttcagtttttaatgatgttcacatatggtatctaatgccattatgaaaccattgtaatgccattatgaaatctggtgtgttttagcatgttaaggattaagctgaatcctgtagtacaagatcccgggaaaatatctatttaaaacatagggggaaaagtgaacatcttggaaagatatccaacagaatttttataaaccagctataaaaataaataatgtagcatttatcattactgcagacagaggttggattaggttaaagttagtacttaaaaaaaaaaactatataaatctggttttagtgtgaataaattacctgatttctttagtggactatgtgatacctttgggaatgaaagtaaatggatccttcagatgaaggtaagaaatgttttaattaaaagtaggtccattgtttcatacaataaactatatgacaaggtgaatccagaattctatgaaagcattttcaatagcctgcttggactgtggatttaggagtttaacctctttccataggctttaacataactgttgtaaaatgatcatgtagaagtagttggcatatctgtcgtcacaaatatttgtagcttactttaatttttaataagttaatatgtgtgatttttaaagaccgtatatgtttaaaatctattttattgcttaaaacatttaagatttattgatttttattttatgtggataggttcagtgcctctgtatatgtctgcagtgcatgtgcttgtagtggccagaggccagaatacaaatcccatggaacaacagttccagagaccttgaactatcatatggatgctgtcctctgcaagagcagcaagtgctgttatccagtgatcaccttgatagcctgtgtacaaaacttttcaatctttttgtttattagatattttctttttcttacatttcaaatgttatcccctttcctggtttcccctccgaaaatcccctatcccctccccaatccccctgctcaccaacccacccactcctgcttcctggccctggcattcctctacactggggcataaagccttcacaggaccaagggcctctcatcccattgatgacctactagtccatcctctgctacatatgcagctgaagccattagtcccttcatgtgtactccttcattggtggtttagtcccagggagccctggggggtactggttggttcatattattgttcctcctatggagctgtgaaacccttcagctccttgggtactttctctagctccttcattggggactttgtgcttagtccaatggatggctgtgagcatctacttctccacaagctattgctgtcctacaaacttaccctaagacccaccaaataatttccctcctgactttatgtcctttttactgaaaaagtctaatgaaaaagttcaagaaatgttctcttctgagagacatgcactaaagtggcaggaattgcagcaagatttctttctttcttaacttcttcactctcttcttttttttgtgaatgttattatatcttacaaaatattgacagagaattagaagcattgtttaaagaagggagaatactaaaacaaatcaagtagtttccttaaaggacaaaactggtaagcaatagaatctctattcacacccatatgattctgaagtctgccttcagtttatattataggtctcgtgttgacatgaattaatttttataaactttaattactaagttatctatacttttccaaatacaccatgaattagcttttgttggaagtgccttacacttacataatgaaaacataattgacagccctcattctagaaatcaaaattttcatttttgaaaaaatgaactgcagacttctttatggcctcctttttttctgcattatgcttagttgatagcctccttaatatcatcaaccctatttgattagctttggaatagcctatccaaacaccctgtatctgttacttttctgttgttattataatatgcattgaccaatggtaacttgaagaagtgtgcatttcttttgccttaaaattacagagtgttatgtcatggtagaaaagggtagaaaagcatatcatgagcagagggtatggtgctaggtgcaaaaaactgaaagctagtatcctcaacattaagcaaggagtagacagacaatcagagaaagaataacaggaatagcatatggcttttgaaactcctaagcctgccacccaggaattcttccaacaaggtttaccccctaaactccgtcaaagatcaccaccaactgggcaccatatgttcaaatattctgagcctatgggggatactctcaacaaaacactctgtagtcataggatcttagtgaatcagagcctttaaaatgaaaaaaaaaatcatgacatgagccaaagagaactccagtcactgatcagctgtaattatatcaattaacacctgaagaattagcttcaagtgcaaaatctgcaaccagaaacatatcagacatttgtgataaaagtataacattaaactaatcaaactacctttatttaaaagattattttataatatttaatgtctgggtttttttgttttgttttgttttgttttgttttgttttttcgagacagggtttttctgtatagccctggctgtcctggaactcactctgtagaccaggctggcctcgaaataatattttatgtcaaaacctacttagatcatggaaaacctagtaaaacatgaaaagaaaactatttacagttagggttttaaatgttacaaatatacaaatttcctatttttttaaacagcatcaggtttcgttatggatggttgtgagccatcatgtggttgctgggatttgaactcaggacctttggaagagcagtcaacgctcttaactgctgaaccatctcaccagcccccaaatttcctattttgtattgttatttttgctacttcaaaaagaatattaagattcaaaattatgattttaaaataatttgagattagaattgtttttatgagcatgtttttcttatatttcaagatacttcttctcataatttcaacttcagttttcatttccaggaaatagtcttgcaagatcacctttcacctttattttttggcaactgggtatagagataggatactatgaacttgatctgacaacttaataagatataataagacctgaaatagtggcagtgccctttcaactatcaagatctagataggtacagaatcttttcaaagatctgtctaactgaattccatttaagtttccctttgaaacattaaatgtcttttcctgtttcaaactagagtgtgatcacttggaatattggctaggaacaggtcattagcaaaaactccaatgaagacaattggctttgggtttgcttttcctgtttttgcagttagcttagcaccagatggtgccctagtgagttctgtataaataatacaatcatagggttgagtgattctctaccagtcacagactcaagcagaaaatagcacttgttttcccacacatgttcatgtagatttacttattgaggaattgttcttatacagctctaactgttaaactgttgttctggttggtgttttctctctgtttgtttattggataggcaagcagccaaatccttgctctgacctagagggaagagctacagaatttgacgatcttttccagagatatccacacattatgaaatggagccggaaaacagcaaaaatgtttgcatttcccgtatcatttctaaaagagaagagtggctgtcatccccttgacagttggtgcacattagggggtcatgagtgtgtaagtggtttcctacagaaaccctggggcaacctcttacacactttcaaagtctagctcaagtgccagattctacccatgatgctcaacaatctttcacagtttgttcttccaatctagctctcctcttttgcatttatccactcatagacctctaactttcagtgtaagtcttgtcttatctacaagattgtccatttctcaaatctagtttcttctggtctgtaccacttaataaagaataggcacagaatattgatttgctggcttaacaacacatatatgtatgtcacagctaccacacagaacaacaaggacttaatgacaagtattccattgagagaacaaatgccataccctgtaacatagagattctcaatttttttctcaaattggaaaaaaaattgagactctatgctctttctttctttttattgttctgaagatttgagccacgtagtagaaagccacaaaagaaaaaaaaagttgcagtagtgcactgagagaaaatagctagagttattacaatggttcgtctattgagaaaagcccataattgtagtttgaaataaaaaaaaaactatgtttcctattgtcatatgagttcattaaattaatccatgccatggtctttgtagatgacaatttagaattatatttccaaattattatttgttgcatacaaatgttttgaccaggttatttaagccaatgatttatccatcgaagaaaaaaatcagtcattatacattttctccaaaacattttgtgatcttcatcataatgctatgtaatattatccctcttccatcagggagaaatccaaaaggaagtacacagacatgtacatagggcaacctgatgggatccttccttaattgaggtattttcttcccaagtgaataaagtagatgacgttattatgccattctgcccctttcaatctttgttacagaaacacatcacttgaagccataccttctccgtgtccttaagctcctacgttaacatcacaatgtgaaacagtgcaacattaaaagtcccacagtctttaacaaattccactgactccaggatctaagtactctttaaaattccaaagtgtcttacctgtggactcttcacatattttttaaagttacatactttattattccatgtgggaagagccatattaaagtaaacacaaaattcaaaaatataaatatcttaatatacaacatgatcttctatgatgcaaagggtttcagttgtctcaaatcaattctatgcatctgtcatgagcagcatacagagcatgtctggtatgttgaggccacttttggtccaggcttgctgctgtccttgtcaactatcatatgctaggatatccagtataactaaggctgcaccttcactcatgtcatgctggatattttcagggactgcaactctatcttgttgtgccaagccttggtttctctccatgacctcttcaaacctggagtttccactgctactgaagctaagcctttatcagtagtctctcctggaattctcacactgccaaagttcaactgccttacatgatctttttaaatcttcaaaattagtatcatgttgatgactcttacaagttaactgcagccttggtcccccactggaccagggctctgtgtgctcacctgagggaacaaatcctagaagatgtcaccttgatgatcccagccctagctaaccaacattgatttttccagttacacagaggcttcacttcaaagttgcgggtcccctgttaatcacagctgattcttcagcctcatctcaccagaaactacattcttaatttaaatatcacacaaatggccctgatatagtttttttccattgtctgcttgtttttcaacatccctagcttcttaagctcccacagaatagaataccagtctctgaactaagctctgaacattcagtagtttttcagccctagattccataatgctccacaactctgctaaagcagaatggtcagaatcatcacggaaattagggcactcaaacaagaagagttctccttatgggctttctcaactcagtttcttacacatctcatgcttttctgtcaacgagtagtaccacccacagttgcataggcacttttgtatcaattagtaaccaagaaaattctctagaacaggaccacagccaaatagaatggaggcaattctgcagttaacattccctcttcctcagtgtgtcaagttgccaaaaagtaaataaactatgacattcagacatatattagtttctagaaccttcgtattatattgcaaggtttattatattattatctgtagctcaagatcaagaactgagatcctcttctcttaaaggtcatttgtcacatcatgcagtgactgagtttgcatattgagttcttatcatcattctaccatcaattatctgtgttttagttcagactcagaagtcaaatcttttaatttctttattttttcagtcacatttgtctggatctctctctctctctctctctctctctctctctctctctctctctctctctctctctctctctctcctgtgtgtagggtccaaaaattagaatctgatgctttcactattgatctcaccttagttttaatatagagtctattgctgaacctgatactcaccaaattatcaagattagttgatcatcaagcatcgggagtcctctggtctctacctgccccgtgccaggattgtactgatttttatgtgggtacttgaaatctaactcaggtcctctttcttatatggcaaaaactttaccatattagtcacttttaattaataagggtgcttaaaccctgagattccacctcacactagtcagaatggctaagatcaaaaattcaggtgacagcagatgctggcaaggatgtggagaaagaggaacactcctccattgttggtgggattgcaagcttgtacaaccactctggaaatcagtctggcggttcctcagaaaattggatatagtactaccggaggatccagcaatacctctcctgggcatatatccagaagatgtcccaaccgataagaaggacacatgctccactatgttcatagcagccttatttataatagccagaagctggaaagaacccagatgcccctcaacagaggaatggatacagaaaatgtggtacatctacacaatggagtactactcagctattaaaaagaaagaatttatgaaattcctaggcaaatggttggacctggagggcatcatcctgagtgaggtaacccaatcaccaaagaactcaaatgatatgtactcactgataagtggatattagcccagaaacttaggatacccaagatataagatacaatttgctaaacacatgaaattcaagaagaacgaagaccaaagtgtggacactttgccccttcttagaattgggaacaaaacacccatggaaggagttacagacacaaagtttggagctgtgatgaaagaatggaccatctagagactgccatatccggggatccatcccataatcagcttccaatcactgacaccattgcatacactagcaagattttgctgaaaggacccagatatagctctctcttgtgagactatgccagggcctagtaaacacagaagtggatgctcacagtcagctattggatggatcacagggcccccaatggaggagctagagaaagtacccaaggacctaaagggatctgcaatcctataggtggaacaacaatatgaactatccagtacccccctggagctcgtgtctctagctgcatgtgaatcagaaaatggcctagtaggccatcagtggaaagagaggcccattagtcatgcaaactttatatgcctcagtacagaggaacgctagggccaagaagtaggagtgggtgggtgggggagtgggtgggtgagcgtgtggggggcttttgggatagcattggaaatgtaaatggaataaatacccaataaaaaaagaaaaaagaagaagaagaaaaagatgagtggaaaacacacacacacacacacacacacacacacacacacacaaaggctgcttaaatctatattactgcactttgaaagaaaaggtactattaaacatgccattttaatttagtaatatgaagaagagaagaaagaatagaaggaggaaaaatgttaatcacagtgaatagcatatttgctcaaatcttgttacactaacccttgggattttaataaaatttcataaacaaagaaatgcctgatgttttaaatagtcatctgaaacatacttttttattaataaaatttgtgtacctttatattacatttagatgcccagattcatggtctgatctaacttggtagtctcaaagcccccaatggtgctattttaaagtgttaagaaaacatggcaagtgccttatgactagatattaactgtaacttcccttgcttttatggctttaagccagattctgaatttcttgcatgttccttttgtatcactcactaagtagacactacttaaaccgcttgagactcagactcagcctacccaacctaccatgtattacccaattcttcagactattatatctcttagcttgtcagattcatcacagtagataacaacaacaacaacaacacacacacacacacacacacatatgcacacacatctctagttactactttaagtttaatttttaatgattttgacatacatatctcccctagtattcagctttaatgttgccccacttatgaattctataaataaataattgacatgatatagaacacatcctaatttcagctatctctgggcttattttacagatcaacctcagggtggttatatgtttatgacaaaggggaagactactgataattacatatctactttgccaaattataaagttattttcttattatccaagttgaactgaatcctgctttcaatctagaagtaattacctaggcagtgcaaaactgaactgaggtagactacattttgcattctgcatccatgaactgtcattaactgatatcataaatattgatatacagtataatactccaccaagtttattaaaagaataatttaagagtccatagtggttttatcatccagggttctgccattctcaaaagtgtgatgagtgtttccgtggttttcctagattttgtatttatgagttctttatggcactgacattattttatgcccgaattcattaacctttaaagtttctgatatggtacagcactattgtcacctctggtttttagacccacagaatgcatcctaaaaagaagagatgtaatggatagcattcctattcactggaagctgctttctttgaccacttggtctctgaagatcaatgttcaatgtgctagagaggacaaaactgcccctgaggtgatgtttttctgatttctttgttagagccccaaattataagcttcattctctcatcactgtgattttaggaaaagtcagtaaccatagctttactgtaaagactagagaaataatgtcactatttaaagaatagttgtagtacataataaaaggtaatcatcacataatctggccatatcctaatcaagcttattctctgacaaaagcattccttaatggcagttccttgtagagatgaattcttctgtgtgattctgttcagaagagcatagaccattacatacacacacaccttttcaaaaaaaaacaaaccttttgctccttttgcagctcaaagtgtgatataaatagtgaggcttctggtgctaaccaatgactttggaacaaatgaagctgaaactagatctattataatattgattctggcctggaataaatgtttatgtccttgaaataatttgttggtggttgttcattcattattgtccttgtatattaaataaaaagtcctttagcctccttcaagttcgggatggactaattagccattttgtaaccactatactacagtattttatcaagagtaattaatttatagtcttacattgaaatgtaattaaaatgttgttgcaagtaggttttagtccctattcagcaattgctgttactctgtatatgaattggatggtaaatttcattagattgtttcctaggcaaaagatatcctccaaccacatagtcaaagaacaagtaaccaaatttacccctttcttatgtttgagaatataaagatgaatatgctccattttgatttgatattatgtttttatttccttaatgttgtatttatacttaagtacttctaccttaaacacttaaaaagcaataaggggaggattttgttataattgaaaccaacattctcttattttgtttttcatccatcaccgtcaaacacaatcacaatcaacccaccaatctgtatcccagtgctacttaaaagtaaatttcaggatttaaaatgtatcctttctctgtcacacaacacatgtttttctatgcctgcaatgctcaagttattgtgctaaatagaccttatggtgttatttgagatcacagcaagacacagacaatctgaaattagttggattaaaatatttaaatatcagcttttgagcagaaggaagccatattgataatgaaatatcagtaagcattgtgcatttccacaaatataacagtaaataatagtgaagagagaaaaatattttctgaaatagtggcttttttagaattttcaattgcttgactgacagccctttaaaaataccaacagacttttctggaaatgtttgcgtaatcatgtgattcatattgctagggttattctctttcccataggaagcatattacctcagaatcagaataagaaacactgaacggtgtttgtgatgcatacttcaattttaacgcacttagtaaattaagctgaaggaattaaaaattaaaaatcagtgatagttgttccatggaagttatctaaaatatttgataacaactttagctctttataattcatatgagatttcatctgttttgtgttggtttataaacctttttgaatttgtagaaatgaacttttgcatttatttatacatgtccaaatctccacattacacatgcatacatacttgcatacatgttgaaataaaatttagttgtacacacatatatgcattgaaaggcaggtggtttctattgaaatcttgtaggcataatgaacttcataaacacatgcatgtatctaactcaactattaattgttgattgcttaaagaatagcccagcaaatttctctagaatagttatctcacattttgaatggggaaaagaaagatcaaaacatacctgcttgtttgaacttgtttgtagaaaagcacagcaggcacttagaatcaagtcctactacacttagttcataagaatagatgaataatcctaatgcaaggataggtaagtcaataatagcgactttagaagctgacagaccaactaacatccctacattagaaagctaggtatctatccatttggttacattgtatctgagcatgtgcaagagtgccactctaatttcatttgcttacaaaactcttctttactcacttatgtgagcctgtgataggatttttaaaaaaatataactcaggctggattaaaattcatgacctctttgccttctctttagttctggaattgtaggaatgttcttccatgccagcctctctaactattttaccaaggtttaagatcattgaatagccacccagctgtatgacttttcctggcacaatgtgaactaatgtctgttcattcaaatgataaatcaaaaaaattatgctggaacaatctagcttcgtgatccacttaatttactgacgttcttcaccggagagtgggtgaagggttactgacaggaacatatgtggctcaaggatagtttaatggctaaatacatcccccagcatgctaaagctgcatgcctggagctctctgtccaactttcatgtagctcagctagtcagaaggtctcttgtatccagaaattttattacttataaattcttaggaagggaccttggaaatcatgtaaatttggaggactacctgatacttaagtgttgtgcactttctgagccttgtaagttttgtttacttcttgagtcttagcatcttttcagggtagaatggtccaattctcatatagttgctatacatagctttttcaagtgattgctcactagaggaatcatttatttccatttaattatcactatggtaattttctaatcaccaaaatattctgtcctaggtatgttgacaggaaattgggactaggtaactaagtattcattaagtctaggtaagcaagtgttacaaactttttaggttaaaggaaacctgattatgtaaggcagtatacatctgatgttttgatattgtctgttttttaaactaaatttcattttagagaactaattcacttcttttacatcagcacttgttcaatatttcttcaagggcatttgcttaaatgtcaggctccagtagcacactacaaaaagaagtgtttcagtgtctaatgtcaaataagtttgaaaagcaatcgttagcaaataggttctgagtattcctataaatatgaacctttataaattaaccttgagttttccctgactgatcaggttatgaaaattttatcccatatgtcaagtcttaaagtcctaattcacagaaatctcttcagtacattgttcaaaataatacatatttattaaagtaattcaaacccatattggatttttggaatcatatcaagctaatcttgactcccttagtcctattatttagggcaattgctattcatgtttttcttggcttggtttctgaaagttaactatcagtctttttcttctccttctcctctttcttctcctctttcttctcctctttcttcttcttcttcttcttcttcttcttcttcttcttcttcttcttcttcttcttcttcttcttcttcttcttcttcttcctcttcttcttcttcttcttcttcctcctcctcttcttcttcttcctcatcttcctcctcctcctttttctcctcctcctcctcttcttcttccttatttgtatttgatcttctggatctctcctactccaatttgaggttttgaatccgggtttgtcctattatgcattcatcatcaatttgggatgttgcattctaaatttgcataaattgctgaatagaaatgagaaacaagattaggcaagattggtatcatttatgaagcatcacactttgattcttactaataatctctttactcagaaacaaatagccaattctgctagtccatgtgatttgaaaatcttttatcaagagacagtttttcctctgtgtattttccatattttcctttactaaaattcacaacaatctagttttaaatatcctcctcaactttccataaaactgttgctttctcttttgcaaaaattaatattgctcaaaacatgctttatattttgcagaaaatattttgggatgttctatacccatagtgtctgcaatgacaataatatattttcatggtttcagtatatttgttttataattttttctctaaaatcatggccacatgaaattgtgtatagtaataaacatagtttgtaaaataacagatatatttaaatgtgtgagagtaaggcttgtaagtgaactgtttaagcatcatttcactttaaatatatgtgttaactaattttcctcaataaaaaattaaaagtagtctgttgttaattattgtctctacaaagaaagaacaactgcagtatattgttcacatttactttaaacaccatagtttaataagagtttgttcacatttatatacatgctaaggtttgaccccactctgcataccctctaacttcaatcttgaagaagaaattttgcttcatttgcaaatcattagggtactattattgacattttgaagctccttcttattatcagaactcctttaaattttcattgctaacactgacttagaaaagtagggtgtcggtagtgagagcttagctggaaactaaaaagactggaggtgatccttgaccccatgccacattctagcttagcgaccttgagtaacttgtttcttgtctctaaatcttgcttcatttgtaaaatggacatcaagatgatgaaggatgcctaattaatgggattttcttaaagctttcatgaagcgtattcaaatcaaacacttcccaagttaccttacatgcattaaaagttggatgagtaataatcacgcttttaaaatctataagtaaaacccctagaatttccacaaagtttgcatgttagatgtaaaaattttactcacacagagctctggagatcaaaaccatcatattttttaaacgtttctatttgtgaggactatgaattatattctgtttattcataaaaaaaatggcaggatatttaaattcacactatcccagaaaactatttcactttagttaccataccaataatgcccaaagcattttttccatcatagaatttaacgtaatgggctgaaatgcttaatataagtaggatgatagggcctactgcttttgtatgcccaagatgtggcctatatattttgcagaaaaaaaatgaataaaatgaaccagtggtgtgttcctactggacacataactattctgaattatcttacatagaattatatatatgtctgtataatttttaaagtttatagcatgattctgaatcttttcctttataaaacccagtttaaatcaacttttgtttgatcttttaatttttaagtataatcataattaaaaaaaacacaacatcttataacatagctcttaattgttagtagatatggtcctatttaaatattagaagaacaataagatttaatggtgaccaatactgtaaagatatagataaagagagcagactgcctcctatgtgttctaaagcaacagtctaggagaaaaattcagtagtgacactggatagtcattaggacctaagagctggatgaacaaattagttttactatcaggagaaggtaggacccttatattagttctgtagtttattaataatctacactcaatttactgtgggtcctttgtacttgaactattagacagtggcatcttatgtaaattcattcatccaaaggagctatcccattctattttgtgcaaaggtacctcatggagaatgaagagctgaccatcagcctctacctaacatttagttttactgtcatgtgtctttctactgtattgcaaaggaacaggcctcattaatagagagcttcttaacttagaaaagatggtcttgtctttctgtgaatactcttgtttccttaatatttctagaaaatttgaaaggattattaaagtagtggtgtaatggaaataacaagtactctatagttagaaaaaatagtgttttaattagaattctaccatttacaagctttctgatattgaatgcattaatggaaaatttagattgcataaataagtctcaaactttaatgaaatttactacatgaatagaaataaataaattgatgttcaaagcagtatagttatactacatataatattcacatgaggtaaaaatcatctctaatttgtatttactgacagaatttgtatatggtgatttgcaattgtgtgtagtcaagaagatagagaatcacttattatataatgactaccttttggccttagatgaagtgagcctcattatatgatctgtcctattaagtgcttaagcttcagagagaagatgccctgcactgcttcattttgaacactttaaggcatgagacaaatgagatcacacaaatcaattgatactatttccattttgaaaatacattttagaaactgattggtactctacaaggaaagtattagtattgacatttcatctaaaaaatggttcgtggagaagaacccattgtgtattgaatatacttatcaacattatcatttacacagagatggagagaacaaaaaacctctaagtagtttttctttccagactatgaagtacaccatagattatgcagtggttagtcttgcataaagtatgtggctaaaatcatgcaaaaatagctaaagactaagtaaaatcaaaatcacattccagaaatgctttcataattgaaaatgacacccggattatggcaaaaatctctctggacagtgcatccttttcattataagcaattttagtaaaataacatatattttataatttgctttgtaattcacatctttaatttcactctgtatctgttctttattattttctggtggaacttggatcaaaaccgatataagtatttgatttccctggttcacaaattcctactttgtagagcactttgctcccatattagaccatagaatgaaactttattcctacattgatttttcttgtatacatattctttgatatcacatctgctgtagaattttgattccctgaggagtactaattttcatttggcttcttctatgtctttggatttttgttattgtttccattgatgatatttttgggagtaatgttaaattagttctacaacaatttggctgctataaagtctgcaaagcattaactgcagagggaaatcaatataatagtaataatcttataaagcatgaacaccttatcgagtttactatggcctttccctttcttttacttgattgaatattttctctctcttgagatctttaaattgacaaattagttgagtatacatgtttttgctttgtagattattgaagattccccattctagaaagttttcccatgtgtttaaaaaaacatttatatgcatggaaaacataattcaacaattgattaaaatacgtggaattctttatgagatatctttctattaacagagtgatgtatgtttgtttattccaagaatgaaggaaagcaaaatacctttaaacatacactgttgaaataactacagttcatcatttttcccttagacgaagtttaaggtttaaattatagagctctatattagacactaaggagacattttcctcttttgttttatagaagaacattggtgattgtataaatccatattgcaaatgcacaataggctgaacctttgatctagaaagtgggttttttttgtttatttttgttttgtttttgtttttttagttttagggtgtgtgtgtgtgtgtgtgtgtgtgtgtgtgtgtgtgtgtgagagagagagagagagagagagagagagagagagagacagtgagagtgtgtgtgtgtgtgtgtgtgtgtgtgtgtgtgtaaatggagcaggttcctaactgactgtgtttggatgctccccagatcagttcttcttattctatggtattattaaataagcacatttaggctacaaatttttccattatttggttatattataattcaaggtgtccattgcatacactagcaagattttgcggaaaggacccagatatagctgtctcttgtgagactatgccggggcctagcaaacacagaagtggatgatcacagtcagctattggatgggtcacagggcccccaatggaggagctagagaaattacccaaggagctaatgggatctgcaaccctataggtggaacaacattatgaactaaccagttccccggagctcttgactctagctgcatatgtatcaaaagatggcctagtcagccatcactggaaagagaggcccattggtcttgcaaactttatatgccccagtacaggggaaccccagggccaaaaagggggaatgggtgggtaggggattggggggggatgggtatggcggacttttgggatagcattgaaaatgtaaacaaggaaaatacctaataaaaaaattaaaaaaataattcaaggtgtctaaatctaccttgggattaggcatttttttctattcctcgataattagtgtcttttgattttatacctaataaccgtctttgactgtgtcatcttccttcacagaaataaatagtcctcagcttgcattatctctgtgttcaaaatatgatcaaatgatcaagcatttttttttcatttccttctgttttggaatagcaagcctgtttggccaatatttctttctttacacattcttagtacagtcctcttgactcaggctgtcatcatctgtcatctgttaaccatcactgtcttcaggtttgcccttcagtctgccagtacattttccacagtatacccaaaccaatacactataagattatatcatccttttgttttcagttcattatttgtagattaaatctaaactacttaacacagtgagcaatggcttccaatttacacatgttatagtctcccttcctacaattctccttatggaaacattgttaccaggccacactgtcttctttcgtatcctgatgactcccctgcccagatggctgtctattcatttaacctagaatgttgtaacaacattctaattatagtgatctcctgtaatacctagttgaagcttctatttccatacatgcgtaactagcataaactcctgtaattttcctggctctctatgcatatttttgaacagcatttctacattatgtttcagatacctgtatttgcttctctctctactaccatagtcaatattctaatttcttcaatttcctttctcaagttattactgcaatgccatatacaaactggatattccacatatatcactacatgaataatgaaaaaatgagaaatgaatagtacaggtttcatttgatatagtcaagcatagcttgaagccacaaactttaaacatttgaaaacataaaacattacaaaatgcattcagagaaagattgcttggataatctcaagtaattactggatccctaaacccatgtagtacttgagactttggtttgctatgtgagaaagccatccacagaatgaaaagcaaaggatgacaataacacgattttctgtaccaacacacaaacatatatacatgcacacatccacattctagggtctcctgatgtaccttctactgtctaactcttccaataaggaattttcaggagggacttgctcagtatttaaatatatatgtcagtatctttcccagttctccttccatgggagatgcctaagaaagatgtccaaaggaaaatgccaaaactaaatttctcccactgctaacactccctctaatatcctcccatttgattttatcttttacagtgttaaaatattttcttgaattaaaataatattggttattttacttatttacaccttttactggttttttgagacagggtttctctgtatagtcctggctgtcctggaactcactttatagaccaggctggcctcgaactcagaaatctgcctgcctctgcctctgctgggattaaaggcatgcaccatgcctgacacttatttacatttcaaatgttatctaccttcccagtttccacttcacaagccctctatgacctcctccctcctccctatttccatgagggtgctccaccaccagtccacccactcctgcctcagcaacctagtgtttccctttccagggccattaagccttcacaggaccaacgacttcccttcccagtgatgccaggttaggcaatcctttgctacatattcagctggagtcattagtaccccttgtgtaatctttggctggtgctttggtccctggaagctctgggggttctggttggttgatattgttgttcgtcctataaggttgcaaaccccttcagctcctgcagtccttgccctaacttccccactggggaccccacactcagtttaatgtttgcctgtatcctaagcacttcttggcatcagcaaaagtgtctatgtttggtgtctgcataagccatggatccctagctggggcagtctctggatggcctttttttttttttttcgtctctgctccactctttgtcccatgaattctggattaatatttttgaggtggatgtgtggccccattcttcaaccaggggttgtgcctatctactagatattgtctctacaggttctctctcccctttgttgggtattttggctaatgtcctccatgttgggttctgggaacctcttgggtccctggcatctgggatttcctagtgaccatgaactccccgtcctgcactgctaaacatctgctttcagattcctgatcctctgtacttctcccccatctcctcccacatttgaattggctcaccttttcccctccttctcctctcgtttttccagataccattctccctctacttcccagagattattcttttccccatactgagtagtactgtagcattcacactttgctgtgatctagtttctttttgggtttcatatggtctgtgaattgtattgtgggtattctgagcctctttttggctaacatccatatcagtgagtatgtaccatatgtgttcttttgtgatggggttacctcactcaggatgatattttctagttccatccatttgcctgtgaatttcatgaagtcattgtttttaatagttgagtagtactccattgtgtcaatgtaccatattttctatattcattcctctgttgagagagaggttctttccagcttctggctttatgaagaagtctgctatgaacatagtggagcatgtgtcctacttacatgttggagaaattttggggtataggcccaggattggtatcggtgggtcctaaggtaatactatgcccaattttctgaggaaccatcagactgatttccctagtggttgtaccagcttgcaatcccaccaataatggagaagtgttcctcttcttccacatcttcaccagcatctgctgtcaccttactttttgatcttagccattctgactggtgtgaggaggaatctcagggttatttggatttgcattttcctgatgattaaggatattgaatatttctttaggtacttcacagttgaaaaattctttgtttagccctgtaccccatttttaatagggttatttggttctctggactctaatttcttgagttggttatatatattggatattagccctttatcagatataggattgataatgaccttttctcaatgtgttggttgccattttgacctattgacagtgtcttttgcctcacagaaactttccaattttgaggtcccatttatctactgctgatcttagaatataagccattcatgttctgttcaggaaattttctttcctctcagcccatgtgttcaaggctcttcttatctccttatacaaacttcaactcctagtgatcaaggacctccacataaaaccagatatggtgaatctaatagaagagaaattggaaagaacgttgaattctttttctttttcaaaagtttttaagtagacttagtggcaaaatgtgaaccatggcatatggtttaattatgagcttgtaaactaaatacagtataagattgcctacttaacgtttatttatttctttatgtgataattaaattatgattgctcaccatgtgccgaatcatatagcatacaaaaatatattcattatgccttcatagaataatatattccattattaaatttaacttcataccttctatattttcattttaaacaattacttgaagtaaatatggagaatagcaatgaggaatgttagttgttcctaaagttcctaaaacttttgtcttttgatgttagtttgtgtgtgtgtgcatgttatatgtgagtctatgtgttcctgtgtatgtgcaagagtactgggggtatgcattcatatatgtacctgcttgtgaatgtcagaagtcgttattggtatctttttcaatcactctctaccttattttgagacattatctctacactgaatctgagattcattgattatggattattcaggattaattgccaagaagctacataaggtcctcttatttccaccttctgagggacaagataccaggtatacctcacaattcaaagctttttatgggcaaggttggggcctaacttcagaccctcttatctataaaacaaacactctactgactgagcaaactatccattccaataatcaataatatgaaaggcaaaaatattaacataatatatgatcatagataccaccaagaaatttgagaaaatgtggttttacaaaataattggttgttctccaactaccaagtagggtaacttctgtatttgccaggcactggcatagcctcacatgagtcagctatatcagggtcctgtcagcaaaatctttttggcgtatgcaatagtaactgcgtttggtggttgattatgggatggattcccgggtggggcaatcttggatggtccatcctttagtcttagctccaaactttatctctgtaactctttctatgtgtattatgttccctattctaaggaggaatgaaatatacataaaatattttttagtaaattaaactctaaagtgattaggtatacttctttgaacagatttctttattattgggatctcatgtaagtatgatatactcatctcagttacttgatgtattcttgttttgttaattccatagtttaggaagtgttccatattcactatcatttttctatgttgtagcaccccctccaggatagcacattattgcttgttgtgatgtctccttaggcagtttttaaatataatgatgcgttcatgctaatgactttggaagtttaatcactttgaagtaataatagacagaactttggaagaatgatcctcagatttgtcttctgttgtcttatgattagaatgttcaatggctttatatattgtcctattaagactcaatattatcaacatgtcatcatcattaatattgttcttgcatcctaagactgaagtaggattttccttattttccacagtgaagttgttcaactccttcttccttttctatagaaaactcattagaaggaagttttatatgtactttatacataaagagcagagtgttccacctgatccccttaaagggattgtatttacatacattatttggactaatccatggaagatttgtatgttttccatttatatatttcttcctcgatctcttgtatcaatacggaccaatgagtaatttttttgataaaaagttttatttctatacatgcatatgagttttgaattttaagccaagtgttctctaataaaatattaaacagtaaataaaatctccataagtgtcctatagtccatgagttggaagagagatgcttgaatgtgcttcaggtctggaaggttaatcattagtggcagacaaggtatcacagctggactttcccaaagagcttctcagactaactgcaagatttcattagtgaatacacttaccaactgtgtcaaggtttaggtgtaatcagaggagagatgacagctttttgtttccaacattctaccttcttttgcatcccatttaaacattggaaacacatctcctgatgtatttgcttatttcattgagagctattctttttctttcccatgacaaagtaataatccccttgagatattttccatgagtcctttggaaaacgtggttgtagatatacccataaatattcacttgtgtactttctgcttctttttgcataatatttatttttattagatattttctaaatttacatttcaaatactatcccttttcctagtttctgctcagaaaatcccctctcccctccccgctccccctgctccccaatacacctactattgcttcctggccctggacttcccctatactggggcatataatcttcgcaagatgaagggcctctcctcccatttatggccgactaggctatcttctgctacatttccagctatagacacaagctctaggggtagtggttagttcatattgttgttcctcctatagggttgcagaccccttcagctccttgggtactttctctgactcctgcattggggaccctgtgttccatcctgtgagcatccacttctgtatttgcccagcactggcatagcctcacaggagacagctatatcagggtattgtcatcaaaatcttgttggcatgtgcaatagtgtctgggtttggtggttgcttatgggatggattcccgggtggggcagtctctgggtggtccttccttcagtcgctgttcagaattttgtctctgtaactctttccatgggtagtttgttccctattctaagaaggggcaaactgtccacactttggtcttcttttttttttttttttttttttttttgagtttcatgtgtttgacaaattgtatctttggtattctaagtttctgggctaatatccacttatcagtgagtacatatcatgggtgttcttttgtgattgggttacctcactcatgatgatatcctccagatccatcaatttgcctaagaatttcataaattcattgtctttattagctgagtaggactctattctgtaaatgcaccactttttttctttatccattcctctgttgaggggcatctgggttctttccagattctggctattataaataagtctgctataaacatagtagagcatgtatccttattaaacttgggacatcttcttggtatatgcccaagagtggtgttgctgcaccgtcggatagtactatgtccaattttctgaggaactaccagattgatttccagagtggttgtaccagcttgcaatccaaccagcgatggaggagtgttcatctttttccacctccttgccagcatctgatgtcacttgaatttttgatcttagccattctgactggtgtgaggtggaatctcaggattgttttaatttgcattttcctgatgattaaggatgttgaacatttgttaaggtgcttctcagccattcgatattcctcagttgagaattctttgtttagctctgtatcccatgatggatgatcatattattgtgttcttggatttggtttgtgagaattttattgagtacttttgcatcgatattcataagggaaattggtttgaagttgtgtttctttgttgagtctttgtgtggtttaggtatcagagtaattgtggcttcatagaacacattgggtaaagtaccttctgtttctattttgtggaatagtttgtggaaaattggagttaggtcttctttgaaggtctgatagaaccctgcactaaactcatctggtctttggcttttttttttttggggggggggttgggagactatttaaaaaattttattagattttttttcatttacttttagatgctatcctgaaagtcccctataccctccccctgcccttgctccccaacccaccctctcctgcttcctggccctggcattcccctctactggggcatatgatcttcccaagacaaagggcctctcataccattgatagctgactaggccatcccctgctacatatgcagctaaagacagaattctatggggtactggttagttcatattgttgttcctcctatagggttgccgagccctttagctccatgggtactttctctagctccttcttgagggggcctgtgttccaacctatagatgactgtgagcatccacttctgtgtttagatagttaatctgatcctgatttaactttgctacctggtatttgtctagaaatttgtccatttcatccaggttttccagttttgttgagtacaggctcacaagatacagctatatctgggtcctttcagcaaaatcttgctagtgtatgcaatggtgtcagcatttgaaggctgattatgggatggatccctggatatggcagtctctagatggtccatcctttcatctcagctccaaactgtgtctctgtaactccttccatgggtgttttgttcccaattctaagaaggggcaaagtgtccacactttggtctttgttcttcttgagtagttaattagaatactgtccctgtgccctctagttaatctgcataaaggtttatctatcttgttgattttctcaaagaatcagctcctggtttggttgattctttgtatggttctttttgtttccccttggttgatttcagccctgagtttgattattttctgccatctactcctcttgggtgaatttgcttccttttgttctagagattttaggtgtactgtcaagctgctagtgtatgccctctgcagtttctttttggaggcactcagagctatgagttttcctcttaggactgccttcattgtggcccataagtttgggtatgttgtggctttattttcattaaactctaaaaagtccttaatttctttatttatttcttcctttaccaaattatcatcgagtagaatattgttcagcttctatgtgtatgtgggctttctattatttatgttgttactaaagaaaatccttagtccattgtgaactaataagatgcctggaattatttcaatatatttttatctgttgcagcctgttttgtgaccaagtatatgttcaattttgaagaaggttccatgatgtgctgagaagaaggtatatccttttgttttaggatgaaatgttctatagatattcgttaaaaccatttggttcataacttctgttagtttcactgagtctttgtttagtttttgtttccaggatctgtccattgatgaaagtgtggtgttgaagtctcccactattattgtgtgaggtgcaatgtgtgctttgaactttaccaaaatttctttatgaatgtggatgcccttgcatttggagcatagatgttcagaattgagagttcatattggtagatttcacctttgatgagtatatttgatgagtatgcagtgtccctccttgtcttttgtgataactttggattggaagttgattttattcaatattacaatggctactccagcttgtttcttgggaccatttgcttggaaaattattttccagccttttactcttaggtagtgtctgtctttgtccctgaggtgggtttcctgtatccatcaaaatgttgggtcctctttatgtagccaatctacatctttttattggggaactgagtccattgatattaagagatattaattaaaagtaattgttacttcctgttattttgttgttagagttgggattttattcttgtggctatcttcttttaggtttgtggaagcattactttcttgctttttctagggcatagtttctgtccttgtattgtttgttgttttgttttttttttcccctccttgtgttgaaggtttccctttattatcctattaagggctggattcatggaaagatattgtgtgaatttggtttttttatgaaatactgtggtgtctttatctattgtaattgagagttttgctgggcatagtagcctgggctggcatttgtgttctcttagggtccgtataacatctttacaggatcttctggctttcattgtctctggtgagaagtctgatgtaattctaatatgtctgcctttatatgttacttgaccttttccccttactgtttttaatattttatctttatttagtgcatttgttcttctgattattatgtttcaggaagatttttttttctggtccagtctatttagagtcctgtaggcttcttgtatgttcatgggcatctctttctttacgttaaggaagttttcttctataattttgttgaaggtatttgctggccctttaagttgaaaatcttcattctcatctacacctattattccttagatttggtcttttcattgtgtcctggatttcttggatgttttgagttaggatgtttttgcattttgcattttctttgatttttgtgttcatcttttctatggaatcttctgcacctgagattatctcttccatctcttgtatcctgtttgtgatattccatttatggttcttgatttcttccctaggatttctatctccagagttgtctccctttgtgttttctttattgtttctacttccctttttaggtcttggatggttttgttcaattccatcacctgtttgggtgtgttttcctgtaattctttaagggattttttgtgtttcctctttaaggacttgtacctgtttaatagtgtcttcctgtatttctttaagtgagttattattgttgttcttaatgtcctctaccatcatcataagatatgattttatatctgaatattgctttttggtgtgctgggttatccaagactctgtgtagtggaagtactgggttctaatgatgcctggtggtctttatttctgttagtaagattcttacatttgccttttgccatctggtaatctctggtggtagatattctatctgtctctggctggagcttgttcctcctttgagtctgttagtctctgtcagcactcctggttgaccagctctctcctgagtcctgtgggtcagagcactccctggaagccaaatgtcctctggcattgaaggtgcacagaggactgaggatcagctctgcctcctggctgaggattaaggcccaaagggaccctatccaagaaactctgttgccgtgcagacccacctcagagagaccctgatagaaaatgatgatcacacctgagtcctgggtgtctgggcactctctgtaggcaagctctcctcaggcacagaaggtgctcagaggtctgaggatcagctctgcttcttgtctgaggatgaaggcctgaagggaccctgtcgaaaaagctctgttgctgtgcagacccacctcagataaaccccggatagaaaattaagtaattattttaaacattggcttttcatccaacatcaccatatttcttttgattctacattttgtcagtgggaactctttcacccagttcttgtcttccttggttctatctttatcagtgtaggactttcaggttttatttgagtatttacaaagaatgctccaggcttattttgtatttccacatctttattttaatctcctcgatcttcatagaaagtggtagaagattacaaatggccagaaaaacctgattaatggcttagaaaacttgtataacctcgtgttttgactagactctcatctataacttcacatcatacttaataaggattttctagtgtttcacactgttatctaaatgaaacttttctaggctacagaatttaaaattattgctgctggtgttgataaatttatagttttcaatggattttaatgaactgaatcaacatttttctatagatactaactggtatatagataacataaatataattattgaagaggtatgactatatcatcttattatccttattttgttttctgtttaagctattaaaatatcatttagataatacacattttatgtaaattatataatttatacaacctatgataaaggaaataatgggtattcagtttgataactaacagttatttttaataaaacacttatctgtttatagattctgcccgtgtataaccacattttgttattttacacataagtgacattagaagtgtttgtgatattataagttctcttctaagttcttgtcagcattttcattataaatgtatttttcaaggacatataatgtctcctctgaaatttcatttggggtttagacttgccaaacacaattgaagactgcaaattttcttttgaaaatttaatcagaatcattgttttgtccctgtgctttgacttgaatgatagctgctttctttcttcccgtgtcttgataaatggtttctctcttatcgggaaatgatgacttttgaatgagaacatggccttaaatttctccatgtttgataggttgtgtgtaatatcataactctttcattctatggcaggcaacttcagcatatatgttccatgacagtagatgtttcttcttgttgtttcattaaaaacctgctaatattgtccctctgggttatgcttcacttctacgttgacgtaccagcaataaccagctagaaaacataaatttgataaaatattcaacatagttgacaacatattagtaagagaaattttaacaagaaaatacacagtttatatattcttgaaaataccttaagtaccacaaatacaaaatttgaacagaaaggtacattatgatctttgtagactgcatgaaatttttaaatatttccctttttccagtttatttaatttataggcaaaggacattccaaattaattcatacattttatgtaaaatcaatcaaaattctcctttaaaggtgttataatgattttagaagaataaacagattatccatataaaatatatttcagaaacaccagtaacatatttaagatttttttgttgttttttgctttgttgttgttgttgttgttgttgttgttgttgttgttgttgttgttttcaagacagggtttctctgtatagccctggatgtcctggaactcactttgtagaccaggctggcctcgaactcaaaaatccgcctgcctctgcctcctgagtgctgggattaaaggtatgcaccaccatgtcaggctatatttaagattttaataattggaaaagtgtataagaatgaagaagtaaaattaattgaataaccatgaaaattaatttttgatgaatgaagtatgatgggcagccgaattaataaataatgtgtggaaaaattggtctgtaatgttggaatataccatagaatccaaatgggagtcctaatatcctctgaagctaaataaaatttttgacttaatttagaactaacagttgaaatgtttaaactaagatgagccaaacatttaaattgaattcaagttatgaaaatactttctattcacaagcatatcgaaaaacccacagaaacggaatgatgctgtaacaaaaagttttacataataagaaaggatcaggctgacatggtggaacacgccaccttttgctcctttagaaggagcaacattttcataatattgctgaagaataaataacaatatgcataaagatgcacaaatattattaaagtttacaaattagagacccaatcagattttgtgtaaacactttccattaccttgataagtgttaaaatttaagtgatggtcatttagaatctctgacaacattgtggtaaatgtattatgacacaacagtgtattcttatttacaatcatattgcatatatgatttcagctatttgagtagaactctatactcataatatttcattattcaatcttgtcaaagaaaaataaataatatattactcaatgagagttcacaaaacttctaaaattgcacagtcactattccttgtcttatgtcaggaattttagcctagaaaataaatagtgctgttaaaaacaggtatcaagtcacagttgccaagctcttagagaacttaatggtgcaaagaactcagaaagggcatccaacaaaacattcagcttccactcacatgtatgtatatcaaaagactgattcacatttcaaaaattctctccccttgaaaaatgtgtcacaatttgctccttcatgtttctaattacttctccgctgtcctgttaagtttacatgtaggtcggggaaaccattctctatcatttaaaatggtttccatttcaagttaagatagagaatctatcattaggaatgcagtgaacctacatcttgggggtcagacacacttttcgctaccagataactgtgcagttttaaccaaacagctttaccactctgagacttggttcttataaaggggcaaaacatatctaagttacttagttcattgcctagtatatagtgggctggaaatcatagctaatattattattattactattatgtataggaagcttgggagaacaaagaatttctaaagaaatactgttgctttcaataaaaaaggtactttaaaacttaatgctaccagaggggcagacagaatatagagtatcagctgagctggcagcctaagtacataagatacctaggaatgaattagttctcaggagacactgagcaagtcacacttaagaaccacgttttatgcactagtgtctagcacagctcaataaagaatttttgaattgacaagtcgacggctgaagcataagaagttaaagaacctggtagcctgagtataagcaattgagtgcatgtgtttccgaagaaaggatatgaatatgggcaaaaggaaaagtggatcagacaaaaagagaagacacagccttctacagtgattgaaactttggctttatatcccgccaaagcagctgtgaaaggaaatatgttgattcacagataggcttgataattttccctcttcacctctatccttctaataaagaaaattagtgacgagatgaaaaacaaaagataaccccagagagctatttctgaagtctgtgtaggaccagcatttaggctcacagagcaatagaacagtggcaataatgacctattttctgagacttaaaaagggacacatgatctgaccgatgttatttttttctagaacaaggatgaatcatgtgaatagtctgtctgtctgtctgtctgtctctctctctctctctctctctctctatatatatatatatatatatagatagatagatagatagatagatgtagatatagatatcatctttaaatgattcatcattatcagaaatgacatttttctgaattaggcatattctaaatatatttgaaatatatgagcaccatgacttggagaatcttatttaaatacaataatttttaaaattagtatatatgaaaaggctcttttcaagtacaaagaaaagaagaaagaacagaaaaattcacacaataaaaatttaactaatctcatgaattacagattgaaatatatgaagcatttatattcatagccacatacagcttttggacaagtcctgtcaggatataagattagtagtgttttttttccttcttttaaatagtcattaccagtgtacagaggctcaggtatagaaataaagtgacatgttctgcctcatatattgtaggaggatcagagtccagaagatgtaggcttaagaagacatgattaataagggtccaaaattaaatagagcttccagaaatttaggaataaaaacaggattagaaaggaggattataggcactctttgtacttaaagtatgacagttttttgtaatatataaatatgacctgatgcaattactaaatgtgagatcaatgtttgtggaaagattttagaatataatgggctttatgaatgagcaagggtccacatagtcgttggtttgaattagaatagaacaaaaaatttccaaaaatgaacgtgttgcccaccactattcattcacacaataaatatttttagtgtacttactacattttcgatcatgtgctacacttcagatatgtgatattgatgtagactactcatatttctgctgtattacagcttggagaattattgggaaaaaaaaaacaacacatgattaaaaacccaaatctatgggaggcagaggcaggcgaatttcttagttcaaggccagcctggtctacagagtgagttacaggacagccagggctacacagtaaaaccctgtctcgaaaaaaacaaaaacaaaaacaaaaacaaaaagataaaagctatcaataaaaatgaaccaagatcaagacaaggagttgtctatacagcaatatattatcaacgattttgaaataatttttttctccaataaggtaatagaaatataaagttcaggtatatactctatgaatgggtaacatttatgattgattaataaatggacattgcctggggtaatactaagcatggagtatcagaacagatagtgagctggtattctagcaaaatgaaagagacataagagccagtcccctccaggaaggaggggagtaatcataggtcaatgtaagatatttagaatgaaataaccaggtaaagggctcttgccaaagtctatatatctgatggtcttgtggaagcaggacacaattgtggatatgaaggtgagtgagaagattaagaatttatcttgaaaacagactccacagaacttcctagattgggagtatgtgacacagcagaatgagtaaatgaagtcaagatttgggtttcagtacttgagcaagtaatgatagcactttcatatattagagttgagacacctagggagaaaatgaagaaacaaatttttgatgtattcagtttcagacttctatgctagagaaaagtggaaagtaaaagtagctatggattcatgggtaggacattaaagacactgttagaactaaatttatagtctgaaaatatacttattatgtacctctcctgggcatatacccagaagaagttccaactggtaataagaacgcatgctcaactatgttcataacagccttatttatactagtcagaagttggaaagaaaccagatgtccctcaacagaaaaatggatacagaaaatgtgatacatttacacaatgcagtactactcagctattaaaaacaatggatttatgaaattcctggacaaatggatgtatctggaggatatcatccttagtgaggtaacccaaccacaaaagaagccacttgatatgtactcactgataagtggatattagcacagaaacatagagcacccaagatacaatttgcaaaacacaagacaatcaagaacagggaagaccaacgtgtggatacttcattcctccttagaatatggaacaaaatacccatgaaaggagttacagagacaaagtttggagctaagacgaaaggatggactatccagaaactaccccatgcggggatccatcccataatcagccaccaaacccagacactattgcatattccagaaagattttgctgaagggaacatggtatagctgtttcctatgaggctatgccagtgcctggcaaatactgaagtggatgctcacagtcagaagcttgagaaagtctgtaaccctataggaggaacaacaatatgaactaaccagtacccccagagctcatatctctagctgcatatgtagcagaagatggcctagttggccatcactgggaagagaggccccttggtattgcaaactctatatgccccagtacaggggaatgccagggccaagaagcggggggtgggggggtgggtaggggagttgggcagagggagggtataggaaactttcagtatatcatttgaaatgtatataaagaaaatatctaataataaataaataaataaataaataagattgggaatggaaaagaagtagacaatgtacagacagggattactactaggttaactgagaaacaaagcatgatgggaaaagcatctgtaaggggacttagggaagctgttgggatccacagagtttagagattatccacattttgcaagtttatggctttaatgtaaaaagaggagtggtggtggtgagatcagaaaggtgagaagagatggggatgagagggaagtataagggcatttgttggaagtagagggaacataatagcagactaggtggaaagcctacagagcaaccatacaccttgccaagcaaaataaaaactaaaataagctcagtaaaaagattttttttttgcaaatatgaaggtaaaaaaaaaatgaaagcaaaaattaaaagatagcaataacaacaacacaagacaaatcccattagtgttcaaacaaatcaacagggctggtaagagagctcaatggggagaggtgcttgaaactaagcctgctgacctgagtttgattcctgggccccacttggtagaaggtcccatttgacccccatatatgtgcattgccacctaaataaataattgcaataaaaaaagaagaagaacaaggtgtttgatgtgagagtgcagtgaataaaggagatcaggagagaatttgttaaaagtatattatattttgtaatgaaattatgaatatatttaaaaagatgtgataatccagacaataagtataaatgtagaagaaaccaaaaatccaaatatatcatcagagtcctaccaccaagattttttcctttcaaaaatattttgagtgtttatggtatacttgaattttcaaaagtccccagggaaaatggagaatcataccaataaagctcttgccttttaattacttgctgataagcaaatcaaaacaaagtgtatcaaagaaaaatagcttagaatgttggattctgtaaagaaaaagaataatacaaacccaatgactaataagcaagtcagtatgttcaacttcagccaaccaaatagaagaaataagcatgggtgtaagaaaataactagtgtagatcacaaaaccattgatgcatggaggaaatgagtaatagtcaccctaacttttgtagcaatatatttagtttcatagttttgtatattttgttaatttcactagtttcttgttcatggtcttgtggtgaaagtctttttttatatatccctatcagctggtcattctgtcattactaaaacaatgctttcccaaatttaatgagcaaagaaatcacaggggatcttgttatcattcagattctgattctctaggtctttggtaggattttagattctgcatttgcacatgctcctttccatggtttcaaatttgactagtatgtagctgaagaaccaatctggaaaacattagaaacagtagatctagggcattcacatatctgagttgtgaatatgtgaggtgggatagtgataatgacctttgcttttcatttcaaccacaggcagttgtcacaaattgcatcctgtttaaaaataatatttgacaataggtaggtggattttaaaagtagtaatataacaaacacatgattctttcaatgttgtcctgaaacagatgtgaatgcacagatgtctactacaaagagagcttgaggggaaagtctccaatgagcaatacatcccatttttatcattttctctttatgatgttttcttttctgcattccacgaaaatgacataatgggattttattgtagcctgcctggatggataatacaaaggagaaataatgtagcctagaaattattctcacaacaaaaaagtttatctgagaaatgttgatggcacaatataactaaccattagaagtgaaatttgagcaaggtaaaaaaataattcaatataaattgtgtattgtttatgaaagatacttgtaatatacagaaagattttcactatgagtcctgagataaaaatgtggccttcaaatatattgctttaatatgactagcatattacattgaagaaactgttctttctcaagatgttgataaatacacatgtaaacagtgtattcagatgatgctgggaatgttaataaattcatcttttcctcctttgcttttacactgtgatccccattttataaatgagacacagaatttaattttgttattttagatgatgaatttattatctattttagtgacactttttcatgataagctcatatagtattccattcacagcatgttaagcattttgtctgtacttgattgattgatggatgtatggatgtatgtatggatggatggatggatttgtatgagaagcagtatagcaatgtgtgttcagagtgtggattttagagacagatttcaatcctgatgctaacacttattaattgtgtaacactgaacattccatttaagatcatagtgttagtttattcatcatcaaaatgggaaaaataaagttcccttatattttgggtaataaatatgctaacatatataaaccagccaaaattattatatatagatagatacaaacacttactaagcatttagaacatgttggataacttattaccaacatctgctaaactatttcatgaactatttcactagctcatgatttatatccttaggaacaatactaatacattataatacattagacaaaaaacatttactttctgtgcatttcaatcatctattatttctgtaatatttgccatcatttcagaagatttcatgtacagcttaaactgccaagaggtatattatgtatttgaagaatgaaaactacagataagataaacttctacaaacaagcagtaaataaagaggtgtggtgaatggatgcacatactatcttgttcttttccttttgtttttctttttttctgtttcttttatttatttattttttagttagcattttttagcatttttactagataatttcttcatttacatttcaaatgctatccccaaagccccctgtatcctccccccaccctgctccccaacccacccactcctgcttccttggccctggcattcccctatactggggcatataaagtttgtgtgtccaatgggcctctctttccaatgatggccgactaggccatcttctgatacatatgcagctagagacaagagctccggggtactggttagttcatattgctgttcctcctatagggttgcagatccctttagctccttgggtactttctctagctccttcattgtgggccctgtgatccatccaataggtgactgtgagcatccacttctgtgtttgctaggccccggtgtagtctcgttagagacagctatatcagggtcctatcagcaaaatcttgctagtgtgtgcaatggtgtctgcgtttggtggttagtttttacactccctattttattcccctccccgatccagcctccaactgttccacatcccatacctcctctccacccccctgtctcttcatggatgtcctccctgccactccacctgacctttaaataccatggggccgccattctcttgagtgttaggtgcatcatctctgaatgaacacagacatggaagttctctattgtatgtgtggtgtgttgggggcctcatataagctggtacatgctgtctgtttggtgatccagtgtttgagagatcttgggggtccagattaattgagactgctggtcctcctacaggattgcccttttcttcagcttctttcagccttccataattcaacaacaggggtcagctgcttctgttcattggttgggtgcaaatatctgcatctgattctttaagctgcttgttgggtctttcagagagtagccatgatagatcccttttttgtgagccatctatagcctcaataatagtatcaggccttgggacctccccttgagctagatctcactttgggcctgtcactggacattctttttctcaggcttctctccatttccagccctataattctttcagacaggaacaattatgggtcagagttttgactgtgggatagcaaccccatccttcacttgatgtcctgtcttcctgctggaggtggactctgtaagttccctctctctctactgtcgtgcatttcatctatgatctttgagtcctgagagtctctcacctcctaggtctctggtacattctggagggtccccaccaccacctacctcctgaggttgtttgtttccttttctttctttcttttttcttattaggtatttatttcatttacatttctaatgctatcccaaaagtcccccacacgctcccccacccactcccccacccacccactaccatttcttgtccctggcgttcccctgtactgaggcatataaagtttgcacgaacaatgggcctctctttccactgatggcccactaggccatcttctgatacatatgcagctagaaacacgagctccgggggtactggttagttcatattgttgttccacctatagggttgcagatcaccccagctccttgggtactttctctagctcgtccattggggaccctgtgatccatccaatagctgactgtgagcatccacttctgtgtttgctaggccccggcatactctcacaagagacagctatatctgggtcctttcagcaaaatcttgctagtgtatgcaatggtgtcagcatttggaagctgattatgggatgggtccccggatatggcagtttctagatggtccatccttttgtctcagctccaaacatttttctgctggctgtcagggcttcagttcttttccctcacccaataccaaatcaggttctcctctccaaccaccacctcccccgactaccccatccactttccctcccagttcccttcctcctccccacttgtgattgctttcttctaaagtgggactgaagtaccctcacttgggcacttcatcttgttgaccttttcgagtcctgtggactgtatcttgggtattcgtactttaattatttgtttgtttgtttgtttgtttgtttattggctaatgtccccttattagtgagtacatgacatgcacatccttttgggtctgagttacctcactcaggatgatattttctatttccatctatttgcctgcaaaactcaaaatgtccttgttcttaattgttgagtagtattccattgtgcaaatgaaccacattttctgtacccattcttctgtcatggaatatctaggttgcttccagcttctggctattacaaataaggccactatgaacatagtggaacacgtgcccctgtggcatggtggggcatcttttgggtatattcccaagagtggtatagctgggtcttcatgtagatctatttccaatcttctgaggaaactccagactgatttccagagtggttgtaccagtttgcaatcccaccagcaatggagaagtattcctctttctccatattctctccaacatttgttgtcaccattttcttaagaagtaattaattttaattataataacccgtgtttattaagtatatattttaaagtgttaaacactctgtataatccccagaattttttccaataattatgaatcatgcaactgaaattcacagagacttattaatacatttcagggcattattataagattcaacccgatgactgatcaaaacattgccttggttttatctagtttacaaatgtccaagcacaattcctacttaaaacaactaaattaggttcacattacagttctgcctctttagagctatgtaaccactttgaattcagaaatttcgtttagacagatggatgctaagtgtacatcttaaacttctctgtaaaacactttctcttctggcatttccctgtcatactgcttcttctccctccagaatcacaagagttgatcatctgcttcaaatgccctagtcactgccaacatatctccatatgcatcctttgtcatcatgctccagattctcccctaattttcttcatttgtatgagttatgataatatgtttatggcattccttcagtgagagtaattcaatatgaaaacattgtctttctccatctgtttctacacttaggctagctatcacattttaattagtaagtactactctgaagcagtcgtccagaacacaaagaaaatgatcaatacttctggttcaagtccagatgtagtataatgagactcctggacacaaacactattagaaaatgtgatatatggtcacagaattggcagattattaaaccactaataatgcccttgttccatttgcccagggaaaataacttcaagggattcaccccatccttactcattaatacattttccagttactatggagcatttattaggtggattgttaatcatagaagtagagacagtatcagactgggtgatttgagaacatactttcttaatctcaacttttctcaccaataagaaaacattttgtctaatattgattcagtcacctgcatcatattctgtcttttaggttttaattgcagttccttcagcctttgctgttcttccaattcaagtgtcatttgcaactaggaaatgttttcaacattctcatccaaataattacattcatataaaaatctgttaatgaaacattagagctaagggcttaattgctgaaaaatcaatgcttgagctaaaatactcagttatggttccatggtaacaggatctattattaactgtataaatgttatctaattgaaatgaacatactactttaggtaatttaaagtctatatataagataatatgctatttaaaaataaaataattgttgaaatagacttctggttgaaaattatggagaaattcacatttttcaattattttctgcttatcaaatttcatgctcagtattttctatcaatttaaatatagataatccccaactgcttttgaaatatgatggtatttaatgtccacatgtcaaacttatataatgtttttctctaaagaaggaaatgttttgcagaaaatgaaagtatacactgaatgacataaaggagctgatgtagggtatatccaaagcacagaaaccaggtcagcaggttgttctatgaaggaaatttctacatataaagaatgttcatgaatttttcaagtatgatgagtatgacaaagacaataaaatattgtacacttgtatcaggttaataaaacatagccagaaatcggtgaaagtcttaagtaggtgtattactgccatccacacaaaatgactgaatattacatctaataattgcacaactgagtactcagagtaagcgcactaagaggatgattcaggagaaagaaacaatactgagattttcttgcctcaacactgtctatattgcaggaaagaagatataagcctgggatgtacagcagtatttccaaagatatataagacaatattagtagcttttgcccatagactaaaggcaaattcccctctcctagaaaaagaacacagctctgagaaagattttatggtacttcaaatactggaagaagtgttttatcaaaatgtacttattggttagtgtgttggtcagcagaatataaaataaaagcacacagtatttgcccataataagtagcttttaatcagtctggaaaaagtatagaaaaattccaagttcaaacacatatgaagattttaaaaattataacataaaattcagctcatgtttctggaacaattccagataaagaacaagttatgagtgatctgactgtatatcttgatggatcttcaatttctagtactttgttgatattaaaaaactaaacacaaaaccactatggatttttaaaaagtcataataaataactttacttaagaaacaattatgctccttctctacagtatatttatggactatatatatatatgtgtatatatatatatatatatatatatatatatatatatatatatatatataaattttcaaatgtttataacataaatgtaggacaaggacgcatacatacaaacagtgtttcatatattccaggctggctttaaattcatatatagaaaagcacaaccatgaacttcttaatgtagctctacctcccaagttttgagattacatgtgtgctaagcctggttatatatggctgaatatcatactcacacatgctccaatgtggagctatggcttttgcatgtatttatttttaaagaagaagatatagacaagaaaattaatggtcttatggaaaatggcaacttttaagaaaaatcaatttagaatcctatagtgatgtttcagaaataggactttaaggattagtaactgcacaggatgtggaaatgctgtaaactatggagtcaaggagatttggtttgattttaaactgacatttctgtggtatgttattttgatatgaaagaaagttcaacaaaaatgaattatgtgcaaaaataagctaatcaaatatttctaggtatatacataaaaggaacaaaagtatctttgtaacaaaacatgactatatttttataacaatattatgcctaatacctaaagtatctgtgtggatttttgctatcactaacatctaacataataacttaatagaataaagaagatttattttggttcatagtttctttttttctggggatttggtgttatagtacatcatgttagaggtgtgtagtgtaatggagccacataaaacatggtagacaggaagcaggaaggtcagacaaaagcaggatataacctccaaagacatgtaatctgcagaacacatttttataggatccatatcctgcaacccacattcttgcatttccccaaaattgaattataatgtataaaagagtccttcaacacatattcaaatattctgaagttgttttcccctaagcaagtaataattcttcaaaacattatgctaaatgaaaaacccctagatgcaaaagatattatatgatcatgttcataggaaatgttctagaaaaaaaaaacctataaatactgaaagcagatggatggttacctataatgcaaggcagggataagaagttaagcaaatgagcataacaggtattttgggaatgacataaaggttccaaaattgatttgtggtcaacatggaccaattcaatgaaacataattaattacagatttcatgtgagtgaattttatcttgtcagttataagccaagaactcctcaattggttgtccaataccaaatggtcaatcctgaaaacatacatacaggtgacattatattgaattgacagtttgcatctaggaatatatgtatataccaatgtatatatgaatgcaataacaattaataaaaacagcatcagtttgaaggagagcaggaagggatatatggaaatgtttacagggagaaaagggaagggagaatttttgaactttaaatacaatctcaaaacaaaagaaaaatacatgattctttcttagtttgcttttctcttgagaaaaatactctgacataagcaacttaagaaacaaagaacttgctatctctcacagttccaggttatagcccatcatagtggcaaagtcaaggcttcagggacttgaagcagttgttattattgctggtgttcaactgacttgtttgattccagtatagttttatcctatgaaatgaggctgtccacatacaggatggctcttcatatatcaactaacccaataagaaaatgctttacaagacaagcccacagccaatctaatttagacaatacttcattgatatcctattcttaagtgattctcggttttttcaaagttctaagtgaatgaaccatgatggaattaaaagtgccaaacgctgtatgatggtgatcttatagtactatattataagtggtatgtttgactatctttaaagcaatcagtaattgtcttctcaactcatgggacctttagtaggaaataatgggctgtgtttttcctagttggtgaggaaatatgacaaagaaccaggaagaatagggaaataatattaatgctgaagtgaagtgtgtaataagttggacaatttattttcttatagactttaatagtgtaaagtatctgtactattggaatgtgaatattagaatcttttgacttcagaactggcactggtaaaggacgggtagaatgtgtgtgacaagtatcatgcatcaatgatagagtagtgggctaccccatactggtgctaggaattaggctaatctggctgtagctgtctagtgctgtaacaagacattatgaagcttgatttcttttcctgtttgttaaaatactatcacaaaagaaactttaaaataatttactatggctcacatttcaaagctttaatgcatcatgccaggaagttaagaaagcagggatttgaaacagctggttaaatagtattcatgatcagggagcagagtgtgatggatgcttgtactcagcatacgttcttttttatgcaatccaggatcctggatgaggaaatggtgcttcacactcttagaatgatcttcccatcacaataaacataatgtaattatttaaaatcgtgacctgtggtgggtaacaactggaatgtaaaaaaaataataatttaaaaaaatcatgacaagaggttaaatagtcacccacaagtgtatctggagacttatcttgtaaataataccaaattctgtcaaatgggaaacaccacccatcacaaacacaaatttggggagagtttaggtcatagaatattgatgtggtatcttttatttgttatgatgtggcaggtgactaagcaagaatagtttttcatttaagataggatatagcaaagtgaccacactgggagtgagtagggtaaaggtagtgttgtgaaccatgtgtgtaaaatactttgtgataaagtatcatacaagcactaaccttcaaatcttgtgagttatttaagtaagcagctctgtcaacactatgccctttaactctgcaacagattcgatgatgttctgggacagggaggacctccaaatgtcttatccaagttgtctagagttgtaaagatttcctacccatcttgaaacaaatccttacagcgcttgatctaagtgatgtgataagatcatgaccttttcagaaatgcctttgatgtcaatcctaattccactaaattttacctgacagggaaagaatgaaacattataggctcgtttgtcaagcatcctagtaatctctcatggcaataatctgctccaactcagccctgcagtaatagggtgtgggagtgatttaccctgactgggaataaacttgttaagtgttcaaacattgattaatgaagtaaaaatgcactaggtagaccttgaagtgataaactggacaggaaccttggcagaaagtgcttcctgcccactagcatgctatgatttattttgaggatgattattttcttacccacatatctacaatgccatgggaaaaatcagtattgataggtaagatacagaagtgaaaattatcacatattactcctaatttaagttttcatcacctttataaagatgaagaaatattcatggtgaaatttgtaaaagcccattttttgctcagctgacctttctgttataaaattttaaagctgttctatcatcttttgataatataaacataaaagatcaaggaaattgaaattgcatttttattttgacaggtacattttatgattgaccatttcagcaaagtaagtatgtgttatttttagttgattatttattaagttttagaatgcttttaatctcttcttcctcaatttatcttatttctccaaacaccaccagtactccagctatcaaactaaaatggagatggggtggggggatatatttttttcttattgctattcttaatgttttcattaattgctaaatttctttctggtaaaaattacttctatagcaaacagaaattacttaatgcttagagtaatattagaatagggcatgtcttgtgactcaatgtgatacacaaagtttaacttaaaatacttggagctttttttttagactaatggcctatgacgcctcactgttgtgttcttaccatgagtttgattgtgtttggaggggagtctaaggtcaatgatacgccttattttttcaggtccttattttgatgttgctttttaatggcggtcttgtttcttttggatattttgaggcatgaattcattatttagcccaaggcatcctttaagctctcagtgatctacctgccttggcctctaatttctcaatgtaataaggcaaatgtctatccctatagccttaaccaataaaagttcatttatgtgacattattaatatgtgaacatgacatagcattaaaggaatttaaatgctaaatgagatctaaaatttgggagttgtgacaagttctgttagacctgaaaggttcacaatattgccttacagtttcttcctccaacttctgaatagttcctgttcattacatccttcaaaccatgcctgatgatagtccctgagtgagcaattaacttaccaagaattacccttcctttaaaattgagaagtttttagtttgataacacaaagaaaatcctgatgtctcggcccccaactagtacccttataaattactgacaaattactgtaaatggctcttcttgcaatgctgtcactgatagataaatctatgctttatagttctggcttttattgtctcttaaaacatcatcagattgattttagagtagcaatgatataaaataaatacacaagatatactcccaataaaacagaagaaaagcatccttctttgtttctgagaattatagtgtgaaaagaaaaaacatttctgagcaccttttggttccagcagaatcatgtttgtttcgaaataacttgtaaattgtggagccagttcattgtataaaaactacagaactcatggaaagtccaatattttcattgtacatttatcattaaaaatagtatttttgatgagctgtaagagaaaatctagttcttatggtttaataaagatatattcatataatacattcatcagttataattttgtatctcccttatattgttccaaaacaatatataaatacagaactaacaactctgagcatgaaaagtctagtctgctgcagcaggtttctgtattaatttattcatgttttataaacacctaggtaccttatcagtgatacttatagagataaagataaactattcattttttcttcacacataacagtgataaacaaacatttgtaacatggataagtcttaattaactatagtatgtagagaggcaaatgctaattaaggcactttaaaattaagtagcacatttatcttttatttcagtctttgtcattgaaatgtattataaaactgtagtccatttaattatcttggtaagtacagtttagagaagataattgtgttttactttagtatatgtaatatttccaggggctcatattctttattctgaaagcagctactattgttcagacaaagttggatagtggaatgactccttataacagcacatcatttcttgggagatgaaactttctcttttagtaaattcaagatacctgcttgcttagtcacaatgcttctttttttctcataaaagtctgagtatagaacatgaaattaaatgtttcattagttgagcttcatttaattaacgttttactgtacataaaatcctaattagtaatggagagatctggctgctttggggaagaagtagtttgttcagtttggaatatgagatttttgttcggaaaataggctgacaccatgatggtatccagaagggatcaaccacatgagtgaagagaaatcatatactatgccaaataatgagctaaagttaaaatgtttatggtgaagaaaaacactgaacacgagatacatctatttgatgagctttttttgaaggaccgatgagaaatccttgtttagaatggactcaaatgtttcacttctcaaaatgcacttcacttatagatactcatattgttttgtaatatctacagaaacattttattagacatgttttccactataccccaaatgtcatacttagatttaacttacacattttcattttattgttcaacagatctattcatctgttttctgaggtgatacctgattccttgcagaaacttgatgacttcttatttgttaaattcataactggatttgttaaagttctatacctttcttctcagacttttaccattctacgattaaaaaaaagagaacctaggttttttttttgtttgtttgtttttgttttgttttgttttgttttctgtttggttccttactatttcctaattagctttctaaactttttctatatcaaacaaagagggagtcattgagatgaataaatgtcttatggagactgatatagcagaattaatcacacatggaaagccctaaagttgtcacatcattccctctttttattttagctggcttctaccaagacagtttgtaattcgcagtgaatcataataacagttttgattatttccaagtcagtggcttgttatgactttgtatttctttctccaacaatgcaaatcagagtgttttatttaaaattctgtgtgcttcggtgtatggtgctagactcttagttattactctctctttttttaaaaaacatgtgtctttcaagacagtgcaggtcaattctaaatcaactttttgctgaaattttagaaaattgcaggctatttcaaagccaactttttattctcctgacaaaggatggaataaaaaagtagggtagtataaaggtttagatgggtacctcaagtaattttctctaggtaaaggtttgaaaatgtaaaaactctctgctgaaacaaacaaacaaaaatacaccttcccacaaaacaaagcaaagcaaaacaaaaaaaaaaaaaacaacaaacaaataaactacatcaacaaacaaaagtgagcaactatttaggcaaacttcaaacttaaatataatcatacaagctctaccattacagaactttttttttttaacctcaccagttgtctgtgaaagaacattacctttgatgaatgaacatgggtaactaaagaggtgaaaatgtgagacaatggagaaactgaaaatgttaaaatgataagtagaaagtaataccttttaaacagaaaggaataggcaaaaaatactacactctattaataacgcacccctttttgtgtcaacaaatttcacattctttcccttggattctctgacaaaatttgttccatgtcaaaggttgcaatcaatacaatagagtgaaatctatgaggacattaatatctttgggaataaatggtctaaaatagttggaaaccttccttcttgttagtaaatgttaggggagttggatttttaacccaagatgacttgacttagattctaagaaaagttcactctttttgggggggctacatatgataagaatatgtagttagtatttcttatataccctgaaaaactactgttcttctcatatggtgaaagggaaacattcatgatctcatctgtctcttctgtttctcaagaaaacacatctaaaaatacagtccttctgcctgaattcctccatctataaagaatatgtttgggccttttacttctttttatgccaagcattattaaattttaataaatggcacattttggcaaaaatatgtagataggaatgagaaagaaaagaggttactgtaatttgaagaaagcctgtctttaaaacattcaccccagagtcaagcaacaagctcttctatagtcaaaagtagaaatcaaaatattattccagccttcctggccttatctgaatctaatatgtagtttggcaatacttcattcagtttaatggactatgtgaaataatgttgattttcattgctttttttatttgccttgaaaaatacaattaaaaaaaaactcttcaaacgccactacaatattgatagaattacaatatatttttagtctgaaagtgacctctgacaatttaatttcctgttaccttttttttttttttttagccttctaatgctgcaagatgtccctaatgcagattcctctttggtgatagtaagaaggcaacaacaatgtaggaagtgtaaaagagctactaattctcagtgtctgctcattaacatgagtaactctactcagaatcatgcttcttgctgagagggactctgggctacaaaccagtaggaaatagaactgggaaatatgttgcagactaagatttttagatgaaacctaatgtaagcagaagatatctgtagatatattaactttatgacaatcctgaatttgttgcttcgaggtttttgttttgttttgttttgttttgttttgttttgttttgttttgttttaaaccagatctccgttatagctcttagcttcctgtcttagggttttactgctgtgaacagacaccatgaccaagacatccctcataaaggacaacatttaattagggctggcttacaggttcagaggtccagtccattatcatcaaggtggaagcatgacagcatccaggcaggcatggtacagggagagctgagagttctacatcttcatctgaagactgctagcagaatatgaattccaggcagatagggtgagggtcttaagcccacacccacagtgacacacctactccaacaaggccacccctcctaatagtgccactccctgggccaagcatatcacacttcctaacagtttgctcaatttataaatggaaattttggtttagaaaaatgtttggatgctccatccttttgtcttagctccaaactttgtctctgtaactccttccatgggtattttgttccctattctaaggagaaatgaagtatccacatgttgttcttccttcttctttattttcttgtgttttgcaaattgtattttgggtattctaagtttctgggctaatatccatctatcagtgagttcaaatcaagtgacttcttttgtgattgaattacctcactcaggatgatatcctccagatacatccatttgcccaagaatttcataaactcattgtttttaatagctgaatagtactccattgtgtaaatgtacattttctgtatccattcctctgttgaggtacatctgggttctttctagcttctggccattataagtaaggcttctatgaacatagtggagcgtgtgtccttattaccagtgggaacatcttctggatatatgcccaggagaggtattgctggatcctccggtagtactatgtccaattttctgaggaaccaacagactgatttccagagtggttgtacaagtttgcaatcccaccagcaatggaggagtgttcatctttttccacatcctcgccagcatctgctgtcacctgagtttttgatcttagccattctgactggtgtgaggtggaatatcagggttgttttgttttgcatttccctgattattaaggatgttgaacatattttcaagtgcttctcagccatttggtattcctcagttgagaattctttgtttacctctgtaccccattttaatggggttatttgaatttctggagtccagcttcttgagctctatgtatatattggatattagtcccctatcaaatttaggattggtaaaaatcctttcccaaactgttggtggcctttttgtcttaatgatagtgtcttttgtcttacagagcttttcaattttatgaggtcccatttgtcgattcttgatcttatagcacaagccattgctgatctgttcaggaattttttccccctgtgcccatatcttagaggcttttccccactttctcctctataaaattcagtctctctggttttatgtggaggtctttgttccacttagacttgagctttgtacaaggagataagaatggatcaatttgcattcttctacatgataactactagttgtaaccctaacccggggatccatcccatagtcagccaccaaacgcagacactattgcacatgccaccaaaattttgctccatagaccctgatatagctttctcatgtgaggctatgccagtacctggcaagtacagaagtggatgctcacagtcctctcttggatggaacacagggcaccaatggaggagctagaaaaagtatccaaggagctgaagtagtctgcaactctataggtggaacaacaatatgaactaaccagtaccaccagagctcatgtctctagctgcatatgtagccgaagatggcctagtcagtcatcattggaagagaggccccttggtcaagcaaactttatatgccccagtacatggaaaagccagggccaagaagtgggagtgtgtgggtacgggaggagggtgtgtggggggggaggatataggggactttcagatagcatttgaaatgtaaatgaagaaaatatctaacaaaaaaaaattggaagtcatctatttcagttacttgaattcctcacagcactttcatgacaaatggcatgaaatgcatacaagcatggcacatttaattatgccagtcactgtcttctgaatatatttgacctaatgaccttttgaagatgaggattgtaaaatcagacacaggcattaggtatttagggggaagctgtgatgaaactaggaatctgtctcttcattttccgaggtgacctttacagtcatctggatagggaccacctcatctgcatcatcctgctaactcaccagatatagatacaggtagaaattcattgtctctctgcgcgaaaacaatggttaaatctctttacttccttttgtattactgttcattcatttatatttcaatctaattatattaatattaatcttatgtgtgtgtctgagagattgagagagagagagagagagagattttgaaggactttataagatgccccactgatgtgaggtataactacccatttccgtctcctaccaacttgtttattctgttttaaaagaaaataaactaatccattgtcttgttctgagtatacttctactgatatttagtgccacaaactttctagtgtaaagatatgtcaatattcttagacgtctttgctaagggtcagaaaatattagctccttaatattcattcttcatgaatcttggccttcagtttattattggtgatgcctcatctattcttttagtctaaaagtaactttattttttactgaaaagacagatatttaataaaggttatctagttatttacccaaggattcatctgaaaattgttacatcactgactctaacagtattattatctatctctctttaatttttctctaaataaaatgcctctacctctgctgcacttttccagtctgtatcattaatacattgtataaggtttaggtagtcagggtcttgtctttggtatgacattatttttacctcttaacatccagcaacaagtgatttataaactagtaaattactttctatctccttccaatattactaacatgatgatgatagagaaggcaatgacaaatataagtgctaactttctaagtactttctatgcaccaaaaattagtcaaaatatttatcccataccaattttttcaatgagtttcactcttttcatatcaattctcttattatctttctcttacatatgaccacatggaggcataaagaggccaagtattattttttaatatcatggttagttagttttgaagctgaaattcatacattgtgacttcacagcctagaatcttaaatttcgctgtgttacttaaggacattggttagacaggaaaagagtgaattattagaacaaccgtactacagtctcataatatctcataggcaaacatggagaatatgcataatttatagctcttcttatctctatatctccatacttaactatcctctccagttttcattgtcaacttctgggtttcctctataagctcctattagctcttcagctaaaatgtaaagtttgctagaacatggtctgctatggatactcatttgtttcatgaatattctagccaagcacagtgctaagcaaagagaatctgtgaaatattaaacaagtgacagacttttcaattcattttcaaatgaaataatgagatatgtcctcctagaagaagtgtgtgtgtgtgtgtgtgtgtgtgtgtgtgtgtgtgtgtgtgttcatgtgatcaaatgcattttcaaattatctatgtgtagtgaagaaaagcatggtgctagccacagagcaagtgttctgtgactatatggcaaatgaataaatgaatgaggtagagagagagagcaagtttccaatgaatatgatcaaaatcaattgtccccatgacttattctacactaggcatactattttgtaccattaaggaattgccatgaggcattagtctgtttttagcttcaaggcatagttattgtacaagcaattttaagtactaatttcttgtaatatccattaaaagatgaatgtgtttgcgggtcctctatgtttttaagtatctaatatatacactaatgacatgaaagtagaagcaaaactgtctgaggagagagggggttgcataaaaggaaggggaagaagtcagaagagagtgggatatgggtgacttatctcatgaaatactatacatttgtatgaagagaccttatataaccctgtataatattcaaaataatttaggtaattggaaataagtatatatacttgtagttcacacacacacacacacacacacacacacacattctccctttcagatactgaaatacaaactccttatatatccaaaccacttatatgattttcatataacctgtatatatccacacattttgtctgtcatctctagaacactgatacaagcgatgtcagtgctcactcttcttatcttaaatactaatgtgctccaaattttatttctaatatagctatgagttttagagatattcttatgcactttctaagtttattcatgtgaatagtggtttttatatatatgcatatatgatttaatgtataaatgtatgtgatgtggtatatatgtatgtgtgtgtatgtgtgtttgtgtatgtccagagaaatgtatacatattttgcattattttcctttgggtaagtaaatttattcatataccttacacctgggtgaatatgctttattattttagtatcttggtaaatcttgaggttcaaagtgactcgtacctattcaaatttaatataagactttagacaaatcctttcataacaaaaaataattggagaacatatgatggcttaggtcttttatatataattatatggttcccagaggggagttataattgaattataagctgcctcatgagtattctagctggtgtttagagaaccgcaaagcagagctgagcaatttttttctccagctaggctgtgaataagacaccctataattcaattataactagcctccaggaaccatataattatactataaagtagtttagggaaactaggaaatgggatgtttttcaacacattgtatatgtttaaaataataattttataattctgctttacccttcaacttttccaagttcacagctctgggaaaacttttcatgaccatattctcttatgctttttatatattttaattgcaaattgtcatcctaaagaatccttagattgcccccttttcattatggtctgtgtgtatattcatacatatcatttaaattcttgtcaactttttcaactataaaatgattaaacttgacagaaatgacttgagaatcattttccagtaccaagagggactgatgcttttattagtcagggttcttcagataaacagaagtttgtttgttttttttgtttgtttgtttgttcttttttgattttcttgcactttcaccaaaagcctgataaggaatggtttgaatgtacagtagagcctagggagaaatggacattgcagaaccatgaggctaacaatggcattacatccaaagtcagaaaggagagagagagaaagagaaagagagagagagaagccactgcttactggcatcccctttttatcatttttattcattctagtacaacagtctatagtatgatgtgattctcatttggagttaaccatccctcgtcatataaacctccctggaaacactatcttacgtatggaaagcagtgtgtcatctagctgattacaaatctaataaaatttaaaatgaagatttctcatcacaaagaaccacgaataatatgataaagagacatagggatgttatagcagtggtgagactctcaagaaactcgcttatgccattgtggagctagcaatctacatggcagtcttgcaaggaaccatgaagaatgtgaatgttccagcatgagtctgaaggcagtctatcagcaaagattctttctttggaagacctgtctttttccttaaggctaccaactgcctggatgaggcttacccacattatagaggataatgagctttacttagtgtctactggcttaaattttaataccatttaaaatattccttcacagtactatctagactggtgtttgagctgaaagtgagcgctaaagtacagacaaaattccacatacagaaaccatcacgcattgatacagggagaatgtgctgcattattcaggttctagttcttcagatttcagataacctcactgggacatgaacgaaaaatagaaaggaaaaacttatctttgaaacattggaataatgtaacactattattgatattttacactgaaaaatagatagatggctttttgaggaaaagggaatatcttagttgcttttctcttgttataaagaaacaagataacttatgaaaagaagcatttaattggtggcttgcttcaaatggcagagggtaaagccctgatggtcatgttggggggaatggcaacaggagcagtagctgatagcttacacttggtccacaagcaagagacagagcaccaatcggaatgaaatagacttttgaaaccacaaaccctactgtcactcccatactttctccaataaaaccataactcctaatccttcctaaaacatctataccaactaaggaccaagcatataagagtgcatggtgtccattctcatccaaaccaccgcagagtatataaagaatgagaatgtaagtcagaagaggaagatgaattctgtgcaatgctgtattcaagaaatgccaaggctgttgcatggataaactaaaagcatctgtcacttatataatatctttgcaagatcaagccaatttatcccagcactgatgaggtttctaatgctccaccttttaatggagccctgttggcagttcatggttgctaaagaaaggacggtccttttctttgaagtggttgcttctatgcctcagtggtcaaccacacacccatgaagatatggtaaaattaactggattcagtgaatttagtcaaaagaaaagaacatgaaataatgagatgtggtgggagggctcaaaagagaattaggaagggacatattatcaagttaaagtcaaaagatgaaatctgcaaagaatgaataaaatatcagctaaagcaaaaaaaaaatgagaattgacatttttatttaacaatctgtatttaagttatgaaatctcactttcttctgttttatagaataaaatattaatttcataataaaaataaagtttaataactattttttttcaaaagaactgtgttcacactgaattccttaaaaatttctttgaaaatttccatattatgagtaactggtggtgctatgacttgctataatagaaacatattttttttattttttagctccattatacttatacataacatttgtcaagaaaatagtataattgtgctgattatattaatttttaacataaaagtctcacttaaaaagtaattcatgcatatgtgattagttgctcataacatcactatttctactaatgaaaaatggatgtgattaagtctagcaacttttaaatgggaaaacaaaataaaatatactattatttatataatatgtgtatacatgtgcctatgaattgtaaccataatgagaggctctaaggcatactacaacatgaaataaagttggaaacattattttcagtaacataatcgatttacaatgacaatatcttatatgctgccatttatgtaaagtatcaataacatacataagccagacacataacaatcaatgtgtgctagtctattttatacagaatgtgaaaagttgctcttatataagtatagagttagaattgttgctagtagttgaaacagttcagatagtttggaaatgtgttagacaaatggtggagaaaagttctcataaagtacaaatttaaagttctactactgtgtaatataatgtgatgactactttgaaagataaattgtgttttaaaaatatagtaagaaagtgagtcactgaagggtgggagaatacatggaggtcctccattctctcagaggaggaggggggatgaaggaaaggactttgtgtgtgtgtgggggggggtgttggggaattgggggagggcagcatgggatataaaatgagtgcataaataaattagcataaaaatatcataagagagtgaatttgaactgtactcatcacaagactatctatgagaatagcacatggcaattaacctaatatataattaattagcttaatataaaaattgcaatatataaaagcatcttgtatatcataactattgatgattttagctataaattttaaaaatagtaagtttgaaaacacagctatatccacagatgaaaaattattttgtaagttggagtagaattctgagatgaaagtaggaaatgagggatgcatgctgatgagaacatttcttttcctgagattgattatgttttactttaattttataatgatagctaaaatggtttactttaatttttatgatggttctatggatatatgaaaatgataggactatatatattaaatatactaatgataatgtaggaagtatatataaataagagtatggtaagagcaatatatgtgcaggaaaatattcatatagtttggaagaggctctattaaaactttagtccccttgtcttctcactgtagtctataatcacaccatcctttttgattgcctattagtagacaatgtcactatttcttgcctttccccaacactccacagtctcatgatgtatttttactaacagtgttttcagaatcttcctataacagcataaatccatttttgccattcttttgagtatattcctttatgtggatgcatcatgatctatttaaacatttccctcctgaggaatttgttctttcaagggcttgcaaaaatgctgcatggacattctttgatatctgcttacaagaaagtacaaaatatatctggaggatgaactcttactagtaaaaagaatgtgcattttaggatttgataaaggtgtagtagagggagcaatatattttcttgatgacaatacttgaaaatgtttgttaatattggatactatgaatctctcatctttgtcaccataacagataaaaaacaactccacatttcagtttctaactttgctgctgattatggatgcaaactatgctaattgactatgccctttcttcatatttctgttaagttttagtacttgcaacattccgattgccctttaaagttcctgctgttttacctttttactatattcaacctacattggggtagaatgcttcttgaaaatattcattttgctattttcaaatacattctgctctacaatgggaaatattatgtgtgctgaaatcacacactatgtgtgttgctctttccttgagtccataaagtttcttcttggagaaaccttcaagttaccactgataataagtcttcgactgttcagacctatatctgcatgaaaatcagatagacctaatttcaaatcttaggtttcctcttagataaaaggatctttatttatttttaattgttcacagattgaacaataaaacctgatatcattaaacagatttcgtatatttttcctttgccaaggcaatctcacttcacctaatgtaacagctgtcatagtgcttacattatttgctaatttaattccattacttttttcacatactatataaaaggacatttacaacacacagttttaacatggagacaaaatgacacattaaatgattcaatgtagaaaatatataaatagaggtacaaaaaaatactgactacaacattagctaccagcatcagtgtgctttttttctttttctaactttcttttctctttttttaaaaaatgatttatttatttatgtatatgagtccattgtcactgtcatcagacacaccaaaagagaacatcagatcccattacagatggttgtgagacaccatgtggtttctgggaattgaactcaggacctctgggtgaggagtcagtgctcttaactgttaagccatctcggcagcctcctttcttctgttcttaatatctgcatttctcccttgttattgtgaaagcaataaatattcatggctaaatatataatatattaatatccttatgtgtatgagtattaatattcaaattatattataataatcaagataaataaaatagctctattcacctcctcacttctcttccactcatttgcctcaaaatatatatcacttcttgcacattttatatcatcttcatggaaatatatatatatatatatatatatatatatatatatatatgtgtgtgtgtgtatacatatatatatgtatatatacatatgcatatatgtatatatatatatatatatatattaccttacaagaacatattcatgcaaataaatagatttcctttagtaacagttacctcaggctgtacactaatcccagtgcaatatttgctacagaattgttggatattttgggggttattttggtatttggtattttgggaccttggaaattattcaatacttacactgctgtgtttttaatttcactaaggataggtttgatttcagggaccaatcaaattttatttggggttaggtatgtgtgtgtatgttatgcattcaacctatctaaaatggtctttggtcaaaatcaccaggacaataatgattattctcacaagcagcttataagaaaaccctatagattattgtcaacaagtaatcacaacaacactgagaaatgacagtgtgtatacctggtaatcaaaggtgatatacagaatcaattaagaatgtggtgttcatttgagcatacagatttttttctgtgttggtttttagatgtcatacttctgttgttctccttacaaattcaccttagttttcatatctaactacttaagaagcatcattgtaaatcagcactgtggtgtatatacagcaagattatgcttctgttagccccaggggcataatgacagtcttagatgtgaggaagaacactgagattttttttctgtaccttttaaaatacccattacataatagctctttattcatctctttttttttaactcttcacctttctaacttccttcctatcttttctctttgttgctccttcccctcccctctctctttaattaaaaaaaaacacaaaaaacaaacaaataaaaatggtctgatgcatctgattctggaacaaatgcttcgatttcacttcattcttctcttcagagaagcagaatacatctcttaaggtattcagaatcaccattttctttatgtggaaatattttttcaaatctttccttaagatatttaattaaataattcttatgtactaattatccaagaatttctttcttaaaatctgcttttatttccactagctttgatgaccagtataagaatttggatttgaaattttaaaattactataatcagtgatatgcactgcctggttgcagtaaaaattgtatcaaatagtttctctttttaaaaattcatcagcataatatgaaaatactaaatggtagggacattgatgcacttcaatactcttttttttctcttttgttttattggatattttctattttatttattttttattttttggcctgtgactaatcttttataattattcctttttattggatattttctttatttacatttcaaacctttcccaggtgctcactccggaagccccctatcctatccccctccctctgcttctatgagggtgttcccccacccacccatctactcctgcttccccaccctggcattcccttatgctggggcatcaagcattcacaggaacaagggtctcttttcccacagatgtctgacaagtccatcctctgccatccacatatgcccctggagtcatgggtcgctccatgagtactctttggttggtggtttagtccctggaagctctggtggggggggtctggttggttgatagtgttattcttccaggtgtggtggtacaggcaggtaggatttgctgaaggagacagaggcagtggaatcaggagttcaaggccagcctgggctaagcacttcaatattcttaagacaatccatgattacgagacatgaaagatagaaattgtaaaagccattcatttctaagcatcagaatggtagagggagtctaacattttgaactgttaataactgttcaaaataattttgtctttaactttcaagattaaaaacagtgctctagaatatcttcttgtttccttcaacattgtttttccagatgagtcacgataggacaacctgattattgattaacttttaattcaaatccatactttgttgtaggcctctaatgaaagcctttgttagacagcctaagcttcatttattaggttgcctgtgattctttgcaccaatcacttcccttttggaattggcttatcattgtgaggaccaaagaaatgtgggtaggatgggcattttcaaatggttttattgaattcccattacaaaaatgccttttcttgctgagtgtgctcgttactgtctttaatctcaacactcagaaagcaaacaccgtagggttctatgaatttgaccccagcccgatctacatagagagctctaggctagtcaaggctagatgagaccctatctcaaagggaaaagaaaatgatttccttcattagcaaaacatgggttgaatatcttctgcatatgaatcaccatgaccactaccagcaatataggaacacagaaggtgcgcctttgagcatggaagttgaaaaaaaagggaatattataatcagggtaataaaatagaaaattcctgcacaaaagtatggcatattattaattggatgttctaaagcttttcagtgtcttctcctgttagaagaaaaagttaagtgcaaacataattaaatcgagaactctgctacttatgagttgcaaagtctccttcaagttgcccaaattctgtgggcttaactttactctttgtaaacttgggaatgataactattgtatagagtttgggtaggcatatttgtttatgaatataatgtgacctttttattgaatattcaatgcaaaacagaaggttgaatgttcatctatattaatacatatatgtttatatagatgtcatgaggcttgactattttttttctggaaatgagattttcacaattttaaaagtgacaggcacaggagaagaaaataactgtattttcctaaagtctcacaactacttgtagaaaccaccaaccatgcttttatggtgatgcattttgtatctttccagcatggcacgcatattatggttgccgtaaacacaataatttcacttgccacttaacttcggtctcacacattttcctttcagatttccctcgcaagggtcatgtcatgaaaggcagtgtacagaaaaatggtaccctcccctcctccatgtgtctcctttatattctctgatatcttccctgtcaatttgaagtcttaaaattggactcaatctaaggcatcaaaagccagaactgaataaagaaataaaaatatttgtggaagacactacattttgtgtttattttcccaattgttcttttagagtttttctctaaccaatatctaaatatccgattattttggaaaaaataaatcagttaaccattcatagacagtttttaaaaactaaatcatcgtctggaattttctgattttatgatattctggcacacagctaaatgtatcttgtcttgaggctaaagtttcaacttcatcacattttttgcttaactgaatattagctctgaattcactctatttatcactaattaaaggtcctgcaggtaattttacttgcttagcaacttgttataaagactgcttaggcagcatatgtgtattttaagaaacacatgactatcatgtgcaagctattgtgtatttactgagtcaactgataaaatattcttttttccaaattctgaaggaggattgttttgtatatagaagttcctatagtcatgggatgattgttagaaatataaacaaagagaatggaacacttaaatattattcattaaattaagaagcatttctacccagatagggagaaggatcagtcacgtgcttgctctataagcaacagaatctatattcagatccttagccaccagttaaaaactgtgcatggtaacagatgcctgaaattctagtgctgcagaggcagagatagaactctgggatctctttggccaactattcttgccaattggtgagctccaggttcactaagatgagagattctgtctcaaaatcaaaggcaaagaacaatacaagtggacaccagacttcaacctcagtcctccaaatacattatcattcacatataatcacatgattgtcaacaccctgtatatgcaccctgacacatggacctattcctaagtacttactatctatcagttagaatgtaaagcaataagaatgtaccaatgaaattgacagatcccatctcttcctttacagaattagaagaggcagaggaaagagagacataaaattaaaatagtagcatgctgaagcatatataacacatgttataagaaaatacaccagggactttaatttagtctgaagagcagaggatgctttctatagtaagtaaaatcacattgagaggtgcaaggagggcaagagtgacatatacaaagaaagctggacaagtccttgtggaactgcaatagtgattctcaacagaggacaattttgctctgatcagggaacactttagtgtctccagagaagagtctgaagtaagagcaaaatggacattagattatagtgaccagagtttctgtaaaaaatttaaccgctctagtgaagagtgcccttgccaaaactgtttctaatgaaagacatagaggtcattgtttcaaccattactgagtatttattatgtccttgataagtatggggaaaagaacattaccatcctatttagttccatctggtaaggaagacatatattagctccaagaataatcagtaatagaaatgagaacattgtgataaagagatattaagtgggatacctcatatagcatcatgggtatgatacttaactgggcttaaagttattggaaatcaaaagaaatattttctgaaacctctggaatcattagtcccaggaagtacagttatagaagattttaaaaagcagtagggatcaaagtcaaggctaaaagatgatgtgggagaaaaatcagacttatcccagtagatggatgcttctcttttgatattataggctacaaaatagatggggtagtggaaaagaagaggttgaatatgtagatgttgcttagactctgaaattctcatccagtgaacagaaaaaagagtgtccaggtgaaggtcaactatgtttccttgatcatagagaaacactgtcatcagcacaaaatgaaaaaatggagataaatagagattttaaagcagatgaaaacttaaaatgcagcctataaaacacaggtcatatttaggtgatggatatacactggattcaagataatttcatgtcaatgtatataagactttttttttttttttgcaccattcctggaggtacttcaataccaggtcaatacgtggcgtgggtggggcaagctcctattccaactcctacttccaaaaacccatttaatatattgtcctcagatagaggacatatcagatattaaactaataaaaacagatcttagcgtgatcttagccaaaaggctgagaaacgatgagacatttcttaaaagatgtcttcatggtaaggcctaatctttgaagacttgaatcaactcaatccctcttgtatttctgctactagccaaggcaccaatggaacaaaataagccaataagtgagcatgtcttcaatataattccaaattggggatatctaatacacttctttcttaaaaatgctttttatctttatatatgggattttaactactagttatataataattatttgtttattttttagtttggtcctacactgtaatagaactgaaatttatttagatatgtcatgtatattctataagcattttaaatccaaagaattcatatgtgttaatgtcattcacaactttacatttaaaatcaacaaaaacaaagagttgtagagttgcaattgcggctagctataatatatacttcactttgcaggcgttactacttgggctccattcctttttcttggcagcatgaatattgcaattttgtaactgcaatgtgggggaaggggaatcagattttttaaaaagaaatcattattctttaaacttttttttaatagtccagtggttacccccatcccagtctgccctttgactgatcctcatcccatacctcctcccctgtctccaagaggatttccgtatcccccaaccccactctaccagacctcaccatttcctggatcctcaagtctcttgagaggtgcatcttctttcactgaggcaagaccaagcaggcctctgctgtatatgagttggggacctcttatcagctgggttatgctgccttgttggtggctgagagatcccagggttccaggttagttgagactgctggtcttcctatggggttgccctcctcctcagcttcttccatcctttccctaactcaaccacaggggtctccagcttttgtccattgtttgggtgtaaatgcttacatctgcctctttcagctgcttgttggacctctctgaaggcatctatgctaggctcctgtatataaacacactatagcctcagtaatagtgtcaagccttggagcctccccttgagctggatcccaatttgagcctgtcactggacctcctttccctcaggctcttctccatttttgtctctgcagttcttttaaacaggaacaattgtggatcagagttttttactgtgggatggcaaccccatccctccacttgatgtcctgtctttctactggaagtggactcttcaagttgcctcttcccactatacagcatttcatctaaggtccctacctttgagtcctgagaatatctgacctcccaggtctctagtaaattctagagggtcccccacctcataccccccaaggttgcctgtttccattctttctacagttcctcggggcttcagtcctgttccccaccccaccccaatacctgatcatattccccctttttctccctgtcccctctaccacccaggtacctttctctctctgccctacccagcaccccagtggttgatttctgctccctaccaagtgggattgaggagtactcacttgggccctttggcttgttaaccttcttgagttctgtggattgtatcctgggtattctgtacatttttttgactaatatccacttattagggagtatgtaccatgtgtgtccttttgcatctgagttacctcactcaggatgatattttctacttctatctttttgcctgcaaaattcatgatgtcctcattattaatagctgagtagtattccattgtgtaaataaaccacattttctgtatccattcttccattatgggacatctgggttggttctagcttatgggtatcacaaataaggccactatgaatatagggaatcagttttgaatccaatcacttttccctacgagttcaaaattgctgccagtatattaaaccaatttagtcttcaaaatattcagccatttctttctggttaggttcaagaaattttcaaagatctgccaacaaagtgagaagaaaattgcaacaatgcatagaatctagtcaattgatacagaagtgtttcccaagtgcccttgcacatttatcaaaagcaaagaatgaaagaatgaggccagagtaaagattgaagcattattctctaaaattttcacactaacctagtgtcactttgccatgtagtctttaaaaacctgtaaaaatattggcttaaaatcagtggaaagagaggcccattggtcgtgcaaactttatctacctcagtacaggggaacgccagggccaataagtgggagtgcggggggggggagtgggtgagggagcggtgggggaattttgggataacattggaaatgtaaatgaaataaatacctaataaaaatataaaatttaaaaagtaagtaaataaaaattcaacttaacatagttaactaggtcaagtattagatatatgaattatgttgatattagttttcctctcatgcacatctatcaaagtatcatcattacacgtgcactttgaatatttgtcaaccaaatgtcagcaaatgtaaaaaaaattaactaaaaccattccgcttttagaatatttgcttgagggagcaaacatttctctgcttctgtttttgtttttggcaaagcctgaaacatttgttcttttaaaagtacttagaagctaggtgtggtgatgtatgcctatatacacagcattcaggaggatgagagaatttcaaattccaggataaccaagactacatagcaggactctgtctcaaagagtacttggagcttgtagacaaaggagctgaagttatattttgttatattatattgggttatatattttatttgagagatctgtccattatcatagagcaatttagaaaatattataatattgccaatcctcatatgattgacaagcaacaccttttttttttcatattgttaggaattgtttctctgtacaattgtatgaaattttaaaatctaaaaagctaaaaatattttaaaaaataaagtcatttcaactaattggctttttaattgtgtagcactatgtggggagttctgtcttctcctacaagagaatacacaggtttttgctgatttgagttggtctcctcccacaatgtttcttttcttttaaaatcaaatgcattaaatttctttattgcatccaattactttgttaattgaaaaggacggcattccactttcattatatgttctcgttttctacatttcttttaatttatggaacaataaaaagtaaagcattgcaaaacccaactatttaaagagccatttggtacagtcaccatttgaccttatttatttgaattttccagacttcctgtgatttcagttcatctccctaagcatggtttgttagcttcattggttattttcaacagcacattagaagtcccctgagatcttgctttgtagctgacatttggtgctgtttctgctgtcacttttaagattttgtacttctccagctgtcacattctagagtaatctgttgtgttgtctgcatttacagacgccaagaagcagctaggaaatatgaataagagtgtcattacactgatacttctaatgagaagtaggttttgctttctctaattaataataaatggataagggaaagcagtgagacaacacccagaaggtaatagcaactcatagaatgagagaaaatatttgcaagttttataagcgagtacatgaataatgattgcacatcaataatgaaaaaaataaataagataaaagggtccaaggttctctaaagaatgcacctaaatgaccagtgagcaaatgagatcaatatcattagctatcaaggaaatgcaaatcgaaactcagagatgctatgttacattcactaatatggctacaataaagaggaatagcaatgataggattagagatattgaaacacatgtagattgctgccaaaatgttcaatggtgtggtcattgaaaaaaaaaaaccagcttcttaattgttcacaaacaagaaaatagacatagttcttatatgacccattgatttctttcataattataatcaaaataaaaaacacacccatagatatgtattcagtgtgttcatgacaacattagtaataaactccacaacatatttatacaatagagaattatttatccctaaaagaagtagggtattttaaatgctacaacttgaaaatagagctttgcaacattatctaattgaaaactaccacagataaaagaccagatattgtataattctattccttaaaatgtctagaatagctaaattcctagaaataaaatgaacattagtagatgtaactggaggggaagaggaaatgactaatgagtagaattggaattaacaactagtgacacttacaaaattctggaaaataataaaaggctttgaattatatactttatagggtcaatttcatgatatgaaaattatatctcgataagatgggattagaataaatgaagaagagaaaataagctatatcatgtacttaagagtgcttccagatatacccatacaaatttcatgtctcatcatatttgatgtttacaacaactgcaactgcatgtatgctgcagtctttctacttcacatatgaataaactgaaagatagcaaagtggcataaaatattctccaaggtaccagggcctaaaattcaaaaatctgcatagtgatccaaaaccaatcttacttctttttctgtattttaatcacagttaattatcacagcatacaattcattaatgtaaattaaccattcattcagtagttttggttgtattcacagacaggagcacatctccatggtttcagagcatttaagtcatcatcaaaacaatctccactttctaatgaattgtatatgaattatagcttagtaaatttgtttttaaaaacacttagtgacatttagctatcaacaaactccccctcctcttccacatgccaatcataacttgaatcactgcattctctttttaatctcttagcatatatagaatcagggaattatagacttctttgtaagagatggcctcaaaatgtactgtttcctcatacacctaaaaggccaaggaggaacattctgggttttgattttgtctttggaatcccctgcactgttttaacgaggaactgagtagtctcaaaatgtaaaagggatgtttcgcttctgggaaagattgcaaaaactgtcaggaacacttctggggctttaaaattgacataatgccctctagctaaatggctttgctaagtggctttgccagaaacctttcctagcctcctgtcctgaagctacagctttcctcctgaccctcttgacttcagttgagtgtacgtcttccagttaacaagtaatttgggggagtgtcaaaaggtaactagtgtcccctgggttacaattaacctaaaattaagaggtggagtttaaaatcctcattaagtataaggaaaacataaaagctagcttcggaattggacttggatttagaaagtcacctttaaattaatgaaactgactgtacttcaccatagagcaagcaagttatttgagagaggactgaggaggagggagaagagaagagagagaggagagtgtgtatgtgatttcatgtattttactggctaattaaaaattagtagaggaaaggatctttctaggagctgttttctatgataccactcattcactatgcacataatgtccttcagttttaattagcactaatttttgaaatatgcctgtgagtgttacattatttgaattatgaattagtgctttctcgttaaacatggtccgatattgggaagcatcctatttccataaaaaatttgatgatttatttttaaatgtggaataataaaagcagttgaggtctttaaaaatgatttacagtgaacacttacagtctgacaataaattctaactaatatgtacttcttataatggatgcctgcagattatcaattctgagctaaaaatgagaaacaatatagatacggttattgctatataaaccttaaacacctgtgttttgctgcatggttacagcagctaaatgtttaaaatatttaattattcagatttgctaatgcttcttttaaaatgtctttagaaactatctctataagcttcttcctgtaacatacacttttaaaccccattttatcaaagtcattttgtggaccccctacaagcagaattatataaatacaataaataattttcaagtaaaaaatttggagagagattcaaaatcattaccactttaaacaacattcatacctgaattgttcccatacatttcccagaatacgtatgccaattataggaagcgatatgcgtgtttacttacttcattagcttttctttattaaatcccatgaatgcatgtgcacacatgcgcccatacacacatacacttgtataagagctcactcatttatctttacctttctgtatgtctggctattatggatggtagttcattggtttaggtgtgaaatagttatgaccagactgacccacagtcagcaaagtatgtctcttgagttatcgagaaatggagttgatggtgacagttcctttgtgacttgaggtatatgtttctatatatagtacttggagttaagctttcctcgtttttcatgggtcagacaaaagattattgaatttagagactatattgctgatcactacaccctggggccaagagatcaggcaaaagataactggtctatttgaggattgattcccccaagtttggttgtcatgagctctaggcttagccaaaatgtaacaaaggacaactgagatttatatggctattgacagatatagactaggtatcaattaatagcatatttttcttctccttggaaatgcatgtgaagaggcaaatttatcagttctcatcaagatatctaagctatctggcagtttcaattaactgagaagagagccatgtggaagcaaatctgttagcttttttaaagaaaagtattgaaaaatgtatccaaatggatttgtttgtgggacacttaatttttttttgttgtttacgtatttactttatatcccactccctgtacccttcctggtccatcccctcctacaatccttccatcgtctccctccctttcacctctgagtggctatgagccccctggctccgccctaccttggcacatcatgtctctatgaggctaggcacatcctgtctctctgaggccagaccaggcaacccagatagaagaatctatccaacatacaggcaacatcttttgggatagccccttctccagttgttcaggacatacatgaagaccaggctgaacatctgcttcatatgagggcagaggtctaggtccatgctctttggttggtggttcagactctgagagccctaagggtccaggttagttaactcttttcatcttcctgtggagttcctttctccttcaagacctcctgttctttcctaagagtccctaagctccatctactgtttaacttgggtatctgcatctgtctgagttagctcctgtgtggagcctctcaaaggacaacatgctcctgtctgcatgcaaacataacagaatatccttaataatgtcaggaattggtcagtgcttgcccatggaactggtctctagttgagtaagttattggttggccattctttaagtcttttctctatcctctgtgcctgcatttcttgtagataggatacatttggggttgaaagttttgtgggtgggttgttatctctgtcgttccagtggggttcctgcatggcttcaggagtaaggtagaaggggttattagtaggtgagccacctatatcattttcttgatccatgcatatgagtaaaaatgaacagcataagaatattaaggttttatgcccattattttcattcttcaatgcatttatgaaatgagaaaatatctttttctatttggtggaccttttctcagattagtttatatgactggaaactgataagaaatttttgaatgtcttttagattttaatgttgctttttcaatattttggtttgtttccaaaatacctcctactatacagggtgcaagggagggaaatgataggtctgcttcatgtggattaaaaactggaagcatatgttttagtgtttggtaaatgagaaatagtttactaatacatatgtagggggtccttttaattacaattaattaatgaaaaattttggcttaatctgaatgagtcattggtgtgctttaaactcacgaaatacatgaatgatttgatggtgcccccccaggaggatttgaagtttagtggtgataaatcactgtcttgatcactgagaacagattactttccaccttcactggtcacaatgatgctctgaatatccatgagaaaaaatatgcatgctctgaaagctaatatgtagcttttctatatcatgaaggcagaatttctaatttccatgccatttgatacaaataagctataggtacagttgtaaggcatatagtagaaacaaaatgtaagagcatatatgcatgctgccatcttcctcatagattaatacagagaaacatggtttaattaaaacaaaacaaaacaccatagccatactgtagctgtgggattttgtaggatattattagttagctaatgttgataaagtaaataaataattgttaagaagtgaatcactagttagacattaacataatgttaaaactataagacagtcatgtctttcaatgaatatcaaccaacaagatccccccaaagcttccagggactaaaccaccaaccaaagattacacatagagggacccatggcttcagctggatatgtagcagagaatggccttatctggcatcactgggagaggaggtcctcgttcttgtggagacttgatgacccactagggcgctgaggcaggagtgggtggatgggtgggtgggtcagggagtgccctcatagaggcagagggagggaggatgggatatggggcttgtggaggggaaacttggaagggggtataacatttgaaatgtaaataacaaataaaaatgaaaaatagtgttgtgctcatgtacagttgatttacaacacttagaagaacaaattcgaatagcacttgaatataatagatagatatgaatgttttctagcttgactatctcacaaccaggaacttatatagtcattgatgagtaatacttttgttaaatagatgcatctctatttttattatattttattaaaagagagttcatagaatgtcatgattttataagtttttaaaacatttgtactttcaaagatacctacaccatatttaattgtcaaaatccaacaaatgtaaattttctagtcagatataacttttttacaggcaaattctgtcatttaaagtattctgaccaaccagttgttcaattctaagattgaatctgacatttgatatatactaatatctaacacatttatttcagtatctaataaggtttttgaaccttattagctaatattgtctgtcctttcccaaacattaagctctactagatgatcaatcatgtttcttttatcagacttatttaacatctactgtattctaagattttcacgacaatgcccttgctctaaactggtagctacataaaatcttgttttctttttcttcctgaaatagcttctaccttaccaagtacagtgcctaatttattcctttagacctaagaggttattgcagcatcattcagatataaatttacttccactgacacatttttctagtatttatcaagagtattttcaggtgtgttttttttttctttaaaacaagttttaaaatagaagataagtatggatttcactcaagaattagagagagcgccagacatgaagaacatatgaagggtagtactgctattcacctgctaagataaacaacagatgggataaggaatttaagaaggaagacatagaaaggaaaattagagtagcaagtgtctaagttatcttcttaactgttcttcatccacccaataaaaccagtaagaatcatccccactaatttctggcattcacttcaaggtatattgctgcttttaaatttaaattccaagtatttgatgaaaagaaattaatgatcagtcgcagctctcaagttgtttcttgcttttaagatcagtgaagacatacttaaagctattgaagtttaaaaagtgcccattaatttaagtatagggtgtatctagagttgagaggttttattatgtagcaaaaaagtaaaacaatgatagaatctttaaaactaattaaaaactagatgttctgcttgagtagatatatttacataattcgtgtgacattcacccttttggttaaatcctctttgggtatattctcctagtttctctctatttcttcctccttactgtttattcatgctttattcacttctcttcaacattagaatgcaaagagaatatgtaatctcatgaataatacaattcaaaaggtatccttaacctatttgttgaagagtacttagtcctccaatcttacattgcattgttggttatagtttatgcattagactaaaacgaaataggaaaaaaataatgttggcatctaacacaactatactcacatttactgctcagaatgtacagagaatgtaaagtgttccattttaaaatatttatatggcataaagtataagaattagaaaggatctttgaggtcatctctactttttaattaaatttagattgttttcttttaaagttctttcttccaatgacatctgacatgaaagttcagtgtgaatgggagaacattagggctcatagtctctgctcattattggttctgtgaaagcccagaggttccatagactttgaaatgaactgatagtttcagagatattgtgcaatgaacatgtgaacataagcccaaatttatgattcccaatagctacatttgtgtgttttttaaaatttagcagaatttcttctgttctagaagtagtcagtttaaggtgtctatatgataatactgcagcagtgcctaatagtgagctgatgaccataggaaaaaagagagaaagggatggtgggagaacaattcagaaacagaaacctttttgcacattgtacatcttctaagagaatatcagaaatatggccaagtattaagaatgggtaggggtgttttattattgataattcgtgcttaccaattccctgaatgacattaaaacaatatcaaagtaaagtgcctttaaatagaaataagaatgatttggaggtcagattgtctcaacaacagaagattactttctgaaaacatagagcaatatctggggaaaaaaagcttactgaggtcatgagcctaaattttattgcaaaactccaaatgatgaatagtatcaattttccttcagatcatattttaaagatccttgggaaggatattgcatatggcaaaatagatgtactttgtgaatacaaacagaattatgaacagagaagtactggatctaaagagaaacttattcaccaggatgtattatattaattaggagaagaactaataggatgacatatatttactgatgtttcaaaagatgataactaacaagaaatgcctatcccaggcttataaatgtgtttttgcaatagatatgctttttcagtttgcatgaactatgcacaaatgttagaaaggggctgaaaataaaatagaagtaaacaggagagcatagttgacttctagtgtgtgtgtgtgtgtgtgtgtgtgtgtgtgtgtgtgtgtgtgtgtataaccacatataatatttaggaatatatataatgtttagaaatatataatatataaatattacaatataatatataatatatgatatataatatgcaatattatatatatttctaaacagctaaatgcaacctgttcagtttctatagcttttcctttagaagaaattccctctctgaaatttacagaaataagtaaatatccaggtttatacattgtagaaactcctatttatgaaaaacctgtacaattgtatatgtaaagttaggtatggaaatgcttatgtagaaggagacaatgaaagtgagaagtcctgacgtttaaactttaaaattaaaccactattgcataaaaaaaaaactcattgggaaataatttactagttgagggggactgtttttttttttttcaaaaaccaaaaccctttgatattgaaatggtttgatacgctattaacacatataaaaacaagtgacaagattgctatcatctggtcaaaggaaaacagacttagaatgcacagtttgataagatgaggtctaaattagatcaattaaactttgttagtgctgtgacaatctggtatgtcattatgtgttgcatcctgagaaatatacttacaattattttaaatcactgatagtacatttaaaaccaattaaataggaattatcaagaaatatattaaactgagcaaggttaataagaaaaggctcaacatttttacaaatgccctctaaacagatggtgttctgtggcatggaagatgaaagctaggatcaaagtaagtatgttctataaactgcattacattctggaattactctacttttaggcagtaggaattttcttttgtcttaattgatcattaaatagtggcatctgactaccttcatcattattaagactttttgtatacaagcataatttcccaaaatttagtcaatgacttttttctttattggatgctcatgacctactcatataaatgctagcaagtaattagaacatatagtaatagtttaccagtgataggcaaatgcagttgaatctttctaaaattattttgtagcagccctgggggtggagtgtgtgtatgtgtgtgtgtgtgtgtgtgtgtgtgtgtgtgtgttgctagctcaaaacagactatgttatgtgtctatagggctgttataaagagtcattacttcataacaattacaactcataaaaataagacagtgtgataatcattttaatactaatgatatattggtggcattttggggctattattatccaccttttatggataatgaaagtaagtcacagactctaccttttcaaatatacaaagtttaaaatgggatgtgggggagtgggtctagctacacaacactaatggataacagtttaatatggaaaatagagagatacaaaaaaactagcaaacagcattgaaacatctcagtgagtagccaagagaaatattttacacaaagaaagattaagctaatgactagaactccttaacgtaataacttactagagtgtcttttgtaagctaaaaagtaaatatgaaacaaatataaatgagccaatgtttaaaaaaacataaaaatgcatcacattttctcattcatggtgacatgaatagaatttgagaacataagttgagtgatataaatcaggtacagaaaagcactagatatgaagaatctaaaatatattttcataaaagaaaacaaattagtgatcagcagaggataggaattataagggagagggaagttctgaaagttactgcacagtagagtgactacagttctaagtttttatgggttttaaaaatcaactaccagggaggaatttgttaggtttctaaaacaaacaaatgattgttaattttatgtatcttctatatgtaccaaataattgcgttttacacttgatcgtagccaaaaggccgagaagtgataaattattgcattttttctcataaataaatgcaattattaaatgtcaaaaagaatacagtttagcctaggaataagggtaggtggcagaacactagcctagcatgtgtgacaacttgtatcatatccttagcactaccatataaaataaacttgaaagacttaattatagacaacaaaagtacaaccaggaggccccactattttactgactagatgtcttagaaaaatgattacagttcttacagaagtacacctgtgaatatagagttccatatgtcaatgcaaataatacaaggtcctttctcacttgattcaattaggacactgtgcagaatattgggcacctaatcactaaagtctggaacaaaactatggaaatgtagtacacaggactcagatcgtgccaagagtctagagatactaatttataagattaaaaggaggaattatattcaactacactaagtaatgactaatgaggaacatgagaactttctgcaagtgactgaagaacaaatgttccaaacagagaagggactctgggaatggccacatatgaaagcagacactttgactaaaattgaaaggattcttttacataccagcatatgaaactacttgggtggtaatacatagtaaactgaaaagtatcagagcataaaacaaaacaaaaataggagtctagtatgggctttagactataagcagggcttacagaaggtatgtttaatatatttatagcttagattaaatactgtgtttctagatttctatatcccttccaaatgtcaaggcatctgtacactgcaccccatattagtgtcacagtgcaagttagagacattgtatttggtttcttattgtctaatgatatggaatacttattgaggttcctggactcccttttcagagacgagtcatcagggataaacaaaactaattttctgaggtggaaaacatttcaacaaggagttaaaaatgctaattgggtgcttttctaaatctatttgatgttcatttatggaataattaaattattgaacattgttactaactcaaaacatgttcatgtgtaggatcaatagaatcaaaccccacccctaaactaaaagctatcccaaaatgataaccacttaaaaatgaaagattaattcttgacaatggagtttcactggtgacacaaactatacttaaggacagacgccatgcccagcagtagatgaccaacataaaatgaactcaatgacatatttggagttctttgtcttataatgttttgttggaacatttttttaacttcttgggtatttatgtatatattatggcttccttttttgtgttttcattagattcttgtgtgcacaaatgtgtgtatatctgtctatatgcatttcttatgtgttttctttggttaatttaattttcttctgtttttcttgccctattccagtgtttatttttattttatgttattttatttttattattcttagactcttacctgttttcaatgagaaagggtgtggatttggataggagaggggatggggaggatctcagaggagttgagggagggaaatccatatgtagtcttactgtatgaaaaaaagtttattttcaagaaaaggaaaatatgttcatctgtaaaatatggtatgtaaagcctgactgccataactaaatatcttattcaatgaatggaggtgaaggaaagcaaacacatgtgttaatgatgacttcttgctacctacacaagtatagaatagtgaaactttccctttgactcctcctttgtgccaaagcaccagctagtctttagaataaactcattggtgttccatgtttttcaggaagttgtagtatatcagaatgtaaatgtactatgtctcaactattttctccaccatgtattatggttgaacaccatatagtctttgtctttgtcgttaccctttgaaatcctttatatatcgtggctcactataatcaatacagagtaacacacaaacatctccaacttaaatatttttaattctcagctgtcaaaagtcaacacaaatattttaacacacattgacactgttttgagtgaaaacaatttttttaaggtacagtgctttagcctgctacaaatgtaatctaaaatgactctaacaatagttagatatattaatatgtatctggtaaaattagaaaattttgactagtgccaactagtgcatagtattacaataaagtaaaaaatatgtttatattcattaaattaagattaaaggcatctctgtttgtaaactgccaaataataacaaccctaagttttgtggaagataacatgcatttcaattgttttgaggaattttaataatgatttgattgtttgtaaacagattactaacctgcattccctggagtagcatgagagatagcacatagaccagctccgtaatattttattatgatgttatgcactaagagcaatgggctattgtttctgacatactattgtttctaaaagagaaccataatgcgatgagagtccaccttatgcattcacaagagaaaggtcctgtgaccttcttggctcctcacatacttaaacattattctagcatataatttccctcataaagttcaagtataaccgaaaaatttaacagacctttttcatgcccttaacgattctataaatacaagacaaaagtcatttacaaagccattttctggctaaaaatgtagcacttttttcactgccaacattagcactagtggatactttacttgccagaaccattttcacataaaaataaagttaattgttaacaacttagtagaattgcagaaaatatcccaataagtgcaaaagggtgtagatatttgatgaagccaagacttctctacaaatttgggtaactataacactatgtcaacttcttcactgataatcccaaggcctctcaacatcaaatattcaaattcagcagtcagtatcattataagtcaggacaggccacagactcatgaagtcactttcagaacagtcaaaatggtactattaaatccatacatcccaatggaagttgtttctcaatggtttttataatgtagtagcaaaagcaggtgatgctgactgtagtcttgttactctaatcatttctacaaagagatctgggaaattgaatttgagttagaattaaaaactcgagaaagacttacagtttctgtattcactttctatacccccaaatgcatgtctaaggatatcttgtaaattttatttttttcttttaattttaggaatttaaatgtcctactctgaaatcatattttaaatagtagtatatgaaagcaatcaccacatgctagatagaacacttggctttcactataatggatgaaaatattaatatagaagcatccatttgttgttaatttgtcatatgtcaggcacttggtaatcattttacatccattatctcattattcctaatgatgggcccatgaggaattcttgtcactgaaagcctttggtctatttaaagtgacaagtcatggagggttgaattggatgcttatttaggatgaccgaaaaatcacttaatgttttacttacaaaatgtagtaggcatttttcaaagtaactatgtttccctttttcttagaataaaaaccaaacaaacaaacaaacagaaagattaatttagaatatctgctaagtcagctagatagcgcttgaattccgatagatatctccgaagttaacctctgtatatctaaattttaaggttttacaaataatgtcaatagtaagatgtgagtgaaattttcatcattagatcaatttgctctcgtgcttttatattaaaagcttttatgtttcaggtagcaggatctttattgtttattaaagaaaatcccaccgccctgttgaagtgacactcatttgtgagtctgctgttatcctagcagtaatctttgatcaaatttttcattatttcccctgggagctgcagaattgcagtggtgtcaaacttgcttctttatggcaaactcaactcactgagaaagaattcgttgcacagtgcagattgatgccaacttttgcaaatgacaatttttgctctctcgcctcctctggtgtatagttaacttagagcatgtaacatagaaaaattgtgcaaaaccaaacagattgcagaagtctagcatctcggatggtatatgcagatttgttgcttttcctgaagcagtcttcttttctgtgaagcaatcaaggcagtcttctgagtaatgtattgtctaggtaagcaagagctttggtgcctcgtccaggcacacaagctatgacactttttggcaagcaactttacctttgggggctatgatttttacaggtataaaagaaaggatggtgtctcttacagaccagttgtaaggaaaaaacaaacaaacaaaaaggttatcttctcttcagaagtgcacactatgcatccaaagtagtattttgcgatgcacatggatgttttctcattagtggcatatataatgacaaatatttttatcatttaattgttacagcccaataagaagtacaaatgaataaatattgtttacaaatcagcaaaatgttgtgtatatgagctgagccacttttaattctataacatatgcaatttatgacttttataacctggaagaggatatggaaaaaaacaaacattttacaactccaatcattgcaagacaaaatggtccatcactaactcatggttaaagaaaagggttgctacttgctgctaatgtgttagcaagcatgacattatccctttcccctcttctatgttttcagaaatgccatgctatcttgtcccagaatttgacagttacctagccaaatattttaactacccctataggcatagcttgatcttctttgatttctaatatagtgcatatatcatgattatctctaagagcatgctcgactgtatgacatattatacaactatattgatacaatcattgatggtctcatctgttatgttttaattagtgtatttttgcatagtatatactctgcttccagaaaaatggtaaatttaatgataaaatgaaagagaacaactatttctactacaaattggggcatgaccaatattaccctgctgagtagaaggatattgtccttaattctgatcagaagcttgtcctggttaactgattttgatcatcagcattaagtataccttttgcctggtgcatgtgtataatgtatagtacagtgaagctggtcatatcaaactaaaaatcagaaagaaaagcaccatgaatacatgctgtcattcagctctcatttccatatgtacagttgaggatcctagtctgagaatggtactgcccacagtggtcaggacttggcatctctattaattcattcaagataatctctcacaggcaatgacaggaacccatcatctaaattctgtcaaagttttcagttaacaataaccatcactgtataacagtttatcccaaggcattttggacaacagttgaatcagtgactcaaaatgacaacaatcaccacaccacacaaccccaccaaacaaacaaacaaataaaaagctaaaagagttgagatttttttctgtttcctggaaaaagttgatctaatataatctttttccaagaaagggtgatttgttcctcctcttgagatttgcctaagggtagaatagaactcttcttaacaattgtcttaacaaatagtcacaaggaaaagaacatagaggtaagagtcaaacttcaacagtgcaaaactaaggagtccttcagaaggactgaaccacacctaaacagtcagcatcaagcaatctacgggccaatctgagggaagcaaatgacatcattattcaaatactaggataagtcgtttttattttaatgaagagatatctcaaatgtataaatgtatggagatcccataaaacaaaacctcaaatacttgtcactattttcactctgctcttttaaaatctaccatgttatagctctttaagatttacttacagaaataaaacataacaaataaaatggaaatcttttatgttcctcctcacactgctctcaattttctctagacataaaccgtcttaaagaaaaacataacattataaatattacagcacatatactatatgaatatgtatatatgttacagcatgcataaagtttttcattaaatgcaaatccatcttcattttgtctattatagtttctgtcatagaactttgatgtgtaagattctgttccacagtttatgttgggcaaaagtactaatcttccattattgagggatatttaggccacttccaaaatttaattcttcaaacaatgattgagtaaacagacttgtaggaatttgttgtgtatgctaatagacatttgttttgttaggataggtcatctttattagatattttcttcatttacatttcaaatgctatccccaaagtcccttatatcctcccccagccctgctccccaacccacccactcccacttcctggccctggtgttcctctgtactgaggcatataaagtttgcaagaccaatgggcctctcctcccactgatggccgactaggccatcctctgctacatatgcaactagagacacagctctggggggtactggttagctcatattgctgttcctcctatagagttgcagatccctttagctccttgggtactttatctagcttcttcattaggggcactgtgttccatccaatagctgactgtgagcatccacttctgtatggcaaaaagacatttttaaagtacatctctagaagaagaacttatgggttggacagcacattttccccaaattggtaagacgttgctaaattaattgttttgtagagagtacaatacttactcgtacaatatgaaattcctaattctccttactaaaatttggtaaaattttgtcaatctgtacatctataggtcttgagtatttatttaatttatattccatcgattgattgtaaatccaagtgctttctcatagttctgttatgttaaaatagaaaattacctcttcagagaatttgttcattttctgacattctgttaaattttatttttaataataaattttcacagcaaagtccttgtactacatgtgcttttagtttgcatttcatctctttgttatagcatcagattaaattgagtacaagtcatactttcttgatagtgtgtcttttagttcatgaacatattgtacctttccttacatgcaaacctggtatgctctacaatgtttgcttattctataaatgtttgcctagctctggcaagaactatttctaggttcttttcaactttttagtactatagatataatcttggggctcttttcctattgagttatttttgttattgattctagtacattgattttatttcatgaaatcttttaaaagttcattttaaatcataatagtttgtatgaattctgggatttctctgtatatataaatgtggcatttgaaattggcaaaaattctatctaatcttcttcattttatacctgatttgttttccatgttctactgtattatctagaatgttcattaaacattttaataaaaagatttattgaaatttatcagtgataaccagacttacaacttaaaagttggcacttccccaaggtgagggaaaaatatgttgcagatgttcttttgtgcagttgaaacacaggttaggaaacagcatgtcacttctaaagtccagaagaggaatgctgaaagtagacagtgtgcactaggaggaacagaagtcacatcagagtcccactaggtaagaaaatacaattttgcgttccttttccatgctccaacattcagaagaagcagggaaaatgaacaaaaagaaatccagacaagtcccttccgctcgactcgagactcgagccccgggctaccttgccagcagagtcttgcccaacacccgcaagggtccacacgggactccccacgggaccctaagacctctggtgagtggatcacagtgcctgccccaatccaatcgcgcggaacttgagactgcggtacatagggaagcaggctacccgggcctgatctggggcacaagtcccttccgctcaactcgagactcgagccccgggctaccttgacagcagagtcttgcccaacacccgcaagggcccacacgggactccccacgggaccctaagacctctggtgagtggaacacagcgcctaccccaatccaatcgcgtggaacttgagactgcagtacatagggaagcaggctacccgggcttgatctggggcacaaaccccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtaccggccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcaaaagtcacttaaagatttacaggagagcactgctaaagagttacaggctcttaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcatacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaccaagttcacacaatatctttccacgaatccagcccttcaaaggataataacagaaaagaagcaatacaaggacggaaatcacgccctagaacaaccaagaaagtaatcattcaacaaaccaaaaagaagacagccacaagaacagaatgccaactctaacaacaaaaataaaagggagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagattcttctacaaaaggctatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgaaagatctgtatgataaaaacttcaaatctctgaagaaagaaattaaagaagatctcagaagatggaaagatctcccattctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggagactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaaaaaaaaagaaatccagcagacatgcggtgagcctccagcacttaaatttgtaaaaatgttccaatctggagtatgagagatgagtcctcctgtcatatctgctgaaaaaattgctctaatattttgcagaacaagataggacaggctattttctgaaggtgtcattattattattattactactactactattattattactactactacgtagtccacttcatttgtatctcctaagcctgtcatttttgtctcagcctcacagctccagaggcaaaaggtttctttgcaaaagcaaagcccactattatctgtgaagaggggaagggggaagaaaggttgggaatatccccaaaccagtgccaaagtaaacttgaaggttactatttacaaaccagggtaacaaatgactctagccaagaccatgagaccatattgatcagaactagagtttttgaagacaagtggggttcaatgcttccagggctgtgaataaactgatgggagccaaccatatcctcctgaccaactctgggaatgagggacaagcctgaaataagaacaaatgcttgcctggtatgtactaacattgtattgacaaagacattccaggtgccaagaaaagggaaaggaaataaagagtggcagtaaaaacagtattttattccttccccactccctttcctcctcctcctcctcagaatctccagtaatcctttctttccctacattcagaagaaatataaatgcaggaaatggggggcggggcacaaatagttagaaacaatcaaatcgcaataggaatttcacaaattggttaatgttccttagtcatcctcttcatcctcatcttctgactctttaactagcatacttttcatcttgctcatcatccaaaactccatccttgtaaccttcatcctcctcctctccactcacgtcatgttcttccctatcctcctctgcatgctccctcttcttcttccactagctgcatatattcatcgtattcctcatcctcatttttcttcctgtaaacctccaggtagcattcctcgacttcagaaccagagtaagaatcaggggcctctttggagctagagcatgtgtgtgtgtgtgtgtgtgtgtgtgtgtgtgtgtgtgtatgtatatatatgtatgtatatgtatatatgtatatacacatacatacatatatatacatatacatgtatatgtatgtatatatatatatatatatatatatatatatcctgctctgtctgtgtaattttacttgtatgtatatgtttttaaggttaggcatttggtattggatagccaattggtgcactcttccttggagaagactatttctcgcagccttcaacattctctagttgcctgtaactctttctgtaagggtgaggccttgtgggattagcatgtctttcttttatcctgttcagctcgtgttcaggtagtcatgttggtaaactttcacacatgtagcttctgacacaagtaggagacagaatcttacaacacaatacctgatgctctggttcttatgacctttctgctccttctacaatgatccctgtactttagctgaagaagtttggtataggtttattagttgagactgagctcaacaactctgcattttgattgcttgtgattttctgtaattgtctccattttttgcatagtaaagtttccttggagaggggcttacttatctgtgcctatgcagaaaaatatttagaatatattagtggattatgtgagtttatattatccccagccctgagtagtttctaggtttaggtttccagtacttgatatgatttctcgtgtgtgtgtgtgtgtgtgtgtgttttaagttcaattaaagacccgttagttaccaacaaaatattcatgtcactactacccccttaagacctattgctctctgctgatcattgtagtttgtgagcattgtgaataagactgtaagaatctttcatgaaaccttctgatatattgaaagctaaacctctgggaggaggctttcaattcaaatccagcttatgggcatttgggctctgtgaccaaagtgcatgtttttccccctcaggaatagggactaatcctccacctcttagaaacaatcaaggttattagcaatagcctataaagttttgaaagtctcttaggcaacactgatcttcaatttaaaggaaggcttcttctcatgtctggtactgggattactgttagatggtctaaaatgaaaatttcccatctgggcttacaatgctccctcccataggttcactgatctttttaaaaagaactattgcatgaacttaatgtgcaatttttctttttcaaattggtcttgtcaaatttttatatcctgattacaagtctcactaaataagcagatggctttcattcttattttaatatagaagtgtgttccttcagagaaatgtattgaaagcctgatcaattttacacagtatgggttatatatgttatatataatatataatattcatatattatagtggatatgtgtctaccatgtttgaatatctgttcatatacatatatacacaaatgtgttatatcatcttaatcatttctacgtattgaaatggaaagttgaatcactttgaattttggtgtctttcctaattcaactcctctttaaaactaaagaggtcaatccaaaacaaactaataatactatatgtactttcctaatctctaactttctttgtgacactacatttatacttatgctatactaaaaatcccaatttactgtataaacaagatactttcatgaatatttacctttgtccacaatttccagaaattttatttgatcattgtcaaataaaattgtaacctttgtttttgattgactaattctcacataaaatatttagattaactttcaatataaatctgaaggtaacactaattattaacaagtagcttgcaaaaggaagtaaaaagaacaaatagaattgattggggagtgatcgcccatactgcattgtctggacttatccaaagaaatttaatacttttacagtgaaagtaatggaaatataaataattgttctgtgtttttgtaaacatagtgataatttttatttttttagtaaaaaagctaacttgctttattctatacattttaatgggtagtgagagtctatgttttgattgataggaagctccatgactgagaatagtggacgctgatctatcccataacatagtctataccactgactaaatgacacaggttttcagactatcatgcccttactcatgaaagcacatggaactcttgaaaattttgtacatgttatatcttattgtctaatgtcaacttttctaggactgttttccctttttgtctctagtatcttaacttcctgatggaggatgagacagaaaatattctctggttataaattaaagttatcctggacatagtactactggtacatccagcaatacctctcctgggaatatacccagaagatgttccaactggtaataaggacacatactccactatgctcatagcagacctatttataatagctagaagctggaaagaacccagatgttcctcaacagtggaatggttacagaaaatgtggtacatttacacaatggagtactaatcggctattaaaaacaatgaatttgtgaaattcttggacaaatggatgtatctggaggatataatcctgagtgaggtaacccaatcacaaaagaagtcacttgatatgcactgataagtggatattagcccagaaacttagaatacccaagatataacttccaaaacagaagaaaatcaagaagaaggaagaccaacgtgtggatatgaataaaatatccatggaaggagttgcagagacaaagtttggagctaagacgaaaggatagaccatccagagactgccccacctggggatccatcccataatcagccaccaaacgcagacactattgcatatgccagcaagattttgctgaaaggaccctgatatagctgtcttctgtgaggctttgccagtgcctggcaaatatagaagtggatgttcacagtcatctataggatggaacacagtgcccccaatgtaggagctagagaaagtacccaagagctgaagggaaaaacaatatgaactaatcagtactcctaaaactcctgtctctagctgcatatgtagcagaagatggcctagttggccatcattgggaagagaagccccttgctctagcaaacttaatatgcctgagtacaggggaaagccagggccaagaagtaggagtgagtgggtaggggagcagggcagggggagggtataggggacttttgggatagcatttgaaatgtaaaagaagaaaatatctaataaaaaataaaaataaataaaaataaaaataaattaatgttttcacatgtcattgatgagactctaccaaatggtatgctccatggtttgcatttgtagagctggtatgaacacttctttcttttttcttttttttaaatttattagatatttgctttatttacattcaaaatggttatccgctttcctagtttcccctccaaaaatctcctattcccttccccctccccctgctccctaacccacccactcctacttcctggccctgacattcccctacaccggggcataaagccttcacaggactaagagcttctccttccattgatgactaattaggccaacctgtgctatatatgccgctagagccacgagtccctccatgtgttttctttgattggtggtttagtcccaggaagctctgagtgtattggttagttcatattgttgttcctcctatagggctgcaaaccacttctgctacttaggttctttttctagctccttcattggggaccctgggcatatgagcacttcttaatgttctaacttatattgagcatatgttttcatatctcgaaatgtaagatatttgataatcataagcctgcatcttaaaaagattattactgagcacaagaaaaatgaaattaaaataaataattacaaaataaattgcattaataaaatgattcatgcacaaatacagtaaccctaagtttctcaaatatagtttgtaactcagagtcataaatgttctcctttcatgaaaaatgatttactctaaatgaattagactccttgatgcttaggatgtcatagacaaattttaaaagaaatgttgtacaaatggtttaaaatagttcactatgtatactatttgaggatagagttttgaagttctaggttttaaaattcccaaatcagggatagatatagacatatatagatatagatatagatataatgatagtaatttttttactttgcctccatttcataataccaccttagactttcaggaacaaacctgaaactgcagctgatatttcataacatattccctggatacttttctgttgcttccagcctcattttccgaaacactaagcaattattctcattactgcttagcacccacgttgcacagtgacaggatgcaagatatccaagtatgatggagctttctgagtttccagctgtatttcaactataatttgagtctcatcaaagaagccatgtatataaaacttttagccagtgagtagtgtctgtaaggtttaagacaaagttatctttcctgaggaacgcttattgtttcacctgctggaatgagaaacacactaatatatggatgatcagtaaggcctttggtgtaatatgcaaagagttagcatcagatatttctggtcaatttaatattcaacaagtattttctggattggcagatagccataatttcttccagatattggtaccgtttcctcaatttattcaggacttatttggcatccattatcagtaggaacaatgatgtttttctttacctttaagtgattaaggcaacttagagcaggggttgtcaggccatgaccccagttaatgtggctcagccttcatttctgaatgggttcataacatggttgcttttgaaacttattaaaataaaaaaaaaagaaagatgtttgtgaaatgtaaaagttatatagtttttgtgccaatgaaaaccaaatgaaaatcaacatggtcacattcattcacttaaatgagttttttttttttaatttttcaacaaagacataaagcgtttagtagctggctttttacagaaaaataaataaataaataaataaataaataaataaaagaatgttttcaggccactgactaatgagattgatgaaatggttttcataaagaaatctgctagaggaaattgtgactacttcattctaaatgtgctattctatcggagcaactggccttatagtattagcaggtacgaatgcacaagaagagaacagtaactcctgatgtaattgcccacattcagagaaaactgtatgtgcagctgaagccagatgttgaaggaatgggaacagcaatgaaacttcagaagtcgttatgaaaaaaactggagaactgctaggtgagctgcaccaaggatttgacaggaagctctaacaaaagaactattattttttaatttagtgtgtattccctgggatggatttttaacagacaccttcacaaaaagccagttcccataaaaacagttttaaatgctaaagcaaaagactcacttccttgaaatttacataaaaccaaccagtgtgagggaagttttcattttattttatcaacagtgaatcttatagaaaatgttgacaattaatttacaatttatattatgaagttgtatggtgatatttgcatccagatgagatacgtaaatcaggagtagaggagaataaattcagatttttgaatcaaagaaaaaatagagattgcagtattacacgtatttttaggcttaaaagcttctaatgtggtgtgtgttaaaataatacaaatggaagtaaagtttaactaatagagttcatttaactaacaaagacaatgaaaccagatatttcactccctgaatgggattacatttggtggttatctagttaatttgattcattgggatttgtaaattggatcattcagagtccaaagtgaaatggtgatttaaatgcagcccaatggcctctagagaaataatcaattccttagaattcatctgaagaattaagttttatcctaattactcacctggagaattagctagaattttgaagcagttgactgggggaaaaataaacctggtccttccatttagacaaaacctccagggaaaacctttggggacatttgagcccattaacaacaggcctgaagcctattttcatgataaaaaatttattcaattatgtggctaggtagagttagcaaatctattcacttgtaacttagtatttaggaaagtctactatgcaccaaatactccccaaatcattaagcacaccaatgtaatgtgtaaacagcaaaacagtttggaagcattcctagagtttacattatttattgcagtgtgtgtgtatgtgtgtgtgtgtgtgtgtgtgtgtgtgtgtgtgtgtgtgttgcctgcacatgtgatatgaattattgcatgtgtgtagtatatgttggtaaggagtatgtatatatacacttgtacctatgaaagtccaaaattcatttcagatgtcttcctccattaagctatactttatgtatttatgtatgtatttatttatttccttttttacttatgagtcagggccaatctctgaaaaagaagctcatgaacactgggtaattccttgggaattccctatttctgcttctggagtactggcattataggcagacactctgcccattccacttttgtttaagtcctccaaactttgatgtccatactttctggcaagtgctttatctactgagcagtattcaaacctggactgtgaaatatttttatagattagcatggtggacatatatttaatcccagcactcaggaggtagaagcagttggacatttatgagttcaataagtccagtatacattgtgaaataattgtattatgttatttttattattatgtaataatttgaaattttatgaatataattatgaaatattgtttaaaatatattatgaaacaatactgtttcatatcattatgaaataactccattgctttatttttattatcttactttaaattattttaaactgatatataaaaaaaaacataaaattcagtgaggtaccatgctatatttcaatagatatatacataatatgatgacataatttataaaccatattatatattataacctcatacattccttacttatttattgttaaaaatatgggcatcattttcattagtctttaaaaatatacaattgttttctatagttaccctgttttataacacaaagttccaatgtcttactcgtataggagtataacttagtacctactcatcagcctttcttgtactccctctccttcccccactattccttctttatacaacttctaggacatcaatgtcatattctgcatatcatagaaacttgtctttcatgggtggcttattttatttaacataaaaaatctctagtttctaccattgctgtcacaaatgacaagatttcatctcttttagctaaatagtaatctgctccgcaacagctgatagacacaggttgttatagttcccatttttatgaggtagacacaaacagtaattaccataaaaagcaatttccggcagaggcgcacctgtataacaaaacagagtagatagaaacaaactaagatgagtggcattactttgtgtaatacagagacatcagagcttcataaggtgaaagctaaatgcctagaaaagactggcatgggaatgtttgatgtgtatattcacatatgtaaaatcaaccctgatatacaagcagatttccttcacaagactatggtgtcatgctctccattcaagctcaagttttgtcttgcaagcaatagtttgaacaaacttgtgaaagataactatgttgtctattattataactattttatcataagcaatattctaataaactatggaagctaagagatttttttataaaaatcatgccatttcaaggtttgctagataaaagaaacaaaacaaacaatattcttatttaaattttaacttcagatgagcaacccttttcaggacaaatatactcaaatatggtaaatgcttactaaattggacagtgcaaaattatttttcaatatcctgtggaaatggctcattagataaagtgttcattgcacagtcatgaggactggagttgagaccccctaaacacatattaatgttgagtaagcatgtcagatgcacctgtaattccagtactaagaatgttgtaaataaaggattcctgaagcaaacagaatatccagaccaactgtatctgcaatgtcttagttcaagtaaaggacctacttcagtaactcgataaagaagatggatagcccaagatctttagagacatgtgcaaatgcacacaaacagacacacacacacacacacacacatcacaaataaaatttaaataaaataaaaagatgaaaaaagataatttgtcatataaaaacactaagagatatcccaatttttttctcaagaatttgctctttactgttttcttttagttatgtttagagagtgttagcaaatcttcaacacattattttggcaacttgttaatgctggcaatatacatgacctgttagaagattagtgttccaaaaataacaggaacccttccccagagcttttcaagagctgggctgaaacttccgcactacttttcagcctattcaaatgcatctcttcttttgatacatatataaaaaacatatataaaaacttatgtccctgaactccattgagagggttattttctgtagcttctttatgaaaatattttatctttaacatttttcaaatataaaactacattgtgatagtaatcatgcatttccaagttccatgccatataatactaccatagggattttttttaaatcacccttcagaaccagtggatgttgttgggaatcagatactggtccataccatgccaaaacaaatcagtgaaaattaaaataatcaattcattatttaattaaaaacatctttttttttccattttttattaggtatttagctcatttacatttccaatgctataccaaaagtcccccttacccacccacccccactcccctacccacccactccccccctttggccctggcattcccctgtaccggggcacacaaagtctgcgtgtccaatgggcctctctttccagtgatggccgactaggccatcttttgatacatatgcagctagggtcaagagctcaggggtactggttagttcataatgtttttccacctatagggttgaagatccctttagctccttggatactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctaccattcggtattcctcaggtgagaattctttgttcagttctgagccccattttttaatggggttatttgattttctgaagtccaccttcttgagttctttatatatgttggatatcagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggaaatctttccatcttctgagatcttctttaatttctttcttcagggacttgaagtttttatcatacagatctttcacttccttcgttagagtcacgccgagatattttatattatttgtggctattgagaagggtgttgtttccctaatttttttctcagcctgtttattctgtgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccatctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcgtcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaactgagagttcctcttggaggattttacctttgatgagaatgaagtgtccctccttgtcttttttgatgactttgggttggaagtcaatcttatcagatattaggatggctactcctgcttgtttcttcagtccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctgggtttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactcggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctcccctgccgggtgggcacctgtcctccggtcaggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggcgaccgctgctgctgtggcttaggccgcctccccagccggacgggcacctgtcctccggtccggacggtggctggctgtccccggcccacaaagggtgctgcctcagcgcctctgtacttctgcctgttccagaagctgtcaggttctctggcgcaccctctcacctgttcagactaattccctaagttcggcgggtcccggaccaagatggcgaccgctgctgctgtggcttaggccgcctccccagccgggcgggcacctgtcctctggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctccccagccgggcgggcacctgtcctccggtccagatggtggctggctgtccccggcccacaaagggtgctgcctcagtgcctctgtgcttccgcctgttccagaagctgtcaggttctctggcgcaccctctcacctgttcagactaatttcctaagttcggcgggtctcggaccaagatggcgaccgctgctgctgtcaattaaaaacatctttgtgggcactacaaacacatggtgcacatgtgcagtcaaagtagccatacccataaaattaaataaataataaaaccttaacatttggctaaatcagtgtttctcaaataaatattaaataataattatatgattttttattaaataagactagcattctattctgttgtaataatgaaatgtttctgtttgtcaaaactaagttttggttttatagaaatgaaaacaattttcctcttcatgtgcaaaggagaaaaaagtcaaactcagtatgtccaaaccttctcccctaaactggcctgctgtttgtcttttgtaactaaacagactgctctccttatgaccagctacaaatctgaaaagactttggttacagttgataattgtactattatattattttgcattcattatttataccttcaacatgaaaatgagatgttagtattcccattgtgctgataaatattctgaaacagtgaagacagctttggtttggctattgaggatgagattataaactttgttgtaaatcacaacacgttttaatttttattgaattattcttaaaacccacattgctgcccaattctgtgccctgtgtgtctattgacagatgaattattagatgtaaagggataaggctttgtgtgaagaggaatagcaaggcaattatagccccaggaaagaagtgttgatgcacaggcttattcttatagatacgcgttccattttcaaacaaataaaaggcttagcttcatgcaaagaaatatttaacaaaaatgttttgtattatcctcttctggtttaagtttcctgaactgtaggagatagccaaggttcacccatttaatctagttacagtgtgtactgcacattaactaggatatattgattttttttgaagttggagaatacagtggctcagaatctttagcctctgatttaatcaacctcaaataaataccaaactaaaatgatttctcagtttatcaaataatatcgcttaagtgcagactatccttcatcccggagccaaatccaggcctctaaatgagggaaagtccaaattatttagtgaaagttttgggtgcaaatgtataaaaacaccattttgacattcaagcaaacacccagtattagtactaactggtaataaaaagaagaaatggttaagcaggacctttcttggaaattatattatgaattacgtttatggttgttgccagttaaagtattaagtggcaattactattaaaattaaatagtaagatatttatcaggatcatttttaaatgtataatgttttaaaacaaaatttccgcagcaataaaatctagagaaaatgtcaaaatcttcaccaaaaaatactcattttgcagttagtcttctcatttgagcacccatcaccatttacctcaaggtctcaatgttcaagacaatgagattattagtgtctagttttcctcacagaacagctagctactgagtgtacaagctactttagggatgagaccattgtaatgcagaaagtataagaaatgttataaggtgcacttatgaagcctcttaatcaatccctcttgctataactgggaatgctgaatgttttgcctgtttgtggtgcactcctttaatcacaagagttgtgatctcaaccattatatctgaggtggtttaagcatgtttgcaatcattcttggtcttgaattatcaagacccgttttcttcatttggactttgtgtaaattgatcttgacgctaagaaaggataattcacattaaatgtagtgtttacttcatatagagtggttttctggaaacacagttatactattccataaatgttacttccaattatataaataattttgtggagattgattaaaaatattttaattaagttatttcaacctgcagaactgtctctaggaatggtaatacaattaaatcatttctgccacaagctgttttgtattatgtaacattgataaatatattatattgactctcttttttattttgtttttttattaggtatttatttcatttacatttccaaaaagtcccccacgcgctcccacacctgctcacccacccacccactcccacttcttggccctggtgttcccctgtactggggcatataaagtttgcaagtccaatgggcctctctttccagtgatggccgactaggccatctttggatacataggcagctagagacaagagctctggggtactggttagttcatattgttgttccacctatagggttgcagattcctttaggtccttggttactttctctagctcctccattgggggccctgtgatccatccaatagctgactgtgagcatccacttctgtgtttgctaggccccggaatactctcacaagagacagctatatctgggtcctttcagcaaaatcttactagtgtatgcaatgatatcagcgtttggaggctgattatgggatggatccccggatatggcagtctctagatggtccatcctttcgtctcagctccaaactgtgtctctgtaactccttccatgggtgttttgttcccaattctaagaaggggcaaagtgcccacactttggtcttcgttcttcttgagtttcatgtgtttagcaaattgtatcttatatcttgggtattctaagtttctgggctaatatccacttatcagtgagtacatattgtgtgagttcttttgtgattgggttacctcactcaggatgatgccctccaagtctatccatttgcctaggaatttcataaattcattctttttaatagctgagcagtactccattgtgtaaatgtaccacattatctgtatccattccactgttgaggggcatctgggttctttccagcttctggctattataaataaggctgctatgaacatagtggagcatgtgtccttaccggttggaatatcttctggatatatgcccaggagaggtattgtgggatcctctggtagtactacgtccaattttctgaggaaccaccagactgatttccagagtggttgtacaagcttgaaatcccagcaacaatggaggagtgactctcgagaatatcactgttattaaggagctcgttcatttataaatgtatagtgtatatctgaatgtgggcagggatatttttctcactttgctatacttcattgctctttctgaaagcttttactactctatattaattaatcaatttagaggagatgataattatttctatgaaagcacaaattgatgcaaaaataaaaacttagaaaactttttgtacctgaatacttagtattgtacatgtatcctaaatcaaaattatataaccctttgttaatacactttaaatgacaaggccatttgttgatgatttggcatgtctattactaccacatggcaagatttcctaatattcacagaaacacattttcattcttagcatcacaggtactttccttacctgcttttcctattattatttttttaacgataaaaaagactgtgtctaatcctgacaactaatgtgtgaaatttgctggcactatcttcctggcaaatagaggatatattctcagcgttgccaactgtggtaggttttaccatttccaatgtttacactagtgtttgccttgaatttccctaattccagagtgattaagaactaaaaatttcccaaggccactgaaaagttctttttagatgattaggattaaggaaattgaatttgtgacgatataacatattctacaatttttagctggaatttgtaccagtagatattagtgaggaaacaagacttagggaagtggagcattttattcctttgctttatttttgcctaaacttctatgcagcattttaactgaagcccaccggtgaaggcctggatgtgtcaaatatatagcaataaaatgtttcaactattttgattctgagactctgagtggaaaacttagctgtcaatgtggggacaggttgaaagcaagtttgtgatcatgataaggttcaagaaattcagaggtgccctgatcttgttgagctttagatgaagaatcgagtaaccccagataactcaggagaagagagagtgattttgaagacagggaaaattgagcactttaatatgtacaatcccaggacttttctctttgcccctgatactaactacttagaactttaaaacttttctaaattcagacgttttgattagacagatacttatgaagtattttgttcactagaaaagacaggcgttatagtaattataatcgaaagtgatagacatagattctgtttgcattgatttgctttgttctctctctctctctctctctctctctctctctctctctgtgtgtgtgtgtgtgtgtgtgtgtgtgtgtatgaatgatgatgcatgcttgtttatgcacaggtgcgcacatgtatggttgtctttctccaatcactcttcaccctggtttttaagctaaggtctcttgaagaacctggaagttgttcacttttctgaactggctggccagcaacccacctctctaccctagcttcccgaatattgaaacagttcaggtttctgtcggtgctcttggttatgaatagataaaaggttctataggaactgaggcaagatgcactatacaactaaagcctatgcttgctcattaaacaaccatttgttgtatacatcctatttctctggcattgagtatagatggtacacaatgaacaagtaactcgggctttctgaaaatttatagtctgaaggatgaagggaataaagtgtgcatgtatatagttgtgtgtatgcatttgtgaatatagggcaggtattacaaactactacaaaaaaagcacaaatcaaagtgaaatctcattgtgcaaagtgacagctgagtgtacaggacagattctgtaatcttcttctatgccttccattgtggtaagtacccttgtcctacaatgcattgttatatgtcattttaagggttatattttatctccataaaaatgtttctatgacccttaagatattaaacttctttgttaccttaccacctatcataatgtccattcaatataattttctacgtttaaaaattattaaataatggagcacattcaaagtgagctgaatcatagattttccaaaatgtgtcctattcattttttaaaatacctaaagtggcataatgttaaaagggaaagaggtttatttacctcacaggtctagagcttgaaggtcatgtttccaagatcaggttagctcttctcaggacttcattggaattgtatcccagtggcaagaggtcttgaaaaatggagagatcacagcagcacgggtgagcgtggatgaggtgcttttgtgtcctccctctgaaccctgactcttaatgggacagtagtagtacatttcaatacaaaacaaacaaacaaacaaacaaacaaacaaaaacaccctggagaatactctcaagatatgctctttgattgtcatgctgaaaatattccaaagcacagaaagggagaagaaactcaatagcatgcacccttagctacctcattgctcagatgagaaaactgacaaaacagttttgagcactaacatctgtctcgaagaatttcatctgatttagtgagacaccaaggagcactgtcatatgcaaaggacattgctacattcaaagagatgacaggcaactatggtgtgtattgatttctaaggtacaattgggggacattttccttaattcactttttctgctaattcgctggctccctagaacctctcacctcatcagcttatctataaaatgatcccttcaaataaatagcataatttaaaaagtgaacacagacagaaatacataaaactcaaagtaaaattacacattcactaatgggatgtctgtagccagacccttactatacaggataagtccttgacaggcttattattagcacggttgcctttagaatttaatcaagacactaatttcaaactgaaacaagtagggggaaaaagagcacataaactacagtaaattgaattctagaagactaagcctctggaggcctcaaaagtgggaaacaggaagctcagcctcatgcagtcagctgctcacagtatatttggtaaatgtcgtattccaaaagatagcttgcaagagtctgggctcacgggccagggataaagcatttggttgcaacaagtctaacatatgcgtgatcatttttcattttaagtgaaaaaccagactggcacagagcttcgaattttcaaaacaatttagcactctgcacaggggggaaaaaaagagtaaaataactagtttgctgttaaaaggagcatctactgtgcatgccagaatctggctcatattacatgaatatgtcatctctcatacttgtaatgcacccgttttggaaatatgatgcttttaaaggaattctggaaagataaatcttatcaagcaacctaccctttcttcatttactactttttcctgttgatgtcaatgaaaagatgtttccagtgttctcagtggtgagctgcaggcgaacttttacgtttcaacaattttccttgcttgacgtcaagatcgtattttcaattattaaatccataatcttgaagacaagcctaatttttgtagcttatgtgtgaatttgcaatttcagtgacttagtttatgcggcgcatgagtaataaaccatcacatattaaatttggaaagtaccaaaagtgaggaataagatttacaatgtgctgcaaaaatgatattcattattatcttgaattttacaaattcgtggtaaaatagtgcaaaccgctgtttaattttaattaataaaatcagggaattttggggggatgtattttatgtaagaaataagtctctactagctagtaagtgcctactttgtagaaagaactctcagcatttcctgacttgaactagcaaacctgttcatccgtttgaaagacaataaggcattgctaaaagcttatctacacactgctgatggcccttttctgttcttgcccatgtgccctgtatttaaagcaagttcagggggagggcctttaacccaagggagagagcacttgaagtatccatgttcctttccttttcttttcttaaattgcctgtgtagagcaagacatttattagtgagccttgacagatccttgagacttacaaaatcacccgtggagggataataggctaactttggatcatgtttgaacttctcagctggtagtcatgcagcaatacccgcccctggaatctggacccaccagcctgtctacactcccgtcgaccttctctattttattaacaactgtttctggttgatgcttagtttaacaactggggtgtaggagggctattgttacattcaaattagtgtattttttttaagttgactctatccttcatagtaagtgtttgactttaatttgttctttgagctcacttctcccctcttgttattcacattgatctctacacatatgaatagccatagtatttaacacttatttgtactcgaatatctcatatgcacgagtattattctctaattgtcttacataaaacatgtaatttaaaatttgtagccttttggcttttgtataagcatttacattggaacataaatatactgttataaacatatactggaagccaagttaatagaaattagatatcttcttacagccaggctattattaaactgaatgatcttgacattactttagaacttgttgcatggtaggaggtgctttcaaaagaaactttccatctcagttcttcatatcacattatgcttttaatctcaaatgacatatttcagcatgagtactaactaactccagttgaccaactcaactgaagctttgtgtttgccattacaaaatttaaattcagcctagaggaaacatttcctacagttgaataggataaagatgtgtttctcttttaaaaaagcaattacttaagggtttttgaaatatcttcatcagtgtaataaatttgtggttgtctatgggggctactttaaaaggtatttctgagtatgcagatgcatgtgtctctgtatgtgtttctgggccttttctttggttctttgttgggggcatgttggctcttttggcttattcaggtttgtttgttcattttagatgcctgtttggtttctggagagagagagagagagagagagagagagagagagagagagagagagagagagagagagaggacaaatgcagatttggatggtcagaagatggggagaatctgctgtttcacttaattgaacccattattattatagtaacaggatgaatatgctgagctgaatgtgcaagtcttactgtttcaaccagaatgtaaactcgtgcttcagtaaagcatctatgcacaatacataaattacctttcaatgctttctttatgcttcacttttctcataaatcaaatgattataatctatctcaaggatgctatgcaaactaatatatatatatatatatatatatatacacagtagctagtttacttatggctttttcatatatgcttagctttcgttgatatgcaccctgcatgattgttcttactgctttctatagttccttggtgatatcttttttcaactcttatgctgaatctcttgttttagatcccagccttataattgagtgactacagatacatttttgctaaatcaactttatccatttctaagtataattcttattttataatttaattttattttttattgaaaagttttttcatgcgatgtattctgctcatagtgctcatagtttttttttaatctcacaactcctcccagattctcccaatctcctgaccatccaaatcctctctctctctctctctctctctctctcactctctctctctctcatcagaaaacaaacaggcatctaaaatgaacaaacaaacctgaataagccaaaacaaagaacaacacaccaaaaaaggagaaccaaataaaaggcagaagaaacacatacagacagagacacatacaactgcatactcagaaattaccctaagaaacacaaaatcgaaaataataacatataagcataagacctgaaaggtaaaaaaataaaatccagacaaaccatcactgaattcattttgctctggccatctaccactagtcatagggcctgcacttaagagtgatttcaatatccaatgagactccattggagaaaactaattttttccatccaagaagattttcatgggatatagcttctgagttaggaatggggtattaagagatccacttctcctctcaatgctgagtctccatttggcttagaccagtgtagatcttgtgcatgctgccacagtctctgagtgcattaaaacatcagtcatgctatatttagaaggccctgtttccattgtgttccccatactctggctctttctgactctttcagtctccttttgttcagggttcctgagcccttggggagggggggttgacataaacatcccatttagaactgtatatttgaaggattcactctctctgtgcatattgtctgactttgggtctctgtatctgtcctatctgcttcagtaggaagaatctctgatgatggccaagcaaggtactgatatatgagtatagcacaattatattaggaatcatttgattgctactttaaaaaaaattagatcagtttggttttaccaaactctgagctatctagtctgtattcctgtttacctggtgttgggtatctgtgttgaaaacgggacaaggcagcaatcagatgtaaagtagaaaattacagccccatatgttttctcctgagtcttcctttggtggccagagccattgcttcacagaagcacagaatatatccaggaatgagaatccttggcacttgagatagacagaatactaaacgtgttcttatcatttgcttgacctaaattaatggcaacattgatgaagaacaatccagtaggactaaagcacattaaaattagagttttgtttctccaaaataatgttctgctttgagatttttttcgttacacaaaagtaatgaaacaaacaaaaagtgaagtacatccatatttgttgatacctgacattttattataacataagatttaggcaaaatcttatttaacctgggtttcagtgttctgtggtttatcttgtcaccattgggtttcatttctgtaattgaacatcgaattgtcacagcctaaaattaaaaggccatcttcctttaattaagtatgcttaccggttttgatcctttattcagctccttcattttgtagggttgaaattagaggttcctgtgggagatcatagacaaatggcagtctcaattgaagttgtatttttgatgagttccagaacagtttcaatcatcagtggcttaaattccatcagttttctaccattaatgccttttataaactatcccaaatttgccttatcatttcataaaatccagagcagattttctatatatgacactggcttcataaatcaaatttattcttctttctcatcaaccttatttcttgtactttagtaaagctcaactctacctattttttaaaaccttccttaattctggtgcaagtttgccaatacttaccttggctagatcatttcaacaagattttcatgattaaaatggacaaaaactacatcttattatatatagaaatacatcctgtgtggtgctcagcatagtgctttaagcttataaaaagaagttattgatctttaatgaaaggatcgtttagcctgctgtaactttgatattgtttcctcagtgataacttattgcctatcttagttaatatagatgacatattaatttgaatttctgttaaaactagaattatattattctgagagggaaaaaaagtatgtgttgacttatttgccttttggctgtactaaaatcagtaaatccctttgtgatttgatataaaatcagtttgtaaatggttgttggatttctaatcctgaaattcaggaaataaaattggactttcaactctagtatctattttgggagtgttgtattagacacatgctttccggtgatttacttggaactcaacaatgtctgtgtggtcgtttctagcacacaacaacttcaagaaatagtagttttatgccatgagaatatgtttagggacttaagattattttgacaaaagctaggtcagaaagttaatatgaagaaggattaaagactttgaaagatgccagcaactatttgatgattatagcacttcaggattataacttgcattttctaaatactatgcacaattctcagatttcaccattaaaattccacttactagtttaaaagaaaaacctctagaagtagctcttccagaaaaagcattccatatttcttagtattacacttagcttctaaagtataaaaatgaacacatctaatcttaagtttattcaaggaaggaaaaggccctttatggttatttcattcatcaaaaataagtaacaattttgtctgtagataaatatttctgataggtctctagaaacattaagtattttttaaatgaaatcctgaaattcaactcagcaaactaaaacgtttttttttttcctaaaggactttaaaaatgcctgcaacaatatgatttattttctctttcatattaatgttccaatatacttcttgaaattgacatgcatactactgcgatgatgccaaccctttatgtgtggcttctttaacgcatgtatttattgtcctaatagtgtaactggggtactgatgcattcatacattttctttgatgaaaatgtcttgtgcatatatagcaactggcagacggtagaaggttcatttgtaagtcccaaactgctccgaaactgctaaatgatccaatcttgtgctgtttgcctaaatagaagcagcattgtgccatgaagagttctgtactaggctcaggaaacatgaatgctggctatgtgagcctctgaaaatccatctattcatttattaaatcattatattatggcatataggtaaggcataagactgagaataggaagcagtataaaatcaaatgtatgggtacctgacctaatggaatgtacagtcttgtgacaaagagggatggatacataatgacagtattgcactgtgatgagtatgaacagggagagacatggtgttatatgtaaatatgtcatagcagaatttgttcaatactgagaagtcagaatacatttctccgagaagatagaatttactagctctgtagccacaactaagaaaagagggatcacaacattccagagataggaaaagcatacagaatgcctatggtattaaaacaagcaaacaaaaaacaaacaaacaaaaaacatgctaaacttcttaaagacaaaacgcaggtcaaagtggtaaaaaaaaaaaaaaaagtgatggatcagatagcaccactctgtttcctgagtgctgctgtgatatgaacatgtgtctaaagtatctacctcagtaacttcccactttcaaactatgacccaaaatatactgtgttgtccttcatttgttttgttaggtgtttttcacaccaaaaaaaaaaagtgacttacgcagtagtatatgattttaggtcatattagagatttttttatggtgacctaaaaatctaataggatgcctttgaaaagatttggtcagggagataaaattgtgaaaatttgcatccaggaaagatccctctaacaacattgtaaagagtcaatcagaaagtgcctggagaaaaaaaggtaggaatcagatagaagaaaaagaagtgggccaggaggatgacagtgtcagagaggtataagtaggtggcaatgaagaaatggaagattcaagaggaaagatgtaaattggaagagcttagattagatctaggcacggtaatgaaggctggaactatcagtactaactcatatatttaaggcttaaataggtggataatatgtcataacttgaaatatagaagaccagaggaaaacgatgatttgttttggtgggttcaggaggcaagaggataatttagatgtgatcattttgttgtatttgtttggttgctactgttatgaaatttttgactcattattttctaaaactttcaaataagggtgaatcataaaagtatcttctattgagaaattgagaactttatgtgtgaaaaaaaaaaagccatagcgaatatttcctttggggcatgtggaatctcagctgtaaatactaccttcagatattatagctgtattaaaccattgaacctcagttatcaagtatgacaatctttaaaccatatcaatacaaacctgccaaataatttggtcaataacatgaaacgatcagttacataaataattgagtatattatgagttattaaattaaaccactaagattaactggcacagtagtctaaaaatctgtatgtgtatatatagatatagatataattatatataactctccatatatcaatgctgaacggctgcagaaggcacttgctctctgcatagaagttcctttaggggaattttctctcctgtttccaccatggttattgccactcatgttgtcttgaggtatcaaccatgagtagtgaacatacagaaacaaaactatataataaaatattataatacagtctactctgtttactctaagtttttaatttttgaccatatttagtcccaactttgtaggctcactatacttcatttgtatttgtctctggcctcgctagccagtatttttcaaaaggagctttctcttgtctttaattagcacatgttttgtctacgttcccttcttaaataaatgcatatgtgtaagtaaggtttcaatcattccatagtatactctcatagctaacctttttaggttttaaatagcatgttttgaataaaatgattttcaggatttcaatattaagaaggatgataaagggttagtagaatctgaatattacttatgtaagaagcatgaaaaatgagccttctcagtacatggactatggcaactgagtgaattattgacaaccttaagaaaaaaaggtaaaaatttcaaccaaatcatacccataattaatcttaatgaaatactagttcattctttttctttacagcttgttatgcatgaatatataaaagcaaggcctaaagccaaatatatttttcatgaaattctttcaaattgaggtagatgaattggcatttccatgatttatgtaataagagattctttcctatgcaatatgattattattgggtattaaacattacagcatatgtgggcataaacctaagattagtcaaatattgtttgttctattaacgagaaaaacttctatttgtatcactggcgaaacttcctagccctacacaataggactagaacatagctagaagaaaaggctatgttagtcaccttcccattactttgacaaaatctccaagaaagtcatttggaaaagagggaagatttaatttgattcatactttcagtattactctgtctccattgcttgctgacaaggcagaaagaaacagaatgtaaaagccacgtgataggaaacaaaacagaacaaaacaaaataaaacaaaacaaaacaaaagtcaacctagccagaaaccatagagactgggtacaaaataaacttttcaaaattattcttccttggtggtgaccttccattaattaagcgataaaccttttggctattaattatttagtaaatgaggttaacctctcaatagatctactagctggggctaacgttttgatatggtatgagaaacattttatatccaaaccatgactaagctcacaggagaagtggccaaaatttagaagccatgaaaatgaaaggtcttggcagaacaaaataaaggataaaattcttcttaggaaagtaaacagtaagctaaaaacctgatatccaggttaaacatgaataaaaccaagtcaaaagcagtatttattctgggattcaatatcaaacctagctctataataaattttgttataaagcaatgtaggactcgttacatgcatgtttatgtttaatgtttatgaattccatgaagaaggtatactcatattttttttcaattttatagctaggaaatatgagttatgtgattctgagctctctctgtctctctctctgtctctctctctgtctctctgtctatctgtctctctctctctgtgtgtgtgtgtgtgtgtgtgtgtgcattatctatatttctctatgtctataacaaaagttaaaacttcatttgtttcccttaattcttcatgactaacatagtgcctgccctataaaagacactcagatagatactcaggaggtttgctgctggatgaaggagtaaaggctgctgcaagcccccagtcacagtgtgtcatctagtcacggatgtgtgagttcatccctagccactgccaccataaattgtattttgctatattagacaccctgcaggccttatttctactggacaattgataaattaatcctgatataggatgatagcagtaaataattactgtatgttaatgtgtcatcacacctacataacttatttgcattttaatggagcaattgtagatgtaattccttcaggcaaaagaaaatgaatcttgagggtaggaaagtgctaatctgggatgtggtatggagaaaggtgctaatatggaaatcccaggagactccctgtatgtgttatatcagttgtgatctttccttagctttgtattagatttgttgattctttggagcaaaacttcaagccctcttgggcaaaggcaaatggttaaacctaataagatgcatgctactgtgaaattagattaattagctagaatttgaattagcgttgttttgcagataaaatgtatccaaaaatctacgtatataaaattttatttgatatgcctacaatgtactatattaaatataatttttctcttgtggctgacaaatggggaaaaatgaggcatctcatgaaatgattggaaatatttcattttatacctgtgtatcatgcagaactaaatttaacttaccccagtgaaatccatttttggtcaattctttctttagacagctacaataaatatattattgagttttttaaatgtttcagtaagctcgcctttctgagacatgttcacgggttacataaatgatatactttttaggtcaatgaaacaatttgaagttattacatgatgtgatttgtcacaaaatatagagagagctaacaaatgattgacggacatagtgggaatacttaagatggtcatttactcagcgagtatttggtgagcacagtctatgcatcagaagctgtgaaagaaagcttaggaacaggaaacattaacacataaatgtttcatgtatcatcaagttagtttgtggagcttacacatttttcctgtgaaagatcttagaaactgtttcaatttgaattgagaaccttattgattatcacattaatttcatatttcttcagctgctatcatcttgtaataagtttcaaaatcagtattattgctttagcattgcttcttttaaataatgtttggctgatccggattttttggtttcctttaaaaaacattagatcaggataaaattgaagagagatttgacattacttgagaatttaaaacgtaagtactgtatttacatccgtcccccctcgctctccttccttcaactcctcctgtgaccatgtacccacctgttcttaaattcacagcctctttaattactattggtgtgtgtgtgcacatttataaataataacctgatgagctcatgtagcgttgctcatacgtgtttgaatttagaattgaccacatggattggatcacctaacagaaactcattcttcaagcagactgattatccctctcagaagatggtaattgcatgtagcacttcttttatgggtgataccttatgctgtttacctcatctatactggcatgtgaactgctgttgtccttgtctgagcctctttaggcaaccatgttgagatttcatgagtatatcttctctgtcctttataaaaaaaaaaaaaaaaacaaaaaacaaaaacaaaaacaaaccaaaaaaaaacagaatcttgcagtagacatcttagtcttctggctcttataatctttctgacccctcttcagcagtgttctttgagtcttagacttatggttgtgttgtagatctccaactcatttttatctttgctgacaggcaacaaaattctttatcctgtgctggttccactccctattaacagctttcctcagcagatagcccagggctctggcatctcgaatatcttggagtctccaaagtaacttcagcttcttgttctaatgtctgggatccacatatgatcttctggtctcctcatgatcttctggtctccaaagggctagaatcacttctcctgttcttccctctatagcactctaagctcagattgatccactccactgacactgctgttcttgctgattatcccatggttctagtgtctccaatacactggggtcttccacttcaactatgcctcaccaatagcctctcataggctttcatcatagtgcccagcctcaaatcctttgcatgacctcttgggccatcaaatgcaactgaggctgcaccttcaccaatggccttccatagcatctcagtgacaagcctcagctgatctccatgaccccttcatgccttcaaagccagtaccaatgtacctatttcttctatcttgtctttaccgtctgatagtctctcttgtatttctttggtcaatcttacatctgatattcttgacaaatttctaagttcttaatttccagttttccttcagttttgtctttattcattctatttacatttccctgtctttatcagttttatttattccactgtttttgctgttgttattgttttcacatatttcattgatagaatttttcaaattctctttaagatccttgagtatattcattatagctatttggaattcttgccttatgcttcagcaatattgcattttttttcagggcagttttactcattttcatttttgcagggttgctagactctagtggagccagagtgccctggctgtcattaatcatgattttatgttgtcatctatttggatataatttgtcattctaggtactgttatctggtcttatctttgttgggtggattttctggtccttggtttttgtaaccctctctggattttaggagcatttgttgagtgtgagttgcttgcaaggagtagtacatctgagttcctgccaactgtggtcactgaggttccctggtagaatttggtttaaggtattggaagctgacaatggagatgagctaggacaaggtattgagaggttacacaggaaggaagaaaggttgtctgttaagatgtgtccacggggaaaggaggaagagagggaagacagatctgtgaaagtcatctcctactggccttgggctagggatgagactggagaattgcaatctgagatcgtgaaggaagggaaatgtatcatcacaaatgaatgataatgtcagataatgactatgacagacataatcaaataagctctcagcctagattttaaagcacattaggaaattctggggtaggtgtcctttatcttactccatttctaaggacattgcattacctggaaatgggggatgaaatctgttaccagtggtgatgtctggaaattgctgtccttgcttcaagttaggtgactgggcactttctagtttctgactatatgcctgaagcctgggattttataactgacttacctggacttcccaagttcttaggcctagtctcatagactgccaatttgaaaccagtcagcaagtcttcctgtctcaatgctattttctttgtccctaatttatgtcatagcttgatatttaattaagtgacatcaataacctttaacttttactttattttgacccaatgtatttttctatttttcaattctttcaatgatgagatgagaattttaatacatttagtctttctccttatttcgtattacttaattaaattaattcataaaaaatctaattataatctatcattaaagtggaaagccacatgatttatttttaatttgattaacctaagagattttgtcatctgcaaacagtaccagaattcctcaagctgattattagtagttttcttataggattattaagttttgcatactgaaaaagttctatgctaaaggtgaagcaaactgtagaagaaatgaaaaaaatgttaagcctctcaaaactctgatgttttctaaggaatctagagctagcaaaaggattcactgaaagagttttagagcactgctgtgtactaagcccacaccaggccatatgctgtgacaagtaacttgtacaaaatgaaaagcagtaataccagctcaaaaatgtctaattttgttatattggatacaccaccaataaaggcgtatgtgaatgctctagttaaaaaaaaacaaataacaagcaaacaaacaaaaaacccactacactaaattaaaccatcaaagctgaaactaatttttctaaggttgttgagcaccttgttttcttattataatcataggaagttgctccctatgactataataagagagtttagtatgaccaggtaagtcatttcaatttttaacataaattttaggtgttatatgtgagtaacaattccattttacttgtttactaagaggagaaatatcaccctgatcatgattctcagaaagatttgtgtgaacagttcagatatattcaccatgatagcattgtgtcaggcctggccaaagcagttgcataccttaatatttcattttcacatactgaaaggtcatgggtaaaagaaattcaagaaaaagaaaaccaaatacttcatttttaagggtatatcttattttgagtagagctattgttattattatcattccaaaaaatcacagtgaatatttttccttatgttctctcatattttagcttctacaccattttttgcaacttatgttctggctatcagttacttattacaatttttagcaatcagattctctcttactgttctttctacagacacacacacacacacacacacacacacacacacacacacaatacaactgataccacatcatgatatacttgacatatcacatttaatttttattttgttttaaaataatacggaagtggtaattttgaatagccatgtcaatgctattgacttgtcaacctcattattctttgcttcagtgatttctttccagatattgattactttgcaaggaaataatgtctgatgtctttaggattttccctttaactctgacctttatattgcttcaaatatcaaatacacctaattagtgtttatattattcattgttcagtgccctagctacatattatttaaaatactgaaaatgttgttaaaatttattccatacacacttcatttcctgtgataagtagtctgtgaattattatatgttatactacatttgtcactaaataaatagatagataggtatagatatagttatagacatagatagatattttgatgttaaaatgcctcagacatttaaatgactacctagcgctaaggacagtaaatgtcacccatgtgttagtaagacttttacatgagtaactgccttgaaataacagtgcctcaaaggaagttaaagctgccttagtgggtgatttgaagctttaggtcttgatggtggtagcttattaataagtaagtgtagtattattcatagttgtattccttacttaactgaataacaccctttgtaccagttctagagaatgaaaattaagtaagtcatgtttacactcattacatgtctgcaatgactcaatgtgtcctttcttgaaatatttacaagttctagctagtttacgctatgctttgggatcatcattacaagtatctcttatgaacaaaaagaaatgaaagaaaaatctattatgataatgacttaattacaaataatacaaattccctgaagagagaacaccatagcatgaaatgtcatctgtttttatctgttttatcaaggaagaaggaataagagccagttactttgggaatctttaccttagcatttgaaaaaaagcaccaaataagacttcaagaaaatgaaaatcccagaaataccaattccctttcagcaacatgaagcctgaagcttttctgggacttctaaggacatgtagaggcataaagagccttagacttgtatcactgaatcacatgagaagaattttatttgaagatattaacaatcatcttcagagaagagtctaaattctttaactgtgtggcaatattaatccagttggccaaaatacaaattatgtcatacttattctttctaaggctgtggaagcaagaaaagtatcattgttagcttccaaatgggaagagaggcccttggtcttgggaagatcatatgccccagtacaagggaatgccagggtcaggaagtaggagtgagtgggttggggagcagggtgggggagggtatagggggctttggggatagcatttgaaatgtaaatgaagaaaatatctaagaaaaaaagacaaatcgagtcagaaaaattgaatggagttgtgtcacagtaggggatgggaattgggtgtagcccaagataccaagaaagcaagaggctcacaggacccaacagggatgacattagtagaaatacccaaggaaggggagagagaacctgtagagaccatatccaatggataaatatggtccctggttgagggatggggccacccactgatctcaaaaataacacagaattgttcttgtctaaaggaaatgcaggaaaaaagggttgaacagagtgaaggaaaagccatccaaagactgccccacctagggatgcatcttgtctgctgacaccaaacccagacactattgctgatgccaagaagtgcttgctgacaggaacctcgtatggctgtccccgagaggcctgccagaaccttgccaatacagttacagatgcatgcaaccaaccatcagactgaacactaagacccaatagaggtgttagaagaaggactgaagtaggggtttgcaaccatgtaggaagaacaacaatatcaaccaaccagattcccccagagctcccaggcactaaaccagcaaccaaagaatatacatggtgtttccatggctccatatacatatgtagcagagaactgctttatctagcatcaatgggagcggaggtgcttggacctgtgaaggctcgatgccctggtgtaggggaatgccaaggccaggaaggaggagaaggtggctggatggaagaacaccctcatagaagcagggggagggggaataggaaagggagtttgcagaggggaaaccaggaagggggataacgtttgacatgtaaataaattaaataactaataaaaaaaaaacccaacctacccccaaagacaaattgctgtcctcactgaatattatatccaaaaatgttggtctatactttctcagattatttttacttcaggaactaaaagcattctccagtcgcaagatatctcccttaaatagtcaaatatggggcctacaatttcaagccaatgacagtatctttagtcaactactgaatttccagattacttctacagcaattttgttcttatcagagaggtaacacatttaataccaattagttgttaatcacttcgagtaagttgttgagagtcatctgggaatcctgagaaaaaggaacaaatataggcaaatcaagtaacctgtgaagagagagaaatgaatatggaagaaggtagaaggcaatgtactagaatcttcagaagcagttacagtagaatcttacactgttgcttggcatccataggaaaccactaggattctgaagaatttaaaagaatgagtatgtctgtgtgcataaacaaacacaaaagcatgtatgtgcatgtttgtgaaaacgaatttcaatgaaagaaaagcaagtaaaaaagaaagaaaatatgtgcctgggtatgtatggtggaggagaaagttttcttgtagaaaaactggagagcatagacagaggcagactatctgggatagttcctagagtaatgcagagagagggggaaggaagaggggagaggtgagacaagggagacaggtgctaaagtcctgaggcctagggtacaaaggtaatcaaaacagctgggttagataaggaagagcctctgggggaagggccgcccagtctagggcctagagacttcagggtagggggctggttatgagagccacaccctgtaagaggaagtgactgagggatactgggagaagatggcagccaggcccactttgatatgttaaataggttcatctgcagttgtgcctggtttgcaatttagcaatagtgagttctaaaagcttgccacacacagtgtcgtggtaatattttatgacaaatttccaattttttttgaggttgttatttaactttttaaaactactctttttcttcttttgagattataatcaaattttttgattccagtacttctctccaaaccctccaaacctaccttctaggctgctttcatatcaatggccttaagttttattactgaatatttcttttcttgagatgattatatgtatctccttcaaatatgtgcctatcacttcttgaattcatttgattttggtcaaagaggtttttgtttgtttccattgataacagacctatgtatgtgttgatcaagtttggcttatttacttgatcaaacaaatcattttgctcttcattcatgaacgttatcttaatgttggtattaatgacaaccatagaatcctacaatgagtcagtgagtaattattcgataaatcacattagtctaggagctttgtgtaaattgttttatatactatgcattgtatatttttcattatactcttaagttttcattcttaaaaatacaataagataaattagcaaaatttcattagtactgtaacttattattccacttaatcttccatctatccattgttaacatctttatggtatacatattttgttagaaataaaatatgtatgaattatgttttagtcaattgtcacataaacactgtgattaagctcctgttttaattttataaatatggaaacagtaactggggaaatagctcagtgggtaagttatacaagcatgctaacctgagttcatattcccagaacacgtgtcttacagtagcatgactatgtgactccactgtttctataccaagattagaaggagagagaatcataggacagctagcatggtaaatgcagttgctaatgaatagagacccggtctccaacatgatgtaacaatcacagaccaacacctaagtttgtctcctgactgctatatgccaaggcatacatgtacctatatgctcacttgcacacatacagagagaaggagagagaggggggagagggagagggagaggggagaatgtggaacagttacatttttagttaatagttattagtagaatacacctctttctcccatacaaaaggtttctggtatgcactagttcttctttagtagtagaacaatttaatggctcatacacttcctttagatgtctaggttagggtgaattttgagaaggaatattggcacctaagataagatttactgaataaaaagaaaattgaccatagcatctggacagaccaagtcattcaaaatgacagatagatttctgggaaatatttagtcagcattacccttccttaaatatgagtccctttattcctcgttgatagtttgatcctgagagtttctgttaagggattgcagtaataatattaaactgatgttttcttaaaaattctatgaaaataatttcttcaaaaattccttcattccccgttcaccagaaaccactttctctgtcccctaagtggtagactcagttgcaaagacttaattctttggcttaaaccaggagcgtttggacagtttacctccctggaggcaatgatactattgtacaaaaagagtcaaagtgctgcttcttggtgcttttagtacacgtgattgcttctttttttatcttttctcccccccccccggttattttaatttgatgagttcctttttaaaaagcataatttattgacatgggtaaatctaagactgagatagaaactcagatgacaattcagtccttcagtacagtggataatatggatactttgtacccacaaatgggtcaaacacattgcatccaatgttccatcaagtcatgccaagtccatcctctcatgggtttaggctacaaaaggaaaggctatgaggttgcccgttccttggcatggggtatacctcttagtgaaataaaagacactttgcagacaaaaagctggcatgaaacatacctttgatttcaccagcaagcatgccatatgtcacaaaattctactgcttcctcctgttatttcatctgaatgcctctttcctgcacatggcttttgggtacagttaagtaaataaaatggatattacatttaattgagggaaggactttaaattcatgtgagtttaaataggttggatgataaagaaatagtacaaccagtttcctttgtggtaggatgcacgtagtaaaaatagcatccagtaagaaataaggacacctgtcctctgccacgttcttacaccatcttgctatgtgacctttggcaaatatgtgaacctctgtattttcttttgaacatgggggtgaaaataaattattatgtcagagagatgtcaggtgtttaatttataatacaatatgtgattgtagatagtttgaaaaaaggctagcattccttggaaaaaatgtttttaatatatagcagttggaacacttatacatctatatggatatgatataaatatgaaaaggaatgtgaaaataagaaagtgaaataagaaaaatttcacttaaaacttataattgacattttaataaaaatgaaatatgactttaatatacagaatggataaataaaatcattgaaaaataattcataatcacaaaacacaaaggtaatattgtgtgtttccattaaatattttattttttcaagaaataatcttctctgtatgttaatggatactgtttttcactgtgacactttaacagacattgattgtagaaaattaggtaaatagaaagttattcttctctttgcatgaaattagtattaataactttaattcttgttttctattctgagtttccacttgatattgtattctgttatcttcccacaacattaaaacactttctgctgtgataaagtaccatgaccaaagcaacttatgaagcagagcatttaatttggggtttatggttttagaaccctaaagcacatgatggctaccaaaagcatgggggaaacaacagctgagagctcccatttgatctgtaagttgtaggcagaaacacacacacacacacacacactgcaaatgacccaagtcttttgaaacatgaaaggccactcccagtgacacaccttctctaacaaggccattcctctagtaatccttcccaaacaattgcaccaaccgggacccaagtgtccgttcacatattcaaactgccacaataaatgcaatgaattttgaaacaatctcaatataaacagcaaaaatagtcagcctaactatatttaaatatctcaaacattgcaattaacaaaaaaggattcaaaatgattagtatgtaatcaatggaaaaatgacaaaatgaacatgttttgcagaagaatgtaaaaactattataagaagtagctgaaacttctgactgaaaggcaagtaattgcaataaagaattcaccaaataggttcaaaaatcattgaagatggtgaaagaaataatcagtcaaatacacatatagatatatagaaattatctaatctagaaagaagaaaaataaatcaaagaaaactagacagagtcccattagctcaggcaaaatgtagactgcataatacatattaatatatacttaaaatgaatagcagaagtcaaaacagaaagggaaagaaaaaaacagtttcaaaggattataccaatcaaaaaaagaacattatttactgatatgcattacaacataaacaaaccataagagtattgtgtaagaagccagttataaaagatcacaattaggtctcaagaagcagctcttatgctacagtacttgtaataaagcttaaagaactgagttcaagtcctaaagcatgtataaacactagtgatcagaggtagctctggccgtacacgcctttaagctcagcactcaggaggcagaggcagatgggtctctttaagttcaaggccaggctggtctacacagagttccaggacagccatggctacatgataaactctgtcttgaaaataaaaattttaaaaaaaaatagtaataaggggttagggatataattaattatgggtaaaaggaaaatgttaatagattattgttagagattttgctaatttagtaaattagtaattgtagattcttctccaataaacatggctacagagttgttagctaggttttccatacctagtagagtacacctcttatagagctcccatgaaggaaactcacaaagatgaaaactacatttctgtctgtagggtgtcttcattgtgtaactgttgttaaaaataatgtagcacatttctttcttttagtctgacatagaacacaagtatatatcaaattgatgattcactgacagtgctttgttctctgacatgtgcatatgtgcaagtgcactcatgtacatgcatacgcatgcacaaatgcatatgcacatataagcacatgcaactgccacatattatatggtactatttatagagagtactcaaattaaactagcccatagaagaatgcagttctagccttcatttaattgggtatgtagtctaagtgcaaaattttgtaatctagaggtggtatggtagacttacacctgataactttacataacctgaatattttttttggctttctgattttgttcacatcatcatcaagtttagagtgttcctttatgattactgttatgccattttgttcaaaaagtttaatatcattgtttcattagtaaggccaaaaacctttcacctttaagagtttgcagaagataattgctcaccttttaagcctaggatgaaaatcttgctggaatttcattgcttaactagtgtcttcctttgaaactcccaaaactctgttaccctattcagcaatgagaataagaatactctagagttgaaccagtcagagttgaattctgactttactagctgtatcttcttgaaaacctttgttaaaaattctatgcttctggatatatgcccaggagaggtattgctggatcctccggtagtactatgtccaattttctgaggaaccgccagactgatttccagagtggttgtacaagcctgcaatcccaccaacaatagagcagtgttcctctttctccacatccacgccagcatctgctgtcacctgaatttttgaacttagccattctgactggtgtgaggtggaatcttagggttgttttgatttgcatttccctgatgattaaggatgctgaacattttttcaggtgctttgcagccattcggtattcctcaggtgagaattctttgttcagctctgagccccatttattaatggggttatttgattttctggagtccaccctcttgagttctttatatatattgcatattagtcccctatccgatttgggataggtaaagatcctttcccaatctgttggtggctttttttttttttgtcttattgacggtgtcttttgctttgcaaaacctttgcaattttatgaggtcccatttatcgattctcgatgttacagcacaagccattgctgttctattcaggaatttttcccctgtacccatatcttcgaggcttttctctactttctcctctataactttcagtgtctctggttttatgtggagttccttaatccacttagatttgaccttagtacaaggagaaagaaatggatcaattcacatttttctacatgataaccgccagttgtgccagcaccatttgttgaaaatgctgtctttcttccactggatggttttagctcccttgtcaaagatcaagtgaccataggtgtgtgggttcatctctgggtcttcaattcttttccattggtctacttgtctgtcactataccagtaccatgcagtttttatcacaattgctctgtagtacagctttagttcgagcatggtgattgcaccagaggttcttttatccttgagaagagtttttgctatcctaggttttttgttattccagatgaatctgctgattgccctttctaattcgttgaagaactgagttggaattttgatggggattgcattgaatctgtagattgtttttggcaagatagccatttttacaatgttgatcctgccaatccatgagaatgggagatctttccatcttctgagatcttctttaatttctttcttcagagacttgaagttcttatcatacaaatcttttacttccttagttagagtcatgccaaggtattttatattatttgtgactattgagaagggtgttgtttccctaatttctttctcagcctgtttatcctttgtgtacagaaaggccattgacttgtttgagttaattttatatccagctacttcattgaagctgtttatcaggcttaggagttctctggtggaatttttagggtcacttatatatactatcatatcatctgcaaaaagtgatattttgacttcttcctttccaatttgtatccccttgatctccttttgttgtcgaattgctctggctaatacttcaagtacaatgttgaataggtatggcgagagtggacagccttgtctagtccctgattttagtgggattgcttccagcttctcaccatttactttgatgttggctactggtttgctgtagattgcttttatcatgattaggtatgggccttgaattcctgatctttccaagacttttatcatgaatgggtgttggattttgtcaaatgctttctcagcatctaatgagatgatcatgtggtttttgtctttgagtttgtttatatactggattacattgatggatttctgtatattgaaccatccctgcatccctgggaggaaacctacttggtcaggatggatgattgttttgatgtgttcttaaattcggttaacaagaactttattgaggatttttgcatcgatattcataagggaaattggtctgaagttctctatgtttgttgggtctttttgtggtttaggtatcagagtaattgtggcttcatagaatgagttgggtagagtaccttccgtttctattttgtggaatagtttgtgaagaactggaattaggtcttctttgaaggtctgatagaactctgcactaaacccatctggtcctgggcttttttttggttgggagactattaatgactgcttctatttctttaggggatataggactgtttagatcattaacctgatcttgatttagctttagtacatggtatctgtctagaaacttgtccatttcatccaggttttccagttttgttgagtatagccttttgtagaaggatctgatggtgttttggatttcttcaggatcagttgttatgtttcccttttcatttctgattttgttaattaggatgctttccctgtgccctctagtgagtctggctaagagtttatctatcttggtgattttctcaaagaaccagctccttgattggttgattctttgaatagttcttcttgtttccacttggttgatttcacccctgagtttgattatttcctgccttctactcctcttgggtgaatttgcttccttttgttctagagccattaggtgtgctgtcaagctgctaatgtgtgctctctctagtttctttttggaggcactcagagctatgagttttcctcttaggaatgctttccttgtgtcccatccagaagatgtcccaaccggtaagaaggacacatgctccactatgttcatagcagccttatttataatagccatatgctggaaagaacccagatgcccctcaacagaggaatggatacagaaaatgtggtacatttacagagtggagtactactcagctattaaaaaatgaatttatgaaattcctaggcaaatggatggacctggaaggcatcatcctgagtgaggtaacccaatcacaaaggaactcacacaatatgtactcactgataagtggatattagcccagaaacttaggataaccaagatataagatacaatttgctaaactcatgaaattcaagaagaactaagaccaaactgtggacactttgccccttcttagaaatgggaataaaacacccatggaaggagttacagagacaaaatttggagctttgacgaaaggatggaccatctagtgattgccatatgcagggatccatcccataatcagcttccaaacgctgacaccattgcatacactagcaagattttgctgaaaggacccagatatagctgtctcttgtgagactatgccagggcctagcaaacacataagtggatgctcacagtcagctattggatggatcacagggcccccaatgtaggagctagagaaattacccaaggagctaaagggaactgcaaccctataggtggaacaacaatatgaactaaccagtaccccggagctcttgtctctagctgcatatgtatcaaaagatggcctagtcggccatcactgcaaagagaggcccactggacttgcaaactttatatgccccagtacaggggaaccccagggccaaaaagggggagtgggtgggtaggggattgggggtgtgggtatgggggacttttgggatagcattgaaaatgtaaatgaggaaaatacctaataaaaaaataaattaaaaaaaattctatgcttttgtttcttcacctgtaaaattgaggaaaatgatctcatgaaatatttgcggattaaatgtgattatggatgttaatttttaaaaaactgtctacttttctgacttttattttgaaaaaccaatgatttactagctattagtattaactgtttacaaaattataccatattaacaagtacatgcaataatatacaagaaaccagacaatatgaactgatactaatgtgttttaccttgtcctttttaaagaaaatgactaatttaccatttttgtgttagatatgaaatagaggcagactactttatcctaaagctttacctaaaagttagactggaagactattttatggggattttcctaataataactaccagctatgacttagttgtcatttgcccacaacagtaaactccttagtataaatcccagagatcagaattaccctccgttatccacctctgcaatcaaatcgctaaagggtctatattttggagcatatgttatgttaatttgattagatcttttacagtctaatgtttagcataattgcaaatgagattctagtagcaagcagtgaacatgtgactgcttccaattgttacacatgaaatttgagagggttactaataaagtgccaattttgctaaactaatgctgaagattgacagcaataagagagtgttgattaatacttgttattcgtaaactatggacggaaatggtatctccaattacataacaccacatttaaaacctattacttttgaagatacgatattaagtttgatgctacattttgggtaagtatgttaatgctaaaattactatgaaatttaccaaaccccaatggatttcattgtaagaaaatgaattgaatatgattgtttacttggggaaacaagcagctattgtttttctccaaagagtacaaagaagcttttatatattgagttaccttcaattttattgaagattgctctgcctattaagtggttagatgatctgcataatccaacacagaggatgtaagaaagtaataagaagcagataatttggaattactttagggcattgttaaagtttcaaaagacgtgaagagatagagatagatgtcactgcaactcaaagatgaattattacttgcaaattactaagaaatagaaatgtgcaagttatttacacaattactgaaaaagttcttccttagtgatattttgggaactcatttttccttccctctaacagtgtattatgaactagaaaattttcaaaatcacaatatagtgtcaattcatagatattttattcaaaattctggtgtgtgtgtgtgtgtgtgtgtgtgtgtgtaaattcaaggtcaagattatcttaactacaactgagaacactaaattgtattaagccttctgtttctgaaatagttgttatagaatttctttgtggagcccttcctatctcctttctttcatttctccacattttttatgtgaagcatgttaacccaaatagtggaggttttaacaaaagcaaacagaaaataaataaaatacacacagcagtaaagagcaagaatatctggcaagaggtgtaatatcactatttagttgtaaaattgcaaactttggaatgttctccttcaaaatggcctgaagaactagcctggcaaggcaccgtgacaatatctattgcaactgtttcaacaaatgattcagatcatatttgaagaagttttccaggtgttactgaacattcttctattgtaagattttaaaaattctaatgtaataattaagtagatccatatgaagtaatatagtaagtagaattcatatcaaagctggaatttcaagccttggtattataaaatgctgaacaaaaacatttttgttcagaatacatcaccttctaggtaaaatgatcatgctatatcctaaaacctgggaaattatttcccttttatttgctaaaacaatttggtgtgtccattagatgggaaaaactggcaaatactatgacaaaatcaaattaatttggttgctttctgtatttcttttggccatcaccacatagaaaatggtcatttttatgatagagttcagccaaaacgccattcattttctgaataactgaatatagtcaattaagcagccacttagcaatcatatattaacaaattgcttttggaaaggttcttgcttttatcaagtttgacctatttttttcaaaagtaattatatctactcattgctcatgttttcctcctctcctgcttaccaaccccccctcaaaaaaaaagaaaaacaaaacataaagttaaaatggcaaagaattcactgtgaaagttagctgcagcaaatattcaggatggaaggttatgctatttgttgcatagcccgagtaaaggttaatgtcttttcttgtgtgggaaaagttcccaatagataaatgtacaaaaactacaaagagctcaaagaagaggaaacagaattagaatgtgtgcagaaagtaaagtattatcaacaagcaaatacaaactaaaatatggcactcgtaatttactcatttaaacagacatttaaaacaatatgcaaaattggccagggtacaatgaaaggaatgtctcacacattgctaatgactgtgtatattataattttccaagcaacaatatattcaagacttttggctcattgattcatggtcttggaatctatcctaacaaaacaataaagataataaaagatgtttatggtgtcttcataatgttccaggctatgcgacaaatagcatgaccttctgtcctgaatatttgctgcagctaactttcacagtgaattctttgccattttaactttatgttttgtttttcagggtttttttttgggggggggggttggtaagcaggagaggagatataatattcataaattaggggcgatgtaaatatccaacaataagagaatgaacaagcaaattgtggcacacccactttgcagtgatatttaaagttattatcatagaaattgtataaaaaatgtgtcacaagggaagggagaaacatgaaacttaagaaaataaatcagaatgatggtagtcatctttctagatagtaaaatgatgagttttcctctaggtctttaaagactgggtgactatgttactgttatagacagcttccacaactctttcccatttcaattttttttaagaaaaagaaaattagagaaaaaaatcagtcagaatttcacaatctaaatttgtcaagctaaaataatctaggaggattttattgtgaaaaaagtattgctacatttacagcgttcaccctttaagtgctgtgctatgaaaggcttgctaaccttaagctgcattctatgtatcctttacttgttttctcaattagagtgtgacttctttgttaaggcttcaactcataaataggcactataggtagaatgagttgatattcatcgtgaataaactagaacaagtgtccatcttgagtggccaatgtatacaaaagcatatataaaattaacattaaacagactgagcagagcatatttatttatctatgaacatatatgtacacatgtatatacatatatatgaatgtaaacaatgtgaaaagaggctatccatttcaaaaagagctagatgggtttatgagaatgttgggtgggagggagaaaagggaaggggaaaatgatgtaatggtatatcaaaaattaaaaaataataatttaaaataaatgagatttagaaacaaaataaatagagaggaaggaaagtgattattaattcatacatatgcacaaggattcatggattcaaaagcagtatttttgttttattccaatatcctatagcatattggagtgtataatatccatttggggagaggaaagaagcagaaaagaaatgagagagcatgattaacaatgcaaacatagaattgattatacttcttcttttatgtctaatcaacctcagcttttctgtcatttgaaagccaataaggaattttagaactagaagagatttctgagataactcagtctcttcactttatatttagagaaactagcctctcagagagagcacgctgtttactgagcatcgcagccagttgttccattgaaagcaaatactgactagtgattggaatttagcatttcttcctcatgtctaaagaagactgacatagcattggacttaatgaaaaaaaaagagcagtgaagtaattagtatttactatcttttgtccatgacagttttgtaacaatgtctttttgaaattactgtgcttttaaagtttgttgcatttcaaatcttgttagtatttttccaaatgttaaattcagagcttgtaaatttttcataaagtcattatttgccaatcatatttgaggtataatttttgagctttgataagtatcacaattacatattttcaaagccccagcccacacaattgtgtgaatcaatcttattttcaaaaaaacaaaacaaatgaaagaaaaacaaatagaaaaaaaaactagactgtttctctcatatctcctggattaactgacaaattttaggacaaaaatgttatgatagtccagtcaaagagcttttactggtattctactttaaagagagaaaaaaaaaaaacattgaataggtgtgacattccttattcctagctgatttgtaggtgggaattgctgtgacttgaactttgaaaatgactcataacagctatataaaatctgtctttctgcattactttttgtctctttctcatttcatatatgtactatctcattgtatgtttcaaatagacacattgaaagtaaagagaatgtcaagatctgtgtacataaaagtaaataaaattatagcatgataaatcatagttgccataatgtattagacattagaaatgaggtatttttagtttttgatttcatgtattatatttgaatgtcattatgatatatgtaaattcctaatgaatggatgattaatagaaagcattctctaagttctttttgtctataagtccttgatagttttctacaatcagtgatactatgtggaaaatagtggtccacctccaaattgttaaagtcccattctataatgaacagcaacaaaaaattgtatataagagtttatgttcgtaggcatcaatttaaatgaattttattgatatggagtttttgcagtgtgtgtgtgtgtgtgtgtgtgtgtgtgtgtgtgtgaaaaaatctctcttccttttaaaaacgtctttgtgcggtaaagtttctaagactcatctattgatcaatggtttgctatgtaccattattcaaaggtatagagcaacaaatacaacagacaatgcctattgatataaggcagacaatgaaataataaacatttatcatgtcatttgttgatgaattttttgaaaggacagaagaggagaatgagtagtctcatgagaggtagttttttatggaaggttaccctgaggtgggaaaggatttagtgttttcagaaacagaacactagtataactacagtacatgaacagaaggaaaagaaaagtagatgagttggaaaattttaagctaaggcccttgtaggttactgtaggcttttgtcttttattttagagtatggcacaccattactgcttcagaaaataggagaacatgaaaaatcatcttagtaaatgttctattgctctgaagatatactgtgaccatagcaacttttataaaagaaaacatttaattggggctggctcatactttcagaggtttagttcattattgtcatggtgggaacatggcagtgtgcaagcagacatgatgatgaagaagaatctgagagctctacattcagatccgcaggtagagctagagacactgagactagcttaggtctttgaaacaccaaaacccatccccagtgacacacttcctctaacaaggccacacccactacaaaaaggtcacactttctaatagtgccatgaactggtgaccaaacaatcaagtctataatcctataggcggtcatttttacttttcttttcttttcttttcttttctgggggggaggggggttagagacagggtttctctgtatagcccgggctgtcctggaactcactctgtagaccaggctggcctcgaactttgaaatccacttgcctctgcctcccaactgctgggattaaaggcatgtgttaccactccccggatggccatttttttcaaaccatcatatttatatgttaaaaattatactctgactacagtgatgataaattgctgtcaggctgcaatggtataaacaggacactcattaggagaaaagtcacaatacttggaaatcctttgatccaaagtagtattgaagaagtggatacatatgtttggattctatatttttttcaaagatgccacaaatgtactaactaatggaatgcatgtaagatgtgaaagatgatagtaagcaaggatggctttaactttttgggtacctctagagaaatgacaaagtccagtctcaaacataccacatttcagaggacttcatagataactatatggaaatcctcagcagccagttagatactcaaacctgtagggcaggagaaagatctatgctggtactaaaagtgaaaaaaaaatacaactgctagacaatgcattagaaaattatagagagaatagattcataaaatgaccttataatcaagcactgctgaatgaacagcatatacgggcatgcagcaacaattaatgaaatagagaccaggaatttgaaagggaatgaggcttttatgggaagacgtgaagggaagaaagggaaaggagacatgatgtaattatattcatctcaaagcataaaataagtaataaaaacaccatatctctttttttttcatgatggtcatttctgatattaacccaaagaaaccttggaatattcctagaatgtttgtagtatttatgtatttgaataataaacagtctctaagacgtattttactagattagtactatatagtactgcaactatgaagtttgaaggttcaggttttaccttcctgaacattaacattaggtttaataagtcttcaacatataatgctttgttcatataataaagtagaatgaactatttagcatcagccaaccatgaacattactgaaggatttctggtttctatatgcttactattaatccaatagagattctaagctctatgctactatatatggtataggacgcatagtttatatgtcagtaggtttcactgaaaatatatatgatagattcctggggttcgggagaagtaatattagcctttctggtgctaaggcaagaggctaataaatttgagatgagttggggcttcatagtaaggcctttcctcaaacatgcctatggagaccaagcatggcagctcacatcagaaatcttagtacttgagagcctaggacacagagtcagtacaaaggaagccaacctagtgagttgcaggccatattggaatgcaaagtgaaaccctgtctgaaactacaaataaacaaactgcgtaaagtgctgaaaaaaatgaaggaatcaatacttgatttcaaactacatatttaagcattataggaaagaaacaggttgcagacttactgcagcacaaaaatgatggaaaaataaatgtaaggaaataagcttgaaaacagcaacaacaacaacaacaaaaacaggacttttaatgttccagaagactttgacatcttaaatggcacttgttctcagtctgtgataagtagggcagctaatgtctttactagccctaagagcttcagcagctcctagctcagcattgggggtgagggggagattcaatgatttatcatgaagctctatattgctgcttacaaacccaatttagatcctactgttcctatagcagtatagtcactagagatgttgtttacatcctctcaatattatgacaaacaaaaatttaccaccaccgaagtcattaaaaatgttctgcaggcctgagactcaaaagccacaagataaatacaagaagtccagtcccctcaagcacactttatttcatgagctttgctagctgtctctccacattcagagcccttcacatcctcagagtcccagtcttaaatgtaatattaaaccagaggcaaggaacgattctttctgaatgtatttttcttactagattcatttcaagtgtgagctagctatgctaggttaatatttatactcctggccatttccaaatcccataatgttttctaatctaaccacagtctttaacattaaaaacacactctcataccaaagaaatagtgccctttgtttgcattccaatgcaaatacttttgtaagctatccttcttttaatttgagctttttctgatactacaacctctagcttcatcctaaatgcttgagaatatatgcatgtagagcacagtgttattattgcctccggctagcttcatgtcatccactttgtcttttgcttcactcctttgatagtattagcaggccaattgtgaatctgccagatgtgtttccttgcaaaaggacaaatctaaaaaggctcatgtttttcactctcttccaggactgttttcattaaagaacttccttatccttttttcatgaaactcagcttgcttaatcagagatggagcaaacagactgcaaaccttatcagcctctgtccaaagtcaagcatgaaatggatctagcttataccagttcttctgatgagagtgaagatgggagaaaaccaagacagtcattcaactccagggaaactctgcatgagtataaccaagagctgaggaggaattacaatagccagagtagaaagaggaaagatgtggagaaatctactcaaggtaggtttttattcaatttctataactaatattattttcattaatgagtatttacatactttaacctatgtatcaaaaacaaatttgtcagtgctaactggttaataattcctactgcttacatatgctcagttaatctgttccacatgtgcacccagctgaggttgtaggttccatgtgctttttacggattatgcatgaatttggatgcaacaatcctcttattggagctttcagaatttgtctaatcctacaaatagccatttacagactaaaggattaaataatttatagtaagacgtaaagtaaacagctaagtgcttttcaagccattgcccatatgggacagaagtctcaaagaaatattcagctgctgaaaacgtgacacaggctagtagagactacccaaaaaggggctaggatgtctgtgtaaagaatgtggaaaggctttgcagcatagcttacaaggtaatgaagaatgttgagagtttcttaaagaaacacacagatgtattttgtaatctattttttgactactgaagtctctcacttatggaaggcataatggtttctaacaaaattagggagatagaaatacaatttctattttttcaggtaatgaaatagaaaaatatattgacattagcatagattatttgttagggataagtcatagtgacattttaaaacaatattattcctctgggacagtgatcttcaggttgtatacccctgactcagtagtatcagcattaactgagaatttactaaaaattcaaactctcacaacccatcttagaaaacctgggtttagaacttgtctatcaatttaaagttttaaaaggcccactggagatttctgatgcttgaatgattcctccaaaatcttttgttcaaatgaattcattggtcacacttgtttggggaaatttccaaattacattttaattcagctttaacctcactcataaattacagttttaaacattcaattatctgatggacatttccaaattgatactatatcagttactctaaattctgtataactaaaaggaagggaatcattctaacaccctcaattataagcctgtttacattgttaggcactggctccttcatgcttgccctctttcagtgagccaccagaatttctctgtgtaacacattgtttcatccagcaaagttgatctctacatctgaaatgtactattagcatatctcactgagattttaaaaaaagaaatctaactaatctgcttgtatttcctttcattcccctttacccttttactgtgctgttgcctacttcctgacagcaaaaagaaaaatatcggagggaggtagaaaagatgcaaaagatagagctgggtgtcttatgtatatggaataaacactctaccacccagctatatctccagatacaaactcttggactctgggaatgccatcctcactgtctctctttatctctgttcaactattattcacatcttaactcaaaagtatctttaactctcaactctcactgtgactctatcaccaaacttttgctttgtgaagatgattgatctcttcttccataaagcataagtatattttatttacgtgactcacttttgctgtagatcttctttccatattctatacctaacaaggatgaggatcatggtttctttcctgctctctgtttttctgtaaaatttacatatatgttctatgacttccctatttgatagtatatgtgatagtatacatattagaagttgcttgttaaatattactatgtcagattcattattataaattaaacttattgcattctaaactattattacagttctacatttacaaaagtctaaatttagtcaatagttcaatatatactaccatgtaaatatccattcacatttataatatcaactgtatgatcatttacatttcaatataactggaaaggttttgtacccatcttttcaaagtattcactttaatctgtcatgtcttcagctgaacatatcttacatttgttcaaactaaaaccacctcccttttggcaacattgtttttctaaatgtttggagtgtctatttctctttaaaaactgtatggatccattaaatatttctcagtaaatttgtctttacagaagacaaattcataattataagttttgtgttgtggaataggctcatagagtgattaaggttttaaaagtacgaataatgttacactaagtctgaactgagaaagtcagcctcacattttgtttctgtgcaaggtgaccaaaagaaatatatgatgagtgcagtttgtcttttctaatgtcatgctaacttcctttcaatagagtatttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggcatccaaacgctgacaccattgcatacactagcaagattttattgaaaggacacagatgtagctgtctcttgtgagactatgccggggcccagcaaacacagaagtggatgctcacagtcagctaatggatggatcatagggctctcaatagagtattttaagcaactagcttttgtttagcatttaatgttaaccataccttgagtccaatgttggaggtgaaaatttaatgcctcttggaaactcataggtggtggataaaattgctatacaaactaatcagtacaattttgtgataagtgcttttgaaatagcttccgcaagcatggtgttactttccaatagattttagttacataaccaaggtacacacacacacacacacacacacacacacacacacaaagaaaagaaaagaaaagaaaagaaaagaaaagaaaagaaaagaaaagaaaaaatttcagaaataaaccctttttaagtttttggttacaaatcatgctgactagcataatgatgttttccaactagcatctctgtcccactccatgtaagaatcatcactttgttcaatatgattgtattatatatgatatcatccctttacttattatagaactctagttaatatatgaagtagatggcattacagggcttgtattcaagtaatctacttaataagcactccaaagcttgagagtagaatgctgtcaaatataaatgctacattaaacaatcaatgaaaacaatcctgaaaatgagaaagtgagaggtcttgatttaaaaaggaagaaaaaattatatgctgaggttactagaattacaatacaaacaaatctatgaaattaaggagaaaggaaaagaaattcactccagttttgaagttacacaaaaaatcatttaagttaaagtcaagatgcatgatatgtgctaggtaaagagagaaaatgtatcaaacttgtgagtaaaagatatgaacagaaatatttatactgactcctggaacatgttgtagcagaaagcattgaacctacaggaagacttacattaacaaatggtgctggttcaactggcagtcagcatgtagaagaatgtgaattgatccattcttatctccttgtatgaagctcaagaccaagtggatcaaggacctccatataaaaccagatacactgaaacttatagaaaacaaaatagggaagagcctcgagcccgtgggcacaggggaaattttcctgaacagaagaccagtggcttatgctttaagatcaccagtagacgaatgggacctcataaaattgcaaagcttctgtaaggcaaaggacgctgtcaataggacaaaatggcaaccaacagattgggaaaagaactttaccaatcctacatctgatagagggctagtattcaatatataaaacaaacttcataagttagcctccaaagaatcaaataatcctattaaaaatgtagtacagagttaaacaaagaatttctcaaatgcagacactattgtgggtgtcaagaagtgcatgctgacaggagcctgttatagctatctcctgagaggctctgagagaaactgacatatacagagatagatgttcgcacccaacctttgaactgatcacaggatctgtgatggaggagtcagagaaaggagtaaaggagtgaaggaatttgtaaccccataggaagaacaacaatatcaaccaaccagactctgcagagctccaagggactaaagcaccaaccaaggaatacacatggagggacccatgtcagggaatgtgagggcagggaggcaggacagggttgatgggtggggggtacaccctcatagaagcaggaggagggaggatgggacagggggcttcggggagggattgtgaaaggggataacattagaaatgtaaataaataaaatattcaataaaaagataatggaaaagaaaaggaaaggaaagaaaagaaaagaaaaagttcaacatccttagtcatcagggaaatgcaaatcaaaacaacactgagattccacctcacatcagtcagaatggctaagatcaaaaactcaggtcacagcagatgctggcaaggatgtggagaaagacgaacactcctccattgctgataggactgcaagcttgtacaactactctggaaatctgtctggcagtttctcagaaaattggacatagtactatctgaggacccagcagctataccactcctgggcatatacccagaagatgctccaacatgtagtaaggacacatgctccactatgttcatagcagccttatttataatagccagaagctggaaagaatccagatgtccctcaacagaggaatggattcaaaaaatatggtacatttacacagtggagtactactccactattaaaacagtgacttcatgacattcttagacaaatagatggaactagaaaatattatcttgtgtcacaaaagaacacacatggtatgaactcactgaaaagtggatattagcccaaaagctcagaatacaaaaagataaaattccgagaccacatgaagctcaagaagaaggaagaccaaaagaccaaagtgtgaatgcttcaatccctcttagaaggggtagcgaaatactcacatgatcaaataatgagacaaaatgtggagcagagactgaaggaaaggccatccagagactgcctgcctgccctacccccccaccccctgctgggtatccattccatatacagacatcaaatccaaacactattgtggatgccaagaagtgcttgctgacacgagcctagtgtagccgtctcctgagagctctgccaaaacctgacaaatacagaggtgaatgcttacagcatatcattggactaagcatgggatatccaatggcggagctataggaaggacccaaggagctgaaggggtttgcagccccatagaaggaacaacaatccgaaccaactagtaccttcagagctctcagggactaatctaccaaccaaaaagtacacatggagggacttatggctccagccacaaaatgttgcagaggatggcattgttgggcatcaatgggaggagaggcccttgtttctgttaagtctcaatgctccatggtaggggtatgccagggcggggagttcagagtcagtaggtggtagaataccctcatagaagcaagagggcagggatagggggtttctggaggggaaacctgggaaagaggataacatttgaaatgtaaataaagaaaatatccaataaaagaaaaccaacaaaacaataagcaatacaaagtcatttgttaaaagttaggaatgaggatccagattcaggagtaggcttggactgaaaagtacaaaaatgttggacaggttgtttctggtgataagaattaccactgtgtgtacagcagatgggaggagactaatgaaagaagactcaccctcagcaggttttgtgtacaacaaaactaagctttctctaaaaagatgctcaatggaaattgttcattaaagagctggtgaagcactaaaccataaagtcagaagaacacattaacaaagtactatatcattatactacagagggcatggtaaagccaggtgtagaatgcatagcaaagaactcttactctttctctaaaacaaaaaccaaattaatcttccaaggatgcggcaacataatcaaaaattgggggtggcagtcaccttgtttctgatgtttttataaatgttttatcccagaagtgaaaacacgatttggaagagaaaggattgaaagttaaagccctattaacaatgtaacagcaacttggccgtcttaaccctgataattataaaaattaatatttcaaggttgtagttttaccttgtctcttggctagaatattagttagtccatcaaggctataaatactaacctagtactagtcttcttggttcagctttttaaaaagaattctttatttcatgctgctagaaccctatacaaggggtaggcatgtccacaaccagtgagctttgttcctacccttggatcagttagaatggtaagcttaatctggacataatacaatgttgaaagttattgactatgtctggcacactagcattctttaagttccatttaaaaattaaaagcagaataccccatgcagatttggagggaaagagtgggggtaaatataatcaggatacattgtatgtatatatgaaattttcaaagaacaaaaattaaaatgagaaatcaaacttaagaagattgaagtataagaacctgcattttcctcagtagggctacagagagagaaaagcaagataaaatgacagtttgctattgtctaaactgctaaacctttgaaatgtattataatttaataaattctgactttcagaaagacaaaaatatcaatgaaattcattctgaatacaataatcaaaaggataatttataattaaactattcttctaagagtgttctacggggaaacccaaacaaattaacttttctctaccaagtattccaagccatgaatgttgtctagtgccttatcttaagtcattgactttatcattgcttagtttctcaagaccacacaaagaagatgatcctcctcctgactgaacaccacacatatagtccttatttagcatttattacagtgtcattcacttcatttcatttcatcattcagagcatcactgagaaatttttagtcaaagaaaccccattgatacatcttctattgtactattgtttcagtttagacttagttattgttgttggtctcttattacttacaaatcaaactctattataggtctgtgtgcacacaaatttatatatggttgtagtatgatgcagcatcattgaaagttccaggcattcactcgtggtcttaagatatcactgtgaataatggtgaatttttagacaatggactcatagatttcaagttttgtaatgtaaagtccacaagagaattgtaaaggtttaacagaagagtaggtgtaattgaaaataactgaatatgtgactgtgtggaatctatgaggtcccaaagttaccacaaagcaaagaatggcatgaagagaaaaaaacatagctaaaaaagagaagagaaacactcaagaaatgtttatgtgatataagggaaatgatttgggtaacttactgctagttgcatttacaaaataaagcagagttgaaatcagtctgcagtttcaaggtttggaaatggtgaggatgctgatcaatttgataaaaaatggatgttaagtttaagatgctggtgtgacagcagatggatcgtccaaaaggttgtggaagatgcatcttttgagttcaagatagattgaggccaaggataaaagcaggcttgatcacattagttcctaaaatatgcccagagaaagatgagattattcagggcaagtgtataaggtaagactagaaaggcaagggacaaaaacctgaatctatcatctgtgaactgacataaacacagtttaaatatacttacattgtcagccagtaccattctttagtgaactgatttatctaagctaaaatataaaggtatagaaagccaaaagcctgaaaacttgagatcttatatgctactgtctttcttactgatctatagaggcactgtagggaaatatctgccccctttgaagagaaacgcattatcctatattaagcaagaaaagttcaattttcttttctgtaaagtctagaatctacattattattttatttcagcaccacctgtaaatcagagaaaacattattagctgtcaaaattgcatgccagtatttgtaacttgcattaatctaggtaaagctgagcccaacttattttttagagtgacagataaaattgtatgtatttatcacatataatatgttttagagagtgcatagattgtagattctcagaaagtcatttggttttagatctgcaatgaagaaaataaacaccattctttatatactgtactacctattcacacctacaccaggaggtcatgataaggatcaactgctttcacaagtctgaaaatactgccaaactaaaactgtttagattcccttcatttctgtctacaattttggcagcttctttatgttccaatggccagtggttgacaagaaatttaaaccccccccccttttttttttttttactctgagtagcattagtaaaagataaatgctatgctgtataatttattatgaatggtttctttgtttttatctgtctgagaaatcaatgggttgttgttgtggttgttgttgttagtgtgtttctagttgaggactaacttttgataaatactgaaaaaatactttacttcaggtttgtcacctcagcaactctcctgtccatgtgcatgtagattgccgaattctaatgttgtttcttgttgttgctgtgttgttttagtcttccaaaagtctatgaaaagatagacaatcatattctatcgtttgttctttattaacaggatgaatataaggaggcttagtgtgtgatttgtggtagatttaataggaggtatagatttttctggaagtagaatggctggatattgttcccaagtatgcccacatccaaaggcagcttcgagtatccaataaacctaagaatcaaaatatggaaaagtaaatgtgctaatttttctatggttttaatatggctaaggttagtctggagtatagccattttacttcaaaataataatgaaggaacatggcctgtacaggaaagtaggaggtatggcaaaattcagctgtagctcatacagttctaaacactctcaaaacagtaaagatgaaattctctctttatatcctgttcttttatggtttattcttcttctaatatgatggttggttgcttggttgctttgtagttttgtggattacagttttatctggtggaaaacattcaagctgccgatttttatgtattgtgattacaaagcaaatagtctatcatctactgctggcctttaatttattcacttatatatgaacactaatttagtattgagtatgccccagggctatagttctaagtagatgacattctccttggaataaatgtaccctaatgactgttatgttcccattccttgacccaggttaatgagctacttcataccactgcagaagctgttcaagccatgttggcacatattatgttcaaaggggtagatagaattccaaaattgcaaagcacacttttttctgttcttatttcaagcagttatccatagtttgaactatagtttttgtatatgtagatggcatggattatagttcctacaaaatttttgtaagaactcttaatctcaggatccatatttatagggaagagatcacagatggcaggagtaatataatggtaacaagacctataaaatgagattttcaacagcatttgatcacacataatgatttttctgccgtgaacatgttatacttatagttgtccagaatttctaccataaagagttataatgactgctgtgaaagagtttagagtctaaaagagaattagtccaattatttaagaacattttcaattggctctcgtcttttaggtggtaacattgcttatgaaaatgtattcacttttttcaaatggagcatctaaaattgtaacagaatgtccttgacaattgttccgtgccaccctctacctgttccatggcagggcagaatcataataaaccactacgtccttacctatcaagaccagctgtgatatcgcacattctaccatatatcatatgccaatcaactagaattgtaaacaaagaaacatatttctagactgtgatatgactctagcaaaccctctatgaaattctaaaagttcattgatgagcaaccgatagtccttgcagtgaaccatcaaacaaacaaaacaaagaatcagagtccacctggaaatggagaaaagtaaagtataccctatagggggatttagaagctagaaatgtggacttctttgattatgggagaaatatgtagcataaatgtcataagtttcagagaggaagtttaagagagtgtcaatgattgtttgtttgtaggtatttgtatatgtgtgtttattttatattgtcaagctatctgtgctacccaatgtgacttgtggactcaacttctattactacaccaacattctactggtgctcagacacacacacgcacacacacacacacacacacacacacacacaacctgtgaagttgtagtagtgcaggaaaatgtatacaaccagaatgagagcctagcatgaaagcttgatgatacattcatataagataatgagcagaaaaatagtgatcttgagatatcaaagaagaatataaatactgaacattacataaacttactgatgtgatttcccaataaaaaggggtgactaatttttttaaacttcagaattaacaatgtaggatgaaaaattgacaaagaatgattgagcagatgaatgctaactttagactagagagtttccagtttgactagatattaaaaacactcatgtggaacctaggtacttgaaaagagtctcctcagtggttgggggttccaataacatttgagattcggatccattgctaaccatatccaatgatcttagagaagtcctatatcaggaagagtaggaaaataaaagaaactgaatgcctgttataaatactgtagaagacaaaatgacaggaacgctggtagaaggaattttaattttttctttttaaaattctatacatgcatacaatgagttttggttaaattcactctctattccctgtgttctaattctatcccttccctcttcccattcttgactcccaattatattacttcttttgttttgttcttgctgaatccactcagcaatattattatgcgtatgtgtgtagggccatcttctcaaggatgggcaacctctgaagaaagaaccatatacctaacaaaaattaatatcctctaagggaacattctttgcatcttctgtaatagaaagtaggttccacacttgaatgtcaaacattaaagaagatcctattttagtgttcccatttcattggataaaaaacaatcaaggtcatctgttgaatgtgtaaatgtaagcaagtactgcaggaatagggaaaggattttcagactaagcaaattgcatacatatataaaccctaaatgagatctggtcaaaaatgaatgtatgataatgagaatgttcactctgctatgtggatttgtatatagtttagatttcagtgctatggtgtggaaatagccatagtggcttttatttttattttgaatttctattgatttcttttttattagatattttctttatttacatttcaaatgttatcccctttcctaatttcccttctgaaaataccctatcccctccccactcctcctgctccccaacccacccacttctgcttcctgggcctggcattcccctatactagggcatagaaccttcactggaccaagagccaccaaacccagacactattgcagatgccaacaagatgtgctgacaggagactgatatagctgacttctgagaggctctgccagtgcctgaaaaatacagaagtggatgctcacagtcatccattggacagagcacagggtccccaatgaaggagctagagaaagtaaccaagtagctgaaggggtctgcagccccataggagaaataacaatatgaactaaccagtacccccagagctctcagggactaaaccaccaaccaaagagtacacatggtgggagactcatggctccagctgcatatgtagtggagtggcttttttgatttcaatagaggtttgagttttataaatgttgagggttagttttacaaatatctaagatttaatttttatcaatagaacctatttttatagtcacacagattatgaacctatcagagctgaggcacacaacagggctcactgaccatcatatacattttttaatacttctagattcatctataagataatatgtccacactgtgataaaaggtttaagcagagtttttcattttaaaaacatgttttccaaagagaatatagtgccaaaacaagattggaaatcccataattattttttggagtgcctttctgtgaaactgatttaagagattataaactacatatttttgtgtgttaaattttattctaagtactggggaacccaacttctcttccttgttgttaccaatggccttttgagaattcagatttgataataacattatttttgtaagatctttcattgtttctcaaagcctggagtcatatttcttcagtgtggtaggtgttggggtattaaaactgccttcagaatctcattaaatccctgagactatttggaaaatcatgcatacagacacaatatttgcctaaaattctataggattcaggaagcccttgatgactttctttatctatggtcttccatactttagtattagaagatacatgtctgcagagctacaaagctaccaacaaggaagtctgtctctgaagctctcaccttccactgatattatgacatcctgatatactactgttatcctcaactggaaagttttccaccagtgccaaatctaaaataaagatgggttggtaaattgttttaaaaaaacaaactagtatctccttccataactaattattcatatttatattgatggatacagattttaacatattgtacaagtatatttaaaacttagtttcaaaaaagaacatgtaagtagaaaatgaatgccgtatgtttgtaatgctacagcctagataataatataatataatagtataaaccttcagacagcgttttgaaggacattatctctgtaacactctcattttcctttataagatttatgtaggagtacgactcatgaccttctagatgtcaatttagcagctaatgacataggttatttaattgggttgagtttgactgaaatacttccgtatataaagaatttaattcactttagaaaacaacaaaagcatatagcttgttggagatatattttagagttgcaaatataactttgaaaatcaaaacaaagaagaatcaagtcagtttcttaattctggcttgctctttactctcagcctaaagataactcttatattgcattctctagccatcagccaactttgctcaatgctgtgtcctaacttttaatgtttcttatttaatctagatgaaaacctacacaccagtatgggagataatgctggtgtttgcttcttaaataattttgttcaggggaattgtgtatttcctttaaggatacacataatttgagaagataaaaacaggttccctggctaagtgtcacataaatgactgtcccctgggcagcaaaactactctcttttggggcatgtaatttggtttctgctgaattgctttagctacagggaaggaacaaaatgcatgtttgtctcagactgtgaagattgagaggaaaatatttgtttccaccttcgcaccccctttggggcctgttcatgatgtattttggacaaagacccagagaccagggtaagacgaataatttgaatgaaaaacagaataggtagtatggttgaaacagagacactgcagaagataaaaagtaaaagttagtgggatatcgagggaagccattaccaaacctaaaaagccaaacagcaaggcaaggatttggttctatagataacagggacctccatagtgccatgagttttagttcatgatgtgtattgaaattacacccctgtttcatgctgcttcttttttatttataaaggtttgaggaggcttcggagttggcattttgaaatctagcctgatattcattcaaacagtcaaaaatggttttagatatctgtggtaggataagtatgaagtattgtagcatgtcctgtcaggaaatcaccctgtgagaaaactgttcttagccttttttctttttcttttcttttcttttcttttctttcttttttttttttttttttttttttttttttttttttttttgtcacctgtgaggcagaactggcacgaatacaaataatttctatttatttttagtacttttcattctcattataattctgcatgggaaagaggtgacagaagataaatcttgggtcccctgaaacattggaaatattctcatttgaagcctttataaccaaatctgaggcttctgcatgccgtcagtacaagcccaagcatatgcagtgctattttggcaccattccttcctgtaccacatgaaatatttaattttattactcttgagtctgtttgagcagatgattctttgtgtcttttatgtaatggaataaaaggcagttagaaatgagctcaaagacaaaaaaaattaataaggatacactcgagccttaagactcgttttccaagctgcagctgagacatttacaaagattcactactagagtccaattatgtcttctcatgagtggctcaagttcaatgtctcatgaacacttaaaaaattatcacattgacatctaaccaagctaaatgctaatggtgtctcagataatcaataaatatgatctaaaatcaccttcactaattggaaaaatacaatctgtgactttgattaagagaatggccacaagaagttcataactgtgttgtacattttatatgtatggatacatgtatttctatcaaatattcactaattgtgtatggatgtatgaagcaacaagggtaatcaatttataatacaattacactctaatttattctattgattgcattttcttaagcaagacatacttgtatatcataataaaagacaaaacaaaacagaccctttatagaacagcatgttaaattcagacaggaatactaatgcctcctattagtgttgtagatttccatctaaagttctctaagctctggctctgcttgccaaacactagtggctggcaaagtctgtttctctatggtttccttcacaccaccttttggaaagaaggcaataaatctgcttcctggagcattgtgaatgtaacagacagccaagatacccagtctgtgtattctttccaagcctcacgtgggatttgcagagccagcacatgactccaatggatggtagcacatatttgatcaattttctttaaaaaatacaagtacacgggtggtgctacgttcctcctatcatgcttttacaacttatattagagactggaacactatttgacacataatacacattcagtatatatttattggaaaaaatggatttattaaaatttaaaactatttacagaatttcaaaagaaaagactgaggtatcatcacttttgctttcactcttcataaaaggatggcagcacattgattattttctctacatggcctaaaaagaatatttgattatcttattacatggtctgttctcatataaatgtagtaattgtattcccaaaatgtatattcataaattcacaataagatttagtttaaatctcactgacaaagccattctatgtgtcctatttctcacatgcctttagcatatgaagatgtatctggacatgaaattaatttcaggctaaatttgtgtgtatgaaagttgttttagtctttacttctgttttacaagactgaaactctaaatagtattaaataatcaagtcagtacacatagcctgaaagctcacaagtagctttctattctgttttagtcttattcattctagctgctgaggtaaatggaaggaaaatatcacaactaaatgactctctctgatatttggggtcctgtggattacagatatattatatactaacatgattatcttttatgtacaagtaaatctcttgttccatgtgtttaggagttgtgcagttgctatttgattttaaatataaattttgaagctaccttgttttgttttgttgtttgtttgtttttttctttttgttttggggtgtttgtttgtttgtttatttgtttcttttttgtttttttcgagacaggtcttctctgtatagtcctggctgtcctggaactcactttgtagaccagactgtcctcaaactcagaaatctgcctgcctctgcctcccgagtgctgggattaaaggcgtgtaccaccacgcccggcgaagctaccttgttataagtgtactttgataagagcattagaaggcaatcacaaagactctggattcaatttgatccagaaattaatggcatttagacatggtaacaagaccattagaaaagtacttcaacaaactaaacaattttatcataatcttaagcaaaaatcaattgagcctttgctaaaataaatattaaaaacacaaaagctataaaaagaatcatggataaatattttttaaatatcatttatttaatatatatatgagtacactgtagctgtcctcagacacaacagaagagggcatcagatctcattatggatggttgtgagccaccatgtggttgctgggaattgaactcaggacctctggaagagcacagtaagagcttttaacctctgagccatctctccaggctggataattttatcatgcatgttcagaaccaatgttcaaagcacttaaaagttaatgatggtaaggtcaaggatctttgtaaaacttactatgtctgctcccttaaaaagatatggagaatttgattctagttcaatggcctcaccaatcttttgtcataacacatattctgttttcactccctaccatatcagaacaattttatttccttatacaatttttgcccaagttcaatttgacaattactgctttgaggagcttcaggtgaggacattgtttgatttttgaggcagccaaaagatttcttggtattgacagatgactcattgcataggcatacttaccaggcaagcctggtgaacaattttacaaaattgtcctctaaattccatatacatctcatggtccatgcatacctgcactcatatacacacattttgcatatccacataacttacacagagggaaaaaattgtcttccattttctagaatgttttccaggcttccaggggtaacaagcatttcagtttcttttctcttgccatgccctaaaatgacatggaatataacaagcaaacattatggagtaactagacactttaatataggtcgataatacccaagttggagattttttaaaatatttggtaatttggatcagaaagttaaaactttggctttcctgtatttcatggtgaattattcagtgttgtataatataaggaatattgaactagcaggaatttgcgtggaaattgctcttttccttgttagcttagcacagtgtcagcacagaatcaacacttagtaagatttcttgaataaattgaatttaattggaattgaaattgaattgaattgaattgaattgagtaatgtcttatatagtccttcagttacaatcttcttccttggttcctcttactctccaaccttcttcaggtgtggttcgttgagaccacagtatctctaacaatcattccttaggaactaatttttctttggaactgaaattcctttggaacttaaatttctgctacagcactgaaacctacctttgtgttaaaattaatatacctcaattaaaatagtatgcatacttccacatccccatagggtgtatgccatgcaaccacatacttattaaccttatagccataatcatccatggctctttaatatttctagaatggatagcatttccaaactgcttccagtttattataaaacaatgtgcatttcatcactggctaaagcactgcttgtagactaactcgaggatgagttaagagaagtggataaagaggtaaatgtaatcagaatatatatatgtgtgtgtgtgtgtgtgtgtgtgtgtatacatatatatatatatacatatatatagttcatatttagatgggtcagttgatattttcagggataaagaactgatcaaagtaatataaacaccagtttttccccattggttcacaacagcacactctttttatgtagctttaatacatgcagaatattttagcatatgatcctgatggcattcctaactatacttccactggattatttcacaagtctattcagagtaagaatgagagtttctaatcttccagggcatatcttctcttccttcgaaggttatgataactagaattggtgggtcatgaaatgcccaaatcaatattgtcattgacttaatccacataagaggattaacttcataggtgacttctgagtatctgagacaaaaggaaacaaaaatgaatcagtctctagcaatgtcccaaggtttgtttgtttgtttgtttaatagctgtaacaggaacagaattctagactcacacagaaagccaagtaggacattgtaaacaactatcttttaataaatacctcctcatcattcccggttgggtgaatacaaatcaatcacgtggaacacattaaggatgtcctaatagaacattttatatagccctgactcaggcacactattgctcctcatttgacaggtcacgaagttgaaccttggagaaggttaactttcacaatatgacaaacctaatttgtggcacaattaagactttaacatgtgctctgaaaactaaatgtcatgattttctttctctagaggttcagagacaatttcgttgagtgatatgcttacatatggcagggtgcaccaaaaatacctaccatttgcatataattttttgtttattatttagagttagtgtctcatgtctttccgtttttaaaatttcttatttctaatccattcagattgccagttcaacttttttgcttttacttacttacttacttatttgtctatttattttaaactccagattttattaccctctcagtccactctcccactgtttcacatcccataccttctccccgaccccctgtctccatgaggatggccccaccccacacccaacctgacctctaaacttcctggggcctccaatctcttgagggttaggtgtatcttctctgactaaacccatacccagcagtcctctgctgtatatgcgttggggacctcatatcagatggtctatgctgcctgtttggtggtccagtgtttgagagatctcagggtccagattaattgagactgctggtcctcctacagtatcgcccttctcctcagcttctttccgccttccctaattcaacaacagggatctgcagcttctgtccattggttgggtgcaaatatctgcatctgactctttcagttgcttgttggttctttcagagggcagtcatgataggtccctttttgtggatgctctatagtctcagtaatagtaccaggccttagaatctccccttgagctggatcccactttgggcctgttgctggaccttcttttctccatttctatccctgaaattcttttagacagggacaattatgggtcagagatgtaactgtgggatggcaaccccatccttcacttgatgccctgtcttcctgctggaggtggactctgtaagctccctccctttgagtcctgggaatctctcacctcccagggctctggtatattctggagggtccttctaacctcctatctcctgaggttgacagtttacattctttcttctggccctcagggatttcagtccatttcccccattcaatagcagatcatgttaccctctttgatccccatccctttccctgccagtcccctcttcccctttgtggttgttttgttctcccttccaagtggaactgggtcatcctcacttgggaacttaagcttgttgacctttgtgagttctgtgggctgtatcttgggtgttcgacacttttttttttggagtggggggtaatatccacttattagtgagtacataccatgcatgtccttttggatctgagttacctcactcaggatgatattttctcgttatatacatttgcctgcagagctcaggatgtcctcgttcttaataattgaggagtattccattgtgtaaatgaataacattttctgtatccattcttctgttttgggacatctggattgcttccagcttgggtatcacaaacaaggacactatgaacatagtaaaacacatgcccctctggcatggtgggcatcttttgggtatatttccaacagtggcatagctgggtcttcaggtagatctatttccaatattctgaggaacctccagattcatttccagagtggttgtttttgagaatttcatataagcatactgtacatcatttccatttttcttttaccatgtttcatctgtgcctccatatccctctaaattttatagcctcttctgtagttagtgttacacacacacatacacacacacacacacacacacacacacacacacacacacacacaaacatataccacctactcagttcatttagtgttacttctgtgtttctgtgtacatgtgcttagggcgaactacccatcaggatagcccatagtgattctttcaacctctatgaaattgtttttacatcttcatctatgagtctgctccatgttgaaatgtccctagtatagtcattgtacaggtctggcttaagcaaccatattgttgaaatttcatgaatgcaacatctcagttatgtctagaaaatactatctcatcattcgccctgttcttctgtaacactacttgggccttgggtgtaaacgttgatccgtatgtgtatcagctgagactgggtacactgtgatcatttgatatttgtattttgaccagttgtgactttctgtaatggtctatatctgctcaaaaagaaaaaaatatgttgttttgattacagtgacaactacttttttctgggcataaaaataggtatttaaactacagatacaaacgaaaatcgtactaataagttttcctcaaggctccatgacctccccagccacaggtcgttggcttagtttacaataatagccatcaattcccttatattgagtggaactttaagtgcaattagacagctgttagtaactcccagatctcaatgccactatattacccttcaggttattttgccatgctgatgtttgttgttgcacacagacttcatatctccataggaatatttattgcttttctcccttggcagcttgcatagcccttcagattctatgagagagttagtcctagagtgccagctcaattcccatcctgtattcaatatctgtgttgtcttcagggtctttcacattttgggattcaagcaagttcaagagcatgtgtttatattattttgcatcaaatcaatatactatgtatgtagaatgtattcttggcatatactggttaatgtacaaatggacctataaatgatattttagttgagttataaaataataaatttgcatttgctttctcatatacccctttttatggttaaccctcactcctatatccaaatcttctctgccccctcttccttgtcctacatagaactttctttttttcttttttttttttgcttttcttttctttttttattaaatattttattttttttattttttttattttattttaattttattttaatttttttattaggtattttcttcgtttacattttcaatgctatcccaaaggtcccccatacccacccccccaatcccctacccacccactccccctttttggccctggcgttcccctgtactagggcatctaaagttggcaagtccaatgggcctctctttgcagtgatggccgactaggccatcttttgatgcatatgcagctagagacaagagctccggggtactggttagttcatattgttgttccacctatagggttgcacttccctttagctccttgggtaatatctctagctcctgcattgggggccgtgtgacccatccaatagctgactgtgatcatccacttctgtatttgctaggccccggcatagtctcacaagagatagctctatctgggtcctttcagcaaaattttgctagtgtgtgcaatggtgtcagcgtttggaagctgattatgggatggatccctgcatatggcaatcactagatggtccatctttttgtcacagctccaaattttgtctctgtaactccttccatgggtgttttgttcccatttctaggaaggggtaaagtgtccacactttggtcttccttcttcttgaatttcatgcgtttagcaagttgtatcttatatcttgagtatcctaagtttctgggctaatatccacttatcagtgagtacatattgtgggagttcctttgtgattgggttacctcactcaggatgatggcctccaagtccatccatttgcctaggaatttcataaattcatttttttaataactgagtagtattccattgtgtaaatgtaccacaatttctgtatccattcctctgttgaggggcatctgggttctttccagcttctggctattataaataaggctgctatgaacatagtggaacatgtgtccttcttaccggttgggacatcttctggatatatgcccaggagaggtattgctggatcctccggtagtactatgtccaattttctgaggaaccgccagactgatttccagagtggttgtacaagcttgcaatcccaccaacaatggaagattgttcccctttctccacatcctggccagcatctgctgtcacctgagtttttgatcttagccattctgactggagtgaagtggaatctcagggttgttttgatttgcatttccttgatgattaaggatgttgaacattttttcaggtgcttctcagccattcggtattcctcaggtgagaattctttgttcagctctgagccccattttttaatggggttatttgattttctggagtccaccttcttgagttctttatatatattggatattagtcccctatccgatttgggataggtaaagatcctttcccaatctgttggtggcctttttgtcttattgatggtgtcttttgctttgcagaagctttgcaattttatgaggtcccatttatcgattctcgatcttacagcacaagccattgctgttctattcaggaatttttcccctgtacccatgtcttcgaggcttttccctactttctcctctatacgtttcagtgtctctggttttatgtggagttccttaatccacttagatttgaccttagtacaaggagatagaaatggatcaatttgcattcttctacatgataaccgccagttgtgccagcaccatttgttgaaaatgctgtctttaaaaattattttgtttgccttccaaatgtcgacccacttcctggctccccatcccatagttcttcctcccattccccttccccatttgcttctgagagaacactcccccacccttccccaccagcatctccccttccctgaatcatcaagtctctacagaattagttccattctctctcactgagtccagacaagacagtactctgttatatatgtgccaggaacacagaccagccatgtatgctttctggttggtggcttagtctctgggagctctgagggttctgggttagttgatgatgtttttcttcctatagggttgccatccccttcagctccttcaattcttcccctaactcttccatagggttccccaacctcagtccaatggatggctgtaagtatctgcatctgtctcagtcagctgctgggagagtctctcagaggacagtcaagctaggggccatttttgcccctgcatttcctttagacaggaacaattctgagtcaaaaaaattgaagatgagtgggtgacccatgactcaactggatgcctgtctatctactggaggtggtctgttcaagttctttctccctactgttggacatttcagctaaagttatcccacattgggtcctagatggctctcacatcccaggtctctaggtctttctaaactttcccacttctcccgcaccttacacagctgtatatttccgttcattctcctggccctctgggcttttctgctgtctccccaccatacctaatcctgccctctttcttctctccctctcctctcccactcaagtccctccatttttctgcctcctgtgattattttgttcccccttctaagtgggattgaagtacccacccttgggccttccttcttgtaaagcttcatacaatctgtgaattgtatcaggggtgttctgaacttttgggctaatatcgacttttgaaggagtaccattatctatcctctctactttcatcttaactacattctgtgatccacttcctctagggtatcctaaatgactgctttctaatttcctgtcttccacaggtacacccaattaaacacacacccaacaattaaaatttagtattcacatatcaaagaaaatatgtggcatttgtcattctgggtctaggttacctcatacagtgtgatcttttccaggtattcccatttacatgaaaaattcattatttcatttttctttgcagctaagtaacattttgttgtctatatgcatattttctgtatctatatttaattttatattattttgcaaatattatgaatataatacacaggaatgtgcagcattttctgttccttacttggtcagagtttcatatttattttgtgacttcatataggagcaattatccatttccacttccctttgttagttttctcacatcttaccagtgtaggagcacctgaggactcagtcttctcttaccatacatactcttattccctcagaggacttgtttcataccagtatcaactatgtgcaataagaatatatccactgaggctccaaggcctaacattattattgatgctatagtgtgctcacaaaaagggacctagcatgaccatactctggaagacccaacaggcagctgaaagagtcaagatgcagatatttgcacccaatcaatggacagacctctgtggttgaattagggaaaaactggaagaagctgaggaggagtgtgaccctatatgaggacaagcagtctcaattaacctggactcctgagagctctcaaacactggaccaccaaccaggcagcatacaccaggtgatatgaggccccaacacatatacatcagaagactgctgggtctgggttcaattaggaatgatgtcccttgagagacttgagccccagagagtggtgagtcctggtggtgtggggacattcttttggagatgggagggatgaagtatgggatgtggaacagtcagagggtggaccaggagggggataaagtctggaatgtaaaaaaaaaaaaaaaaagattacagaattaaaaaaaaaccagaatatatcccccaaattaacctccctcttcatattcatatttatgtccatatttctctttttcatattcccttagttgcatagtaacatattacacaactgttctgtgtctcatactcttcaatgctactttgtcattttagctgttattgtagctaccagttgtgccgaagcatacattagcaattcctcttcacatctgaagcaaatgaactcttatgtgttgcctattctgttatgtgtttgaggaatgtctatagcagccaactcagccaatttttggtgtgtgaaaacatgtgtgtaagaaagttgatatatctttgaatagcatttgacctataagagaatgaaatactttcatcaatatttcttctatgtttgatcatgttttcttctgggtattttataatagcagcatcaacaacatctatctcctgtttcccatatctgtggccacctcaaaaacacacagtggagtaactgactttacttctctatttggttttccttgttcttcattcttgttttgttcattattgtccaaaataaattctgtgtatacaatgctatctctctggtattgatttcgggatacccaggcttaaatctattcaagactcttgactcagaacctcagaacctcctcctccaacctcattgacctcaaattcttgtaactctttctcccagtccttataccttgacaggacccctaatcatacctatcagcatgtcttttcatatcctctttgaaagcagactcagaatgtgactaattctcatcacctcctctgccattgcccttgtctaaagcaccatcatttctcatattgatttttcagggaacttctaactaatcttcctgcttctgttctacattataaccctaacattttactcaaagcacaatagccaggctagtaatttaaaaatgattcatagataatgtcacttccctgatgataacctgtagccacagaataaaagatactatacaagggtagtttccctttccattggtgactctgcttcatttattctgctatacctttcgaataatgtttctccaaaatgcaagtgtatttctgccttcaaagttactgattcttatacctaaactatgtttcctcttcacatttaccctttacctgatgaagatcgttatgcatatatttccctcttagtgagacataactgaccatgctacttcaatttatcatctgtgcacactactctcctttttctttctttctgtacagtatatattgcttagctaaccatctatattatttattctttaaagtaggagtttttgtgcattctctgtgtgtgtttgtgtgcattagtgttagtatgttatgttgtagacacaacacaggaactcagaagacaggaaatataacagtgacctatatcaaagcactacactgaaagtgttttggaagtaaacagctgcactaagaataacactaggatcatagatatgaaccaaggccatatgggaaagttgaggcattatcagtcctacttttcaccatttgacatagtattttacttttcttcatttatgcattatatattggctaatgcttaatgtgtgtatgtgtgtggtatatgtactaacttactatactgcacagggaactctttcaacagtatactatacatttttttaatatgttcatttggttgctgttttttccaataatattaagtgctgtattttccaataatattaataatattaataatattaatatatatacatatacacatatatacatacatatgtatatatgtgtgtgtatcataaattactagaatgcaaaaatattatctagcacatcatcatctattattaacaggaagtattaacattatttgtcatccaataaaagggatatttttcttgactcggattaattattgagatgtttgggtgacattgttctattttacttgctctttcataatgtcttttttgaatatatctgtgaaggtgcttgagatcatcaagtcatttttcctttgcttttctagtgctgtttattattattattattgttcttgttgttgttgtttttgctattttgccttgtaggtaggtgtttacaaatctttgacattgttgaggtcactttcttatccatcggtttctataacaaattagataagaacatagtatggttttgaattttaaattgcactgggttaatttatttgaagtcaagttgtgagtattttgtaaaaatccttagaattcttgttatgataataagaaacacatctcttatatgctttatccagctggaaactgtggataaaaatatctaagaagagggactttgagttctttcagtagaattctagaaatgcaaattcatataattgtaatgatcaatcatttactggtatgttaatttcttaatgctttcaatttatcagcagcaggtttttcctaattctaaagaagcaatgcttaattctctttttactgattaattgtggagaattatacttctggcagttgacaaagggacttacatggtttgcttcaataccattcaagacataggtaaataataaaagtaaacaattcatgagaaggggaaacataattaacagcattctatgaacgtttgtctcctcttgcaaaatcctagtaagctatggcacaggcttccagttttcttttgatgagagcacttgttagctaatcaatttataatcccaagtgatccttaaacattaaaaaaaatgacatcagccaattagctaattcaattggacaagcatttatggaacatttactattcaagcaattgtcttttggtcacagacacagaatgaatatagcaatacccttgtataaagcttacattagaacgcatagctgatagattcaattctttttttttcttttgcttttgatttactgagcctttatatttcaagacacaggattttctttatagcacatctgtggtcttataatcacaggctgtattataatacaattgtgctttattgagacagaatggatgaatagaaagttcactttgcaagtcctttcatttaatgttgaatttcatgctgaggagccttgtcttctaacagtttgtatagatagtgtctcttattcccatttgctcccttttggcttgcctctaccatatggtcttctagaaagatcacatcactgggtcaagactcatgctttcaattttgcttcgttcactcactggatgaccttaggtcttcttttaactgcctttactagtatattaatagtcacctggggtctggtggcacagttaatcaaagtcctaaaaataatttgaaatgtatagctttctttctgcccctggagagaatctttgaaccagggaacaaggtaggaaggaaagggacatttgctcagataatcaacaaggtctctgtgtgatgattcccccttcagcactgtctcctgtatattcctacttagtctccaaaaaatgaaataaacattttaatattctcctgtataattctttatttgaagattggagattataaaatgacaaagctgacatctatttgaaataaacgtaataaaattggcagtttttcttcatgatgcttgtttgctatttaataaaaagagctgaaatatttatatattttgcatctctctatatatactatatatacatatatatcttttatagtatataatataatagaaaagacaacataaatttgtgaagtgaggaaacatggagggtgttaggggatgaaaataaaggggaaagtaatttacattttaattaaaatatattcaaagaaaaaaacaaagaacaaaatgacatctaaattaattatattctaaccatataatatcagacatgaatggtagtaacatagaaagtgtagctaggcatctagtaaaacttatgttctcctccatataacatttttgtctctctgcagtgtttgtttccacctctctgataatgaatgttacaaatggtattctgtagctccctgttgctgttaatagactgttcttttacttaattatggttttatccaaataactgtgaaaatattcaaaggtattttaattaaaagtatttgtttattattgtgtgcttgcatgatgtgtaggcgtacataccacagcatgcctgtagaagccagaacaaacatttgcctagttggttctcattttccatcttcacatgggtcccaggaattgaacgcatgttgccagcctttaatatcaaatatctttacctacagagccactttggcctccctcaaaggtagtttttagttcttcatattgagcctcatggaaaactatgttcaaggtggacttctggatacgctaagcatattcctttatagcaaggaaggtttcaagatttttgaggtttttttaggcaataaagatcacaaacagtaggaataaaaatgatttgcaacatgaccatttctaatgataatacactaatctagcaaaaatatcaggagaagattagcttttgcattaaatggtcaataaataagaggagacatcataaggtaaatattagaattggcaggacttagcagctgacagtgtgtgagaactagaagagagaggatcaacattttaatctttgtttaatcaataacataagaaaaatgaagtcatcaagataggggaataataaagtatttgtgaaaaatctattctctttagaacatgagttttaaggaattatatattgtcaatgtctaagtatatagtttgaattaaaatatatttgaattggacttgtcatctcataaatgactgacataaagtaaagcacatggaaattactgagatatgaatagagacaatgcagtattatagaagtaaagagaaaaacacaatatcataaaagaagaataaggggatctcatacaaataaatttcaatacccttaccagatctggaatttttgttaaatttttgagctaaaatataattacatcccctcttcctattatccctcctatgtcccttccatttaaaacaccccctcttgcccccattgtttgcctttcaaattgataacctccttttattgtattgttatcgtttcctatatttaaatgcttaaatatgaacatataacctgctgagtccatttattgtggtgcgtgcgcatgatttcagggctgaccactttgctgtggacaataagttacagtgctcatccctgagagaaactaagtttccctctttcagcagtaactatttgtatgtatgactttatcaaaggatgtgacccccccatgaaattttcccttttcacattaacatgtctgttggtgttgtctttcttcgggtatggtttagagagacctattattcaggtatcatgtgtatagtttccctgtcttttctagagacagaccacacaatgattttcctagttccctggtcctctagttgtcatgattttttcatcctctcttccaccatgttccccaaaattgatgtacatgaagtgtgttgtagatatatctacgggggctattatcccccacaattcttaaactctgcattatgggcagttgtagttttctgcaatgttctccagttgatgtaaagtgaactttccttagaaacaatgcaatttagacacagatcccaaaagctgtaactgacctgaattcctactctctaagaattacttttcatggtaatataaagtagcatgcaaggttccaaaggggagaagaaaccaacagtttttcacagctatgatgccttgtcctacaacaacgtacagtatgacaatagtaatacttatttcttagatttgaccaagagttcttatctccttgtactaaggtcaaatctaagtggatcaaggaactccacataaaaccagagacactgaaacttatagaagagaaagtggagaaaagcctcaaagatatgggcaaagggggaaaattcctgaacagaacagcaatagcttgtgctgtaagatcaagaattgacaaatggaacctcataaaattgcaaagcttctgtaaggcaaaagacactgtcaatcagacaaaaaggccaccaacagattgggaaaggaactttaccaatcctaaatcagataggggactaatatccaatatataaagaccttagggagatggactccagaaaatcaaataaccctattaaaacatgtggtacagagctaaaaaaagaattctcacctgaggaatactgactgaatggctgagaagtacctgaaaaaaatgttcaacaacttaatcatcaaagaaatgaaaatcaaaacaaccctgagattccacctcataccagtcagaatggctaagattaaaaattcaggtgacagcagatggtggcaaggatatggagaaagaaggacactcctccattgttggtgggatagcaatctggtacaaccaatctggaaatcagtctggtggttcctcagaaaattagacatagtactactggaagatccagcaatttctcttctgggcatatacgtagaagatgttcaaacttgtaataaggacacatgagccactatgttcatagtagccttatttataatagtcagaagctggaaagaatccagatgtctcttaacagaggaatgaatacagaaaatgtggtacatttacacaatggagtactagacagctattaaaaacaatgaattcatgaaattcttagacaaatggatggaactggaggttatcatcctgtgtgagataacccaatcacaaaagaacacacatgatatgcactcactgataagtgatactagcccagaaacaaaatattcaagattcaatttgtaaaacgcatgaaactcaagaaggaaatccaaagtgtggatacttagctccttcttagaatggaacaaaatacccatggaatgagttacagagacaaagtttggagctgagatggaaggaaagaccattcagagactgcccaacctggtgatccatcccataaacaactaccaaacccaaacactattgcatattccagaaagattttgctgacaggaccctgacataactctcttgtgaggctatgccaatccctggcaaatagagaagtggatgctcacagtcatctattggatagaacacagggcccctaatgaaggaggtaaagaaagtacccaaggagctaaaggggtctgcaaccctctaggaggaacaacaatatgaactaaccagtacccctagagctgtgtctctagttgcatatgtagcagaggatggcctagttgaccatcaatgggaggagaggcccttggtcttgcaaggatcatatgccccagtacagggaaatgccaggaagtgggagtgggtgggttggggagcatggtggggagagggtatagggggctttggggatagaatttgacatgtaaatgaagaaaatatctaataaaatgcctttaaaaaagagtgacaatatgactggtactggaaagatagccaactactcaggactactaaatgcatagatcttgaaggaaaacctacaagcaccaatttagtaaatcagcatagtccctaactatattcaatagatctgttcttataggcatagataagtatagtcctcatcacccagcaatggaatatctttttgcagcagacagattattacagaataaaacaatagatcaaaattcggagttgtagagcctagtcccaagtgacacattttgtaaactgaaggctgagagatcattgtaggagagagcagaatgagtgtaaaaatcacagaaacaaagaggctgctataactgtatgtatactaataatattagaagctacttctataaaatatcaataacatggctgcttaaacattatttgaacaaggttaaccaaataaacatagcaactaccagcaactgaggattgccaaaattggggggggggaagaatcttcctcaaggaagaaccacactaaatggttttccaatacaggattatcatccctgaaaatatatacacaaataatatacagagcaagcatgcatcaggtagtatttgtgtgtgtgtgtgtgtgtgtgtgtgtgtgtgtgtgtgtgtgtgtgtgtggttgtgtgtgtcttaataacaagtaataagaagccatggatttgaaagaaagtgatggagtacatgggaaagtttagagagaagagaggaaagggaagaggaaaatatgtaattataggtttttaaaagtactatgtaaacagagaagcactttgatgaggagcaagagctacactcatctatgaggataatgatgctttagaatttcctcagtaattatgctggtctgataaagtgatggtaacaagtttggtttttgttgttgatgtcttttaaaatagaatccatgacctatctagccatgggtaattttctaggtttctagtaccagacatgacttttcttcttttagtggcccttaagtctcattaaacagttgatacttaccaagaacatgggactgatacttattgaacatttagagatatctttctatgctgtttattattgtaattcataggcatcgcagctggataaggctattgattactatcctcctttgatattttacatagtacttacaggtactatggaaactatattgcagagccaaggttttctgataaaaatcagattgaatcatttgaatcttgtgtcttaagtgtgtagtgtcttcagcactaggcacttatcttcaagttatgagaggtaaccaagggcaacagcgatagccagtattgttttggcagttattagactatactgacaatctgtatggtgattagttggcacatggaaagtgctactattaggaggtatgcccttgttggagaaagtctatcacaatataggtggactttgagaactcctaatgttctagttccattcagtgcagaaagtcagtctcctggctgcctttcaatcaaaatgtagaaatctcagctcttcctgcaccatgactggcctgatactgccatgcttcctgccattatgataatggacttgacctctgaaactgtaagccacaccaattaaatgtcctttataagaattgccttggtcatggtgtctcttctcagcaattgaaaccctaactaaaacaacttgcatacaagttgcacatatcaagtactgggagttcggttagggagtttacatggagcataataatcagaaggcaaaagttaattatattcataattttaggtaaatacaatttgtcccttctccccctttttctttttgtactgataatagtcaatacagatttggcatttacaaatttgttgccccctttaaaatggattggtgtaacagtgaacgtatacatcagagtttgatagattgaggaatgaatgggaaggaaagaagtaagcatagatttttgagatgtttaagtgaaaagaaattaaatggtttaggatagatgtaataaataaatagtttcaacagaatatttttataatcacatgagtttctatacaaaaagtataacttcagcatgtatgctttcctacttttttaacttgtcaaattgataacaagtaaatatttgagggatgaataaatgaatacatataaaatttcagaaaagaagtaatatatacaaaccaaaggatgggggaaatagtggtatctaattttacaaactctcaaaaagcccaaagtgatgaaatatggatgtgagtctctcaaactcatggaaagtatagtaggagttactatattcatagcatctattttattatgtcaagtagaatacagtgatatctgacatgcttcagaaccacaaggtcatgagtagattaacaaacattggaggattgaaaatgtgatagactaaactaggtacaaagaaagtaagagaaaataggattaaaaaagattaacatacaagttaggatcttggttacagtgttggaaaaaaaatcttcaaactagcttaagaaaagtagagaggtttggggtaagagaactttagaaaaactgaatatcaatatcagtaatgatcacgtaagtcaaaggctatcaacatagttcttaagtcattttagaattaaagtttccttttagtttagatacaacacagtaaaaagtatgactggggaaaagctctcaagatttttctcttgcagttgtgcattctctaatagaggattctgttctatttgttccaaatattaaaaatcgtgagcagggacattgactctccttgttatgctcacttgtcactcctggttcaatcagtcatgaccaatagtgcacacatgtgaagtaaacattaataaataaagctcatgtcaggcttcctatttgaattgatctgtgatgacagtttctttcatcatgcaataagtattcatttggtctttacagattcccaaatcctaatgtaggtaatgagaaaagaatggcatgaaaatagttatcgttcctacttttgagtgtttgccctcttataaaacaagattaataattaataaactctttcacatattatcagaataaattatacttactataaagaaaaggtagtgaaggtgaacttcaggatggatagtcatgtatgtctatatggagtgatcacaagaaagatgcagctatttgaagatttgagtaaaggtcattgatgcagagaaaaaagcaattgcaagatcatagggtaggaaatgatcttggcataattaataattaataattaacagagagatggttgttgggaaaagaatttatggagtgaatgggtgaatgctgtgacatagaatgaggaaactgagcagaagctagatctcatatgctcctgtatctactaagtacttaatattggatgaaggaaagcagactggtataggttttcattccagtccctataaagaaaaagcaaaccaagctaagtcttataagaagattcacaggttgagtagaattcacagggaatgcagagataatgttcattgactacttacaagaagttgatccaggattcaagatcatgatagtaaacagctaaacttaggagagagtctgatagactaagagaaaagaaagttcattgatcttgtggtatttgtcaaggatggaaagtacactataagtccaggagagagtcagtagtaaaagaatgacactggcagaaagattttttaattacagattttggactgccctattgttcagatgaatacttgtttttatgtttattacatcctaccagactatgaatatcttgttagtgtacctagtttccaggaacgtgcttatttgggttcaaaatactctctcctccccattcccttttaaaattgtgatcttttccattattaaacattggctattttcccagagatggcactgaagaagaaaatcaatgacatatctagccagccggcttggactgaatgggcattcaaatatactccaagggccaagtacagatggtgatttattgtgcatacaacttctacagaatgccttcatttgagcattgatgtatatacaattactcaccagaatgctgcagttttacaattcagccaggaatctgtggagagagatcatgttctccaagaaatccacaaatatattttctacattttcagcatttctaaaaacactcagtcatcttctgtatgaagaagcaatttcaaaaaccacttctttcatttttaccatatttgtcattattgtcatgttttcacaattaccatttgatgacaaattcagatttgttaaacattatttctctcccaacatgtgagtagaaggagttgcttgaggcaaatcatttactgtggctattgtgaaggctaaatgtgcagtggtgatctatttataccagagacttgctcagtggaaaaatcattttatgcattgttcatatcataaggaaacaacccattgaatgttaagcaatttatagaaaccaactacttaacattgcatgggcaaaaaaaaaatagtgaagatacatctaaattcttttcttattgaaaagtctttgagtgaccattttgtccttatattctgaatggcaattgaaatgatgtggaaacttccacctttagcagaataactttaaaaagtaatactctttatctcttgccacatattacttaattgctatgctactagtggaatgaaagtatggccaggaatttatatgcttatattttagttctattttctactattgataatgtgctgttctggtttataactggaattaaatgatatttttctttgcactgccatatttagaattacaacaaaaatgtattgtctaatattttggctacaattcaataataatatttacagaatcatttcagacttctctataaggaacacagtacacagtcaagattaatagtagctataaataaaaagaagctgtaatggtattgataaaaatcagctcagcaaatgaaaatgaggaagttcaataacaaataatatactgcaatgacatagtccatcgagttgctagatgaggcagcatgaaaaataatccttcatgttatttctattctataatcagcatcctggagagtgagctactggtggaaggaatgggcaaacattgtgtatggtgctaagcttagtaccaccctcacattaaattgaatatatgcatttgatgttgcaaaagaaattcttctcactattaacacattccccagctttcattagcatttgctcatctgaactttattcctatgtctaggaatttttctgtactagtctctgttttgttattataacacacaaagtcaactgatttatgaagaaagcaagcttactttggcttaagtttctggaggtgtgtatacaacatctgcagtcctaatttggagatgactttcttgttgacatagtacctaagcagtgcatatcctccagtcaatagctgggaacatacatatgtttctcttttctttttatctctttatcttccatcttttataaaactacaattcaattgcatggatcccaggcctttgtcttgttctaaccatattccaaaggatccacttctaaacactatggttaaaaaaatttcagaatataaatgccattaagttatcatttgagatattcaatttctgaatgaattggagcaaggatggacaaattatagccatttactcttagatcttagtatatgattttcatatctgataaaaatcaaagtcagggttgataaaggaagacataattttaaaggagttacttcaattaattaagcacgaaaataggtgctattcaagtaataaagtatactttatggacatttcccttcatgtagatacatgagtcaggaataaatgtgtgtgtgtgcgtgtgtgtgtgtgtgtgtgtgtgtgtgtgtgtgtacgtgtatgcatgtatgcatgtatgtgtgtatatatatgtgtgtgtgtgtgtgtttatgtgtggtatggtgtgtgtgcatgtgtatgtgtggggtcacttgtgtatttgtgtgattttgtgtgtaagtgttcagatattttaatataaataaaattaggagaaattggtggatagtttcattttattttatgattttatgagaccattctagctttgtagcccaaattgtccttaaatttgtgcagccaggcctggcctcaaattcaacatgcttctaccttagttccctaagtgctgagattataatcttgtaaaagcatatccaattgcatcccaattataataagataaattcttttatgagaacattgttacagattttctgtgtgttatcaagctcgttgatcattctgtagtaatcatcagtcattgaatggatggatggatggatggatggatggatggatggatagatgaatgaatatcttctgtgttttttgccaatacatatggatggtcgttagtgttttatggaggagaaaatgaatatgaagaatcaagtctcagggttctaagtttaggagattgatatgaggaagattgaaaaggaatatttttcaggctagacttgaagagttcaattttaaacatgtttattttgaggaaccattagatgactgaaaatataaatcattgtatttaccatccaatgaaagaaagttcaaaagtttctacatgaaaacaattgacagaagaggtttagcggtcatgctttaattaattcaacaaatgtttgtttactttctgctgtgtggcagctattgtgctaagtagtaagaatacaaaggcacaaagtcaatgaaaggtttattacaattgagtttgaaagggaaagcagttagtttgtaatacattttgaagagaagaataaagagcatctaaattgaatagctgagtagatgagtcatgagaggagggttcctgtaacgtgcacatatgaattaggttccaaacttccagacaaagagaagaaaggaataccaaatttaaagttgttcaaaaaaagttgtgccaatcatagctatgtgacaacattttaatcattgtgaacataggatattttgaattattaaatatggctatgatatttacagaaataactattaaaactaaggtagccaggggttttaaagtgaccaattggattcaaagagaagtttcatgtactgaccctcaattatataagtttgtttctacttcattttcaaacattatatatagtaaattactacatggccttccaaagcaattatttaatcttccacattacccacctctttcaagtttttcttattcccagaaaaatgtcattatctctaatactcctcagttactctataccttgttgagcagtgaacaatgtgcagtgaccctttatcaactagtattggcatttggaatttagcagccttatgccatgtgtaaggagagacttaaaagtgatcaacagaatgattgtagtcacattctttttacttctttaacaatttctctctctattcttttccattggatatgccaatgttttgagataaacacgaaaatattcacaattcaaaattcaattttatttggttttctcctagcccttttgtttctacggttgttatccattgattgactgaatttgatcttccacagtacggatgtcctaactattctgtccctatcatttctagtactacccaaagtcatatttatactagccatcaaaactagcaccaaaatgaaaaacaaactgcttcttttccttctcttctttgtcaaacatcagacaactgaaactttaccaaatgtcacaaattatgtcctgccaatgacaacagaacttttagaagaatagggcaagattgtaaagtaggaactaatttagaccagttaaaaagagtctcttctgaatgtcagaatacatttgtaaaactcgcaaatttatttcattaaaatctatattgtcaggcatttacatgtgcttcaagaccacacagtctctttggaggacaatttatggatactggacaaaagcacactggtaatgctttaaatctctgttagtatggactgcttgaaaatgatggagagggtacaaatccaaattattcatttgtccaataaataaaagatatataacagttaatagcataaaattccaagtgtcattgaaaatgttacctatatatacatatgcatatatatgaacaccttacacttaaaacatgcacacaaagacatatgcaatcatataaaaagatatgttttgggatatgtacacagaatgaatatactgatattttaagtattataacttccagaatggaagtacttcaaggcagacataaaagggaaagtcactttgtatgtattatctatgtgtgtgtatatcattatatatatatatatatatatatatatatatataattttgaaatgcttgccatatgcaaatattcctttttaatagtcaaattgtttgggatagtataaaattgtttatgtggaaaataaactgtgcaaaataatgtattgctcttgcatagctataaaaattataaaataaaataagtaaaatcagttctaaaatacacttgaattttaactgggtaaataaaatgataagcaatcattggaatgcaaatgtcttcctttaaagtaatttttaaagcttcttttaaattgcttaagcactttctttccaaatttcaatttaaaaattaattatgtttgttcatctttttttaccaatactatatttataaaagaaagactgtcagtgtatttataagaaagactagaaaaatttaacaaattctgggcttttaatatctcaattaggattctaaacagtctctttatactaaaaataaataatgtctgatttttaaaagtaccttttgaaagaatgaaatattgtctataagttaaaaatcactcaaattgttcttcacattctcagtgaacctttacatttctttttctctttaaacttttcaatatgttttctctatattgaagaatcaactttgatgtatgtatgtgcttgtaactgtctgctcatatctctctccctctctgtctgtctgtcttggagggtgtgtgtgtgtgtgtgtgtgtgtgtgtgtgtgtgtgtgtgtgtgtgtgaaagtatgtgtacacatgtgcaggtgtcctaagaggccagaagacgatattgtttcaagaaattgtgagtcatcatgtggttttctagaaactgaactagagatccttaaaaacgatcaggaagttcctataagcactgagccatctattcagtggcaacatgttctaattcttggtaagaaaccagatgctcgccatattgagttgttaaaacggctgttctgattgtgttgtgtctgatttttcttgtctttaggctaaactttttggcttttacacttctccataacaccttcatggggatatgaggagtagaaaagaaaaacaaaatgctgattagtcttgctgctccagggcagcatcaaactagaagggtgtgtgtgtgtgtgtgtgtgtgtgtgtgtgtgtgtgtgtgtgttttcttaattcatctaccagaatattaggacaaggaactgcagaattaggcagttttctttaaaaattactcctgggattatttttaataagaatttacgactagtttgaatgtaatttcaccatatgtagtttgactaaatgtagcgacatgggatttattcagaatcatctcttgagatttttaaaaattgtagtattgactgtgatctcaagcctctttctgaaatttaattacagtaaatgtttaaaattaattttttccatgtgttcgataggtgtactttgaaagcccctttgtgaattgaggtatttcacttctttttaatcccttcagactttattttctgtatcaggagttcactcaggagtaaacatagtgaggtgacccaggccaatggtcatgtttggtatcccatatttcccttaagtcttatttacaatttttttctgcaattcattctagcatttacagatctcatctacctctaaggcctatttcaagtctttccccttggatcaatttttccttcacagtttctggtttctacacatattcatatattgctcacagcttctgtgagctattgcagttttcattgtctgacagtcagtcctgtagttcactatattactatcttaagcattggttgtaaaatatgtctcctaacaaaatggaaagttcctttaaaaatgactggagatacttttaattgtactgaaatagatgtctcttgactgccttacaatacctaacacctagcatttagttgctgctcaaaatgtttggacttgtaaactccagttttctggccaatatacaagtcacattttaaaatcccactattgccacagcctcaattagttccctcctttagtatatcatttttttacaaggcaggacaaaatattaccactgatattgaactctagtttcgcttatcggctggtggcaggctttcctgtagggcattatgagcttttacaaagctagtatacctaatctgttacagagctatcttgcccttttggtctgatttattttctcacaactgcagtattctctgggctactgtggaagccgagatttcaactttttaatgaccagcaaagttgtagaacagcaaataaaggcacattcataagtgaccatctattcttaaaagccaagtaattcctgtgggaaggaccttctgacaatcatgcccaagttctccaaacctttatctacccgaccagtcacagaaaatttcatgctttttgagatccaagacctttaatattttaatttagaacatgataatttctcaacttaatttgaggtagaccttagaaactgtttgcttcccttcttttcaagcctttaaggaattttgttttatctgccagaaaattgacttgaggagagactctgaaatttgaatatctcaagctgaaacttacatggctactgagcattcttctgtacacagaaaatagctgaagatgagtcagggacaatagctaaggattagaagaggtatcctatcctcctcttgggcattttctgctgcttcagcctcatggttcctctccctgcaaagaacaggtgtgcctgacagcaggtgtgtttgttctacttttcctatggcagctgtcactccccaggtaactccattttccaggtggcaaattcttactacccatcatcttctttcctggctaccattacttctggaaaaaaaaaaaaagaaggtttggctgttaaccctccctgtttggactgtagattccgttgaaataaatattatagatggtattgttgacttcccttcctcctcctcctcctcctccccctcccctcctccttctccttctcctctttggtttcatgtatttagaaagatgtattttagggtaaaaatgtatcttcagtaagcttttatttacaactaagatgaatgatgttttcctattgaattcctttgtgaaagtcagcagcctttgatttggactgcacttcagagctttcttcctgggcagctatgggtttcaccattttcatattttctagtagtttgaggtccacccttaatcaagacaccactgctgggactgccagtcactacaggcttggctttgatccgcctttgtttctattcatagcatgcatttctcataactctaaaagaccatttgatgccccatgttgtttaatatctatgtgattaaagcagctgagcaaattagctcatgccctaagtctaaggaaaaatccagtctagaggaaattgtattgcaagcctagatcatttttaataagctctgctactcactctttccagttcctctttgggaatcacttgggcatattggaagtatttgagagacattgaaaaagattctttcaggcatgcgtttgactattagaacaatgtttactgaaatccaacattgtacagctccttgacaatggtcctacaatcaagtacaaaacaagcaagtgtgcctttctaacatataggaaaatcaagcgctctggatgcagtagttgataaaaattgcacatatttaaaattattgagtgtatactgaagtcctcaaatgaacaggcattgtagaaccatgaacctggtaagtaagtaatggggaagaaaacaaaaaattgataaacaatattgttaactgcataacatactctctctctctctctctgtgtgtgtgtgtgtgtgagagagagagagagagagagagagagagagagagagagcaagcgagcaagcaggatctaggaatttgagtttgtgaattagcttcagtataatataagtgaataagagaacacaagaagaaaatctgattttaaaaaaatagagattgagaccaataaataaataaataaataaaaacttgaatcatttaccttacaaaaatattttaacttaaactttgggctcactttacttactcataatacaagaaactttttaacattgaaagtaagagttttcacaggcaagagttgtttctctaaactgccgattgtgttcccagaattctgtagactaaaacctacactgagatgatatacaaaatggcttatccctatagtaaggtgtttggagggttagagtagaaggaaaaaaaatatgatatttcgaggctatgtagtgaattcaaagccatcctgagatgcctaataagaccccacctcaaaacctgattactggcaaaatggctatgtggtgaagtacttatctactatgtaccaggccttggtttaaacctctagcccccaaaacaaaacctttcatgttaaagtttaattaacattgcaattataaagaagatgaaatcattaaaaggttatactgacatgatagcttagccttcatgagtgggctaatgaagttatcagggaagtgtggtcttcaaccttctaccatgggctgaagccacacaaacactctcccttccaccatgaggtgaagacacagagacacactccccgaaatctagtgcaatgccttcatatttccttgcctcaaaaaacaatctgtgtattagacttgtattcttcaattgatttaagacacagagtattatgaatttccacatatttgtaatctgtgatgattctgatatatggttttgtaagttaacctgccaaaaacatgttggaaaacatagtaggtaggaaaagatgaaaactaaatctcagagagactcgagtaatcatgttagcatggcttagctgaattgtggtgttggaaaatgtgaccggagagcctcctagagcccaagtaatttgcctgaggtctctttcctgcaggtgaattctctagtggcagttatcgcaatcatgccagaggcttattttcatgcagacatactctctggtattttcaaagcatctattgacacaactgccagtgtatgcagacccaggtctactagggaacaccagcaatcacttaacagtcagcatattttagtgtgcttttactatatggctagcatatagttagacatcaagaggatgtaaatacaatatatcatccattgggatactttgtgggactataatatttacaggaatgcaatagcgaaaaggccatttgtttttttattgaaaatagtttttcttttcacataatatttcctgattatggtttcccctccctctacttctcctagttgcttgccaactcccatccatttctgatctatcccctttcttcctttcattagaaaaccagcaggcttctttttttttttttaagatttatttatttatatgtaagtatactgtagctgtcttcagacactccagaagagggagtcagatctccttaggatggttgtgagccaccatgtggttgctgggatttgaactccagaccttcggaagagcagtcgggtgctcttacccactgagccatctcaccagccccatccagcaggcttctaatggataattcttttaaaaatataatataatataataatataaaacatatactaacgtatcaaaatagtacaaagtaaacaaacaggaaaagagctcaagaaaagacacaggaacaagatgcttactcatttatacactcaggaacatttaaaaacactaaactggaagccataatatataccaaacatacttaaagggtaaaaacatagaaaaatataaattaaattaaataaaaataagaaatgcaatttaaatgtgtgacaagacacaagacattataagtcaaggaatctctggatcaacaactggttttgtattctgttcaatgccattttaaaaatcaaactgcattttgacagtaaagtaagattttagaatgctaggaaaggaagagatcaattaaaacaatatattgagaatgccttcataaaggaattataacttgccctataactcaaaaaaaaaaaggcataaatttcaaagagtcagaatgagaagagaaatactctcaaagcaattctgaggaagacacaacaataacaaccaacaaatcaaataacaaaaacctagtatttaattatttacttgtctagttggttagttttgacagctacaaagtgagtgtgttacataggaactcataaactgttgctcattttaaaatttttattgaaattagattcttctttcatacagtacatcctgactgcaggttcccccttcacttttcccagtcccctccaacttcccctctcagccagattcattctgtccctccatttcactttagaaaagagcaagcctccaaaaggctacaatcaaacagaacaaagcaagatacaacttaagacaaggcaaaattctgaatatcaaggctggacaaggcaagccaacaggagcaagagtctcaagagcaggcaaaagaatcaataacacacctgttcctactgttagagtcccacaagaccctcaagctaacagccatagcacatatgcagatgacctggtgcagacccatgcaggatccttgattgcaactccagtctctgtgagccctagttagttgattcagtgtttcatgttcttctggtgcattccatccattctgactcctacaatcctcactctctctcttctgtaatgttccctgatctcctaggggaatgacccaatggaaacctccagtttagcctctctttgcatttaatgtctgacttgggtctctgctcccatctgttgccaaaggaagcctctcttgatgactgggcaagcctctggtctatgattatagcagcataccattaggaatcctacatactaatctctttggtacaggaaggtacactgcaggctactgaaatagaaatgtggacaccaacctagccacaaaacttggacctacaatctgtcctgcctgcaggatgttttgtggatggccaggaactgaagaatggatagcatggagacctagggtagagttaaacactattggcgaaaagataaaaaagcacctagtattttaaatggaaaaaaattatagttgcagactctctcaaagaactcaaaagcaggtcaaatacttcgaaacacgttttaaaaaattggttgccattgttacatgcaatataaaagtatgtcataatcattaaggggtattttaagacaaggaaaatgataaaacattccatacaggtgaagaagagggaggaagatacacaggtagagagagtgataagtacgtaactgactttatccttactttcccaattcataacggccaatgcccctgaacttctagatctatattactgttagagtgaagtataaggccgtaagtaacatacacttgctttattggaaaacatgtctgtctttcaaatttgatttaacctgtacaaatgttccttaagaaattggaattcctttttattacatttcttatatttgctacttccaggattgataacatcttaagatcttttactttcagatggaatgaagtgcataaataaaatggcaaagtaataatttacacagatgatccaaaacccattaggtatctgatactataacaaaaatatgtacctttgagagttaagacaaactggacaagaaaggcagtgcagagaactcagagcatgagtttcatgtgtagcagcaattcagtactttcacatttgcttcatcaaaggaattatttctctatcaaatttgtaagtataaatttgatcacgatatcaaaggaaatgaatggcttgctttaaggagaggaaacagttttaataaattagaaagtaaaacacaaggaagatatttctttcaggaaaactccttttataattgatgactctgtaaaggaaaagaacaatataggatcctttcatttatttgtcttttgtcttttataatcatgtttctctatcataacttctttgtagagcagtgtttcaaacctggttctatgaatgtatatcactatgggaattttcctgagagcacaatgcaatgtaagtgttctattttcagcatggtccaataaacaaacaaaagcactgtcaattgaccactttaaatccacactttgccattttcaggagactgtcagatatacagaattgagaattttttcttcatgggattatcaacagtatcttttatgccaccccatcattaaggcataagaatttgtaaagagatatgccttttgcatattgttaacaatgatgactgaagttttggtttatttttgactacctaagttttgacaagtaataattgcacacttaatagtaaacaagaaggtaagcaataaccaggaacagaaaaattatctaggacctgtgagaagtaaagggagtgatactactcagactgtgggatatactagttgttgcttcagcaacaaattattagatgggtgtgtgattataaaagagtaacctagaactgcagtgtgttgctggttattcatgacgactcctgcagatgatttgatgatcatttagtatccctatttctccgtaagttagagaaagacagccacatctaacttcataatccagagttcagacttacttaataatccgtaaataaggattatattagacaatgtttcaagttaaatattataaatataagttatcattttcaaaagtaataggtatttttgtcaagatataaaacctagaataaacaaaagaatgttgcaagtgcttttgacattccaattccattctgcagaagtgtgaatagcagatgtatttcttctgaggaggctaccaggcaaatcttacaattacagtttttataaacataataggtgtttatattaaagtaaaaactgtatacttcaataatgtgataaaatgaccatttagaaggtatttggtatgattccaactttaaggtacaaaaatactttgttttatgaatgttgaaacaatttagagatagatgtaaacagagaagataaatagatggatagatagataaatagatagatagatagatagatagatagatagatagatagttttatttgcccttttgttaaaatagattggaggtattatcatttgttaaattcattagtctatatagtacatatttattagaatgtgtatttgttcagatgactatgtctagaactgggaatataccaataaaaattatagacacattttataccatcatgaaatttaaattccagtagaaactgggttataagatgggtccaggcaaggagaactcctattgaataagtgtaattaagctaagtagggacaaaaaactcaatgggacaaacttaacatattcctattgccagactgctctgaagacacatctgatatataactctatttttttattggatattttctttatttacatttcaaatgttatccccctttctgttctgccccccaggaaccccctatattgtcccccatccccctgctcctatgagtgcgttcctctacccactcatccactcctgcctccccgccctggcattccctacactagggcatcaagccttcataggatcaagggcctcccttcccactgatgtccaacaaggccatcctctgctacatatgtgtttggagccattggtccctccatgtgtactctttggttggtggtttagtccctgggagttctgagggtctagttggttgatattgttgttcttcctacggagttgcaaacttcttagctccctcagtcctttctctaactcctccattagggaccccatgctcagtctaatggttggctgtaagcatccgcctctgtatttgtcaggctctggcaaatcctctcaggagacagctatatcaggcttctgtcagcaagcacttgtttgcatccacaatagtctctgcatttggtaactgtatactggatggatccccagatggggcactctctagatggcctttccttcagtttctcctccacacggtatctccatatttgctcccgcattttgttccctcttctaagaaggaccaaaagacccatattttggtcttccttcttcttgagcttcatgtggtctgtgaattttatcttgagtattctgagcttttggtataatatccacttatcagtgaatgcatacttgtgtgttcttttgtgattgagagacaagcaggaagatcaattgaaaagaattaaagacccagaaatgagcccacacacttaggatcacttgatctttgacaaaggagctaaagccatccaatgggaaaaaaatatacagcattttaaacaaatggtgcttgctcaatcagcagtcagcatatagacgaatgcaaatcgatccgttcttatttcctgtacaaagcttaattccaattggatcaagacttccacatagaaccagatacactgaaactaatagaagagaaagtagggaaaagccttggacacatgggcacaggggaaaatttcctgaacagaacaccaatgacttatgctcttagatcaacaatcgacaagtatgcatatgaagcatattggtaagaagcttcacgtataatacctaaaaactaaaaaaatagagtcatgtccatcactggaaatgtgaataaacaaactgaaatattcatatagtaggattctattcaatattaaaggggagcaaattcctgaaagatttgaaaacctggataaattttacaaagctttacactgagtgagaaacaagtaatccataatagcaatttaactttttcaatatggagacatgcaatctactttaaaagtctatacttttaagtctgtaattcactatagcctctaaaatctaactaatttattaatttaatatagcttaggaaagaaaaactagtcacagtactgaggaggtatagaaaaaaattctttcatgaaaatcattcaaagaataattattctttagcacattattaaaatgtattttcataatataaaagtttttattagtattttgtgatataagatgttttagcgagcactgtgttaaattctttctttttccatatttatatgttttatagggtttaaaaaaaacaataaacactggaatttctcctagactcacagagaattagagttgtttaacagcacagatacaagttgttttgtcagctcacaggaccaattatctgttcatgtggctgccctagagcttccctcgggcagtatagccactatagctagggtatctagtttgtttggtggctcctcttttccttttccttttttgatttcacacagaaacagtaagatcctacttacatagtgtgaagtgaagaatgacatcggccaccaatgcttccctatgtagtctgccgcaaggcagactatgagtcccataagtgatattgcgttctactggaaaggaagaccacttaaaaaggttgaatccatttccaacatataaatgttattgaatttattttactacgaatttgtgcattgattcccatatcaaaatctcatggatcttggaggcagaacacaaaagagacaggtaccttcaaaggaggaatggaacattataacagaattgtctgttagattaggaaccattatcaactacatatcccactgaattttcaagtggcagaggcaaaatagatggagaaaaggacaattcaaaatctaagaaaatgaaaataaggataaataacaagagagtatcaatttcttctcttgaattgagaattaattttaccctggaataaatacatgcatcttagaagaccataatcaaagtttcagaaagattgccttcctctctaccagcttctatagtcattgttgttcctcagatcattacttctttatctacaaatctagtcattgtgtatctgtttaactcttcctccaaattcaaatcttctaaaccttttattctgccccacttatctacttaaaaggacccttgtggttagtagtagggatatccaaatgatctaacatagtctcaaggccatctggttattaaccataatacaatctgaaaccttgatttgcctctatcatgcacactaacaggtaaacatgtgggaattagggcatggacattttgcagactatattatgcctactataaatatatttaatatataactttgcactgtgataaagagaatgtgtttatcacaaccaagaaaatggatatcatttttatccccagataaaagcacccaaatttacaaagtttagttgagtacacatattagatacaaacatcaaacaaaatgatgtaaatgttttaaaacaatagaaggagagagaagtatgccaggaaattttcattcaatagaggtttggataaggagatcaaatttagataaaatagcactcaatgttaaaagcaacataataatccctaaagcaatttctcaattaagcatatatgctatttgaagtgctgtataatatatatgataaaactatggtgatatttagagaatacaattattttaaattttgaaacatacacaaaccaaaatgtaacaatacaaatattttcatattgtaatatgaaacttgaagtattatttttatttttgagattgtattttgattacatttatcccttctctttcttgcctccaaattctgacacacctaacacacccttcttcaaatcataacttatttttacactgattttttgcatatacatatatatatgtaaatgcttatattgtccccaaatataatcttttgagttcataggatgtttattgtaggcatgtattcagtactgcagtttaacacaggaaaggcaatgggtgagctcttccacggggagggctacctctcacagctgtagttctttgtgaaggatgcggctgtctccataaggtttgctgtgactcttggtgtcctctttgttcaactcacatttgggcagtcatgtgggtgagactttttgtgtttgagttttcaactaattgtttattttttgagataattatgtcgtttccctcttccctttcctcttatgaaaccctctcacatacctctccttgctagcattcaaatttgcagtctttaaaaaacacacacacacacacataaaaattacattagtatataacaatacatatttctgttttataaatcatgaatgaataaaactatataatgaaaataaataaaattataaaacttatgaagttatacataaatttcttttttctttcattaaaaattgattttctcggccgggcagtgctggcacatgcctttaatcccaggacttgggaggcagaggcaggcggatttctgaatttgaggccagcctggtctacaaagtgagttccaggacagccagggctatacagagaaaccctgtctcgaagaaccaaaaaagaaaaagattttctcatgttacaccccgattatacattcctgtcctttcattacaaattgatttttccacgttatatcctgattatattttccccacttttcattaaaaattgtggagaaaaataaatatttatctgcaagtggttatcaattggagattggttctgggttccaaatgaaggcaagttcaacttctcctttcaatcagaaacccagtctggtgtatatcagtgcgtgactggtgcatgttgccttagtctctgtgtgttcatagagctttgttcatcttgatttagatggtcttgttttcttggtgtcctcaattccctcggttttacactctttctgtctcctgtttctcagggtcccctgtcctctcagggaaaggatttgaggaagacctttcatttagggctcagtgttccaagatctctcactctctacatatctggctgtgggcctctgtatttctactgttcggctttgggaggaagctttcctgatggtggctgagaaagacactgatctgcttccctggctagagtagcctgtgggtgtgcagggaatcaatatttctgggttttgactcagagtcatttttaaaagctgaatatatgctttgccacagtgaaagcttaaatacgctctcatgtaaaggactgacacaatattttctgacacaattctatgaagctagaagtcaacaaatagaagatgagaaaagtgcccaagcataatggtacacatcattgatcttagtactcagaaggcagtgacaagcagacctcaaagacatcaaggcaagcatgaaccacagagctacaaatgaacacatttagacaatttaacaaaattgtatctatgggatagaccaaacttatgtctagtatatgtgagaggaatgatttttatacactgaaacacacaatgaaaacctattgacatgcaaggataaaggggaaaatcttacaggctttttacaaagaaataaaatcaaaattagtagttttagtgtctatatcctggaatgtataaaaaagaaaaaatagaacaacaatccaggggagaaaataaaaagcaggtatcctacttcctagtgaacatatcattcacatgatcagagaaacatttatgaagatttggaaaaattcaaaaagcatgatgctctcatgtaccaatgaaaacaaaatttgatttaaaaagtcataaatggcttagaatacagaacctaagatgataaatgaaaaataaagtaataatattggctttctcaaaaggcaattaaatttaaatggaaatccacttggcagtggataaaatgcaaagctagaaatttttgaacaggacagatatttcataatattctagaagaatgtcatcatttacaaacagttaacaacttatatgaatgcttagctaaggtttatatagattcttttgacatataaccaaccatggtccactaatattgttccagaaatagagaataataagttccaatatctggagagtgtgatgaaatctcattccattcctcttcatcttttcatgacatgaattatcattttttagtaatggctatgatgtgtatactagcagcttattggtcatgtagcaccaatcttacttacagatcagctttcatgttattgtaatatttgtattcatataatccacagtttacttaataatgacaagacaagatcagtaagtgatgctttcactttaaatatgctgaagagaaactgtaagaattttcctctaagcaaaaatgaaggattttttcttattataagatatcattacatggtttctatttaattattaataaactttccattatgcttaatatgcacatttaactctcttataagtatatatatatgtatatatatgacatatatgtgtatgtatgtatgtatatatatatatatatatgattgtattatctgtgcatttagatatgaattgcagctcttcaaacatgtagtctacagataagaaagagctgctattctgtctgattttagattttttgagtaatcacactataaaaagtaataatgaatgaaactaattaaaagccttatttatttaattatatacactatcattccaatatgaaataaatatatttgttataaattagacaattatacatcatctttctctgttaaaaattagaaatccattacatatatgtacatgcatcacaactcagttcacactgaatacctttcatatatgctcatgtgactttaataactaccatactggatagaacaggtctatgtgtaaatgtatcaaacttctcaaaaaagacatagtactgggggtaagaagaagaattgtaaacaacagtattcagaaggtctcaaggataaaaaagaaaagtgagaattattttgagcataacattatagagttgacaatgatgggaaaagaaaccatctgaaagtctagaaataggacattacttaaattatgatgtgtttatagtgtacaatgtccccacataatgtaataatatagagtcagaccatcctgtagtagcaccatcctgtagaggcttcctttttttaagggtgtgcaatgtaaacagaaaatattaagcttaaaattagaaaaataagaatctctttatatgtgtttatttttataacttttatgagtctacataaatgtatcaaaatattctaaaatgcatattaatatcttaatgtgaagactgaaggaagcaaagagggagtcattcatgatatttgcccttataaacaccttattgcttgaatttgtttaatgaggacttttcggtaatttccacaatagcttatctaagataaagtgagtaataaataactgtacattttaatgttcaaaaaagacttgatctttcttgataaggtcatacaaagtctcagtttatagcattatttgaacattaataaaggagaacaggactaaggaatattaaaagtgcagcacttctttttttttaattacatattttcctcaattacattaccaatgctatcccaaaagtcccccataccctcctccccacttccctacccacccattcccatttttttggccctggcgttcccctgtactggagcatatacagtttgcgtgtccaacgggcctctctttccagtgatggccgactaggccgttttttgatacatatgcagctagagtcaagagctccggggtactggttagttcataatgttgttccacctatagggttgcaaatccctttagctccttgggtactttctctagctcctccattgggagccctgtgatccatccaatagctgactgtgagcatccacttctgtgtttgctaggccccggcatagtctcacaagagacagctacatctgggtcctttcgataaaatcttgctagtgtatgcaatggtgtcagcgtttggaagctgattatggggtggatccctggatatggcagtctctagatggtccctcctttcgtctcagctccaaactttgtctctgtaactccttccatgggtgttttgtttccaattctaaggaggggcatagtatccacacttcagtcttcattcttcttgagtttcatgcgtttagcaaattgtatcttatatcttgggtatcctaggttttgggctaatatccacttatcagtgagtacatattgtgtgagttcctttgtgaatgtgttacctcactcagcatgatgccctccaggtccatctatttggctaggaatttcataaattcatcctttttaatagctgagtagtactccattgtgtaaatgtaccacattttctgtatccattcctctgttgaggggcatctgggttacaaaaagaccaccagcacttctttttttaaattaatttattttttacactccatattccattccctgcctccatccactctgtgactgctccacatcctacaccttttccccactctccctgtctccatgtggatgccctcagcccctaccccacctgacctctaagctccctggggcctccagtctcttgagggttaggtgcatcatctctgaatgaacacagacctggaactcctctactatatatatgttgggggcctcatatcagctggtatatgctgtctgtttggtggtccagtgtttgaaagatctcggggtctagattaattgagactgctggttctcctccaggatcgcccttctcctcagcttcttccagcctcccctaattcaacaacaggggtcagctgcttctgtccattggttgggcacaaatatctacatctgactttttcagctgcttgttgggtctttccaagggcactcatgctaggtccctttttgtgagtgtcccatagcctcagtaataatgtcaggccttgggtcctccccttgagctagatcccactttgtgcctgttgctggaccttcttttcctcaggctcctctccatttccatccctgaaattcatttggacaggaacaattatgggtcagagatgtgacagtgagatggcaaccccatccctctcttgatgtcctgtcttcctgttggaggtgggctctgtatgttacctctacctactatcaggcatttcatctaaggtccctccctttgattcctgagagtctctcacctcccaggtctctggtggaattctggagggttctcccaacctcctatttcctgaggttgcctgtttccattctttctacttgccctcatggcttcagtaccaataccagatcaggttcccctctcctcccccacttcctctcatgtccactttccctaaacataatgtgaagcatgaaactcaaaacacataaaagagaaaatatatgaaacacttgatcacattaaaattaaacagccattaataatagtaagagaatgcaactagttggcagacaatatttggttcataaaaatactgtgcatgcatgtaacacatttagtgtaagaattaaatacatattagtaataaaatgagcatatacaaaagtgttacaacaaaaagctataaatgcatataaatgaaatacaaagtaaaaatgtaattgataacatttacaattttaaaagtcttgagatgaggtgaattgatatattagtttgaactaaatctttttccttttaaagaatatacagtttgacccagcactcagaccttgagggatttatattacagaaaagataacaagagtacagaaagatatatgtgtatatcattaagcaccgtatttcttgaaatagtaaaaattttgaaaaaagcaaaatatgacatgtttcaatgccttaagcaatggaattccttacaaatattgaaaagaacaatatagatttatggatgtcaacatgaaacaatgttcgtagcaggatgtatgaaaatacaaaatgtatttattataatacatatacaatatatatatgacatagtgtcaaataattatgcatttattatataatatacacatgttatatataatatatgtatatttattttagtgtagccaagttatgtaggcatagattcacttgaatactaaaatactggatcataccttgacactgattatcatagatatggctagaatagaattctcagtaaaatttaagccaatcccctctcaataaagacaaatctgatcaaatcccagatgtacttgctttcgtcaattttatatgaattgacagtttgcttgagcatgttcagttatttataaattgaatagtactcaacttcctgaatccattatgataattttattttacaattggaaatagatgtaaaagatctaacacaaattagatgttaactgacttccttctgtttttaaattgtgattttaataaattcttttacagttttatttcttagggaaccttgtaggtaatgaacagtatatttttcttagatttttattttaagtcctaatccctaccacaatgcttttcctctcttgtcttagaacacagagatctctctttcacttttcagcatcatcatttcatcatcagcccccttcctaattcctacatatacatatacctatcaattcttacactacatagaaaattcaagcttagagattaatcttatctttgctagtctgtacagaatgagtaaagaatgcatgcatggactctgattaaattggtatatgaaatcagaatcaataataaggcctggacctgagtccacatgttatgcatcccttactccctttcttttattcctaaagacagagccaatgtcaaaatacagaaatatctgccaccatattacctgcctaccatggaaggccatgagcaaatcttggcaatgtgattctatttcagttaataattgtgagacagttagatgactcaatgaataagttataatgaacagagaaattcacctgtgtttttatacaggctgagaagaagcctgttgtatcatgttgttaaaggcttatcatggtaaataaaaatgtataaaaatggcagaaagagaaatagaaactaaaggagagagggagtagagaaaaggggcccaagctgacattttataaatttctttttggtggtagttgtggttgttgttgttgttgtttggctttctttctttcttatttattaatttatgtcctaaatgctatccctccgtggtacccccatcacagaatttcaacccccatctccccttgccaggaggattaggttccatttcccccactgctatgagtctcacggtaactcacaagataatggcactaaccagtttatgaggcccaagtaagctcttgaaaatcacacctccaaatattgttacaaatcaattgcatattagcatgagttttccaggtaatcatatgagccatagaatgtatgctagtaagattgacccaaacacaattaggtagccatctcttggacaagcactgtggctaagatttcagcatcagtttagtagcttctttgtaaaatacaaaatgatttgtggaaaatcattgggagcatgttattcccacatgggattatgtaaagataattaaaatagaaacaaatatttggaagtacaagcctcaactggagaaatacaaaggcagttggaaaatctgtaggtgttcatagcagttcttaattatgtttagccttaagttgtactctgttgcagtttactaaattctgaaacattcatcgcaatattttaagactggcacgatcttcgtttctaatactatcttcatttttgtcctttgtatgaaccctctaaaccagccagcctagcatatttactgagcaaaaagatctgtgctatagctatattcacactgtaatcagtcctccagatatggcatcttcattcctgtatgtgaactatgatttgatctttacttgaaatgatttttcaaagcactcctttatacaccaaatattgatttgtttttcaatgtatcaaacattgttttgtggactatatatacacaaggacagtgcataattatataagtgattctcatgttataattgtgtatagtgatttggacaaaaaatagcttaatctaatctagacaataaagaaagtgaattaaaatctgaaagataagattatccaaataaattgatggaaaggacagaacagagaaggggaaacaccagacacaaagagagtaaaatgaaaaggaggttgtcccaattaaaaatctggaaaaaacatccagaattggatagctttacagcaaaattataagacaaattaatgtgaggctggagagatacctcaatggagaaagctattgctgcatgatcctgaagactggagttgttttgttttgttttgttttgttttgttttgttttgttttgttttgttttgtttgtttgtttgtttgagacagggtttctctgtatagccctggctgacctggaactcactttgtagaccaggctggcctcaaactcagaaatctgcctgcccctgcctccagagtgctgggattaaaggcgtgcgccaccacgcccagctaagactggcgttctgatccctagcagccacataaatatcaggatttattgccttgcaatcctaatacttgggaagcttagcaagtgatccctggagaaagctgtctagcttgactagcctagtcattgagcttcaggttcagcaagaaaaatggaaagcagtccatgaagatactcactgtcaatccctgtccttcagaagacatatgaacacacacatgcttgtatatgtattcatttatgtgagactcacacacatgtacagacacctgcaaaaaacaaaagatatgatttagtgttgtgtcaaatgtgaaactgataatgcctaaattgctaacctcaaccagtgaacgtatagtaactattcactgaacatcaataccaagaggagaatcagatttggaataaattattatattagctttatagcttttaaacaatacataaaacacataaaagctcaaagcatgctaacaggacttagaatattctctatgcctattccaacttttccattcatccactagttacttaatctaccacatctacaagatgccaccttcctgatcatcctcttccagatgttcattgtcttgatcgtgtaccctactcttcgtattaaatgtctcatatatccataactataaattatgttctccgaatgtagggattcccattggatcaaggtaaccttgacttctaccacaaaactatgtatgtagaaagacgacatttttgatgtttttctattttctgagattgtaatataatttcccctcttcttttctccatcaaaatcctcccatttaaaccctctttcaaactctctttcaaacatatggcctcttactctttattgttacatatgtatgtgcatgctttcaaggctgaccatttggtattagataaacaattggtgaggaagactatgtatccccctcacaacattccacagttgtctgtattttttttttatgactgatgccctatgagcttttgtgctgtccactgtagcatattgattactgtcatccacgctgagatcctttttcctgttataaagtgaaaacatacatccctcctgctaaattggtataagaacatggccatatattctgatctgtccagaatcagttcttcacctgctaaaatatcagcccaatcttgaaatgtcatttcagaaatccattataataaacaatatgcaaggaatataaactacatcctgtatataaaacactagacaactgatagttggctctgttgtcattgttattcattttgtaataatctggaagtaccataatttcatatgacagctaattctttgcattatgtcacatgtaggaaaattatgtcctcttttctgcactttttactaccataaaatgcacttctttctctacttctgagaataggtgttaacatgtttgttttacccctggctggagcatagcatctagttttagacaacattacattgtagttagactcctgtgtttcacaaattacaaattaaactatagtcaaagttcacaatgtgtattgatttacacatgtttatatatgtgtgtatgtgcgcatgtgtgcatggataagtgtttattaatcatgtttacaaagaacactcacttctgttgctatataccatatattggtcattatgagaatggaacaattacaggaaattatctactttgggtcatgaagcacaaactttttagtagtaggggtacttttagtaaaaaaaaaaaattcttcctgttgcttcatggtgttctactcatctatcactaatgcatcaatgaactctacgtggttttctgccacttcatcaaaagaacaagaatatttattttgtttgcattaaaaaatacagagggaggtgagtgaagaagtggctagatggataaaaacacttgctactattggagataatccaagtgtaggtcattacacactcttcttatctttggccctggggcatctgatatctctggacttttaaggcccttaagcatgtgtgcaaacacacacacagagatataaacacagatacgaagattataaactactaaaaaaaacaatggaacatatatgaagctttattatttatttacatttatgaaatatttgctaacaaaatcaagctgataatgtctgtaagcatatggtaggtataagtggccactttttaaatctttttatttattttttatttgttagttagttagttagttagtttgtatttatttactttacatccagctcactgcctccctcctggtcacaccctcccacaatcctttcccccccatcctccctccccttttctcctgagcaggtatgacccctctggatatctcccctaccatggcccttgaagtctatgtgaggataggctcttcctttcccactgaggccagaaaagacaagccagctaaaagaatatagcccacgtacagtcaacaacttttggggtagcccctgctccatttgtttaggacaattacatatatgaaaagtcgaattcaaaatggctgttctagttaattttccttctttgtctctcttaacatccacttgaaccttatgtaggctaagaaaaaaattgacttccttgatgaattaagttaatcttctattattttacccttatgctaaaactataatatcaacaagagcactgttttagacaatgcagatcagatttcttattttgatagcaaatattcaacatttatataggacaatataactccttttatcttttatttatttattatgcactgtaaagtgaaattgtgatacactgatttttttaaaaaatttttttattacgtattttcctcaattacatttccaatgctatcccaaaagtccccccctccccccccacactcccctacccacccattcccattgtttggccctggcgttcctctgtactggggcatataaagtttgcctgaccaatgggcctctctttccagtgatggccaactaggccatcttttgatacatatgcagctagagtcaagagctctggggtactggttagttcataatgttgttccaccgatagggttgcagatctctttagctccttggatactttctctagctcctccattgggggccctgtgatccatccaatagttgactgtgagcatccacttctgtgtttgctaggccccggcctagtctcacaagggacagctatatctgtgtccttgcaacaaaggcttgctagtgtatgcaatggtgtcatcgtttggaggctaattatgggatggatccctggatatggcatcttaagtctctagatggtccatccttttgtctcagctccaaactttgtctctgtaactccttccatgggtgattgtttccaattctaagaaggagcaaagtgtccacactttggtcttcgttcttcagtttcatgtgtttttcaggtaagctgtggtgacctgtctctgtttacttcccctttatactctctccttcaacctcctccaggaaccagtctctaaatctattatttgagatgatatctagtttgggaagaaggggtttccctttcatctccatcactgtatccctgtatccttcaagatatcagatcccaaaatatttatccaaagaaatatttcaggatataaagtaaatgtgacatgcagggataaatacagccggtctcaggacaacctctcaaggtcttcaattcctcttcatggagaatacacagaagttatggatgtggctttttacccagtaatattcatttgtgtagaagaaaccaaattcttgtgtattactgcttatatatatagtatgtttattctgaatttcagaaagaattctgaattaatatccatgtgataatttagagatgaagaagaagatgaaggtgtatttgattctgagaataaatctattcccattagaggatgagttctgtgatggtttgaatatttgtctaattttctttagtttctgcggggggggagtaccattatattagagtttgaataaagattttctgatttaatggatttttcttacattctagattagaactcatggcctcagaattccaagattgctgagtatattttcagtaaattctttagaaaaacacatggtgggactcatggctctagctgcatatgtagcagaggatggcctagtcggccatcattgggaggagagggcctaggtcctgtgaacgttctatgccctagtatatatagggaagtgccagggccagtaagctgtagtgggtgggttggtgaacagtgggagggtgaggggatggggagttttcagagggggaaccaaaaaggggataacagttaaagtgtaaatataaagaaaatacctaatacaaaaagaaagaaagaaagaaagaaagaaagaaagaaagaaagaaagaaagaaagaaagaaagaaagaaattttataggaattttaggcagtaaactcaagatcttgtgtacactatacaaatattataactttgagctatatcctaatactaaacttccatagattttgttgttgttgttttgatttgcttttgagattttcaaatgtattctcactatgttacctgggctagcttcagtctcttaagtatctgagatttaaagtacctaccattttttccagctcttgaaagacaccttcacagttcaggcatttctgttagatttataattccagactccttgtagataggaacagtaaacatcatgaacaaagcttaggaccagtgacatagccaaggaactgttaaaaatgaaaatctagccaagcaggtgtcatctgaatatagcatcaaatctgttatgattttttttctcctaaggtgttaactgagaactaaacaaatatagtcaactattcaggctttgcacagactcaagttctaactcatatacagtcttgaacaactacagtcttgaacaaacttcataaactatttgacctgttcatatttcctgtctggaaaatgagtatgcaatcatgtattcattgtccattcctaagtgtttaaaatgccaatttgtttgtttggattaagtttttggactatgttaataagacttttgggctctataagtttcctactccaaagtataatgttattgtttctgtctgtatttgatttctagcaatgggaggtttagaagattcattttgttaaaggattgactgtagagttactatcaaggtttgcatatgagctaaagagaaacataactttattcaatgtcacacttctttcataaattccaaataaataaatatggttctaaacacacaatagagaagtagagaatattttccagaaaaaaaatcacttttcttaatgctgtgaaatgtgcaaaactcataaagaagatcacaaacttaggtctagtctattttagcctatgattataatcctgtcttgtaaacaagacttgctcccaagttttgatctggttatctcctgtggctgggtaatgatgtgctaaagttatccccctaccaccacagagttcccagtgaataatattcccctcataattgttaatgttgttaaataattccaaaactctcctcaaggcagctgctttgtgcttgggagctaaacacaggaaaggccaacattttcttttatttgtctgcctgcagacacagatgttgtttgtgtcgtctaggagcataaaatatggtctaaaatatcactgctgttttcaatgagtcaaagggacatggtagtagtgatgggaatccataagaattagtacaaagtggaattatatttcaggcggaggtataaaaatacattacacttgcagaacaatgatgagctaatatatgcagagtttaagggtcccttttcaggctgtcaatgacggagcaagtgcccattgtcttctggctgccatatccctcgaagtattttggcaactagctgtaaaaatccagatggaaacagcagcaaactcaatgaatcctgggaagcaagaagtaggaagttctcgcctcagccacatacatataggacaaataggagctaggctgtgaatttgaatgggctacttataactttatatgctctgtgaggtgattagggctcggtgttaaaattgttctgaattagctttgccatttaccatctatgcaaccttagacaagtcattttatttctttgtgagcctcagttgctctttggaaaaacaagaataataacagcttttctctgagagtgtactgtgaggattaaatgagataatatacgtttcaaggcctggtacatgaaaaccctgaatatacatttggatttattttcttcttaccctcatatgtgacactgtgtgttcttttgtagcttgacctccaattacttgtggccaaggactgtggaatcagtatttaacttggagacactacaccagctgattagagtaaaatattgtgtttcatttacttatgattttttggggggtaaccaaggtaaactagtttctcattttccacagctattagtgacctttctatataaacatgttttaatggtaagcatatactgtagagaactactaataaaaactttttttctgttcgtatctactatactctaaaaaaaaaaacaagcattaattataaaaatgtttgagtgctatggcagtctgctatatattatttccccttggttaatatagaatgatataataactaagtcattctatagacttgagttcaactctctgccatttaatagatacacatatgtatacaattaagaagcttgcagaaattaataatgtacaaaggaaacattactaaatgtggtatagtggcacacaattttaatccctacacgtgagaggcagaggcaggcatatttctatgagttcaaagccagcctggttcatgtagtaaataccagaacaaccagaggtacacagtgaaaccctgtctcaaaacaaagttagtaaaattattaactctctgttgtggaaaggtatattttcagggctgttttaagcatggtctgcattttgactgatttaacactaacttttcttttattcttcaatgaaaaagatatgcatataaccatggtgaataaccaggattgtgagaaaaatctctatttacacaatgaaaccaaagcttctaacacgttaaagtggatggagtcactgatattaaatctacatggtctgtcatggtactttatcaccgagactccataaatcctctttgtcatggataggatcaaactgaatttgttagtcattgtagcattcattagtctaacatttcagcatacagcatttaagctgtcctgattcccctggtgtggcttaaagcaaatgacagaaactttgaaaagaatctgtcatttctctcattcaaagcagtttgtgaaacacaatcaattatcctgtcctataaacttggctactttattttgtagctctcagtgtttcactagaatatttgaattaggtaagcagaaaatattttaatgatccccttgtgttttccaaaccattttgttaagaaacaattaacatgaaataaattatgtatattaaatatgaaatttcatgaatttgatatatgtacataatcctgaaaatatgaaatcatcatagtgagcctagatatccccccaaatgtattcttgtctttctgtattgtctttttaccctttgatttctatttacccaccagcaacctacaactaatctactttctgtccctgtgggttagtttgcatcttctataatttctcataagcaaaatcctgaagcatttaaaatttttgcctgacttttttactttgtttttgctatggttttgatatggctctaatatattgataaggatggcctcatgtttattacccttctatgtattactttcttgatgtagcaacaaaatacctgaccaaattctgtgagttgtaagctatgttcctgagaacatacacccattggagaaatagtggaatagtagcataaatgttatgaacataaccaaccactttttgactggctatgaagcccacactattgagaagaagcccattcctgacacctttcatggagacaagaacctcatatggttaggtaggtcattagccttagaggaaagctactactagtatactcctaaatagacatagcattaaaattactcctagtgacttattacagtgcatctctcaaccaagaagcttctttttttttaaaagattattttattttatgttttagtacactgccacttcttcggacaccccaaaagagggcattacatctcataacggatggttgtgagccaccatgggtcaccattggtcacattccttcccccaaagctcaaggaacttcatgaagagggaactcaaaggttagatgagtcagaggtaggggataacaacaaggaagcagatgctaacagaaataacacgcacatgtgaactcacagaagtgatgcagcatgcagaatatatgcagttaccaaccagacaaaaattcaagcatagaaaaggagagcttggcacggatttctattcatggttgaagagctattgacatttgatggctacttggagaaggaatgtctgtttctttcaatggtttaacattttgtatatccattatactccatggcaggtccaatgactggttgtagtcagctatcacaaactatactcattacattataaaacatgagggagtaggagggtaggtaggggagcaccctcagagaagcagggtgatagtgatgggataaggagtttttggaggggaaacagagaaaggagataacatttgaaatgtaaatttaaaaatccaataagtaaatgttgtgtcttgtgtggggagtgctctagggaaaagatctgggagaaatttgaagaaggtaatgagtatgcccaaaatatattgtttgaaattctcagaaaatagtataaagtaattactttaaaaaacaatccaagatggtccattcaatagctgactgtgagcatccacttctgtgtttgctaggccccggcatagtctcacaagggacagctatatctgggtcctttcagcaaaatcttgctagtgtatgcaatggtgtcagcgtttggaagctgatcatgggatggatctctggatatggcaatcactagatggtccatcctttcgtcacacttccaaattttgtctctgtaactccttccatgggtgttttgtttcctattctaagaaggggcaaagtgtccacactttggtcttcattctcttgagtttaatgtgtttagcaagttgtaccttatatcttgggtatcctaagtttctgggctaatatccacttatcagtgagtacatattgtgagagttcctttgtgattgggttacctcactcaggatgatgccctcaataagtggatgctcacagtcagctattgaatggaccacaggacccccaatgaaggagccagagaaagcacccaaagaactaaagggaactgcaaccctataggtggaacaacaatatgaactaaccagtaccccggagctcttgtctctagctgcatatgtatcaaaagatggcctaataggccatcacttgaaagagaggcccgttggacttgcaaactttatatgccccagtacaggggaacgccagggccaaaaagggggagtgggtgggtaggggagtgggggtgggggtgggtatgggggacttttggtatagcattggaaatgtaaatgagctaaatacctaataaaaaatggaaaaaaaataatccaagaatcttaaggaaagccttattttgtgtaaaatccaaggatacactccatcatagcaggcaagccttggcagcttgagtgtcaggaggtagctggcacattatatgcatagccaagaattagtgggagataaatgctctcacttagtgggccacttttccatttcactctgaacaagacacaggccagggtaggtcttctcatttccattaacctactataggcaatgccttagaggcatgcccagatcctatcctaacctaaatagttcctcacaaatgtacctggaactttgcctcttggtcattctaaattctatcagactgacagactatgttagccgtcacagataatggcctcattttgtagcttagtttggcatcaaatttatgatcccttgcttccacagacacagtgtgcaaactgtcgtcatgcaccatgtcaggctttgtttgcttctttaactcaggataattattttcatatttatccactataaatatttaatattatttgctgttgtacgtgtaaataattttgctcccattttatgtctcagtactattcaactatgtggatccatatagttggaatttcttctgttgatggccttttgagttgtttccatatttcacctctcccaaacaagcctgcaacaagcattgaaatatacattattatattcatatgcaatttcttttctctctggtaaatattgatgagtagaacatcctattatattccaagtaaacatttaactagatataaagatctaactaatcctaaaaccaaatttgctctcaacctactttaaaaaccatggtaatgagactgaaatgtaatcatctgcagcgccccaacctggtgtcacactctgtgctccaagaagctataactgcctacgtgtcctctataagccaattggaactgtgaaattaataaggaaaaaggtagaaaacctttgaggtttaatcaatgtgccatcataaggaattgggacaaagatacactcactgactctctcacatccttcatctgtatccagtagtgagggcaaagtatatagagcagacttggtatgttaacatcttagcagtctaggtcaggtgtgtcccataaaccattgacttactcttgtcttgataccactgtaaagcttctagagagaagaatttccattctggatacctactaggcttctcttcccaggacataagattttctgaaaaagtccaatttcttatgtccattggtttagaagtctggtagataagatgacttttaaaaaatatgatcagttaactaggccaattacactattaccacgttttttttgtgttcgcttgtttgtgctagaacaaacctaagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctctggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaactctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggcttttttttggctgggagactattaataactgcttctatttctttaggggatatgggactgtttagaaggtcaacttgatcctgattcaactttggtacctggtatctgtccagaaatttgtccatttcatccaggttttccagttttgttgagtatagccttttgtagaaggatctgatggtgttttggatttcttcaggatctgttgttatgtctcccttttcatttctgattttgttaattaggattttgtccctgtgccctttagtaagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttccttttattctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacgtgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgtatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggacggtggctggctgtccctggcccacacagggtgctgcctcagcgcctctgtgcttccgcctgttccagaagctgtcaggttctctggcgcaccctctcacctgttcagactaatttcctaagttcggcgggtcccggaccaagatggctacctagagtgagattgttacaagtaagcaaattaaaacatctctaagtctatatagttactattttcgtgtttgtaatattgatgcctcaacccctggccataaagcccagttgtaattccaaaaactcacgttaactaagagaaaatgacatgatatatgtgtgtgtgtgtgtgtgtgtgtgtgtgtgtgtgtgtgtgtatcatatatataatcaaattatttacttacacttggatctaaaactagggaaataaacacttcatctgtgttcaccttgcctacagctgttataatttatcaaaaagatgtaataaagccaggaaatctgaatgtatagatttccctatgaagcctaacttcatgagctaggagataggcttattgtctaatgtctgaactttggcagataaacacctttcagtctcaacaatgtcatttattgaaagagtcctcattcccagggtccttattgtagtatgagtacctaaaatatactttattttttaattcatttttattagatattttctttatatacatttcaaatggatgtactttatttttgatgatccaacagcacacggcttttttgttaatcattttacttatgtgccagatgttgcccaccctccaagttgacccttacagagtcattatccccccattacccttccattttcctctgagagggtgcactcccatttccccctaacctgctgcatcacttccctgcaggattagtcacatcctcttccactgaggcaagataagacagcactttgctacataagtgctggaggcctcagaccagcccttggatgctctttggttgatgactctgagagctcccaggtatccagattagttgacactgtccttcttcctatggggttaccattcccttcaattccttcaatccttcacgtaactcttccacggaggtccccaacctcaatccgatgcttggttgtaaatatctgcatcggtctcagtcagctgctggtagagcctctcagaggacaccaatgctagccccctgtctgcaagcataccataacatcaataatagtgtcagggatggattcccgtccaggttggggtggtcactggctggacattccttctgtctctgctccatttttgtccccacatttcttttagacaagagaaaattggggtagaaagttttataggtggtttgatgggagtcctgtctgataactggaggtagtctcttcataatccatatccccactgtttcgcattttgggtaaagtctcccatattgagtcctgggtgcctctcccatcccaggtctctgagactttcttgaggttcctccaacccccactccaggcagctgcatatttctattcattctcctggcctctgggcctttacctgtctcccccatccccatacctgatcctgccccctttcccctcccctttccctctcccacccaggtttctgctccccctatctctcatgattattttgttcccccttctaagtgggatttaagtatcctcactcaggccttccttcttgtttaagttcttagggtctgtggtattcagtacttttggctaatatccacttatcagtgagtatataccatgcatgtcctttggggtctgtgttacctcacccagggtgattgagagacatcaaaaatttagaagataatatactgaataggaggcaacagtctaattcaagagaaaatatatgatataaataatgaggaaaaaaactaaccatgtgtaagagtatatagtaaggttcgaagtgctaccatgagaggtaaaattcctgggattgaggaaattttgagaagacttcatgagaacgctgagacagaatgaatatgcatatgtgtatcaaataccttagagatcaaaacagaagtatcttagatgcttggcaccacagaggcaaacataaagtgtctttgaaaggtgttagtaataatccctcaatagagtgggatgtagtttattcagcagctcctcatgggcattgactcaggttctatcttgacatcttcctcattcatcataaaacaaatgctattggagagctgtggaacatttcagaattcacattgtttgtccttatgagtatgtgtgtgaagctctcacaattatcattaacagtgtcactcctctacatggaattgtacagtagattaatgtagtttaaaatttcagacacacaccaacagaacacaatgtgcaaacttcttcacatgcttagtgagcataatggaaatacacaacgatacctggaagaccacagggaacaataaggatgcaggcaccaaagtgttatgagtagccagaaaattggaccaacacacgtaagaaatgagaaatttttagggccattgaacaccacgtatttgcagtgttcagtagccctgaaaatttctcatttaagccaggaagtccctgtcttgttgaaaatgttgaaataaaggcagcgtgtgtaagttctcattgatcacatctctgctgtagtctaggacctcccactatcttttagggtccccaattctgtttccaggctcttgtcacaaggctatactgcaggcacccctccttttcactctctcaggagctgttactgtaacttctaagcaagttctggtatatgaatacattctaaaaggagatgatccctaaggttaaaattagtgaggaaatagttatcatttgcttagtcccagatcaaatctctttcctgtctttggaatgatgactattttggtctatttacaagtgtgatcagtttgtttaaatttcctctgaacttctatctaatccctctttcatttgacttgatggaattatttgctgggcttctttgatatgggctgttattttacagactactgtttcactgtacttccgagaacatcctttttggcctcagcctgatttttttttttaaactatgttctgggatatttccaggtaggcaatagcagttggctccaagggataagtgtttgtatttcttggtttaaaccctacagggattcactagtatcctttccagtataacgaacagatggagagatcttgaaagggaaataaggcataatcagtacttggaaatgcaaagagaagattaggctgcaggaagcttggttatgttatttatattctctgataaccacatactccaaacctacacttttggaatagtccctctctccctcctataccagaaaaaggccgatgcgccctcagcctgaaactaaaggtcaggtttggatgatgtgtgtttattactttcctatcactagggcctttaaaaagactctctgtggaactttgcaaaggacatgacacagagttgcaaactcactctgctcactgccttgtgtagcagcaaacaattgataaaggtttttcataaagagaaaaggaaattaaaaattggactaatcctttaagaccaggaaaaaccaaggaaggctgcttggttttattttcttgacttgaaattgagtgggtgttcagtgacgctgtgtaggagcacagacacatgaactgatttatttgaaaatgtgatatcattttctcctgaaagcccccaagctgagaaacaaaaaatggtttccagtagtgaaaattatttgtctcatattgaggattgctaattactttctttgtatttcttactagagcctcaaataaaccattgcatgttccctagaaccagtaatggattattaagtggtcaataatagtttttcaattgtgtgaattcattataatggagtcctgtttgtgatagcctgattgtagactgctaattttatgtttactgagtaagcatttacatgattgcctttttacaattaatattttagataatatatgtattaataattttgagattctcactgattacccaggcaacatcaattcttttaaggccctgagacttctaatgataacacaagaacttatttagcttctatgtgtgcttattcatctcaaaacagtttctgtttgaatgttgaccagtaacattttgtcctaagagtctcagaatataattacagaagcatagaacaagttgccttttagatatttatttttaaaattgaattacctgaattttctcaagtgatttattttttaaaactatataaataattaacttttattttatataattcaaaaaggttgtcatgacacaggaattaaaatcagtaatttcattatcatccattattttggaaataatctcttttctttacatgttaagtctccaaatttcaagtcatagctaaaataaccatagttcttgacctcccagtacttgtctagatcatgctgccttgaagattcttggagagttgatgggtagacttttaaagataataaattcttgaacctttcaaaattttagaaatggtaaatctctaaaaatgatgatggagatatcattactgtactgttctagttctgataaatgacttttccagacttgccacctaaaaatcaacatcttcattcagacaaaaagtactgtacatcaatttattcaggacctcaatatttaagtaattaatttcttttcatcaaaacaaatagcctagggtgatcgaatgtatctgaatgtttcaaattagtctgatgatcctcagatagtggatgctcatgtagctgtggaaggctaagcattggtcagcttcatcctattttctatcaaaatttgagtcatttaatgttcctatgaaaacattgagccctagaggatcactaaaatatcatgcatccattaaccttgacggcctcttggcttagatataagtaaaagaatatttcttttcatgttcaactgcttccagatctgagattcttggctccatctgtgaagatggattgacttaaaatcccataagtatcttcattacttttgatatacaattcattacttttgatacacaattccatcagaaaaactatataaaagtgtagtgaaaatataatatatcaactgggcccaaagtatactttattatttctcaaattgttatctcccctggttaatttttaattatcagcatgaaacaaccaaaagtcatcagagaagaaggaatttcaattaagggattactaaaatcagattcttctgtagccctgcctatagggaattatcttgattgctgattgatgtgggagggcactgctcactgttggaagcaccattcctaggcaggtcagcctaggatctataagaaagctacctaagcacaatcctcagactaagtgacccagcaagctccatccttccccccagttcctgcttcaaatgcttatcctgtcttctctgaataatggattgtgaattggaggtgtaatttgagataaaccctttctttctgaagttgttttaggccatggtgtttatcacaatagcagaaaaaaaatcagtatatattcatttacatacttttagacatttagtaattggaaacacgggatgtagattatgatctgcttggtagattgtttactttgtttggattgttaatcctgttgttatacaacaaaattcccttcctttattagaagggattaatattacagttggtttattcacttacctttttagagacagttgcatcatttttacttttcagctattgtgaaaatgaagctccaacacacacacacacataatttgaatgtaaactgaagttataatttctctgtgattggtgtccaggtgtacaacttctctcttggaaagtacaaatctaatcaatggaaaactactagactatttttcaaagtggcatacaattttatttttgacatcagtgtattagacttgtagttactttccacaattattagcacttgatgagtgtgattcttttttaaaaatggctcttgtagtctcatatatttgaatgcttaggcaccagagtgtggaacagtttgcaaggattaaaaagattatggggtgtggacttcttgagtgggagtggccttgttggaacctactgggagtgcattctgagcttgcttttctttctttctttctttctttctttctttctttctttctttctttctttcttatatttattttatttacatttcaaatggtgtcatctttcctagtttcccctccgaaaaccccctacccccactcactaacccccccacatggccctggcattcccctacactagggcatagagccttcacaggaccaagggcttctcctctcattgataatcaactaggccatcctctgctacatatgcagcttgagccatgagttccattatgtgtactttttggttggtgatttagtccctgggagctctggggttactggttagttagttcctcctatgggactgctaatgctttcatctctttggatcctttctctagctccttcattggggaccccatgctcagttagctgagagcatccacccctgtatttgtcaggcactggtagagcctctcggagacagctataacaggcttctgtccgtaagcacttatcccgcaatacctctcctgggcatatatccagaagatgttccaactggtaagaaggacacatgctccactatgttcatagcagccttatttataatagccagaagctggaaagaacccagatgcccctcaacagaggaatggatatagaaaatgtggtacatttacacaatgaagtactactcagctattaaaaagaatgaatttatgaaattcctaggcaaatggatggacctggagggcatcatcctgagtgaggtaacacattcacaaaggaactcacacaatatgtactcactgataagtggatattagcccagaaacttaggatacccaagatataagatacaatttgctaaacgcatgaaactcaagaagaatgaagaccaaagtgtggacactttgccccttctgagaattgggaacaaaacacccatggaaggagttacagagacaaaggttggagctgtgatgaaagaatggaccatctagaaactgccatatccggggttccctcccataatcagcttccaaaagctgacaccattgcatacactagcaagattttgctgaaagggcccagatagagctgtctcttgtgagactatgccggggcctagcaaacacagaagtggatgctcacagtcagctattggatggatcacagggcccccaatggaggagctagaaaaagtaaccaaggagctaaagggaactgcaatcctataggtggaacaacaatatgaactaaccagtatcccccagagctcgtgtctctagctgcatatgaatcagaagagtggaaagagaggcccattgttcgtgcaaacattatatgcctcagtacaggggaatgacagggccaagaagtgggagtgggtgggtgggggagcatgtgggggacttttgggatagcattggaaacgtaaatgaaataaatacccaatttttaaaaagtgtctgggtttggtgattgtatatgggatggatccccaggtggtacagtctctggatggtcattccttcagtctctgctccatactttttgtctataactcctttcatcttgcgcgcgctcaactggccaggaagaacgacgctgcaacaggatccttctgcacacgtttattcagtcctgtttcttcttgtttatatctcccttgtttatatctccctcgaataatcattctccctctgacccgggcctctcactctcatgtactctcagttcccatccacgcacagcaggccacgccacctcaccaggcatgcagcttcagctaatcagggcagcaggggctatctccatcaaatggattcaccagtatcctggtacacctgtgcagctctcaagatgtttgtggcttatatgaggaagtcaggtgcaaatcatacgacttagctacagtccctggcgcctttgggactgccgccacacccgttcctcacacttccatgagtattttgttccccctacttagaaggattgaagtatccacactttggtcttccttcttcttgagttccatgtggtttgtgaattgtatcttgggtattctgatcttctgggctaatatccacttatcagtgagtgcattccatgtgtgttcttttgtgattgtgtacctcactcaagatgatattttctaattccatccatttgcctaagaatttcataaatttattgtttttacgccattgtgtaaatgtaccacattttctgtatctattcctctgttgagggtcatatggtatcacttggagtgagttctgaggtttcctacgcccatgtcagccttaatgtctctctccttttcattgcttgtggatcaaggttatctctctatgaccaaagcctgcctgtcaccatgctccttgacataatgatgatcatctaatcttttgaaagtgaaagcaatttctcaaagaaatgtgttctttgataaaagtatcttggtcatgatgtctcttcacagcaatagaacaccaagtcactaaggggtttcttgtgctgttttagttttggttggttgtttgtgtgtttgtaatcaataccagacaatgtggttgtaccacattgtagttttagtttgtattttcctgataactaagtagtaataatcttttattcctttattagccattcttacatcatttattgtgaaatgtctcctcaaacttattatctgttttaaaaattacacttttactcttctacactcttgaaagagcataaaatatgttttcttgagaataaaaattagaaacatattcatgagactgcagatacccttacttgaccttctctacactatttcattcttgaaatttagtttctcatgttaccagtgtatccatgtaaaccataggtgttctaagagtatacatttatttctcttgcagatagctctttgttaagaacagatctataataaacccagtttaactttatctcctctagggaatgtgcagcattttaggtaacaaggttatatgtgtaaggctaaaaacaaccactaagggtacactgaagtgcttgttaaataatgtatcttatgggaattttaagcagaatgcagacttttgtgtgtttaagaaaatattctgtaatgataacattgacttcaagaaaggaaagtaagacagttcaatgaacatcacttatggtgacaagtaaaatatatcgatctttctctgatccttcatacactctttaactttcctttaacacttcataaaaagaaagctcatgtcttgcttggatctttctgaaagttaggttgtctaacttccttaattgcaatatttatgatttagtttttgctttcaaaatgacataattccaacaaaaaaaaagaaattggttaacctgtgcaagttttgataatcttaagtgatacttactttgaagagaacaaatcaatactcaaatttccttttgagttggaaaatctcttcaacaaaaaatggagtctggctatacatgtcagtgccccccaagggggggaaaaacacgtcttattccagtgtttcattaatctagaatggcaaatggtcctctatttatttgtattttctcatcccttttcaataaatgccatgactctgatattcatatttaaaaatctgtggaaagtcacatctcaagtgctatcacctgagtgaaactaaacatacgctaattttggtgtgagggagaactaagtttcctaattagttcactaaatctatgaaaaaaatatggaggtacttcacagccattcagaacagatattttatttctttgtctccagaattcaagcaggcactacaaaaatctgtggtagtggcatggttgtaaattcactgccctccttcacccatttcagagaaaactctagggcagaaattttcaaactatgtttcctatgatgactataagcctcaccttaaaggccttttaattgcaaactgtaatccaactacataccagctgttttagacattaagccaaagggtaaggtgggagtgaaggtaagcaatctatgttttaacaagcctttcaggtgattctggggcaggcaagtttgagaactggtattcttggggaaggtacaaaatcatgtttaaataactacgtaatgttcttttcttacagctataggctgatgtgtttattagcacatgggtggaggcaccaccattgtaattttcaataaagaatcatactgaaattagcatataactattccaaagtttctaagatttgctttgagtagaatgaacttttaaactttatttcagaaaaaaagcataattcaataagatttagtgtttgataaatgaaaccctacatacatatctttaaaataacatttcttttgacttgacatagattctagtagaaaactgcaattatttttaaaagaaactaatcattgaaatcataaaatagtattctgtgaagtaatctctaactcttcaagggttaattgttattgactttcctcatatgttatagcagacttatttgtctgcaataccagttttgcaaagcacagtcctaggaatataacaaccactaaacaagcattaccattggcttctaaaacctgtatttagtaagctttgtttgcatccaagaaatagttactatgacaaataaattggaattctgaattttctctagtacatggtatacgatcaaacattttctgtattcaaagaattgaattcatgttagagtttgcattttattgatatgtgctatggattagatgcagtcagttaagccctttccgggccaattgacataccctgtctctgatgtcagtctgagaaaatcctatatagtgtactacatcctcagattaacttatcttagaattacatggacatttcagatgatatgtcttggcatatggtcatttttcattaaattattagggattgttaaagcatctttccccttttttgacaccttgccataattgaatataaattgactttaagacagaatgccagatattcatgcagtaggttactggggcttcactggtgtctagcagaaataatgctcacctagggtattgaagccaaataaataaataaataaataaacccagaggtttttgctttttgatgtaggctcgtggaaaaatggcatcagtattctagattttattttctcaactatttatatcttttttggaagatgaacatttaatattcagtatatacttttcctttttcttttcttttaaactccagattttattcccttcctggttcaccctccaactgctccacatcccatatctccttcctactcccccttccccaccccccaaccccaccagacctctaaattccctggggcctccagtctcttgaggcttaggtgcaaaatgacatgattactaagattctgtttaaatttctaaaatttggaaggatagggagaaaatggaaaccatgaagcactgccatggtgcaatacttaaactgtatgattttcttctctggttatgtaaagagcaaaaaataaataaataaaataaataaataaatatcccttaactaagataatgtgctttctctccttatccaccttctcagtctgttctagaactacagccaaccagtttcctaagtcaaccttcttttctgaattatccaaaaagccataacttttttttttctatctctgttctgttgaccctaacactttgagcttcattattctttctctaaagttttcctgctcgccttgtggcagtccctgtaggtttaagtcaaagggcatggcttttttcttcctcctcctcttcttcctcttcctcttctttcttctcctccaggctgtttggtgttatagcttgtgcaccctggaatttgtcatttaagctataatacaagcctcctccagcttcaaaacgaaacaaaataattggcaaaagtatgccttaaactcatttggaaatagtgaaaataacattagttgcttgtaattttagagtttagcatatttgaaaaatctatttgaatgtattgtttttctcagttttatattacttattagattacatataatatatatgacatactcagaaaaacaaatcattttgttattttaagcataggtgtgctgtgtagatcacatatttgttctagaaaagaaattgctttagaggacatctctctacactttatacttattgtattcgcttatttcattatattttgtgcaaccaaaaattgtagctataagctattttgagaatgcatttttcccctagaaccttgtaaggatcaacaggagcataattttaagtatcaggagtgcaaaataagcacagactcctaactacgataaataaaaggccagaattttaactttgcaaaaactcataattactagcaatggggaaggggaaacatgaggatagaaaagtgaaagttaatgggttttttgaatatacttatatatatatatatatttggtctgaacttttttcctttccagagatagaattctgtgaaacacctcctactttgtgctccggctaccacacagacatgcacagtgtttctcgacatggctaccagctggagatgggatctgatgtagatacagagacagaaggagctgcatcacctgaccatgcactcagaatgtggataagaggcatgaaatcagaacacagttcctgtctgtccagtagggccaactctgcactgtccttgaccgacactgatcatgaacggaagtctgatggggaaaatggtaagaaaactacatctgcagttttgctttgctatcacttctggtattggcccatctttcatttagtatgcagagtacaaatacaagatagcagggtcccaggaacaaggagggtacttaagtatctagcaaatagacacatttatttataacgacacaaaatagtcttcatttctggggaaccctcaagagaaattatctcatgtagtcagcaatattgtgaatgtcttattcattactcaccttttattttcatttttattttccagagctaccccagtgggatttattataggaagtactcatttcatgtattttagctttacatcggtgtatgaacaaggagatgaacaattatatagcatgcatattctctgtagggactctctattttgatccaaattaacttgctgagtttataaacagattcacattaaccacattagaatgaaattatttcacaaacacaattattttaaagacaccagtcatttgcctgacaataagtactaacagcaatatcattacgttgtaattatacattatttccttatacattttagaaaatgaaatgttttctctttttgagttttgaggaaagggttggcttattgaatatatgttcttctgcctctaaccaaaaaagtaatttcataatagacacattaaatgaatattaatcaaattaatctagtctatccatcagtttctttgtcaaattttgatatgagttctttatcatccacactcatgctagaatatgtgaattcaactcatttcaaaatgacaaatactgtgttttctctcctttgagcttcctagattttatacaatcacataaaattatgtatgtacatattaaatgaaaatggaaatacatttttttaggggaacaaagggacatagagagctgcattgagggaaaaatggatagtagaaaatatactccatattcaatatatacctgtctgaatagaatttaaatgtaaagatcatattctccgctattggccgatcctccgaactgtttgaaatcactttctgggagacaaaagttcagactctggtcggtgcctgttcctttttccagcatgagtttccattgtttcagtagttgagagtcagattgaaagacacaatatcctctttgtaatatcttcatctctgccaggctgcttataaaccctcacataaagaattacagttaagtacattcagttgaaacatccaccattaaagaattttccattctagactttatcatttttctatctctatatgattgtcaatgggaggtttcttttaggagtgttgaaaattgtagaattaagtaaaattgatttttttaatgactcaatactaccaaatcttggttttaatggaggaatattagggtacatagagtttttttcattaatgctgttaaatatttttaaatactttataaagagttcatgttgaaattttaagaatctcaggcaccatgggcaaagattaattaataaaacatttaatattacaggttttaaattctctcctgtttgttgtgacatggaggctccagctgattcggctcaaggcaagtgtttccaaatattagaaggacaagttgtttttacctcaatcaatcatgacaggtgccccatccacaaatagaccctgacagactgacaaataactcataaggccgaacaatggaattgtcagagattattctagtggtcacatactgccttacttgtctcttttttcacttatgaagagaagcagaggggcaacactcatttgtcttgtcgttgttgttgttttgctgttattttgttttgaatttagaatggctttcgctttaacatggtatctagctgatgctttcataacttcctagtgttctctggcagatgactccaccctttctccagatgcttctaccttggctttgcaatcacattttattcatgtcgtcaattgcaaataactcaaaaaggtcaaaggggaaaaatcatatgattgttcatcattttatgaagtttttctttttgtcactcttcagtaagggggcattgctcattattgatactaactaggaatcacctgtatttaatacttttttggagaaaacttgaggatgtgaatgcttttcttttttcccacaaatgcatgttaattcaaagaaaaaaatcattttcaactcatttaacattgtgtttgcatgcaaatgggagctatttatttcccactgatatcatccattcatgaaagcatgcctagcagggtatctagctcattaactcattaacttgaatttatacattctatatttgaaacataaaaatgcttaaaatattttttatttataggtttcagattccatgccatcttatccctgtgatacaactagtgttggtgacattttattttgtttctgccttcctatactttctgtttttttttcaattattgatgatgctatggacataatattatgtgaaagtttaggataagataagcctcactgctgtgaatgagaaatacaagcttaagtaagggaagttgttaatctgggtgagttatacaaccataaaagaatctaagaagtggcatcaaagatgcttacaattctgtccatcccacaagtagacagtatgacttagtggcactttgtttttctacttggatttcctgaattttgcctaagaagactgatttctttcatttcatccatagaccaagcattaaaaaatattttagtactgctaaccccgttttattgttctaaatctaatttaattctataacatgttacaaaatcttgaatttttgctaaactcaacttcactactggaatatttgaagcaggaagggaaactaacaggtaataaaaataagtatattttataggtttgcacagaactatcagaatatcatttgtttttaaatccttcccacttgtcctaagacaatcctttaacatttattactacttaattttctattaagcaaaaaggcagatttaatttttagcttactcctggtacctgaatgacaatttggtatcatgcttccttcagtatagccttctcactgtccatttcaaacatttgtcatgtgtctaagtcatagagtcctagattttcatacctaccaaaaggggtaggtaagcaccagattagatagaagtgtggtctgtcttattctccattatagcttcaatacctagccacaggatctagagtataattacagagtcaataaatgagaatcacgtcatgttttgagtgaggggattaaagtaagagataaatattttcatgaattatttatgatcttgtgccactctttgaaggatagaaatgctgcattgagtgaggcctatggtcacctaatgtgcaactttgcctctaacaaatgatatcttcatcaatttgtataatatgacaatactattttgtattagtcaatgttctctaaaggaactgagcttatataatgaatatccatctgttatacatgggatttagaattgtatattggctgttatatggctattccaacaaagattatctcttgactcaaaggccagaaatctggtagttagttgttaaccctgtctcagcagtctcaatctggtactggagtcctagagtcctagagagctgtgactcttcagtctatgttggagtcctgaagaagtaggcattaataccagtgaaggaatgcctcagctacagtattagtgaatttaccagtgagacttaaggcaagaagaccaaaatcaaaagcttctttcttccatgtttttttatgtgccctgtcactagaagacatggcctagatttaaggttggtcttcccaactcagatgatccaatcaggaaagcccttcacagttgtgctgaactgtttggattttagttgattctagatgtagtcgagtagaaaactaagattacatgtctcttgtgcaccccttgctaagtttcataccagcacatctccttaattatgcttaatttccaaatggaaacaaaaacactcaggtatttctacaactggtcacatgacatgagctggtatttataacttcttttttctactactctttctgtatttttttcaacctcatcaaccaactcagctaatcttagttcttttctaggaagagtgacccatagttttattcctgaaggatctgtgccctttgtcatcttgcttgaactgagttgttgtagtttcacattaactttaaccacaggacatggtaacaacatgagagaccccactggatctcttgcattccaggtataatctgtctaacctcctttatggagaagtgtagcaatttgtccctggtattctggaccaatcacctcttaacatactgttactcctatcttaacctgttggctaatggtcatcataagtccaaaggagccagttggtaatctgagctctcatcttaatggaatgattgttgtcttctagcaactttgcctctaacaagcacagagcattctccatctggaaccaaaagttctatgtcaggagaaattgtgtttgtgcgaacaggaagcaaaaattttcctactgggtcactaggggtgatagtgaatggaaccatttccatttatactacttcattcctggaccagtgaatcctgggtatgggagaatattactatagattcaaatcatataatatgttttacagaacctgccttcagccttctgagttactgccatctaattaaaactgtctttaaatgtcatctccctttctatgacgtcagctggtttcaggatggtggaaaacataatactagtgatttccattgagagtagatccattataacattactctgcatattaagtgggttttttagtcagaggaaattttgtatagactaccataacagtgactaagacattctgtgagtttgtatatggtaggttttttttttttttcagaaacatcaggtataaaaaaggcaaatctgtaaacaagataagtatcaatttcagtaaggacaaaacattgtcctttccacataggaagtaggccagtgtagttaacctgctacttgataactggctggtcacccttgggaattgtatcatattaggagctcagtgttagtctctgctgttggcagatctggcacttaacagcatctgtaaccagtttacctaggttagtataagtgcatttgttgagcctgtgcacaaattctatttctgctataatagccactctggtaatgggcttagtagaaaataacagtgaatgactgtgaaagactctgcctatcaacaagatgggccatcctatcagtagttttttacctctactgaagtcactttctgacgaacatttacatgaatagacaagcatcttcacattctttgcccatttgaaaagacctagttaagtgcttattcccagggtatttttcctcaccaattttctaatcatgctctttctaaatccctgaccatccaaccaatccattgggtaaaactcatgaatcaaacaacaagacatatggtcatttctccatccaagaaaaatgcattaccttgtataatgcccaaagttctacctacttatgaagatttcccttcactggtgtctttcagggttgtatcagaaggtttgtaaataatgcagctttccgtttctcagtagttctcgcatagcatgcagaaagagaaccatcagttcaaaagtccataattgctaaagagatgattccgtgactaaaagcactacttgctctttcagaggaacctaattcaatgctcaccacccacatggcaacacactactgtctgtaactccagttccagaggactcgacactctcacacagacatacatgcagtcaaaacaccactgcacatgaaataatatttattttaaaaaggccctcattcttcctcagtaaaatgtccataaggaatacttcaagaggccatgggcgcatgattgggagtagaaagaattttaatgggagtaaaaaccataagtatttaggcaacttctttgtataatttgcttgtgccctcaggaactactctggccagatcacatatattccacttccatttgataatagattgctgctgtgtacgtcctaatttataacttatggggttaaataatatctagattactataggcagccccagttgcctgacaccttggtgtctcattatcaaatattcactttacactaaggcccaatagcaggccaaaagctgtctttcaaaagaatagttgtctatagataatggtagagttttgatgctaaatttctagggtttactttgtgattcatctatatagaagtgcaaatgactccaggcaaccttccttgcagccactgataccatcaggtctctggaatcatattgtctcagtagaagtgcagcctatgtctcttgtgagactatgccagggcctaccaaacacagaagtggatgctcacagtcagctattggatggatcacagggcccccaatggaggagctagagaaagtacccaaggagctaaagggatctgcaaccttataggtggaacaacattatgaattaacaagtaccccagagctcttgactctagctgcatatgtatcaaaagatggcctagtcagccatcactggaaagagaggtccattggacttgcaaactttatatgccccagtacaggggccagggccaaaaaatgggagtgagtgggtaggggtgtgggggggggagggtatgggggacttttgggatagcattggaaatgtaaatgaggaaaatacctaataaaaatattttttaaaaagtgcagcctacacagaagtcttggtatactgaagactcttctcctattccagactccatttaaagctggtggctttccaactcactttatatataggatgacataacatattctagtaaggaatatgatgcttctgcagtccaaataagccttccttttgaaggtgggaatggtcagatacaataatgtatactttagttttatatggcatatctatgccccacacagtgggctcctgggaatttccctgaagttctacccttgaaatttgtttggatttatttcccaccctcagaatccatgtgtgttgccaacaagtccaatgtggtgtgtatgtcctgctcttatggtccactcagactaatttatcaatatagtggatcagtgtgatatttttcaggagagacagatgatcaagatcctttcaaactaagttatgacacagtgctggagtgttaatatgcccttgagataaacttgtaaaagagtactgttggccttgccagctgaagggaaattgcttcttgtggtccttatggacaggtatcaagaaaaagacatttgttaaagtagtagctgcataccatgtaccaggagatgtgttaatctgctcaagtaaagatactacatctggtacatcagctgcaattggtgtcgctacttgattaatttttcaatagtcaactgccattctccatgatccatctgtcttctgtgcaatccaaataggagttttaaggggagatgggatacaaactacaacctctgcatctttcaattccttgatagtagtactaacttctgcaagccctcttggaatgtgatattgtcttttgttcactattttccctagtagcaaggacttcagtgacttgcactggctttcatcaaccataataatcctcacaaaaccagtataggaattctgtcaacttctaagtacatataccccaattatacattttagaagtaggtaaacaaccacacaatgcatttttgggattaactgggcctgctgtgagtaagactttagccaaaactctgtcatctgatctccataaacccctacttcaactgattagccacatttgctgttggacctctcccataatcagtgccaattattttcctagaaccagtatcccatagaccctggaaagtctgatcatttcctttcccagtgtggagtggcccatgtaaaagaacatgtgtccctctccagaaggactgaagaaagctaaccttaaagaattgaagaaaactaaccataaatctcttaggtatttaatcaaggcccttcctcagaggacatttgacatcccctcattcaaggtacctaaggtttgcaaataggttcaagtctagaaattgtttcaggagccaagatttcctattgccactatccaatgtagcctttcttggatttgttcaataatgtatctgcttatactaatcatgtaaaacagtaggcttcttcatgattacatttctaaaaacacaatccattattagtcagtgtcagagttccatatgagatttgtgaccataaaaagtactttgcttctgctgcccattatgggtcagaccacttttgacatcgctctacctgggcttccattgccttaacagtgcttattattgcccttggttattcattgttgccacatgaaccctgctactccagtgcccaattataacccattgcgtttaattcaaacaactgagctgtggtatttacaaccccaaaggtctggcacaagaaaggaattaccatagagttctttaagtgtgctggtgcccctttcagcagttttcatgttagaggattagtgaagggctcttctgggccctcccactgtggaggattaggttttgcccagcaaaccttctgtagcttcacagtctcccagaaccttaaaatccctttgtcaagacttaggcaagctgtgtcaaacatcttcatcttcttttcaataggccatcttatgacaaattttggctgtgcaaacttccatactaaacctagaatgtgtagtcagggctctcacatcagaaaactcagtctggtccagttttatatcccaactacaactatcacacagccttaaaacccatttctacatatattacccagaattttgcttcaatgaattagcaaactcactaagttctttagtggtatattacacattttcatggactgtatttcttacctctcttctaagagcatctttatccatgaatgtggttgtaggtctagaagcactattggcagacactgaatgacatcagggttgtcttgcctgccacctccttcacagaaggacatcactgttagttcagcagatagtgaaggattaatttacacaggcaaatatggagaggggaacactgcagtagatgaaagtgaagaagtattctattgtaagggtgaagaattgatcaagtgagctaaatccttcagaataagaaagttcaatgccttcatgttgagataggttgtcccacacctctacatcctcagttttaggatccttacccgtcagtgtacttatttcaccactatcaataacattttatgaggctgggacttgaattttcattgtatgcaaatattcatatactggggacttaggattgattttctataacttgaactctatggttgctgaggacaagattctcttccacagcccacttataaacttttagactatatgtatggatctggagtcaaccaattaattgtgtcactgcattcattcatttgttactgtaccctgagatattagaagttggttaattttatcaaggagttcattttatcctttgccaatttatccagagatgttagaagcaagcaggtagcaccattcttttccttatttttctaccaattgtcaaaagtgttgagtatagagtcactaaatttgctgtttcttgcaatggataggtcaggataatcaaatgaatctatcttgataagtttaataccatggatatttaatgctttccatgctactgagtaaccttcagtaaatataggtattagtggattagaaaattagttccatgaccaagttattattgaagagagcatttttcagcttccatgtgtatgtgtgatttctgttgtttttgttggtatttaagaccagccttagtccatggtgatctgatagggtgcatgggattatttcaatcttcttgtaactgttgacgcctgttttgtggccaattatattttcagttttggacatgaggttctaagaagaatgtatattctttgctttagggtgaaatgttttataaatatctgttagaaccacttggttcataacttgtgttagtttcactgtgtctctgtttagtttatgtttccatgatctgtccattgctgagagtggtgtgttgaagtctcccccactattattgtgtgggatgtgatgtgtcctttgagctttagtaaagtttcttttatgaatgtgggtgcccttgcatttggagcatagatgctcagaattgagaattcatcttggtagattttttttttcctttggtgactatggagtgtccttccttatcttttttgataacttttggctgaaagttgattttgtttaatattataatatctattccagcttgttttttgggaccatttgcttggaaaatatttttccaaacttttactctgaggtagtgtctgcctttgaaactaaactgtatttcctggatgcaacaaaatgctgagtcctgtatgttatgtatgtatatgggcccatatccagtatgttagtctgtcttttggggaaaattgagtccattgatgttaagagatattaagaaaaatggttgttacttcttgttatttttgttgttggaggtggagttatgtttgtgtggctatcttcttttgggtttgttaaaagattactttctggctttttctagggtgtgttttccctccttgtgttggggttttccatctattatcctttgtagggctagatttatggaaagatattgtgtaaatttgattttgtcatggaatatcttcgtttctccatctatggtaattgagagttttgctgggtatagtagcctgggctggcatttgtgttctcttagggtctgtatgacatctgcccaggatcttctagctttcatagtctctggtgagaagtctggtgtaattctgataggtctgcttttatatattacttgacctttttctcttactgattttaatattccttctttttttagtgcatttggtgttctgattattatttgatcagaggaatttattttctggtccagtctactcaatgataacttggtcaaggaagaaataaagaaattacaggcttttgtagaatttaatgaaaatgaagacatatcttaccaaaacttactggacacaatgaaagctgtggcaagaggaaaacacaaagctctaagtgcatccataaagaaactgaagagagcttacagtagcagcttgacagcacacctgaaagctctagatcaaaaagaagcaaatacacccaagaggagtagacgggaggaaataatcaaactcagggctgaaacaaatagaaacaaaaagaactatacaaagtatcaacaaaaccaggagctagttctctgataaaatcaagaagatagatttaacccctagtcaggctaaccagagggcacagagacagtaaccaaaataataaaaccagaagtgaaaatgaggagataacaacgaaatatatctttaaatgttgtttgttcaatattaacagttgaaaatatcaaagtcatgttctacaaaaaaagaaaaaaagaaagattggtattataaaaaaaaagaaaagaaaaaagcaacccagatacttaaaaaatgaggctgatggatttctataaattcaaggccaacctggattattgagtcaactccaagacagccaagacagcatagtaagatcctgcctcaaaaactaacaaacatatttaaccaacccctctcccccccaaaaaaaattcttataattatgttctgtagaatccattctgatattactatctgtactagtcaaggttctataaatggtaaagaactgatagaataagcacccatatattaaaagggatttattagagaagtatgcaggctatggtctctctagtccaacaattgttgctgtctaccaagtgaaggaccaagagcctggtagtaattcggtccatgcagctagtttttttagcaatcccaatctggtgcggagtcccagagaacttctagagagctggcagtcttcagttcacattgaaacccaaataaataggttctaacaccagtaaaggaaggcctctccaaaagggtacatgaatttgcctttgagagggagagcaagcaggctttatactgtcattagtagacccactgaggtatacgtgctgacttgatatttactgctttgaagttgggggctgctttaaatatcaagtgggtaggcttcccaaaagcaatatttgtattactgatcttatcctctggttgtagctaatgagtgttagatacttgaatcaagtagagaaaatgattctatttccatggaatgtagcaatgacactaaaacattcatgattcattttagctgcttttctggacagaaattaagagctggactatatacagagttggttttgttttgttttgttttgttttgttttttcactccagattttattcccctcctggtctgtcctcaaactgttacacatcctgtacctcctctgccctgctgtctcctcaaggatgtccatctaccccctcagacctctaaactccctcgggcctccagtctcttgagggttaggtgcatcctctatgactgaactcagtcagacccagcagtcccctactgtatgtgtgttgaggggcctcatattagctggtgtatgctgtctgtttggtggtccagtgtttgaaagatctcaaaaggtcaggttagttgagactgctggtcttccctcagggtcgtcctcctcctcagcttcttccagcttttccctaattcaaccacaggggttaacaccttctgtctgttggttgggtacaaatatatgcatgtgactctttaagctgcttcttgggtctttcagagtacagtcatgctaggtccctttttttgagtgctttatagcctcattaatagtgttgcgcgggcccaactggccaggaagaacgacactacaacaggatccttctgcacacgtttattcagtcctgtttcttcttgtttatatctccctcgtttatatctcccttgtttatatctcccccgaaccctgggcctctcactcttttatactctcagttcccatccacgcacagcaggccacgccacctcaccaggcatgcatcttaagctaatcagggcagcaggggcatatctccatcaaaatggatttaccggtatcctggtacacctgcgcagctctcaagatgtttgtggcttatatgaggaagtcaggtgcaaatcatacgacttagctgcagtccctggcgcctttgggactgccaccacacctgctcctcacataatagtgtcaggccttagggcctccccttcagctgaatcccactttgggcctgtagctagacttcttttccacaggctcctctccatttccatccctgcaattctttcagaggtaagaattatgggttagaatactgactgtgggatggcaaccccctccctcacttgatgtcctatctttctttttttttttttccatttttttattaggtatttagctcatttacatttccaatgctataccaaaagtcccccatacccacccaaccccactcccctacccacccactcgccctttttggccctggcgttcccctgtactggggcatataaagtttgcgtgtccaatgggcctctctttccagtgatggccgactaggccatcttttgatacatatgcagctagagtcaagagctcccgggtactggttagttcataatgttgttccacctatagggttgcagatccctttagctccttgggttctttctctagctcctccattgggagccctgtgatccatccattagctgactgtgagcatccacttctgtgtttgctagaccctggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactcctgttaaaggtgcactatacaaattccctctcctcaatgtagggcattttatctagggtccctccctttgagtcctgagtctctctcacctcccagatctctggtacattctagaaggtccccccatcctcctacctcctgaggttgcctgtttccattatgtactattagtgagtaccacggatgtcctttgaggtctgacttacctcactcaggataatattttccagttccatccatttgcctgcaaaactcaggatgtcctcattcttaataactgagtagtattccattgtgtaaatcaaccacattttctgtatccattcttctgtcatgggacatctaggttgtttccagcttctggctatcacaaataaggccactatgaacttagtggaacatgtgcccctatggcatcgtgggacatcttttgggtatatgcccaagagtggtatagcttcaggaagatctatttccaatttctaaggaacctccagatttatttccagagtggatgtaccagtttgcaatcccaccagcaatggaggagtgttcctctttctacacatccttgcaaacatgtgttgtcacctgaggttttgatcttagctattctgatgtatggtggaatctctgggccattttgatttgcatttctctgatcactaagctctttgaacatttctttaggtgcttgtcagccatttgagattcctttgttgtgaattctagatttagttttatatcccacttcttgattgggttgtttgtttttttggtggttagcttcttgagttccttatatattttggatattagccctctatcggatgtggggttagtgaagttttttttttccccaatctataggttgccgatttgtcagtttgattgtttcctttgcttactgggtcttattcctttcttttggataaatatttagacactagtcaatctgtacagatatggataaataacatggattcatgttcaaaaataaatgacttaacagttttcctatttagtccctttttgtgattattttctgtttaatatagctcaaattggttttgtcacgtataataaatcctcttaattaattggacattaatatttcccaccagtctagaaatgccttgaggttggggattatacataatattcatttttcaagcatctcttgtagttaatacaaagtttggcagcaagtaattgttcattgggcattttttaatagaagcatcattatcattaaaactataggtaagtataaattctttgtaattcatactttattaaaattaacaaataagatttcttactatttctttctgtttggcttattaacaagcaggtttatttttatatcttatactccatctttggtacttacatttcaaattcctgagtactagccattgaataaataattaacactgcccaaaccccagtttgttgttctatgaaacagatacattaccaatttcatttttgtgtgtgtacagaataaaactttatagtgtgacttctgtaattatatattcagtgcatgttaggtgtgaatagagtttattactattcatttactatgcctaagttgtgggatagaggctatgggtgacatttttattatcaggagttatacaagtagccaatgtggagtatctggcatcctcaagaaattctctatccttgtagagtccatcctaatttctgctcctttcaaaaaaggtaaaaattcttgtgtttctcttactttaactaatatatcattttaatagttgaaaaatatttttctactaagcacagtataactttagaggaaatacagtgatgtgattttaactaaacaaggccattgttatttcccattgacataaagtagacctttaagatagagctggaaacttgtttccttagaagccataatgattttcatcattgttgaacacttaaattctttctatgctatttaacaactttagacaaaggaagatctgactaaattccatcagagccacgaaatttctaacagctccctgttacttctaaacttcacacccagaaactgacgacatagcatgtgcagccaataaatacagtactagcgtagccttgctcatgccattttgagagcctaaattgcttcactggaacatctggagttgtgagacaaaaatgcctaaatgaacacctggaggtctttaaatggtatgtaatacttatgcccaaatgaggagttacccttctgatatctgaccatgtgggatcattcatgcacacttactagaagggatttgtttcttttacatttcttgcctgtgctttccatgttttcccctggtgatataagttatacaggacacttctatagcagtgaaaacagttccttaggaaccatctaaaagttaaaggaagtgtgtgaaacaatacaatgatttggtaatagctttggcaggaaccctaccatataactggcaccctaatggctctgttggaaccattatgcatgtatgaggcagtgcggttgacttttgtaacagctattttagagagttccatggtcggaggaagggtataagtcatttggatgactttatgtgtgagtcagacatttctgtgacaactgagatactcttacaattgaaaaccagtctaacgatattgaacattaagctattgtcaaggtaaatagataaatgcatattttcaaatagaaaaacctttattaatgtatttttttgctaaagtagtatcagctgatggtttaaaattgatactgtaaaacaggattaagtttttttttaaataaactattctcacctttgccctgtagatgccactcgagtgattgccatttccacattatcagtataaaaacagacagaattctgtgaaatgaaaagtcttgtagccttttctagtttagccatcttgcatattatcttctttgttggtcctcagtgataggtgcatgagacctggacacataggtaacacttttctatttagctaggtcattgatacaaatgtaggtgtccatcagtttgtttttccaaaaaaaaactttctgttacttgtttcttacatacacttctttttacatagctgttggataatttcttataattggaaatgattgataggttgtggtaatagccatttaatgtttactaatagctatcaccacatttttccctcaaaaaagaaaagtcagtgtatctttctactaatgcttatgaagagtatctattttctcatattctcatcaaggctggcaatgatgaaaaaaacatttctaatacatattctcctaagatatataaaatgttattatactattatttttcatttatgagtgagcttaggaaacattttatatgctaatgacagattttgcatctcttattctcagttgtttgttaatatgtctgctcatatttctacttataattagtaaggacttaggtaatctaacaacaaagtaaaaagatgcagatatgtaaagataatgtaaatgcttttttttctaattctaaatgtgccattgattttgtattttttatgattgtagtatataagtgtataaaatgttttctaataaaagagcttaaaatttaatgttaagtttcataatttccatatttaacctaaattctttctttttattttattgtgtatttatttcatttacatttccaatgctatcccaaaagtcccccacacgctcccccacccacccactcccacttcttggccctgtcattcccctgtactgaggcatataaagtttgcacgaccaatgggcctctctttccactgatggctgactaggccatcttctgatacatgtgcagctagagacaggagctccagggggtactggttagttcatattgttgttccacctataggattgcagatccctttagctccttggttactttctctagctcctccattgggggccctgtgatccatccaatagctgactgtgagcatccacttctgtgtttgctaggccccggcttagactcacaagagacagctataatagggtcctttcagcaaagtcttgctagtgtatgcaatggtgtcagcatttggaagctgattatgggatggatccccggatatggcagtctctagatggtccatcctttcgtctcagctccaaactttgtctctgtaactccttccatgggtgttttgttcccaattctcagaaggggcaaagtgtccacacttaggtcttcgttcttcttgagtttcatgtgtttagcaaattgtatcctatatcttgggtatcctaagtctctgggctaatatccagttatcagtgagtacatattgtgtgagttcctttgtgattgggttacctcactcaggatgatgccctccaggtccatccatttgcctaggaatttcataaattcattctttttaatagataagtagtactccattgtgtaaatgtcactgatagatcacaatctgcaatttaaaaatcataatacatagtattctatattttatgtggttttaatggaagtatacacacatatatgcatagattaatttgcaaatattaagattaaatgaagaaacaaaattaggcacattcaaaattgtatggctagagcccagtcatcatcagaaagacttcatccgctactcatcaaagaaaattcagacactcacaagtcaaacaataggcagaggtcccagaacccttcagaagttgggaaggaaggattgcaggagcacagcccatagaatcaactaagcaccactcataggagcttacagagactgtcaaggtagtctacatttgtctgtgctagatcctttgtatatgttatggttgtatagcttagtgttcttgtgggattcctaacaggggctgtccatgagatttttgcctacttgtgggaccctttcccccctacttgattgctttgtccagccttgatatgagggtatgtccctagtcttattggaacttttaatgctaagttcagttaatatccccaggaggcatgctgttttctgaagggaaaatgaagggaagtggatctgggagaaagggcaggtgagtagagggaccaggaagagttggcggggggggggtggtaaactgcactcaggatataatatatgagaggaaaatataaaaacaattaattaataattattattacatttgcagagagctaattacttggctaggaggtagaatctggagacagtgggtttttcctctgtacttctgtcccctttaagcttcatattataggctgataatttttagcttatgttattttaaatttatgaaattaatatggtatcacagagaaattaatccaaattacctgttctctggactactttagagcatattcaataatggctgttttcaggggtgttttgaatgtcttaaagtagtatacaaaaattcttttgggtgggaaaatgtataaaaccctccttttgtttagttctcccatctctcactccctttcttatgtgtgtacatgttcgtgtgtgtgtgtgtgtgtaaacaaatgtattaaataatatctttatgtaataatctcttctttggtttaatgttaagctacctgcttgttttgattttgttcataaaatgcaacccacgttcatttgtttccttgaaaaagctgtttttgcagataagtttctacctctcataggaagcagggcatggcagcattataatctagtggacaagcaatgctgctttcctaaattgtctgccaaaattagcagtttcagtacaacaacaaaaaaagacagttgtaaatttcaatgcctccatgtaatatataccatactattttcctttgagaccaacagcatgtatttgtcattttacaattctagcaacatacacataatcatgtttccatgaacaaacacctattatgctaagtggcatattttaagtataatttctgtcattcacacagttgacaccttcaatttttgtggttctattttatggccactatcaactagaaatttgtgcttaaatacttttcatttattttgatgtttgtaaatgcaaaaccagtttttctgaggcaatttaccgtttattttcattgtttctgggaaatgcagtgtatactgaaataaatttatcctctccatgtttatgtggatttggaagatcaaactctgcttatctgtcttgcctggcaatcaccttcacagaatgagccatctttctggccttcacatgagcagagcttaaagttcacaaacatggaatacaaattgattgttcataaataaggcatttttgtgagtaaattatgaaacaagcaagtcaatcaaaattatcaaaaagtttattcatttaagatactttctaaattgatgtgtgactgaattgtctgataatccctttggaaactattgaatattttgtttatgaatatgtaatcatatttttaagaaatagcacatccattgattggttaaaataagattcagttagaattgatcaatctagtcaaagttgtcaagaaatattcctttgcaagacaaactcttggataataaagactaaaactgagttgttatgagatttgatagtcccaaatcatagcaaaatttgagaaaatttccatgaaagttgaaaagtatagaaaatgaaacccaaacattcagccttacaggaattataaacctatgaaatcatgacatcttacatagttataggaagtcaaaaataatgacacttaactatctcaaagtggaaataaataaaaacaataaaataaaacaaccacacaatagtaaaagtcaagggaagggaagattcagacaacagtagttccctggattaagtatttgatataagtatttacttccctcagcaaatatacataaattattttaacatttcactgcttcccttgaagttttgatctctaggctactatatgttcatttgaatactttatttaaggaacaggaagaatttagaaaatgttttcccttttgattctggtgtagtcttagtcctaagttttgacacttgtgtagccagctggattttgtcattttaacggcctcaaccacaataaggtttattaagatgtttctgcttttcaacacatttccaaacagctgtctagatgtacagtcacaaatctgctatattgggcaggcatttggaacactttttatcatgttgtccctaatatatatatatatatatatatgaaaagaaattaacccaaggtaaatcacagcctaaaagtgattttctgataactgtttgcctccaaaatcgggaatggtctttactcacaagaactagaaagaataatttggacatattttcttggaccttatatctttggacccacgagacttaaaataagaaatatcttgctttcctacaagttgagtttcagttgttccagattgaattagtgtaaataaaatagaaagaagggctctagcaaatcaatactgcattggtagtaaactggaaaatactgacaaattatccttttaggccttagcgaggtttaatctaaacatcgttttctcctgacaagatgagagagaagagagtaatttattacccaagcctgatatggatgagaaaagactgcagcttgttcttcactgttatggctccgtccctttttgtgccagttcaatttttgccttgctccagaaaagtcattctccaataatgtttatgagtcttatatcttcaatgccacaccttatcatggtacatttggctacttgtcagcttgtttaagaagaagaatgtcaattgaaaaatgttctcttgagattcaagagtctcttatgtgcatggagaaccttcttaaggtatggtatgcatgaaatttcacagttttagatagtaggagagagcaatacctacaggagtattttatgaaatctggtaatgtttaacatgaataataacccaacccaataacttataatagccaaaacatgagttttaattattggggttatataaaacgggttctagtttcagttccattccaaacttgtaggaggagaatttttattttgaatgaaatatatgttcacactgtttccttcctaatcatgattttatttctccccattctactcttattcatagttataaacatgaagcacaaataagtaaaagatgtagcagaaatattttgtcagctatttgttcatctattcttttaaataaagtagttgtgttaaatgtcacatcttcccagatagatatgataaaatagcatttttaattaatccaagagggacatggacacgagaaaaccaagtacgtgctccaggcaggatcatttctcaaggcactgtattatgaacagtatttaaattactacctatatttattcctcacatttttttaaaacctaaggttttatactattacaattatatctccacagttattataatggtaataaagatatcagcctaaaacacttttgtgttcttggggaatatatgcatatttaatagtaagaaatagttcctatttattgtatcccataccaaagtgaagtctcagtaggtttagttgctcattcaaacttgaaaaatatgtacattgcaaggatcctctaccaacaaggtaaaatgaatgtagaattagtaaatatatttataggatgaggatcttgactgagaaattaagttacacacaatattattgtctcacagtgatatggatttctttgaaaaaacactatctaaaagtacagactttttaagaggtgtacaactgtgacatttaaacataaatgtttcaaacttattctaccatagtcctagacaagtaacacaactttcctctaaatcataatggcatgctgcatatatcaatgaagtaagagaaaagaatcttttggaggattaaaatcaaatatttgctttattacaaacaacaaatgaagtaccatttttctcttgtggaatctcttattatattaaataccttaaaactcccaaaaccaagaaagtttttatgtaggaaaaattggaagaaatgagaaagctaagaataaaagcacacgtggttttaagccacctacttagaagcttgattgcttgtacttagggatgctttgaaaaatatgtatgaattttccccaaacataaaattaaaaattataattcttgtagcattggaagtttgtttctggtcaactaagtcaattagccataataatactaatactttctcccaattgtctagacaatctgttttggtcatctaattcactagttcagattgctaaaaatgaaccacacttagagagataaaaatataagatagtgggaagtatcagacagtgtaagagttctataagagcaagctcatctactgattcctgagagcaatttatttactccaagaattgatatggtatctaaattcatgaggggtcttcatgataaaacgtagaagtggtgtgtttaaaaaaagttgtaaaactgtttattagaatttgtttcaacactggaatttattcaacaaacttttatcaaacacatatcatggacaaaggaatggtgacctaaaaattaatcattaggcatatttccttgactaaatttgaagaatgaaagaagagacagactaaactttgagcaactctacaacttctggcatttatttacttgaagtaaatcacattgaagcaaatctcctttccctcccctactacagaatacatcatttcaaaaaaaaaaaaagcttcatgctgatccataaagtaatcaattatttgtaaataatgtcttggcctggtgtcttctacatgaatctactatgaagaactgattaagtagggtgtataaactatctatctatctatctatctatctatctatctatctctatattttccttccttttctgcggaaatgtatagtatgtacatgccatactgtctatcccttcccctctgtgcactcccaaggcatagaagaagtgataacagaaaaaaaatagatttgaacactgagaagtattcaatgtaaaaatggttctctgttgctgagatgaaagagttgctgtatagtagatgcattttaagtgtgcatatgataaagaaaaatttcacaaaattgtccttaaatttatttatttaattatttaaagtagtcagcatgattttattgaaatgtcttagtaaatggcaccagatctcaaaattctctagtctctaacaccagggcaagcactgcaaggaatgtattcctgtatttagttgacattgtatgttataaagtgcaacacatcaataatcttttctagtctggtcttattaagcctaacctgttctagtctctattttacgctattcagtgttgccttatagtccatgtcattatatcaaacatgctttatatgataccatacatttcttttataatgatatattgggttactatgtggaattaaaaaacaaacacaaaactatgcatagtatatccttgtatttcctttataattttttgataggatgagtattggttgattcccatgaaatgcttctgaacatttgaaaggttcatgctagcatctctgtccttaagcttttattagaaacagaaaaaaaaatgtagatctggatcaccacaatatgaacagctagaggaactgtgctttatacatcaaccttttcttttgggaattgacttccatgtttaaacaagaatacttaaattttttctagaaattcaatgttttgccaattcattttaaggcacggtcagacatcctctaaaattgagagaggactcatgggtcttgccatttgtagtttaaagaaagtctcaggtgataaggtctctctggtgtgacaaataaaaaagaagcaaattaaaatgtgcctgatgggaagaagaggaatatccagaaagatcatttctgatatggcccttctaacttagcttctttataaaagataattggcagtcaaacttaggaaggatagatgtgtctacaagatacaccatcttattatatattacatataattaatatagtctacattattatattatgcattatattatatttaatatgtacttattatatagtgataacttgttaagagaaaccaattcacaccctcttctccaacacccatttatagttgaaagaaaaagacatctctattctcttcccaagaagacttcattgtgttcttttctcctttctcctgccctacatcccaaacacacaaaagctagaaaaaccactcctatacacaaactttcttttctccttgaccttattcatttgtatatttcctcttcccataatctgactttcctgttgtcttggtaactaactgtactaataatcagaaaggaaaaatttatagaatgtaggaatttgaggtacgaacagaaactttaacttcactctgcccaaaatcccctcatttctcttcctgactttcaaaaaactaagttgtgaactgagaaattaagattatgagtcacatggaatgaagggtcaaatgaattctaaagaaaggttcaaagtaatgatagatgaagaacccttcagcttgttgtagttcctttctttattgattcgaacagcattttacagcctgtatttcaagcatagtttatcagaacagccccatcaatcctttgattttgaacattttatgtggggaattgttattgaatgataattttacacaaagcagtatatttaattcatgtcacattaatatatatacatatacatacatatatgtccaaatcacagtgcttagagctgccgattccagattcactacaagggctgctgacaaaggcagtcaacaattaaagaagttactcagcagactttttctgagagaacaaagcttaatttactgggcttggtactcttctgtggccagaagaaaaactatgagctcttttaactcctagggaccagccagaaagagaaaaagagagaaaattcacacacacacacacactgagtggatgaaaaaaaggcagacttcaaaaacttcatacacactaacatgcacgcatgcatatatacatacatacatatatacatatgcacatatatacatgcagacagacctatagacagatgtatacacattcccacatagaatggttagagcaactctcaagcaagcaggttccaagcatttcacacatatgtacatctacataattggtacatgcaagcaagcagggcatgtggagtataacacatgccctgacaagcttcacatgtatacatacatgcagacacataaaccttacacaaacacacatagttggttagtggtagaaacattgttccagtcatgcatcctttattctttcttccatagcatatatattccagcaaaatctttcaaacagtatacaattacagcatggttacggtttagttttcttctggtgaatgattacaaaaaaaactgtgttccccaatacctttacaagaaaaaacattgtgtagttcaggtaatgaaaacaaagtattataaaaatcccatgtacattcagaacctaacaacttgctatggattaacaaagtgtaattaagcaaggtgcttttctcagccagtttctcttactagcaggcagcaatttgtggtcacaaagaaaggagtactaaacttatatataaaaatcaatcatatctatcctaaatcctcaaaatgcatgtttttactcatggcaattcttcataaatcatatcaggaagctaagggcaaaactaagtatatgaaatcaattatcaccagtccagcctcagtgagagtcatgtcagccagtgctcccattgctcttgttctgtgaccccataaacagtccctaagttaactaataagagtatgcctttctgaacttcaaattatcccctaaggtttttacatcagtgccagtagtaaaaacatctcaacctaacttcattaacaactatttttccaaatgtttgctaagggtggtggtcattgttgacaaactatgtctctaaaatcttgctgatttgatcataatcttctccagcagcaatgcctgaaagagatcaagcattattattgtgagtgccagaggtactgcacagtgaggggctggaagccccattagggttttcatacaattcttagattaagagagaggtgagtgtagcaagcagtgtggaactccataaagcatagtcttcaggacatgcggttctcagggccgtgccacacccaggctcatccatgtggctgtgctaacctgtgggatgcattccatgagttctaaagccatttgccattcctcttgcatagcccttggaggcagtgtactaataaatctacttttcttatatgagcaatatcaaccagaaataaatggcctgtgcttccctgcagatgagtcgtctccatgttgatcagggcaaaagtgatcacgacatttatctccacttcctcactttgcttctactgctgctgctctgttcttctcaccagtctacttccactttcatcaaaatcttcacagggtctcacctacccctccccccatcttttagaccttgtcatattttcttgctaatcatatttcacccatgaatatgttgatacctttatattacactgtcttgccaatcaattatggatcagtgttacttggtgtttaccctattctttctctcatcatgctgaatattactcccaaacaaaccatgtatttgattagtgcctatgaaaattcacaataccgaattttatcacaatcttaagactgtttgttgcctttctcccacgatagcttcattcttcccactctgatggggttctggcagaaatacttattctagtcgcataccctcacagagaggtgcttcctaactcatgcagaaaacctaggtctccagtaatgacagttcctcaatttctgccatcccattgttaacatacttgtaatttgcattttattttacaatacattttacagtcagaagtatcgttatcctttttaaatgccaattcttccatgctgttcccacttcctttgaaccttaaattttcaatgttcttttatgtgctctgcaataggccttccattgccttataaatacttcctctgtgatcactccattctcattctttgtgaattgttccctttcacttcttaatttaaatgggacttagatgtgtaaggatttctatgatcatattattgaacagtacagcctcatataccctaactacataattagtagcagctctaatttcttgctttcatttttcagtttggtctttgtcacagtctaatgccactggcttatttttcttagtcatctttttcctttcccagtggaataaatattccacagggcagggatttgcatgtgaatactcattagctgaaactatatttgacatagtataatagaaaaatatttactgaataaaattaatgaatgaactataagttgagtcctattttctactattctaattaagttataaagaatatgcacatcaggactatattctgaatttaacctagcttcagtattagttagtgtgattggttaactacttcattgagaaaaaaatattttttgagctctccaaattttcacactcctctttggcatctcttcatcagtcaagtctactttcaaaaaatacattagtcttctcaagggaactgtctctaagtaaattttcttctatatataaatatttctctgagaaattttatctatatcgtatttcaaaccactgcaatgcattcctaatgtagagcccaagcagcaacttttagctgaagtggcttatctatctgatcatgatctgatcatgtgcatctattagagagtacatagcttcttcacatataacaccaattcaataatcttagttcttcgggatgtcttgtattagtgggaccaacatctactataatttccataccgtatatatttttaaatgttccacggtattccttctctcctgccttcccttgtatgctaagttctcagaaatctatttccaaattccatttctgaagcattcatttttttcctctgtcattcccacttctctttttcatctatacatcctggtttttcacatagggtgtgaggatattcggctacatggttttcatatcttcatgccttcacaaattcaagttttcaatatttaatattgttacctaaaacagtaatacaaattgctctcttgacagttgccatgacttttatactacttgctcagctccaacaagtaatcaaatctagcctagacctgccttcatcatcacaaactctatgggcatactcacttctttatttttcccaaagtacaccaaactttctcaatgtaaaaaaaacatggttaattttaccaaaatgtcagttccctcccccatacttcttggaaaacttctaagaatgtttcaagccaattaaacactagttctacagacattcttcaggtatcctcacagtaagtaatgatgttcaccgatcatcaagcactttgtgtcacacatctctacaaagctatgtgtacattatgtcttagaaatattgtctgatttctatctttttctctagattatgaactagcaggtaagaatgcccaaagtgaggagacagtccacatatttaaaagaataagggtcagtgttggataggagaggataggcacaatatgactgaaatgaactaagaagaataaaagcaaactatatttgcttcttgagtatgagtatggacagttaaaatttaatgagaatgtggcagtgacaggtgaatgttcatttgaaaataaagtagcaaaggattaatatttcacttgaagatcatattttgggataatatttttaaaaatcagactgtaccacattgtaggcattggtactggcagatctgaacttgatagtaggttcccctttgttatcaagttattattctattattctgatatatatatatatatatatatatatatatatatatatgtgtgtgtgtgtgtgtgtgtgtgtgtgtgtgtgtgtgtgtgtgtgtattcatgtatatatcctggtccttagacaatagacagttttgacctatcatccatgcttttacatgtattctcatcctaaaattaccacatctacagtaaaagtgttctgatgtccacagagaatgcacctatttatactcttctgcttagatcaatttaaaggattgctcttggaatctgctcagttcctttagatcataaggtccagtttagagaatgttctgattctgatagataaacagtaaaaaagatagaatataatttgaattgcagaatttgtttgttgaaatgtggcaccaagtttcacctattaaagtgaagagagataagagcaacttgcatgtgcttctgcagcttgagcagccagttgtatctgtagcaccctaagtcctttttgctctctggttgtctctttattcagaagtttacattaattaaacgtggctctcctagtgtttgaatggcaatttaaacgcctgtggtaagaaaaatcacaacctataaaatcagccaacatgcacattctaagagtcaacacagttggtagtgatatttcctaatgtctctttgtcacactgttctcgctttttctgtactgtttcttttctaattattatctgttgagattagtggtttgccctttgatttctggcatggcacactgtacaaatgttttgtggtgggactttaatttgttcatgatgacactgcttctgcctttgcccgtgggaaaaataaaattgagtcattcttcctctggccttcttcagctacatatcctgtcagtatgatgtttatctcaacttgcctatcgatgatcacattgattgtggtgtattctagtgtgaatcgttgtgcttctggctttttagttttgtagagtttatgtcccttaaaagaaagcctgtatgaactttaaaaagtcactgaggagattataaggaataggacttcccctaacattagaactactaatatactaaggaataattcaaaaaggaagttgtgtgaatgctggaatataaattctatgtgatgatcaaccacattctagcaaagccaactaactgaagtttctttgttttttttttctttttattgtttgtttgtttattttgttttgtttgtctctgaagaaaaagagtgctgtaatatataatatattgggcaagaagaaaagtaactttttaaagtactacctttgcatgaatggctagtctttcaacttctcctcagtgatttttattagatatttttttatttacatttcaaatgctatcccctttcctagtttcccctctgaaaaacccctatcccctccctccttcacctgttccccaacccacccacacccattcccaatcctggcatccccctacactggggcatagaaccttcacaggacctagggcctctcctcccattgatgactgactaggccatcctcagctacatatacatctagagccacatgtcccaccatgtgttttctttggttggtggtttagttccaaggagctgtgggtgtactagttagctcatattaatgttcctcctatggggcttcagacatcttcagctccttggatacttttttagctccttcattggggaccttgtgctctgtccaatggatgactgtgagcatccacttctgtatatgccaggcacaggcaaaggccctaggaagacagttatatcaggctcctgtcagcaggctcttgttggcgtctgccattgtgtctgggtttagtggttgtttatgggatggatccccaagtggaacagtttcttcatggtcattccttcagactctgctctgaacttttcctttgtaaccccttccatgggtattttgttcccccttctaagaaggattctgagcttctgggctaatatccacttatcagtgaatgcacaccatgtgtgttcttttgtaattgggttacctcactcaagatgatatcctccagaaaagcaaataatcctatttaaaaatggggtacagagctaaacaaagaattctcaactggggaatactgaatggctgagaagcacctaaaaaatgttcagcacccttaatcatcagggaaatgcaaatcaaaccaaccctgtgattccacctcacaccagtcagaatggctaagatcaaaaactcaggtgacagtagatgctggcaaggatgtggagaaagaggaacactcactcctccattgctggtgggattgtaagttggtacaacaactctggaaatcagttggcagtccctcagaaaattggacatagttctacaggaacatccagcaataccactcttgtacatatacccagaagatgtcccaacatgtgataaggacacatgctctactatgttcatagcagccttatttataatagccagaagctggaaagaacccagatgtccctcaacagaaaaatggatacagaaaatatggtgcatttacacaatggattactacttagctattaaaaacaatgagtttatgaaattatcatcagtgatttttaaagtgttatcaggaatggcattgagatttcaaacatttatatttcttattttttcagtttttacaacctcttacgcacagcctctgactattaatcctgacttatctacatagtggactgtccatgtttatgatattttgtagccccttatatttacagcaaatttatataaggctagtgcacaagaggttagtgacagccatgtaagatgaaagatagttccttgtatatatttgctggagttacagcatgaggccagttacaaataaagccaattacatactttctcctttcttccataaaagagtataacattagataaatatatgaattaagaatttagtatttttgtatattaaattactacaggtttaagaagttaaaacatcatttattattcttcagttactctaagttcagttactctaactctaagttttaagggtctgagcacataaaactgagttctctgcttgtagtttcaactaggatgaaatgatgataacaactgggactgggctttttcctcatgattctcattaatgtgtctatggctggtgacagaattcgatccatttgattataataccaaatgcctgttttcttcctgccattagcctgttgtcactatcaggtgttagaagtagctctctagtctacgctatatgatattctgcatatgttcactcatagcatggcatatacttcaaagtcagcatttctgacataggcagaacagaggtagatacagactgacataggcaaattcatacagataacaggataagagagacagaaacaaagacaggctaaaaaaagaagctaacaaagataagagagaggaaaggaaggtgggtagaattcattatttgctaagaaaaattaatcatgtagatatatagaataatatccatgaataatgtcttttgccatttatgattaattatgagtgaataacacatcacctctacccataaagtaacaattgtataatggcataaacaaggaactatctgaggacccatgagtttcagtcctcaaagaaataagacacaattcactagcgtgaaacctacatggtatgatgagaattattcttttgatagttacttaagatgcataagtgaacaaaatatcaaatggttcatattttattttcctaagtgtatactttaaaaagtaacttttcagattattgaaggagcctctcactttaaaaaaaagttgtcctagtaattcataatcaaaacttagtataaaaacaattatagacctgtctaaaatagaactgtcctttctgctcaactctaacctgccatagcacgttactctattcagaagttatcagatgaaacactgtacttcttttatattttaataatgaaaatgaaattatactctaaaggatgctctatagctatgcttttcagaccatgctttgggcgggcacttctacatcactttttgtagttcccagtacattccttgataattctctatttgtatggaccattgaatgaatcttaaattatttttactttaataaattttatgtacatatgtatttatgtacctgtgacgattatcttgtacaaatactttcccttaaaatagaactcacaagtagaaagatatacacaattattattttgatagaaaattaagatactggtaaaatatcctccacaaatgatttatattttaaaacttcctgacaatattatggatgaggttttttttttcccctatattttcatctctaaaatgctttactgctagaaacccagtggggagacaaaatagtagttagtaaacacaataatgaaagagagaaaagaaagagacagaaagagaaaaaaagagagacagaaacagagagatagagagccacagagagattcacggagagaacaagagagcaaacacactggaaagcatggaaatggtagtgtccatttaggtgaacacagaaaatttaccttttttaagtgtttgaaaaaaaaaaaaacactttcaaagggataccgtttctcatgctatataaaattagagcattctttctaattcagcacacacttacataatgtagaggaaaggaataagtttgagaaagtcaacagcatgtttagagaatgaacattctagaactcttaaaaaatatcatggaatgctagtaatgcatgttattaattcaatgactctaagagtccttcttcaaagccatctctaaatcacctatgattacatagaggcctcttaaaacaagtaaaatggatctataaactaggttgtgtactagagtactaaaaagctatcatataagagatatcacataaaaatgtcaaaatttgtagctacccttcccccaaaagaaagagaattcctttgctaatatataataatgtcaaatgctatttttggatggcatttctggaactccatggagattttttttaattttatgattataaaaattactcagaatctcaaggctgatatccaagcatcatgatttgttcacacccacatatcttgtccatcctgtgaaactaattatgaatgctataaaaaatactcaattttctccaatttctgattcctatatcccttctagtttttctcttttgaaagagaatacataaggagacgacaacaatcaaataaaccttactcaatgctttctgtaatgcacagaccctttcgtttaattatgtctacaatttgtggatcaatcatgtaaagtggaaatcttggcttagtccaattggtttaatcaccctgaattacaactctagtgaagaaattacagtcaccctgtgcttctaatgcttaaagttgctgatgatccaatgttgtctaagaatattttaaaggactattttgtgcataagcaactttcccagcaaaggttaaacaaaatgtatactatttcttatgtttataagtaaatcattatttgaagtatgtttgatctcccaggttattttctagtagatgtctactttcagactatatttaaacaaacaaacaaacaaaaacagaataaatgtgtttaggagcttcatttaccatttctcttcttgttgattggtaatatcagtattttcatttaataatgaaatgtctgttcaaatatgtttaacacaaagctctccaaatttatttatactgagaattcttttagttattaacactagccttctctcatatcaggattcgatatgttgcccttaccagtagcagtgtcaaactctacacagtttctttcagcatctaccatggtgatttcacatcatcactttcaactcgtttcttgaaattaatttattctacaacctcagttatatttcaaaaatttaaatatattgagctggcaagctataggcagatgtacttataaacacataccatgaacgtttaataatttaaagacagtggatttaattatgtaatgtgtaggggaatacaattctcaataaccatatctctcttttcaaaaggttattttattcatggttaataaaatgcaaccctcagaagatagaatttgataaaccctcttctttgaattaatttattgtcctgttatcattgttaactgtgtttatgaaagataatctaaggatatcacaggaattagataaagaagtgctctgaagtcaccttcatccgggtgatggactgaaaactgtgattgaaaattgtagccaacttaaggaaaaacaaaataaaaaaggaaatcactgtcgcatagaagtatagttttggaggttgaacccttataaatcgtattgatacgaaacctgcacctgagccacagtgaatcatgccacttggattatatttaatggcaattggaaatatccttgttccttatgtttttattgtatggcactgttttgtggctcaccacagaaagtcaagtttattgggaaataaattttcagagtttcatatgttgtctttaaggaaacagtagtcaccacctgccacttgacacccactgatgtcatttttcttcccaatcaaaaaagcaggtcagcaatttcctagcaggacaacagtactaaaggattcttttcccttctgcgttgtcttgtgggtaggacttacacttagtaggacacagggcatatatttttaaatgtactaagctattttctctatgaaagaaaaagaacatatatacatattacttttttaaggtttgaagcacagagttgagtgtatatttacataaaatttttgttacttgtagaaattgtataatcattttgctttacctggaacattctactctcatttcccttcacctactcatgctgatcctcactattctactctatacctttacgaatcctttagatccagatttcattctactttctccaggatgttggcaacacatgcttccatgtacatgttccatgttccaaaaacagcttgtaggcaacatacattatacaaatgacatatgtcctagggtgttttccttgctcaacttgaagttcccaactctatcttgtgatcaatagtatcatcacctatgatattcaaggcaaagtaaacaactctatgtttcttatgtcagactaaagaatttgtgtgatgctctgaatataggacgttcatacagcagagaaaataatgtgacataatgtaatgttcctacaaataaatacgacctaaatgttgtattaatgaatacattaattaatgtattcattaataaattaatacagccaaagtagagtcccttagatgctacatgtcactaggtactgcaagagttatccacaaaacctgtaacaccttagaaatataaaatctgactatcacgatcattcagtgggtaaaacacctgcttcacaagcttctgtacctgggttcgaatccccagaattcatgtaaagcatgagagggaggcaaggagggagggagaagacatagacacaaagggagacaaaaagacacagcaagacagagaaatacaaaatctattcccacccaagatcctgagtttgaataaagctttgccatgattcccagatgatttggggagtattaaatgtgaatacgcagtgctccaagtgaattgtgtcttgtactctatctttgtgaagtagtgaaaaggataaaaaatgggatcctgtgaaaaatgttcccattagtatctattgatactgccattattccagtcatttctatgcagtctctttcaaaaatgactggttcacagtagacgtcctggtattctgtctcttccaaccccctcttttgcaatgttccctgatccacacatgtaagatctttaatatagatacacctattagaattcatctcccccaaatctgccaatctctgcattgtatccaattgtgtgtttctctgatgttctccactgctataaatagaggtttctatgacaagtatgctcactacactgtcctgtgggtataaggataaaatttgaaatgtagtaaggaattatgcgggtctagtaaaataaacccagtacattcttttctaagattcatgacattagtagccatacaaatctgattagtattttagtaatgattgctgggagaagaattagctttccccagagataacccccccaatagttgccaaatacagagtggtcatccctgaaaatatatacacccaaacagcaaaaatggactatgcaagttactgttgagttttgaacccaagaataaacagatgacattcagaagatgaccttgtcaggcatcactgagaaaagaagccttggtcttgtgaaggctgatgccccagtgtaggggaatgccagggtggtgaggtggttgggggagtatcctcataggagcagggggagggggatgagatggggagtttgtggaggggaatcagggaagggggataacatttgaaatgtaaataaagaaaatatccaatacatacatacatacatacatacatacatacatacataaacaaacagatgacgttttcatattacacattccaatgcaggccttgtttctggttttcccagctgccctcagtctatacctggcataacccactctctaccctgaactttccaacttaggaggtagggtgcccttccaccagggccacttctatttataacacattttggtctccctctcccttagctctcttttctttccctctctcttcacatgcacgcactttctttctcttgcccctcgcttctgtttcccactccatggcaacttccctggactcattccttgggaccagttaactcaacctgcctgagagcacatgcccaataatcctgcttatatatactctaatctggcttgaattggctcattcttaccagccagagaaataacttatcagttgtatttatatattcatacatacacataaatatctgtgtgtgtgtgtgtgtaacaatactaatcagaaagaaaatgagtctatcaccttgagtgtggcaaaaaatattggaggggttggagtgagggtacccagaagaggctagagggagaaagggatgggggagaggtgtgacatacttttattttaattaaaaacattggtcattaaaatgcattaaacaaggagagggaattagcttatatttatctgacataatattactatttcagaatctccagcccatccaacatagtattactatcttagaatctcaagtctaaaatgaatcaaagtgctgagatttttgagattttatattatctaatggttataagcaatttcaccgcattaatatatctgtctcacatgcatgtgtggtgtctgtgaacgccagaagacagcatcagaagacatgcacctggagatacagatgattataaactgtcaagtaggttctggaaacgaaacctggccctctgcctgagccccaaaacattattttaaaattaagataaaatgtacttttaaaaatttataataaataaatttacatctatatttacaacacctcttcaagtatacagtgacactataatagtagtggactctaccagtcaccttaccgtttgtcatacacagattttttttttttagaacacagcctcagagattctaaattataaagatatcttgtgaagtccatggttctgccatttattgagctgcatagatcttgatacaggtttctgttgaaactaatttttaaaaaaaaagttgtatttgacaatatggggggaagatgcaatataaatgtgttaaaatgagcactatcttgatcagacctgtagtcagcttgctaaatgtccaaaatcaactggtatgtaacttatactcgcaggacctgataaagaacatggcttgccttaagtaaaattttatttatatttaccaaagatttactattggtgacattattgtcaacacgaattattggttctagagaaggaactatagttaaaagccttagctctcctagagtctttcactggatatactcaaaacagaacataaagctggtcagcctttccccttgaatactctcattctattcaacagcacagtccatcaaaaccaagataatagtacctttctcttcacaatccattgagtgttggctatcctgagcattttaaatgcttgagaataaatttggtccattttgctcctattgtcaggcagcagataatgaggttaagtaattaggtacattggaaatgatcatctagaatttatattgaaatactaagatgctataaacataaaaatacttattgttgtaccttggaaaaatatttcctaatgtaacttagaaaacagattatataagcctgttatggcactaaaagtcattttcctagttctaagtaacgattccactgagcactgcattggaacaggatttcttttcaatgagctcagtatctagagagaagcttatgagagctattgggtgcataatgtgtttccccaagaacagaacaagaaatctgagttgacaaagatgaattttttaattctactttgcctgttaatagtaattaaacatttaatgcttattctgttccttgtgtcactatgtcatcccaggaggagagaagcataaaatagagattctcaaagaatttaaacaccactacaaaatgaaaacaagagtcctactaagcaaggtagacatagtaatggatgacccacaagtaccaagtggccctgttttgagaggcaagataactattaagaactgttaaatcaactgatgttttataggcaacaaatagagtcaagtttagtcacctcctttaaagcaagagtgatttttgctgaaagtgctaaaaatatgtgaattgcatcccatgtactgcttccatatttcatgaaataggagaaaataaattcatcagttttactcaaagtcatgcattgtgaaagatacttgaagaaccatcaacaattttgtgaaatgaggcaaagatggcagaaaggcagaagtggtaaaaggaataaggggatcaaggaggaaacagcagtgaactatagttaatttacttgtagattctaaatggagtggaaaaccaaattccttatcctcttaagcactgaaagcatttcaaaggccaggcagaacaactggctctaggagagaagggagggaggggaggctgcagccaggaggtatgctgtgaaagaggaatgaaaaaggaaccaataacaaggggcaactggttctcaagaagcagagtgtttggtaaacctgtttagcaaggtaatgaacttgttcagggcctggaaatgtagatgacaacacacattgaattaaaaacatcgtttcatttggaaaacaaaacagtacttcaaggtaaaaacaaagagggctgtttattaaaggtgctatgtaattgcaggatagcaattggaatgcctaccataatttatttctctcaagttttgatgaggagaaaactgataaccccaaatgagacaatccatacattttaagtttttattactatgggaatctgcatggttgacagaaaaaaaagtttagctatcacataataagtaatacaatttcaggaattgtaccacttactacaggaaaatcttttttttttaatacatttttttatttattacgtattttcctcaattacatttccaatgctatcccaaaagccccccataccctcccccccacttccctgcccacccattcccatttttttggccctggcgttcccctgtactggggcatataaagtttgtgtgtccaatgggcctctctttccagtgatggccaactaggccaacttttgatacatatgtagctagagtcaagacctctggggtactggttagttcataatgttgttgcacctacagggttgtagatctctttagctccttggatactttctctagctcctccattgggggccctgtgatccatccaatagctgactgtgagcatccacttatgtgtttgctaggccccggcctagtctcagaagagacagctatatctgggtcctttcagcaaaatcttgctagtgtatgcaatggtgtcagcgtttggaagctgattatggggtggatccctagatatggcagtctctagatggttcatccttttgtcacggctccaaactttgtctctgtaacttcttccatgggtgttttgttcccaattcgaagaagtgtccacactttggtcttcattcttctagagtttcatgcatttggcaaattgtatcttatatcttgggtatcctaagttttgggctaatatccacttatcagtgagtacatattgtgtgagttcctttgtgattgggttacctcgctcagagtcggctgacacccgccagctacccacaacacccgccacaggaaaatctttttttttttttgttagaaaacagtatgtttattggttattcatattttatatcctttttaaattattttttattttttattaggtattttcctcatttacattttcaatgctatcccaaaggtcccccatacccacccgcccaatcccctacccacccactccccctttttggccctggcgttcccatgtactggggtatataaagtttgcaagtccaatgggcctctctttgcagtgatggccaactaggccatcttttgatacatatgcagctaaagacaagagctcccgggtactggttagttcatattgttgttccacctatagggttgcagttcccaatagctccttgggtaattactctagctcctccattaggggctgtgtgacccatccaatagctgactgtgatcatccacttctgtgtttgctaggccccagcatagtctcacaagagagagctataactgggtcctttcagcgaaatcttgctagtgtatgcaatggtgtcagcatttggaagctgattatgggatggatccctaatggaatgactgtaagtgattgtgtcaagattctgtacagtttgatagacccaaggaaaatatgggtttttttttgggggggggatatagttccttggtgttctggcctctgtcctagaaatcttgataattagttgagtgaaaagagaatgctatagaataggttttgtccttttgtaaattaatgtatagaaaccctattcttggatatggaaatgtgggacattttgtgggttattacatttaggtgaggtttttgtgattttggtggaagtgggttgttgaagtgtcccatgattaatgtgtggagtttgatatgtgatttaagctttagtaatgtatattttatgaatgtgggtgcacttgcatttggggtatagatgttcagaactgagacatcattgtgatgtattttttcttgattaatatggcatgtccttctccacatttatttcaaggtgaatcatactttttgttgatcaaaatagcaacatagataccatgcaaaaattattaccatactcaaatcatcttccctacacccacacagatgtccataagtgtgccttattaatctactagctgtctgtcaattcaatcaaaattaacaatcagaacaaagggtataaatattgcaggattttacataacctttggcaagtctcagtatcaagataatgttatcattataatgtgtcttattcagtaaacagaaaactgtttgggagtctccatggtaaataaaatatgtagtaatacacacacacacacacgagtatgtgtgtgtgtgtgtgtgtgtatgagagagagagagagagagagagagagagagagagagagagagagagagagagagaacgctagattactcacctgcttgccaagataggtcataacccatgctctgcatgcatagcttttgagaagccttaggctaccagaaatggtacaaaaagcaattgttcatgattggtactcctttgtgctaacttttgtccactctttcttaataacagggaacacatgttgcttgctgaggaaggctttttgcttcataggagtccttgctttcatgtacagaatccaaactccctcaatattgtagctgagtttagttttagtttaaactctattgctaatttatttcagcctctattttttactttcttgaaccaaaaggacaaaaggcaccgtgctcctccccccacccaccccccctctctctctctctctgtatgtgtgtgcgtatgcattttgtatcaaccaagaaacatatggggggactttctccacccatcttaggtaatggttagagacatgtaataatttctatttactcattttttccttgcagatattttgcatacatatgtacacacacacacacacacacacacacacacacacacacacatgaatgacagggttttactcttctgagctctcaggtacaaaatctctggaggtaattttgagcacagaaaaatcttttccatggtaaccatgtacctattttgatcaacaaaaagtgtaaattaaatttaaataagtacagcaaatcatattctaacagtactcctgtcctgctctagaaaattaaatgttaaagtggcatgttcacttcaccataacatattattacctaactaaaattataatgtatagccatgcattataaaactataataaggataattatttattagaaaattatatgcgtgtctgtgcatgtataaataaatagccaagcattcttgatctcctttgtcaaattgtattgttattaatcctctagattttcacttggggtcatcaaataggcaattacactctgattagcacatgttgtgatgttttagaatgcagaacatttcaaaaacattatatgtacttgctgaattaagaaaattttaaaccatatggtatcccctgtcttttaatcttgtacagttgtacatcattgtgaacttaagagtctagtcctattaaccatatttaatattcattgtcaacttaaatgagtttagaatcaccatggaaatacccacttgggtatacttgtgataatgtttccagatatatttaactgaggagataaaaacccatccatggtccaagtttgtgcactgaataaatgagcaaagccaactgagcaataatgttcttcaattcattccattactcctttctccttcttgactgtaaagaccaactgaggatcattctcacattcttgcatccatgatttccccatcactatgggctgttctcttcaactgagaacaaaatgaacccttccttccataaatcactttgctcatagcagttttgtcacagcaacaagaaaaactaatgttccgtttaaactaatttatactcctaatttttattgagatctttttattttgttgttcgaagcaggatcttaccaagattagctcctaatttgtaatgctctcttttcagcctcctctgtaactgggattacacactaccatgcctggctaatgaagattgttctgttattcttataactttcttatttgtgatgctgagaattaactagtgcttagtgcatgctacagcaatgctttttcactgaactacatactcagtcattgatttattctgagttaaataaatgtctgatttttaaagtttcttccatgtttattactgatcatcagtgtgaattataatacttcataatattatagactcaaaatactcattattaacaggtcagtctgcatactttctcaaatagcattttgttgggaatctcaaagggaagtacagattccagtagcattattattattcataagggtgttctgtagcaccttataatcatataatagtatgcatcaagaacagaagtatattttaaaagtagtatctgttggtcaatatgttaaccttatttgaacgatttaaggaaagaggttctgagaggtcaaaccacatgtccagcttatacgaagttattgccagagattgaattctcaaggctgcgatcccatactctatccactcctgtcactcagctctcagccatcaaggatttactataatcagaactaaaaacagcaggaccttcttcacttgtgatgtaccaaagagataaggtccaatcacttgacagaatggattgaggttgattggatctgaatgacataggccagatgatttaaaagactgttttattttgtccatacctgaagcagctgctgaagtactttatttagaaaaaaaagttgcaaaaagatatttattgaattttcctgtttcaaatatggcactttaatgtctagctgataatattttttatttgatgaacagagctaaaaatgatcctaatcaacatcaacaactttccttcataattttgtatattgtggtactctgttttattacacacacaccccacacacacattaacaaaagcaccttcgtttttgtctgtatgaagcctttcaaacatagctcccaaagtagagagagcatgacatttttgttcctataactagaattaaatttatgtcaccattttgccatgtttagttcatatacactttttgctttgcttttcaaactttatgattttttttgtgctaatgaaacaaaatgtttaacaactgatagagattttctcctcccctaccattttagttccagagttagctattatctggaagctgcatttgtttaacgtggttggtatgtagatggaaagcctgtcttttcatctaatggtaaaaatctctccatgtagccagatgactgatcattttctcaaagtttaacaaggtgattatttctcaaacatgtcagaaacatcactggcggagactgcggtacatagggaagcaggctacccgggcctgatctggggcacaagtcccttccactcaactcgagccccgggctaccttgccagcagagtcttgcccaacacccgcaagggcccacacgggactccccacgggatcctaagacctctggtgagtggaacatagcgcctgccccaatccaatcgcgtggaacctgagactgcggtacatagggaagcaggctacccgggcctgatctggggcacaagtcctttcagctcgagtcgagccctgggctaccttgccagcagagtcttgcccaacacccccaagggcccacacgggaccccccacgggatcctaagacctctggtgagtggaacacagcgcctgccccaatccaatcacgcggaacctgagactgcggtacatagggaagcaggctacccgggcctgatctggggcacaagtcccttccactccactcgagccccgggctaccttgccagcggagtcgcctgacacccgcaagggcccagacaggattccacaggagatcctaagacctctagtgagtggaacacaacttctgccaggagtctggttcgaacaccagatatctgggtacctgccctgcaagaagagagcttgcctgcagagaatactctgcccactgaaactaaggagagtgctaccctccaggtctgcttatagaggctaacagagtcacctgaagaacaagctcttaacagtgacaactaaaacagctagcttcagagattaccagatggcgaaaggcaaacgtaagaatcctactaacaaaaagcaagaccactcaccatcatcagaacgcagcactcccaccctacctagtcctgggcaccccaacacaaccgaaaatctagacacagatttaaaaacatttctcatgatgatgatagaggacatcaagaaggactttcataagtcacttaaagaattacaggagagcactgctaaagagttacaggcccttaaagaaaagcaggaaaacacagccaaacaggtagaaatcattaaagaaaaacaggaaaacacatccaaacaggtgatggaaatgaacaaaaccatactagaactaaaaggggaagtagacacaatagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcctacagaactccaaacagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggatagatgttatacagacactaagagaacacaaatgccagcccaggctactatacccggccaaactctcaattaccatagatggagaaatcaaagtattccacgacaaaaacaaattcacacaatatctttccatgaatccagcccttcaaaggataataacagaaaagaagcaatacaaggacggaaatcacgccctagaacaaccaagaagtaatcattcaacaaaccaaaaagaagacagccacaagaacagaatgccaactctaacaacaaaaataaaaggaagcaacaattacttttccttaatgtctcttcatatcaatggactcaattccccaataaaaagacatagactaacagactggctacacaaacaggacccaacattctgttgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatattcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcatcaatggacagatcgtggaaacagaaactaaacagggacacagtgaaactaacagaagttatgaaacaaatggacctgacagatatctacagaacattttatcctaaaacaaaaggatataccttcttctcagcacctcatgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagacttcttagagtttaatgaaaatgaagccacaacgtaaacaaacctatgggacacaatgaaagcatttctaagagggaaactcatagctctgagtgcctccaaaaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccagttaccaaagttgaatcaggatcaagttgatcatctaaacagtcccatatcacctaaagaaatagaagcagttattaatagtctcccaaccaaaaaaagcccaggaccagatgggtttagtgcagagttctatcagaccttcaaagaagatctaattccagttctgcacaaactatttcacaaaatagaagtagaaggtactctacccaactcattttatgaagccactattactctgatacctaaaccacagaaagacccaacaaagatagagaacttcagaccaatttctcttatgaatatcgatgcaaaaatcctcaataaaattctcgctacccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagtgttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaagtgaaagatctgtatgataaaaacttcaaatctctgaagaaagaaattaaggaagatctcagaagatggaaagatctcccatgctcatggattggcaggatcaacattgtaaaaatggctatcttgccaaaagcaatctacagattcaatgcaatccccatcaaaattccaactcaattcttcaccgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaaaagaccaccaacagattgggaaaggatctttacctatcctaaatcagataggggactaatatccaacatatataaagagctcaagaaggtggacttcagaaaatcaaataaccccattaaaaaatggggctcagaactgaacaaagaattctcacctgaggaataccgaatggcagagaaacacctgaaaaaatgttcaacatccttaatcatcagggaaatgcaaatcaaaacaaccctgagatttcacctcacaccagtcagaatggctaagatcaaaaattcaggtgacagcagatgctggcgtggatgtagagaaagaggaacactcctccattattggtgggagtgcaggcttgtacaaccactctggaaatcagtctggcggttcctcagaaaattggacatagtactaccggaggatccagcaatacctctcctgggcatatatccagaagatgccccaactggtaagaaggacacatgctccactatgttcatagcagccttatttataatagccagaagctagaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtactcactgataagtggatattagccccaaacctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttatcaaaaggacccagatgtagctgtctcttgtgagactatgccggggcctagcaaacacagaagtggatgctcacagtcagctaatggatggatcatagggctcccaatggaggagctagagaaagtagccaaggagctaaagggatctgcaaccctataggtggaacaacattatgaactaaccagtaccccggagctcttgactctagctgcatatatatcaaaagatggcctagtcggccatcactggaaagagaggcccattggacttgcaaactttatatgccccagtacaggggaacaccagggccaaaaagggggagtgggtgggcaggggagtgggggtgggtggatatgggggacttttggtatagcattggaaatgtaaatgtgctaaatacctaataaaaaatggaaaaaaaactcaaaaaaaaaaaagaagaaaaaagaaacatcactggccatcttttatcctattctatttcattaagtgtgagttgtatattgtctgattgtgaaggatgtcagaaagcatatttttccaatatatattaatgtgcttttggttttgtcacctaactaggtagcagttaatatccatatctgtaagttgtaaaagtctttgtagctcttctttttgactaacctataattaagctagtgttaaatttaaaatatttttcctttgttcacagcccatctttatgagtttcaataattccctttgccaaactttgggcagcaaataactcagatataatggaattcatgtcacattcactcaaatgtgattgcttaggatttgtggatgctattctgctacatttagaggcagcatttatacagtttcaaagtaactaagccattttgcacttcattgatctttactagagaacagttctgcatgtgctccctctatccataaagccatatccagctttttacatataataagcaagtagtatttttgcaaactccattttataaatacttgagacactgaaccaattgatctagtaataatacagaaaacatggtgcatgttattgcgactagatggcaaaacttataattcactctagaattaatactttagtagactgaagccagtgagaagctcagaaaaaataatctatgaagctcacaagtcatacagttagcaaactagtatcagtacaggaaggattagaatcaacagcaagtccaaaatagagtaaatttgaattagaataaataaccaaactcagaaatccaaaacaagtagaaagttatgatcaaatagcaattagctaggagcccatgaggatacactcagttttcttaaggaagtcatttcatttatctgaccttcaatgacatcatctataagtacaaagattttcttattagcaaaagctgttttggaatttttgttgctgctttcaacatttttagttctcattctaaggtgcaaaataacacatagaactgttaaaaccagacatcagagaagctgtctacttctatgaaattgtaaaacaactatcaagaaaaaaattaacagactatttaggtctattttatcaagcattatacattttccagagtttaggatacacagggttagaaaaaatacaaggaaattacttcactactaagaaagaactaagactatactctgcctgttctacaaatggtgatcagacaaagtagtaaagagttctcatgaagaatatgggaagaaggggagtaaagaagaaaagaagagaaactataaaattttgagttaaaaattttaaggaaggttgaagagaggttcaaaaatttattgcaataagtattgtgttggccctaggaataaatgatagagcattactaaaagcaatataattattttcctgattggttacaaatgttatgtaggtacatacagtagaatagcttaagtaaaaactattagtataaaattgctttgtatatcctcaatattataacacagatttataaataaatctgttgcctttactgcaatgtcaccaagttacctatgatcctgctaaaatttttgaatagaaagtcaccatgagagtttacatggctcatcctatatatttttgtacttgaaacccaactctgcctcccttccccaactacctagtaggtactcaacaacaatgccctcaaagctacttttaagaaatggttaaatgggatgattccactgaggaaagagattccaatgatcatttctcacttgtaggggcccagattttgcttttatttctttaattttaatatttcccattaacttgaatcatttatgaaggtaaattgtgccaagtcttggtgaccagattaactggaaacaaaccagtgacctcctagaagctaatgtggagaatgtgtcctgttgctcccaaaaggatggaaaagatgaacacttaggctaagaggttaataaaaactagaggagaatatggtaatgaattcattcgtagggcagaagtatatttgaacattttgtaatatatatataaaacatttataaatatcaactaatgtatatttaatgaatatggcaaggattatactacctaatacataaacattatattttataattatgatctgctcactgggcaacatttcacagatgaaaggtcaaggctgagaaaacactttgtagaagcataaaagccccaaatgcatcttttatagcacttttagcatactggattactgtatttactcatgttcacttcaatcctttaattttgcaaaggaaaaaaatattcacccttgttgtttcaggcaaaagatattcactaagtagctcctatgggctcaggtgtctgactggacagatcagatatttcagaaagtaggattaatataaggaaaaatcagaggcatggcagattatagagttactggagaaactaaggcttattcagtttaaccaaagagaacagtgcctaagtagtggtgtaaatgaggctagagaagatgggggcttctttataatagaccttctggagtggattttattctgaaggtagaggggagcaggaaattgaagtgattacatttgcataacaaaaatctcagtctagcaactaaaaaataaagattgaaatgtgggtacatctagaaaaaagatagccatttcagaggttatcttattggttcaaatatgggtttagacaaaaactatgaaagaaaatgagttgaagactcacaaagtgatgatacagaggccctgtgataaaacaataggctttgaagtcccccagaaatcatattaaatttcaccaatattattcattggctcttagtaatgttaacttttctgggtctacagttaatgagattcaatacctcgtgtgagtgctttgatcaagtggtttgatcataggagaatatatactctcatttgtattttgatatcgagtatatgatttaaaaataaaatactggccctatccaatatgtaagtaacctttagctgttcttgctaattttagtcagtcaaacagaacatataatttcctttgagttcacttggtgcccttattaatattttgctattttatgtatattttatattttttgccatttctatatgtgtgtacaatacatgttaccacactcacttgcaccatgcttcgtacccaactcagtccaatcattgtgttatactttagcagtaataataattataatttaataatagtatgttaattgcaagaagccttctagacactgttccacaagttttccttatgtgtctacaatccttagatgaaatagataatattatcattaacattttatggaaaaggaagccaagcttacaaaacttaagcagggaggcctataagctgcaacatccgtgctcaacatgggcagtggcagtagggactccagagaccattattaccccctcattgctatgactaatactttttgcagctaagaacctgatcctcctaccttgatcattactgagtgctgctctatacaggtgtaattatgtctcccttaacattatttatttctctatgttgcctctgatgaaatccacacgcaggcagatatttctgttttgacagttgccttaagaagaacatgttttcattggtcctaattttgtttaagtttatcattatgaatatgcaccgagggcaatggcaagtattgcattgtaaaaagaggggagagtaaagaagtaaataaatgtaagaccttacttcttggatcttgagggactaagaggtgataaaggaaaacactgttaaaaattcatactagcaacttgtgttgtatattatgcatggagactaaactttttagtgtcttgacaaagccctggggcagcagagaggtaccttagagcagagaaagtgcatttgaaatggtaatgagaagtgagccccatgacaaagtgctagccactgaaatatttctctgagacaaacataaatttagagagggcagagagtcattgactgctgccagatgacctattttaaggcttctttttttcccctgggtatactcagatgacttcacagtgggtacaattttaataatgcaatagctgtccatctatttgaagtttgatgctaccatcttcacctcttatttcttgggataccaactttgagttttattgttttcaaatagcagcagcatcatgaaagccctctcaaggtttaggatacctttaatactgcttcctatttaaataaaattccaacacttttcttcatcatcctttaatagcatgacaatttgccttttctctggactgtagggtgaacagcacaagaagtcccttatgtgacacattcgtgttgcttcaaagtttggaaagtctcagccttctgtttcctggcaaaggaggccacgtccaaattttcaagggtcattgactaccatttctcaccccacacacatgcttggatattcagtggaatctatgagatagtattacaatgaatccctcaactcaactaggtattcctaacaattttgatgtagctaaaaatcttgaggtaagacaatgggagaaagatgataatgcctagggaattgttccaggctcagcgccttaagatattctgataaggaagttaggaatgcttcttgggttggagctaaagaaacagtcttcagagacagagcacccagaaaacagaacgaagctgtgagaatgtttcgtaggaacaaggaaggatggccagggccacgtagctccacaaaaagagggtcttgtgccaatacaaaacattaatttgaacctccaaatagtcaaaaacaaaacacctgaaaatttgaaacaaaagtaatttctggtaaaacatgctgcttttcattctccttcgagaaagtatgtggagttctgtgcacaaacatcaaaaaaaaaaaaaaaatgtatgccagagtgagcactgatggctaaagtcaccaacctgataataaaattgttggatatttttttcctcattatataaatgtctgaccccttcttccatacaggaacaaatttggacacacagtctctaacattccagcaaatacagctttttcctacatcaatggaggatcacagctttcatagccaaagactcccaattatttgttgggttcccactatctcacttgtcccaagccaattattttgtggtttttctgtttttaaaattgtgctgctgtgcaatgttgtcagcatttggaggctggttatgggatggatccccgggtatggcagtctctagatggtccatcctttcgtctcagctccaaactttgtctctgtaactccctccatgggtattttgttcccaattctaagaaggggcaaagtgcccacactttggtcttcattcttcttgagtttcatgtgttttgcaaattgtatcttatatcttgcacacactagcaagattttgctgaaaggaccctgatatagctgtctcttgtgaggctatgccggggcctagcaaacatagaagtgaatgctcacagtcagctattggatggaacacagggcccctaatggaggagctagagaaagtacccatggagctaaaggggtctgcaaccctataggtggaacaatatgaactaagcagtaccccctccccccgagctcgtgtctctagctgcatatgtatcagaagatagcttagtcggccatcagtggaaagagaggcccattggtcttgcaaactttatatgcctcagtataggggaacgccagggccaagaagtgggagtgggtgggtaggggagtcggggggagggtatgggggacttttgggatagcattggaaacgtaaatgaagaaaatacctcattaaaataaaataaaataaaaaattttaaaaaatgctggtgggaaaaaaaaagtgtggttgccttagcaaggccattgtcatagctaacaataaccttcttgatggtactccttgtacttcttccccatcaggctttccaaagctattatctaaatcctcttactgcatctcaaccctcattatgttctcagaacaactgtgctccaggaaggcatggggaaacagtccctctgcccagttcttcgaagcgaccacttatattcaggatttatgaacatagttccttcaaatatttttgacagaactcatgatggtagagccagagcaaagcaaataactggtttcagataaggctatcctctgctcacagtcagctattggatggatcacagggcccccaatggaggagctagagaaagtaaccaaggagctaaagggatctgcaaccctataggtggaacaataatatgaactaaccagtaccccccggagcttgtgtctctatctgcatatgtatcagaagatggcctagtcggccaccagtggaaagacaggcccattggtcgtgcaaactttatatgtctcagtacaggggaaccccagggccaagaagtaggagtgggtgggtgggggagcgtgtgggggacttttgggatagcattggaaatgtaaatgaaataaatacctaataaaaaaagatacaaaaaaaagataaggctatcctcagttgtccaattctggctctagatattaccactactattccttcaaaacatatatcatactccatatccaattgactaatgtaagcaatcccttggaagttattcaatttcccataataatttttaaatcccaccaggtcagaaccacatagcttcctgagaatcaaatatttctgtaatcagcatgccacataaaaaataccccacctcacccccaacatgcacaggttttatgtaaaatctaaagccactacaacaaatggctattgtataagacaggtaggatattgtgtgagtagaggtgtaacggaagtagagtttgtgataaatttccccacagattataacataatcaagtgtcttttaagcatgagcacagtcagaactttgagtttacagggcaagaaccctttgaggaaacagtaaagtaatccaagccaaactcctatttttcccactttgaaatctctcacctacaagctttgtcgacggattccttttaaagtagctgctagtcttgtttattatgcccctgagactaaaaatatgattgtttaaatgtgggatacctagaggacactgagtaagtctcatacatatcttttcatcatccagcacctgtgtactctcaatgaatattaagcaataagttctgaccctcttagctatacaagatgattccttgttttgagatgacatgccctgtgaataaacaataattccttcattttccatggctgtcaagctggcatctttgatcagaactaaatttgctttaagtagttgaatgcctaacagttttaacagaaaatctctcattacctttatctattcaaaaaatgtaaaacatagtgttatatttagcaggaaagaaataagtcctgaatcacagtgtcagcttcatcatttccttaatggtgtaatggtgattatttttaccataatcttcttctggctgttagcccagggtgggaaatgacatcgttacattgttaaataaatgacagtggagacattccggggtttgtttttcccccaaaggatctgtacatatgtatgtgggaagagtgtgggtgtaatcctcaggacagaaatttcctacctactattttcataataattcataaaaacttgaattttaacacttgtcgttcaaaccttggaaatattctctaatcctcaacagtgtttcaaaaaaatataaacaccatggtgtatttgaaaccactaaacaaacttacactcatgtatattttgtggcttcttaatttgtattttttttctttttcactcaaaagtcattttctcataataaagagaggtacaggtatatacagaatgagttcctttcttacccttcgtctctatgataatcatccttactgtttttgtctattcaaatatatacagttctaaaaatagcagcttctttgaaaagggtctaattggcatgagctgctcttgctgtcatgctgaagtcctgccgacaaggtgaaggttggcagaaaaacaaataaaagcaactgataaatgtcagaagtaagttgtagtaaaaacatcctgttttgttcatttggataaaagggcaagtgcaatgtacatcaatttttttccttagagagttctcaacagatagattgaaaatccccattgagaactaagtttatgtcttatttagttatacttaaaagtatataacatccatagtagtaagagtagagtgtatatcaggcactacaatgtttagcagattgaagagttattatggaaaatctgtttcaaaaggataatattcaaacatattatttcactactatacacacttagttattaacatcagagcaaaataatgattaggatgttataggaaacaagcctgagatgagataagtaaagactcaaaataagacttcactggaaaatagacataaatggctgttaattaaagcccattttaatttgattttactagattgtatttcaaggtctgttgcattcttttctgattatgactccctctgttttatcctaagtttgaatttcctattttctttctctcatctgcctactgtaccattggggcactccatattttaaaagtacctttttgttgaagtatattaatttaaaagatgtttgttattaatagtttgcttcttttggtcattgtgtaacactacttcaaataaattttttttgtttgtttgtttgttttgggttttttttttttggaatgggaaaacctgtgaagaacaaattctaatcaaggatattttaatttacatgttgattttttaaaaacataataaggcaaagaacttctaagttagcattataaatatataattcttgtaataagaaaacatgctacttctcaaatttgacatttctttcaggaccaggaggtcagggatttctctctctctctctctctctctctctctctctctctatatatatatatatatatatatatatatatatatatatatgtgtgtgtgtgtgtgtgtgtgtgtgtgtgtgtgtacatatatgtgtgtgtgtgtgtgtgtgtgtctgtatagtagaaatcatttgctagaaaggttacagaccttggatctaagccaatgatctatagggcttgaatcaaatgttcttaaaggatctccttagattcacttatctttcaaatgaagttatttcagcccctttcagattcagtgtatgaatgccctttgttgggcagtattcataatcctacaaaagagagcaatgccgagtttctcatccagaaaaagaaaagaaaagaagagaaaagaagagaaaagaaaagaaacaaataaaagaggttgacaaaaatgaataaataagtctacctaccattttaacatattcacccttcatgacttcttttattcttgtaaggactctgcagtttaaagagaacacacagatttcttttgcatttttgtaaataccaataatgtaagagacaaccaaagaatatattagtgagcaagatgtatctttgcaaacataggttctattaataaaagttacaaaataccattaaagggtgggttttttccttattttgcagaaactagataatcactttggaaaagttaaaagcataaattagtgtattttgaaaatacagaagcatataaaaattcaaggaagtaaaatttgaagaaaagctaggaaccgtttcacatatttactgtcaagctttttatgttttgcataatttgggtcatgttatttatgtccttgtacatcttgccatttggttaacagtcacatttaagttataaaaccagtaaatagttttgtgacagtccatataattgttcttttatgatctgtaatttacataaatgtcccccatctgatggatttgtaaggtgtcttcaattttctacactctaagttaagccgtctattgttatcaatcttttcctctttcatatgtacccagtagcgcttacagaaataaaagtaacaggtcaaacagaatgaatgttcttaaatatctgtaatatggttgcaaattaattttcagaaaaacaactatggcagattaaggaccatattctgtgctttgtactcttacaatgtaagtaaaacttccttcaccctttgccattgagaattactaagcattggttcatgtaagaatacttagccctaactcacattttatatcattaaagcaaagagtaaaaacaagagacattcaggcagctttaaaaaaatattagtgcttagttaatgcttgatttgctatatttgttatacttttaagaactttatagttcatgcacataaagtaagggctgtgcagtggtgttaaaaatgttcagcttgtgtctttctggtttgctacactgctcacttttcacgtagaagtcaacaaagaaagttcatatgaatcagtatggaaagtcaagtatgagagagtagttgtcagttttcactaatagattacgatttgatctacaattatcccttttgtgtagttgaaatatcttttctaaaataaagacagactcattgtcagtttcttgaaatttatgtttggaaaggcaagagttgaaaaaggagaataatttatatctagaaatccccaagttgggaaaagttttacccttaaaaagaatatgactctgatcttaatatgtaaaaaaggaaaatttcacactagtagtagtacatgggaaatggcttgtgatctaaaatgttattgtatatgtatattattttatatgttaagaataccttcacagcaggtaaaccatgaagaacaagctaatcagacttgtttcaagttttggtaacatgaggcaagctaacatttaatttatcagaaacatttttctatttttcctcttccttctcttcttccctcttcccaaaaccttttggtaagagtttgacagaaacacaaatgtctcataaaatgtgataaacatatttctaaacttagcacaggtagccataaatctaaatttatttgtgtacttcacgaatatggatgttctgtcagcatgcacacctgtataccagaaaagggcatcagatcccattacagatggttgtgagctgccatgtggtgctcagaattgaactcaggtcctcttgaatagcagccagtgctagaaacctttgagtcagctcttcagtctcatgtaggcataaatggagtaaacacaaatgtataaagagaaatatacaagggaagccaataatgttgttttgactcaatcaatcatggaatagccatatcctacaatataattcgtcattaaaaatggatagatgacatttctatgttgagtggtaaatacattacaataaaatagcatctacaggatgatcatttcttttaaaaaaatatgtgtttaaatcaaccagaagaagaccactgtactatggttgcttctagtcttcattctctttaaattattataggaatttatcttataaagatagtatgttgattttttttcctatcctttccacatagactggcaagatcaatgtgcccctcaccccatccctgagatgcttctattttcaggagataatcattaacacagatggccacatcttcccaaagtatagagaatataggactcagaatgctcagtctgaagagaaaaggtatactgcattgccttctcccaaggcttagagatcattatggaagtggcagtataaggagtatgagaaccaggggcagtagacaattataaggaagcatattctgggcatagtaacagcatgaaagttatacatatgacctcacagtgattgcaacaccatgcacaaaacctatggaagcccaaatcagaccaaatcccggtgtgaagtggatagttatatgcacacaatctcaccagtacctgtgcagctaatggcagttgttggcttctggaaaatagacaactttctctaagaatgcagtccctcataagttgaccacactccagttgaagaccacacatccaagaatacttgggcagcacaaattgcccttgaagggcattacaaaataaataaataaacaaaaattgggtgagtacgctttggagcatagcttatggaagaattagaggaggggtataaacattaaactcaagagaacgaagaccaaagtgtggacactttgccccttcttagaataggaaacaaaacacacatggaaggagttacagagacaaaatttggaagtgtgacgaaaggatggaccatctagtgattgccatatccagagatccatcccatgatcagcttccaaacgctgacaccattgcatacactagcaagattttgctgaaaggacccagatatagctgtctcttgtgagactatgccagggcctagcaaacacagaaatggatgctcacagtcagctattgaatggaccacagggcccccaatggaggaactagagaaagcacccaaggaactaaagggaactgcaaccctataggtggaacaacaatatgaactaagcagtaccccggagctcttgtctctagctgcatatgtatcaaaagatggcctagtcggccatcactgcaaagagaggcccattgggcttgcaaactttatatgctccagtacaggggaacaccagggccaaaaagggggagtgggtgggtaggggagtaggggggtgggtatgggggacttttggtatagcattggaaatgtaaatgagctaaatacctaataaaaatggaaaaaatataatcaaaacatggtatgcaacttaaaactctcagagaaacattttttatataaatctgatgtaaaattctgatatcaaatattgtcaactggacagaacctaaaatcaagtaggagacatacctctgggcatgtctatgatggtagtttcagatcatattaactgaggtggaaaaacccacatcaaatgtgagaagcacctttctattgtttggggtccttaacagaatgaaaaagataaaagtgaattcagcactagaattcagcattctctacctcctgattgtataacaggttctgtgccttgctctgtcttggtgtcctatataattgacatataaaataaagtaacacattccttaaattgtttttgtaaggtattctgaaacaacaaaatagaaagtaactaccatagaaaaatattacttttataaatttaaaatatttccagaaaatgaagaaaaattactatacaaaaatagtgtatttggatgcttctctttaggactacaaataaaaaaacatttccaagtgtctgatttttttctcttaagtttctcctttgattagcacaagtaattaaactaaattaatggatgatgctaaaaagaagaaaaacatttcataaactgctgtgccccatcctctcagtcttccattgatttttgttgacaggaaaattatctcagccaaaaggtcctatgtgcaaatctgtaaggagatttgttttaaaaacgtatcttagaggtcaccattgcccaaagcaattactttccatgctgttcacccatctaagtgatttctttgaaaatttcaagcaattttctagttttcccaagtactagtacactgtcttataaaatagagcattgtaaatctaggggacattatagaattgtggtgatatgtaaagtaaaagaaatctcttaatgtaacagtgtaggtactattcaagtgattcttggtccatcagtactttattcaattaagcctttatgatagaacacaaagctattgacaatgggcactttcaaacagctgagttatgaatgtaaattattttacattaactacaatccattatcttcctgtatgttcttttgtgttacagaatattagaaatagaggacagcataaggtatgagacagtagattggagaaaacagttatcatgcgttcattttttaaacatcaatcctgaaacctatactctttttggtctctattgcctataacaaatgtgtacttgctccaggctcatatggttacaacagcatattatagacaagcagcatgcagctcaagtatttcagtccttcattcagtcaaaaagcactttaggagagagatcctacctcggaattgtaaaaggtacacaggagactaagatatgaactcaatactcatggagcttgctctgcttgaagagataagacatatacaaacagaactctgatatgattctgaaaaaataagagtcctgtgagaaagaagcaaacaagagatagcatgatagaaatttggaggcatatcagaaagtgttatgtggcaaaattatatgtgagttataaactaaaatatgaacaatgttttggcacaaatgaatggatgccatgagcacatgttaaaaaaacatcttaaacagtcttaagtattggctccatttattatgttgcaaaaggcttattcacggtaacaacatgacccaaaacagaatatcagtgcactatcatgtaatactctataggaggtttacggagcaaacacatccactgcatacagtttaaggctatgttagaacatggaattatatcgttcatattatttaatgagcacttaaatgaagagcagattgatccatatatgaaccaggactcagtgataagaattctacaagcgcagtcctatgattctattgtaactctgaatatctagtaatgaaggaatacattttgttggctagtaaaaagtctctcctccagcttatgttatcaccaaataatgtgttatctccatgccataggtacatcctagtaatctgacattgaaattcaccattctaagcagtgaattttctgttttacaaatagattcaacccaatatattcatgatttctgtgggtttttaagatagtcttgtgtagcccaggctattctctaactcacaagttagtagtgcctcaccttgaattcttgatttcccagtttccaccttcgcagcacttagattacaagtatgtgctactgtgcccagtcaaagacagtactgttactcttctctaaaatagaaaactatccccaaggcccacctcaattcagatctaagaaaaatgcctcaaataagtaatgttcacatacttgtccttagctatcccagactatgaagagataggttataaaacattgaataatcaaacaagtatatgcccccgaactgaattgtctttggtaaatatccctgacaataaagtgacaagggaaagttagttgaactattttcatttcatatgggccaaaattatgaaaatgtatatttcaaaatatacagttttaagattgttctcagatttcctaaacaacctgcagtgtatgttttgacaaaggatctttctatataagctcatcctgataagaccatagcacaactgttaatcgtatcatatcacaagtgctcctaatactgaaagaagataaacttctctgtgataggaagttcagagttagtgcattcctcaatgttgataaattatatttgatgaaggtattgatgaaaatgataaaaatagtgaaaataacaactacaaaagctgcatcatttttattaaccaaaaagataaatttcacaaagaccttttctctttttcttccctcccccctctcccccttttctcccaatcatatagagtaaagtctagaccatagctgtataaatcatgaaaaagtcttaaaacacacaatctgagaaatttgtaaaggaagcactgttctacactttttatttctgttattgcatttacttatcctacaaatctatgagaaacacaggctaaatagtcatactttcattaatataaataataagaaaatagatttagccttttcattggttttttaattaatagaaaattgtagccgggcgtggtggcgcacgcctttaatcccagcacttgggaggcagaggcaggtggatttctgagtttgaggccagcctggtctacaaagtgagttccatgacagccagggctatacagagaaaccctgtctcaaaaaaacaaaaaacaaaaaacaaaaaaaaaaaaacaaaaaaaagaaaagaaaagaaaagaaaaaagaaaaagaaaattgtacttcaattcttttttaatttaaactctttgtatggctaggcatgcactctgcctttaagctacacctgtggcccaattttaaccttttcaaactgcattatacaagaaaataatctcaggctctccagaccaaaaagagagcccataggggttcttcattaaataaaatgcacaaataattccataacattctctaaatggttttctttgttctttcttcaggtacagacgaaggtatattgttgtagtcttagggcatgtaatcttgtttacaccatccagttctcccatttgcttgtcgatagtccatcgagagacaacgtgatttctgaggacaaagcacaagcttcagaggatgaaaggacaggagaataatctttctttaagaggctgtgtgctttgggcatcttaagatttcagaacttttatttacttttagtacctcctttataaaaggagatgcaaaatagaagaagctttgtttggacagttgaacaagatagggtatgtaaagtttctctcaaatagttccacagctgtaagaattgtacaatgtgcactgcctcagttactttctactgccacgagaaaacctgaccaaaaaatacttagagacaaataatttgatgggggcttatagtttcagagggtgagcccttgaacttcatggaaaggagcatgtcagcaggcaggcaggtatagcagcggatgaatagttgagcgcttacctgctgagacacaaccataaatcggggcgggggggggtcgagagagagagagagagagagagagagagagagagagagagagagaacacagggaatagtgtgaagttttgacacctcaaagaccaccccacctccactgacacacctcctccaacaaggccacacctcctaaaccttccagaatagttcaaccaaggagagaccaagcatatatgaatctatggaggaagataatctcattcaaactgcctcatgtactctaaaggtaactgaaaaatatgacttgcctctgaaatataggaaatgtaatacataggtaagaacatattctttgaggtctggcagattttataaaaaagatatacaaacataactagaaagcatcttgttcttattacaaccaataataatggtaaacactaatcccaattgtttttactttaaaaccaaattagctgttttttacattttctatagacaattgtcttcattcaaaaataactgatgacttgtgattgtaaatcacaaagtcaagctggaaaatagccccttgatctgtagattgaaagcaaatttaggtaagtaaaaataacatgatttctgacatatatcttcaggcatccttataattattttagccctcatctttcccttttcttctgtatctctaactaaagcaccccttttcccattttccccattaaatcactcggtaccctactattcccctctctattattattcccctctcccacaatgccccgtttactttcctggcttctgtacttacttcaggttttatagttgcacctgaagatttggagttagggtccatagatggaagaaaatatgtgatgtttggatttctgaatcttggttacaccattcttatactcttttctggttctttccatttacctgcaaatttcataatttcattttatttacagctgtagtgttccatggagtatataaaacatgatttagctatccatttgttacataaaggatatttaagatatttccatttgctagatattattaataggcctgcaatggcatggctgaacaagtatctgtgaaataggatatgtgcatcttatggtagatttactttgagatttctgagggttcttcatagtgattttcagagttcctgggacagtttgcaatgttgctaacagtgaatgaggttttcattcacccccacatcctttataagatgtttgttgatatgtaatattttggctagagtaaaataaaagggaagctatacccatagtctcaccaacatggctgcctaaaaaagacctgaacactgatgacactaatagatattctgatgtaaaagaggtcaatctcatagggcaccaacactagacaaagagctacaggcaaggaaggaatgcttaaagaagggaaaatagtcttctttggaagaagagccacacattcgttatccaaaaccaaatgatcatccttaaatttatatatgcacataattaacataatactcacagacagagtaggatgtatttatgtatttagggaaaggccagcaattacacaaagtaaaagagcagaatcagagagagcaaaggatgctacaggggttgggaggaagaaagagggaaaggatatatgtatatatacatatatatctttaatctcaaaatcttgtaaagcaaatttataaatgaagataatagaaagcatataatactccagagaaaaaagttttgtactttataaatatttgtgtacatctaaatacactgatatgcaaattaaaattcactcttctatattccaaaagcgtgtgctttcagagacattccattaattcatctgttgagctatttggaaaatggtgtgtcagaaatccaagatacatacatacatattgtgtgtttgtaaataaactataaatgtagtctcacaatacattatctgtgaatggaaatttattacataatttatttgttgtttatatattttgtatatttgagtgcatatacctgaggaggccagagatagattcctagattgctctcccagtaaattttgtaaataaggtctctcactgaaactcacaactcagcaatttgcctaaattggctctccagcaagccctagagattgcgatgcctctgcctcactagtactaggattacaaattcacaccaccatgttcagcattttatttttctacatatatgttgaggataaaactgatttttttatgcttaaggggtgtgtaggggagtgggggggtgtgggagacttttgggatagcattggaaatgtaattgaggaatatacgtaataaaaaaaagagagataaaagaggcagatctttgctgactgagccatttccccatctctgatgcatcattattcttacactttggggtcaatttttatcagaaatggtattttggtgtgttttatcaacatctatttgatacacctaataactggctttgtcattatgacagctaattgatgattgttattaatcttgaatatattcacaaatcgaaaaatttccaaatatttggtgagaaacaaaaatgtgtcttgttttgctgaaaactttaaacctaattcttctctagcacatttacgttatgagaaaatacttttcttcattttcagatgagcttatcctcaatgtaagctaagcattcacaatgccttaaatcagttttatttccctaagtgcagtgtttatataaatttttctttgtgtacctaaagtgctttttttaattaacaaagatttttttattattgaaaattatatctaaaatactgatggtgttttaaaagaaagattctatttagttattgcccataacttccttggcaactaattcaaaggacaagagtcatttaaaatttaatatctagaatattggaaagtcccaattagaacattatcttttgcagtataatgaaatcagtgttggaatgaaaacacccagcattcacagagctgtttaggttttagggaagtttcctcagtgttttaattcatggtaccaaacagaatatttcctttatgaatttggaagagcactcactaactttcagagtcttgttccctaatatatttccagtcagcttatgggatgtgatgtgatggatgatacagagcaaactctttcttctatgcacattggcttcaggaagtgtacaaataagcatttctaaaacccctagctgactctgacagacccaatgtattgatgtagtagcctgccagccatctacaaccatgcatagcttcttgaactcctcattaggaaataatgagggaacagtcataaatacgttcaattgattatgcattactactgatgcctgcatttactttcagtactggttaggcctacttgaaacatttaattaatagtttgcaggcacttgctgatggaaacattgagtatataccatcaagacagaaataatttatttccttgcttgatttaatgaaaatgttaaatccttttaagacttgtttaccacagtcctggcattgggagttactttcagtttcagctcatgcccatagtattcagttaaataaggcaggtcccaaacaggaatcattcctgacaatcagtgccaatcagacctttcttctcctctacctttaatcacagctctctatgttgtttgcctgtgtcatttggaatctaaacagaaaaggcataatagaaattataacgaagatgcttaatattggctcctggtcacacagattgtggaagcataaagcagctgaacatggcagatgctctctgactgtgtcatgacaggaagcctccgatgtttttagggtgaaggataagggcagaacccactgacatggtaacctaagaatgagggcaggaccaagagagtataaacgtgaatgaatggtggatctaaaagcaaataaacaccaaatgggtgtggttgtatggttgtagtgataatttagaagggagagagagagagagggaggcagggagggagggaagaagagaaagggaagaagagaaagggatggagtgagggaaggaaaaggatgaagggaaggagagagggagggagggaaggagagagggagagagggaggaagaaaggtagagatatgaagctgttgacaagttatagaccaaaccttaaccacagtgtaatatgcataagtgatatttaatccaagtcaagatggtgagagtacttactatttgcatttttattaatatcctggtatgagttcccaacagattagcccagaaatctctagttgtagcattctaggctttctctagtttgttttcccacactttcccagactcttcccaccaaacattttttaacatttttaaactatatcgccaggtcagaacagtaatgaacactacacaaagtttaactcatttattatttttaatgtaataaagtttataattttatgtgtagccccttgttcacctcagcagtttagaagtaatttgattctaaagtatctatacatttttaattttgataaatactgatatgcttgacaaataatgccaaattactttccacagaagccggactgattctattccccattataaatatgtgagagttctgtttccttaaacatgtgcaaacacaatatatatgtaagcacggtgttattcagtagttagtgtatagacactgcctcaggctggagatacatatccattaaagagctgacctcttgttcattgaggaagttgtcattttctcatcatcctctatacatagtcactggccccattctttgcttacctcccttgtctttatcagtctctgaaaacataatgtgtccattttatctgataagtcatttgccttacatttatgccctttatagtcctcctaaaggtatttcctggttgaaaatatcactcatcactccctttagtgttaatttgatgttacttggtatgtcttcacaacacattcattactatagtaatatcagcacagcacacttcaaccaaagtctcactttgtgtattagtcttctctcattatctgtttcctccctctccttcaggctaacatgtagctgtgttaaaaaaaaaaatcacatactggcatatcaactgcctataactatgtgactttgaataatttaaatgaaataaagtcggtattatgtttcctggcacaaagtaggtgccagtctcttctctctcatcctcccttcacatggttttctatagatttccttagctgtatacactccccacttccctgaactcttttggtatctttcaataaagttatttggcttttgtcttcctagctaatgtgagaatgtgatcctttcgcatcctttgtttgcctcagcaatgtttttgctacttaatgctgagaagactgctcaggaatgtatacataatggttgctttgtctgtgtttaaaaataaaataacagtgtcaactttcttacatcaactggcaaaatataattgtatgaccaaagataatttaagacttgttctccctttttgtcaccttgcattgataacagctattgggtcacagataataatatgccaaaatctagcaagagttattttctgactcaaaaatctttcttattggaaatcacttttcaatacctcttaattgcttttgagctcgtagtaggaaatccaatcaaaactatagtgattcaaaatatcataggatagaggaagcaggaaattatcatatttaattatagattttgaatgacttcaaaggaaactctgagttttcaagggattaatgcaggaactggtcccttattataggaggctacttgggcttctatttagctggtttctggcacattcattgacaggaataatttaatgattgtgaataatcaccaagtgtaggaaataaggtcctctttgagtcataaagcttttaaacatgagtaatattatgcatttgtttgagaatggtgaaatgtgtgaactaatttcacattgtcctaccaattatgaatgtgttatttctggcaagcaggtctctttaaaattgcatatgcttagttgcttgccagggaggtgagagaaaaacattgtcagcctctttatacccagctggggccaggtgttgatcattaacatgtaaatagtacaattactgccaattaagattttttaaacattaaaatttgtgggaacacagttatatcctctacaagatttaaaaaatatctatatcttagtgctttaggttcctataaggcatacactgtaacttgtagtcttaattacacatgatttcaaagttgccttcctttgtagaatgccatatttatcatatttaccattagaattgaaaatgaaaggatgttgctagaattaggttcatagccaaattgcattacaattactattacttggaaaattatagttatttttctcccacaaatatttattgaacttgctgtatataaagaactatgtttgagttaaattatgaataagtcaaacatggtctcttctcactaataacacacaaaccaacatagaaataagtacacaaaccgatcaacgatgttataggaagtcttacataaaatgtcttaagaaacaaaatgatgagggtggatgcagtttgctctgggaggtctctctatgaattagcatcttttcaggttctaaagggagaatcgatgctatccaggtgaagacatgggcaggagtatattaggaagagaaaacactgtttaggcagctgtaaacaagaaaaagtggaatgtcattataaaactgaaaaacaaaaatacatacctgtcaccaagatctttgtccagcctctccttaactccaaagtctttgtgatctctatataaagaattcaaaaagacacacaaagttcactgttatagtgtaaagcaggaacactctcaagagatgagagtgaacaacgactaaagagactgctgtataaagtacatactcaggggagggaatgggcaatgggctaagggactattgttcagacttccattttaagtaggctttaaactatttttaacatctctggaacagacaactttcctgacggacattttgttgtccaggtgattgacaggccctacttgcattgatgcttctagaaaggggcactggtatgaccttgatctttatctgaaagtctcttgttagataatgatcctgtatggttctgggctgctggacccaggtttagatagttatcaattaataaccttccaagcagttccagatgacacatctactcttaggaccacagatgtgacttaggtcccatttctctgactcaggatttgtttttttacaaagtgttcactatgatggaagggctctgccttaaagttttctgatcccactaatattaaactagctatttaacatgcctacttcaaagtaatggttgccttaggggataagaacacaaaaagaaatattaaccctgttattctctaataatataaattcattttattcacaaatgcaacttgtctgtaagcacctctttatcatcacgatcttggggatacaatactttgtatgtaaggtaataggtccacttagactcacaattttatatctcactttattgggtgctcaggtctcattaaaaataactcaattattctatactgcatcaaatggtaaccaagtctttttgtgatataaacaggttcacaggtaaatcacagcactatctcccaaatccgaagagagaaactccagggatttatagtaatttctggaatttcagtcctttaaccctcctgtttatcaaggtgctcttgtatatgaattaacaactttctagaaatagcgagtaaatgaaatagcaagagctaaagaaactcagaaatggtcatgggcaggtccaaggaaccaccataatatagggaagcattaaaataaccatcagtccttgtctatggatctgatgaaaggaatccagatctacctaaccaattcagtcacattacttccttaagtatttgatttagtaccatatgcaatacacttgagctacaaaacttagcagctttaatgttaaagagcttactgttccctttgggcaataaaatacagttcttacctatttctggttgaatctaagaatagaactgtaagagtctgaaagttgctaaaggaagaccccagactcagagagcatgcaaagacaaatagctttaattctgcaaaaatatccagtatgtgggagtcaatcaatctccaaaatagcaatcacagacaaagtcacacaggccttcttatagggaaccatagggaattggaggaactctttagaaggactgggtaatctaaaatatcattggtgagtactagtggcttagaggtggtgatcagtggtctgcattcctacgtcatgaccctttaaccataggatgagatagggatgtctagcacagatggcccattctgtgctgatatttcctcatttctgtggttatccctggggtatcatttgggagggggttttatgatcttgtttctggtttttatggccttttcctggagctggtaactatggccttcttttcaaaatcaggcctgttccttaaatggagccaaaagggggtttatgttttcctttcataagtcaactgaggatccagtaagtagagaataggaaatgactgcttctttcacttcagagatgaattgagtcaaattaaactaatgttccatattcttatgagattctcacaggagagaaatgagcagaaatctagaaatagtcattgtagtcaaatagatcttttaaatgtcaatataaaattcagttgtatatcattatcattcacaattgatgaaattatctctttttctggacaaagtcatttataaccatgaatatcaaagttctttatatgtaaaccttacagctgaggtttaaataactaacatttttagcactccagaaaatatagattgataagttatgtagacaagtcgctatcttatagaccataccatttatcttaagtaggataattgggttttactagaagagtgcaatattatcaaaatctaatgtctgatactagcctcgatatggttaaggtgcttgctttttcaaaaaggaagtagagcaattgtcctgaattttaaagtggagaagtcctggctttatgaattgacttggatagagagaagtgcataaaacatcatgcaagggtcagtagggttgattgtccattccaaactagtgatccctcgtggaaaagcagtgtagtacatgtcaccatgttctcagaaatgcaaatgtgtgctacgacagtgtgtgaacagtacctgctgcacgaaataagcacagatgtacttcaaattaatatttaatctgagatgaaaagcacttaaaggagttagggatatgagttcctcagaagaaattacttctttctcgcacacagcaattatagcactacaaagataacaaaaataagactgtcatagtctccttgggcttcagtaggaagtctggaggtgaagtgcctctctctctcttttttttttcttataaaaagacaaataattctcccggactgtcattgcctggatcaaatctaaagctcataaggtgcttttgaaggaaagacttgctaagtccttgagggtggatgagagtgacttttaattgacatcattagagtgttattaggatgaaatagaacaaagaaaccattattaatctttaaaaagaaaatgcctacaatcagattataatttttgagttcttcctgtgaggctatcttctgaatcacattctaagagcaaattggagtctgaagctattgtgttcttgtctttcattttaaacccgtttatatggcctgaaagaagtttaaacatcacattggagagcgagtacacaaaaccactacctcaaaagagggaagaagacaaaaacacaataccacttccttaatctctgagagtatttttgcgtaattatctataaaagaaatgactaaaccatctacattcagaggaggcttaaactaaaggcattttatgataatggtaggtattgtagggtagatgtgtcatcaaaatgccacacaaaaaattgttttaccgtggctatttttagataataggttagtcatatatgttggggcaattagaagtttctccagcttttaagttgataagataaaaggtgtcatttgacagaaactcattcatcaaccattgaaactaatcttcgttcaaccatccacatgtatttattgagtaccaactatgtgccaaacactggaagtaatattgaagtgaagtcatagcgacagggatgtgaagcagctggtcacacatgcacaacaggaaacaggaatgaatgtatgcatactactcacatccacttatccctctatatactctcaaatccttgttcagaaaaattggtgttgctcacagtgagtaaatctttcagccgcaattcatgaaatcatgacagtatcccagaaacatgcctgcaggctcatctctcaaatcatcctagattctttctggttgataatactgatatgatgtagagatgtgatgaggtcaaatgttttccgaagccatggaatgagcttgaaattttgttttgtaaaactgaaaattgaaccctcatagtgtgtgtgtgtgtgtgtgtgtgtgtgtgtgtgtgtgtgttagacaagtaatgtaacaaatacatcctgagtccttgttttattattccatttttattctttgagacagactcttgttaaattgcaagactcaccttgaactttctttaatgtattcatctatctatctatctatctatctatctatctattttttattttaagctccagattttattcccctccatgtccaccctccaagtgttccacatcccatccctcctccctgtctccactagaatgtccccactcccacccctaccccacctgacctctaaactccctagggcctccagtctcccgagggttaggtgcatcaactctgattaaacacagaccaggcagtcctctgctgtatatgtgttgggggcctcataacagctcgtgtatgctacctggttggtggaccagtgtttgatagatcttgggtgtccagattagttgagactactggtcctcctacaaggttgcccttctcctcagcttctttcagcttttccctaattcatcaatgggggtcagctgcttctgtccattggttgggtgaaaatatctgcatctgactctttcagctgcttgttgggtctttcagaaggaagtcatgataggtcccattttgtgagtgttccatagccttagaaatagtgccaggccttgggacctccccttgacctggatcccactttgggcctcgctctggaccttctttttctgaggctcctcatctccatttccattcctgcagttctttcagacaggaacaaattcgggtcagtgcttttgactgtggtatggccaccccatccctcacttgatgtcctgtcttcctgctggaggtggggtctataagttccctctccctactgtctggtctggtgcattctggagggtccccccacctcctacctcctgatgttgcctgttttcattctttatgctggccctcgcggcttcagtcctttttgatcttccttcctcaccatctcagtgcgaagttactggaattagaaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagaacccaaggagctaaagggatctgcaaccctataggtggaacaacattatgaactaaccagtaccccggagctcttgactctagctgcatatgtatcaaaagatggcctagtcggccatcactggaaagagaggcccattagacacgcaaattttatatgccccagtacagggggacgccagggccaaaaagggggagtgggtgggtaggggagtgggggtgggtgggtatgggggacttttggtatagcattggaaatgtaaatgagctaaatacctaataaaaaatgggaaaaaaagaagattacctttagatttttacataataattatggatatgtatgaaatacagggtgctatttccatgtgtgttcaaaatatgtactgatcaaatgaagcatttcattcaccttgatatttaggtttgagctcccttttccaggcctttttttttccttaatttatatacattttatttttccattcatatattatgagcacatatgttgatcttaactcttgataaatgctgcaactaaccctgaggatgaaggtggtgtatctttggtttgttcatttcatttatgaatatacactcaaaagtatgatttctgaatcattgactatcattaatctagttttagtagtggtactgtttttttggggggattcttatacaaaatcattgcctgtatttacatcttggagtattttctttatgttttcttctagccatttcatggtttgagattgaatatttgtatcattaatccactctttatacatgtgaatacagagcattatttattgaactgttccttctgagatatatgtttttttctttctcttgagaattagttagctataaatatggaagattatttctagtgtcttaatatcactcccatactatagtactataatatgtcttgagatcagatattgagatatgtccatctttgtactgattttaaatcttaagattttcctattttgtatattttgtgtttgcttttttagttatgtgaagaattgtcaatactattgtagtggaaactgcatcacatctgtaaattgctttgggtattaatgtgtattttgatttatttatttatttatttatttatttatctatctatttaaatgtatatgtatgtttggcctgtatctgtctgtgtaccccatgtatgactagtgcctgcagaggccagaagatagtatcagatcccatgagactgtaccatgtaagtttgggaaacaaccctgggtcttcttccagcccttcatagatagtttaatattaataataccacttattcaaattgtgagatttagaattcctccagttattctgccttttatttgtttcactggatattataattttcattgtaattcaacggggaaaaataagttcccatgagccttctccatcaataaatgattgttgaccaggccagctttgtacatgctcaatgcaggtagctacaactgctatgagttcaagattgcagtggctttatcatgcccagaggactttgtagggagaaggtatagctttcaggggtaaaagacaaaaataattacaatgccttttttatgtgcgtgaaaatgtcagaggataaatgtaatctaatcaataaaaaatatatgttttatgctgaaagtatgcctgtctactactttgactgttatatgctgaattccagctggatgtgtgcacttaagcacaaaaagcaacaatttcaagaaattgaaaggaatcaacaagcatcagcatatatagtcacaagagttcttgaaattcccagtcttcaggcattgatggttcttttcaaagtgtctacctacctgggaatccatcttatcagatgttgtctcctgacagttccttgaaagtatgtgcctgaggataagttgctattgctggaataaagcaggtattgtaaaagacatgaggattatataggtctaattaagaaagcagaatgaggacttgaggaattgctcaatgatttgctcttacaaaagacccaggataggttcctagaacccacatggcagctaacaaccatccataactccaaggtgagggaatccaatccccttttctgacctttgtgggcaccaatcctgtatttggtacacttacatacatgaaggaaaaatactcatatacaaaaaatgaagtaagactttatttaaaacaaaataagattcatgtggaattgacagtccaaaggcactacacgggagaagagaaaactaatagcatgaaaactaaacatgaagagagatttactctgaatgaaagtaaatcattttttaattttgcagagagacagggctactaatatatttatctgtaggtttctctgagtttaatttcattaataataattgtttaacaattatcttgtaggagggggtcacagatttaaatatataaaatgaactaattcatttgtttgtttgcagagagctaggaaatgtttgttacaggtattaaatgatgtattttaattttagcctgactagtcaatttctattataatttgtcagtatattcttaaacactatatacattattaatatgacataacttgtacatgaatataatataacatgtgcaagtacattattatatttttaacatttaaggttttgctacagatagacattaatgttaatattcatatttttattccataaatatcatacattaaggcatttccatataaaggcaaaaatatatttctatgtaagtggaactataatattaacacagcagccttatatagtcttatatagtcttttattttcttctgtttaattttatttttgttttctttttcatgtctttgtcctttaaaaattctttaatgatcagtatttatcagtcattatagaaaccactacccatttctaaggcagtgatattgattataatttattgatgagggttttcttttcaaagctttcatctatattttctcccatgaggaaaatgttataaattttttccttgtcaggcacattaaactccagaaacttgtatctaactgctagagcacaactccaaccgcttttctaggacaacagcccatttgcctcacagagaaaaatgaagcgtgttaattgtctagttaatacattatatgtctaaatggtatggcttagtttagtaataaattaaaacaatgtttagagactaacctattttctaacaaggccaaaagtgtcttgctataataaaataaaggatatttttgactgacaggagttggtgaaacaaaccaaaattatctttttatgaagttacaaataagaataatatgaggttattttacatcctcaaaaacttaaaatttctttaaattttgtgttaagaaatgctttttaaatcactatttttaaagtgctttgcctttttgaaatgattttctttttaaatcaagggaagtatttctattttcatgactaggtcccatctgtcatcatgcatatgggcttgcccttttccttttgcaaatggtctatttttcttcccttttaacaaatatgttcaaaattttcatagcaaataaggaaaatattttctctcattattatttggctgagaagtggcataaacttatgactctaaagaattaattactgaaaatgcttgtcatttcaggacttctatttgcaaaatataaacaaaagattttctttacttccattgtgaacaatatttccattgaagattgttgtcagagtacgaattcccatgccagtgatatgtttttaatgtactacccgggaaaaggaaaatctttcagaaaaagttcaagttctgggaattaaatatgaaataactaacatataatctgtactcaacatttggcataaaaacaaaatgcaaattctgccatagagaattgcttcagggaagagtcttggaaaaggaaggtggagaagatttggataatggtggaaatgaggttatgtgaattattgaaatgattcaggttggcaagtttctaatatattcccaggttccatctgagataattcagtccccctgaaagataggtcaggtgttccccagactgaggaaatattgggctatctgaaagaaataaaacccatgccttgatccacccttcatattgaggttaatacctccctgaaggttttccatcagccctggaactaaaatcatgagcctgtgctgtatattcttgcaagcattggagtgtatacatgcatgcacacacacataagtacacttcaacttgcatatatgcaaacccttaaaataaggtagaaataataactctacttagcagcttccaactgaaatgtgccaaccatgtcattcttctaatggagaaaattaatatatcccatcagggctccatgatatgaaatgctgtgaagtggctgcttatagaaaagtcgggaaatccactttgatctacatttttgatgtttgataattgcacttattatcaggtcctctctgctcttttactttgacatgagatccattatcagtgacagcatgagtgtgagcatgggtttgatttgaaaaactgcttaagatgagataatggaaaagaaggttttttatatgttcatattaacaggctaaaagaaaattaaattttatcatgcagtggctcccttgaaattatttctctttcatacattgcttagtttgaaagaaattaatccatagtgaaatgttttgtacataaaaatctagtatcatttgcctttaggcttttattccatgatcaaatatcatgtgaacaacaacaacaaaaaaatggccacaaagaataagacaggctgtgttgttcatctttgcatgctcagaaattactaaaattaaagtgtatagtcatatgtgagtagagtaagacaagaataaaaatgaaaactcatatttgatgaaaggaaatatatacaaactcacatttctatgaaatcactggtaaattcattaattgggtgtctttggtatcatttgatttatttaaataaatcaggttacctagaagcaagtcattatggcaattaatatgggctaatgtagctgaacttttctgcttgcctaaattttacaacaaggaccaatgctaatttagaactttaatggtttcctgtacacattgacaaattattattctcacagtggaagcctaagtaaaataggtggtttatttattcacttattctttatctctgttatgagcattgtttgttgtttggttaaacacgcgtgcacacacacacacacacacacacacacacacacacgatgaaatcatgaaattattttagccaaaattaaatattttcttatgtttatgagttttaattgttttgctgaaggacatagaaaaataaatttacctgtactcgatccttaatcttgtgttcagttcaattcaaaagcaattctgtttggtttgcctgtttcccattaacttttctttctaccttttttttttccctcagataaatgctcaccacaaggttactggagaagtaatattctctgtagctttggagaatatgataatgtgtttggaagtgctttatgaactagctttgttttaaaattctttaactctttcctatactatactgagtttagagaattttagcaaaacccaaagagcttactcatttcctgtttctcctgctggtctgcttcttttttccaacactgctacttttttaacacactgatttaattataatcactcataagcatgagtggcaggttatttaccagaacatacgcaatgtactaattgccacactactgaggaaaatttcaggcagtctccaagtactcattaactgcccagagacactcagtgaggagtgcggcctcagcagcctctatcccaggcatgatgaaatagtgtaaaaaggccccagtcttgtacagctgcagtagaaaagaaaggattctgaaatagcttttgtccataaaactacttgcttaaatataaactgtgtatgttgtgaaaccacagtaattatccactacaacatcaagcctccattgacctattatccttccagtctttcaattttgttttatagtatttgaatagtcttattaaatccctgtcaatctttcatatggatagattttttgaagattgttcaatctttgcatagtgctaatttaagaatttcacaaatgtttgaaaaaagagtaatttaaatgatgacttcctattcagtaactcattgaggttatactttagaaacatacattggttttggatatgtattccaaggaatagtatagcttactacaatttgatttttagttaaaatacaatgtgatagaacactacttatactttcttgagcacatgtctaaagacacaatgacagaagcaaattcctatggatccgtataaattcctttgcaaatagcaactcttactcattaccaaacagagataaggtagagtacataaagcatccttttcttcttgcctcaaaataatacataggtgatgtatattatgcttaaattgaaaattattataatgttttttattcagcttcccttggaagaggttcaatacatttctgcatgtgtattgtctgactttgacctattacacttccttaaaatttttttctattggtgtttgaccttcatgtaattctgtgtcagggtgtcagaagtcctggtactggacttacaaacagatgtgaactcttaagaacgaatactcttaacaactgaaccatctctccagcctaatttttccaaccacattctttttttcttcttcttttcaacctgttacattcttaagaaaattcaagacttgtacacagttgctacctaaaccaaatcataagaagatattacaaagtattcaaaacattcgttgaccattcaaataaaaaggaaacactgatgagcagtgtatgctatttgcctttaagctgaagtgtcaccacctgagatatctctcacagaaatgacaaaacagaatcattgtctagaaaactggttcagaactcagtgtctctcaggagtggtgctatcctgtgttttactaaagcattattctgatacttcaagcacattctgttttattatagcataaagagttcattgattgcaaagggtctacctcatctcgaactcttaagacattcataaatttataagaaatacaagtgacctttaagcaacatagatttaaactataaaattacaattatgcttagatatatttttgagatttaaaaatagctcgaaacaaacttttagacaaaccacatatgctaaaattagtgacagaaaggaaacattaggtacgacatgatcacacaaaaatcatgtatataacattctattttatcatatatcctaccataaaatgtatacaaatatagaaagttaaaaatttaaaagttgatatagatgcttacagatcatacttggaatcatttaaaggcaatataaaagaaacaaatggaatgatgttttaaattgtaaatttgaaattgtgtaaaatgcatagcttagcattgtaatagttacatagccgattcccattgctttgctttgagcaaatgtgttgtaattatccacataaaatgcaatgtcaactttctccataagtgctatttgtatttccaataaatgttatatcctgttataaagtggcctctcaggattcccatggacttttaactatatccatacctataacatacaaaatcttccttgattgactgaacatattaccagggagctacatgcaaaatcaattgataagcagaagtttcctggacaaggatagatatgagcacaaaggtgtctgtgggaagattgaatcctgataatttgatatgaaatatgcctagtgctatgtcagatacattaattcaggggacccccttaactagattagtagttctcaaccttcctaattccacaaccttgtggtgacccacatattatggtgatcgacaaccataaattttttgtttttatttcatagctgtaattctgttatgaattatgatataaatatctgatacacaggatatctaatatgggacccctattaatgtaaaaggtttattcatttgacttcctaaaaaagtcaccacctacagattaagaaccactgaactagacaaaagtagaaaccacaaaatgataacattttttctgtttctccccttttctgtgccccacatttctgggaagaaaaagtttctccaaacttctagagcttttaaccagtcaatttaatcacatctgactggattctcctaaaatatgtttgtactggctagttttgtgtcaacttgacacagctggagttatcacagagaaaggagcttcagttgcggaaatgcctccatgagatccaactgtaaggcattttctcaattagtgatcaagggggaagaccccttgtgggtgggaccatatctgggctggtagtcttggttctataagagagcaggctgagcaagccaggggaggcaagccagtaaagaacatccctccatgggctttgcatcagctcctgctttctgacctgcttgagttccagtcctgacttccttggtgatgaacagcagtatggaagtgtaagccgaataaaccctttcctccccaacttgcttcttggtcatgatgtttgtgcaggaatagaaaccctgactaagacaatgttaaaactcacttaaagaatattatatagaatagatctttcattcagatatttattgtattgtccttaatttcattctgaatcaatggcctttaccttttaaaatataaatattgtttgagaatttcatatttaagtaccacatttacatcatttctccccctttatttacccatcctccaacttgtgttatggcctttggaaatgtagtattctaaccatcaccctacctaaagccttctaagtaggctgaaaaatataaatatagattactatgtaaataagattattctgatggtaaattgcaaaaacatcagtgaaatacatagggtaccaaatttattataaggatctaccaggagtttggcaagatggctccacagttaaaagactgtactgctcttatactttaggtactcatcaggctccactatgatatctggcacctgcttctcatctctgtgtgtactggacatacatgcaaaagcatacacaaaataagaataaaacaaactatcttctcataactcaatgaaattaatcgctatagtgtctactgaggtcctgacctaaggaactggaaagaactcactaatcccccactgtctctattactttgtatatttctttatgtatgtttgtctatttatccctacagatagtctgtttgattctcactttgcatggtcagaaagagccacacttctgattttgaatgggcatggcttttaaatctaaagcaccgttcaattttaccatgtctcaaccctgattctcaaatgccaggaaagagcatcttcttagtaaagtttggatcaagaacctaatgccaatgtacttgggtctcaaaataggaaaaggataaccacacagctgccacaaaagttttaactctgcactacatgcaattgttgggaaaagaggtaagcggactcagccaaagtgcctgaagtaagatgttctggtggtctgctttaaagtcttgctatgctaattataatatctgagttattattggatttatctcaacagcttgtccattttcctttacagaaaatcataattttccttgatttttgtaggctacaatttaggaatatattttggacactgattatttctggagactgtaggatctattttacaactgtgtgcagttgtgcttgtttttcttttggtttagaaattggttaaaaattttggacatgaatatcagactttggttctagcattacagctcaaaactcagttttgtttttgttattctcagcaagagattttagaatgaattctacactaactatgccgtatattttctttgtttgtgtacttttgaggataaaccctttactttcccttgacttatagttgcctatctaatctctgtcccatggttaagtttgagatactgtagttttctgctaggatatttgacaccttaaggagtctcttactgttttatacattatgtttaaaaaaataaaatgaaacaaccatcaactggaaactcacccttgactttaaatttttggttcctcaccaaaacctactacgtttactcattctctagtgcctgtgggacattctgttgttgttgttgatgatgatatcatgatgaaggtgatgatgatgttgataatgatgatgatattgctgttgagttttttctttcttttcactattttctcatttcttacatcccaactgcagtttcttctctttctacccctatcattccatctccttacctgccatcacccatctccctaagaattactcctccatttactttctgaaaaaaaaaaaaaaagcaggcctcccagggatatctagtggacatggcttaacaatacacaataagactaggcagaaacccagtaggtgtaaaatggtttcaagtgtaagcaaaagagttggagacactcccattccctttgttagaagtactacaaaaccaccaagctacaggactattaaatatgtgcagataatctagctcagatttatacaaggtttatgttggttgcttcagtctctgggagcccctataagccctacttagttgatactgtgggccttgttatgatattctctattgctctggcttcaacaatcctccctcccctcttctgaggggtttccctggctctacctagagttctgctgtgagtctctgcatctgttcccaataactgtgggatgataccccttatgatttcagttggcctaggcatcgatttatgagtatagcagaatatcattaagaatcatttcattgacacttttttcctgtttttcttttttttatctttttcctttttttttttttgtctcagtcgtatttgtttctattgtagttctctgtgctggatctttcgtctagtcgttggccttcaggcagtggcaggagtgggctcaagttggacctgtcattggttagtcacttcacaagttctgtgccacaattgctacagcaatatgttgcaggaaggactaattgtaggtcagaagttttgtggctacgttgatgccccagtctcacttctgggaccctactctggttacagaagatggccagtttgggctttctattccctattactaggattcacttccctagggtcacttttgcagattccaggtgtttatacctaactcgatttctacactgcaccctaagggaccccaactgcaatcacctctctcaggattctctccctctatccttcccacctcccacctgatttctcttgttcccatcccaacctgccccaagtcaggcacaaatcttattgtctatagatgaacataatatgatagaactcaattaaaactttctcatcacttggactttttccactgttctttataagtgtctcaagaaagtaatccatacacacccactttaaacttaatataacccaaacacctactgtgtatataatgttttacatctgctaggcttctttttagcaatttatataaaaagtttgtttatggaaccaaatatcaaaggatcatgtgaagtgatataaagagttctatttctttcattctcatactccctgagagatgtgttcatcctgacatttcttaggcaaatgagatttttgctatatatgacctttctataatttctatactcaaaggtacagttctaattcaatttaatattgaattatctacaatacatttgtaattacaaccctatcaaattcacacacagacacacacacacatgcaagcattaacacattaggtacttacatagaaaatattaaaaatcatttttatgaatagatttctttaagataggtttacttaatcagttttacttatcatcttccttatatagcaaaacattaacatgatctagactataatctacctaaattttctgttcaatattatttaataaataaatgaattgtaataatttaaatcagtttgtttaaatgtacatggttacatagagactagctataaaataatacatgtggaaaatactttgaaatttttaaattgtaaaaaaagtatccttttagatgcatatctggaggacctactatatgtaaaattctaaactagttgttttggattgaaacacaatgaagtacaatttcttctcccaagtgaagaccatctagttttaaaacagacttttgaacagctgaactatgtttttttcttgagagatacaattaatgccatgatgttaagatatgatgtataatatcaagtcagtcagtgagggatttcaattgtagcaacaggatgatgcattagtcacaattctaccttgtattacagataacataaaaatgtacggaggctaaaaatagtaattgattctttattcatctaaatgccactaaatttttcttattagtgagcagttctctggggattaactaaaggaccacacttctttccatctttgcaccttcactgtcttcaacatgaggcatggacattactgtgtttatttgcatcaaaacagataaaaggggaaagacaaagttttatcagacctggaagtagtattaatttttctgacatcactcatatgcctttatctttcacacaaaaaagtgaaaacacacaagaaaagtgtgtctcatagagtaaatagaaaacagttagtgaagagctttgtagtctctgctgtgaattgtcagacttagttgctagaaagtatattctagttacagtgtgggtgaggaggtggacagaaagaagctaaaggtggattaaattaaggaagtctcaaattataagatatttgtgtactaatgcagggatacctctcagtagtatgatctagtgactgaatttagagatggcaaagtggacaaaatgaacaaaagattgatgataatataactgatcagctgtttgccggcaagcaatgcttcagtgtttattgagtgccacaatactgagaactcacctcattgcactgaagtgcttgcctagcaaacaaaacatcccaactttgatccctttcatagaaaaagaaaggaaaagaagaaagaaaaaaggaaagagagaaagcaggtggtagatagaggagggaagggatagagaaaatcagtgttttccttcaaaatgtttgtgataagagaaaacacatgaacggaataggttaaattcataggttctttttgtttgtagatgtgtgtgtgtatgtgtgtgtgtgtgtgtgtgtatatgtgtgtatgtgtgtgtatgtgtgtatgtatgtgtgtgtgtatgcgtgtgtatgtgtgtgtgtgtgtacgtgtgcaaatacaaactaaaaagaaacaaatgaaagactatgatagaatttctaggattaaaaagaacaaggtgtacgggctctaatacacttgaatcataaaacatataattcttctctttatttctcttttgtattgttttgaaatgtcaggatgagttagcctaggtattacactcaatagaaaaaaatgcattttaagaataagaggatcaagcaaagaatgatggaaataaataaaagcatggcaagaaaaaaattatacttttaaacttcaacagttaccagacaattcatttttaatgtgctatgaattttctgcctttccaatgagatggaataatggaaatataaaataaagcattctatacatggaaattggtttaaataataaaacatatctataaacaaacaaacaaacaaagacaagcgaagtcactatgcacttactcacacttactcccaaatgataacgagatttaggaggagaccaggtatcaggaatgtatgtataggttatttgagcataggctgaagctttgaattcaatttggtatttgttgatactgttatttcagttaagcatctcagtttgaacagaacatagatggtgtatatcagtggtggcttgcaactctgatttaaagcaaccatacacatctgcaaatgactttcattcatttgaaaaatatgtattaaggttatatattatagtaaataactagtacctgaccactaaagatttcaataatcatttttttcattttttaatttatgtggcaaataaaatgcccattacttttgagaaattgggaatatgtaaaatggtttagtagagctcacataaagctaaagaagtaatggcatgttataatagagaggtctggtatgtgtaggtacaaagcaaacatattcagaagtcacagagcaagagatattgatggcaggagagacctttgagattgtcatcaaataagagtacacatgcccatgtatttaaaggtgaaaggtaagatcttaaatgtctttccaatggagaggcaaagagtaagcaataagagtcaatggttaagatcatcaagtacctagactttcatgtatagcacttagtcctttaaagcactttaaagatgctcagaaaatatccaattccatcctggttggtatacttttgcatagtccttggtactgtgtctagtttacttcttttcagcttcagacatctaactaattaacagaggtggggaaataatgatttttccatcagtagttgaaggctctgcttgtccctgctcatgacctcactttgcattccccgaaggctacaaagtcatttgcagatgtgtatggttgctttaaatcacagttgcaagccaccactgatatataccatctatgttctgttcaaactgagatgcttaactgaaataacagtatcaacaaataccatcttgaattccaaatcagatggaattgacaaaagttttatgtgacgtgaatcgccaacatcttgaatgtctcctactatagcagtactacatttcttagaagctaataaccatagtttcttagtaaaatgtactgtttaaagtgtgtaaatatacactggtccttggagggtgctaattttaacctgaaatgtttcagaacaagatagtaaactaagaaatgagtgtttgggcataaagtatgaaaatgtcattcaagtgccactgctgtacctcatctcatcagtgtgtttatatacaaagtaagtatctataataacttcagccctttttgtctaatttcccatgatcttatttctgattccacactagtcacgataactctttttaaatgaaggttaatctggagctttcttttttgtttctttgctaatagttatcaaaataaaagtaggccaggattgatgtttggaatcagccaaacttatgttcattgcccatggttgccacttcttaacagtgtggtcaggtggctccatagcacaatgtatttctgacagtgtagccttacaccaggcactgtactctctgtgccttgacttttttcctctatgaaatggaacagaattagctacccctctgtagcctgtctgtgagcatcagaggttgtattgtacatattaccaaatgtaaacatttgtaactcattgccaacagtgtttgcatctctcaagtaaagtaagtcacttccagtgggaacaattctttttcatatacccctgcccacattcctcaagaatatattccaagaccattactaaaggcttgaaccctcatattatacacatatgtgggttctcatgtactgattcatctttaatgaagtttcgtttagaaattagtcatatacaacattattatgaagatagaatgacatacatttatcataattcaattgtcaatatccactatccttgtacttcatttatctttcatattatttggttaaagaagagttacttgaaaacaaacacgatgatactaaaacagctgatctgagaacttaaatggctataaactagtgggtagatcccatagccaggttagagatgttagacaaaggtatgatttacatgtcagacataataacatgagatttttctcttgctaaacagaatggtacacaatttaaaactgtacatattctttatttcctgattttgctccagtactttcagagctttgttaaccatcatgctgaaactattcaaagtagaaacaaatgtaagggaggtctattataatggttttaaatttcccttcttttctccataccattatgctagactcctaagtgaggaggagaagtaaaactgaagacaatatatctaggcctccagtcccatcccattccctaaaacataatcctaaaagataatttgaaaaccattccattggtgacacccattacaaagtactggggaagcagacaaaatgattagattaggaaaacactgtatggcttctcttacatctaaatggcccaaaatgcatattctataatacatgtaattttaataaaagcactgcagaggtagggagtatagctcaaagatagaacatctgtatagcatcttcaacacccttgatataaaagttttgcagtaaagatatatgaaaaaaattgtatgcattgagtactgaccttcaatttacaaaagaaacatatgagaaatggattttctttgaataatataaaatttttatggattcctcaatttccagcagtcttcctaaggaaatgagctacaacccatgcttacagttgttgaatgataagttgttcgcaaaatacttcctggcaatccatcagaaaattattataaaatactggctgttagaataagatcttgtgaagtcattttccacaaatttattttaatctgtcaacttctagtctctgatgtgaatggaacactcacatacaatgtgtgaactccatcatttatgtcagaacactgcaactctccatggttttgaaatggagatgacttctctaggtgattataattggcaaataatttaaaatacaatggtttcttaataagttgtatagatacattagaacatgtgttaaaaaaaaagaaaacagtaaaccaggctagagagatggctcagcaattaaaagcactgtttactcttccagaggatctgagttcaattcccagcatccatacgacagctcacaactgtctgtaactcctgttcccagggatctgacttcctcacacagatgtacatgtaggcagaacaccaatgtacataaaaaaatatattttttaaaagcaataaaccaagtagagattcatgaatttcggaagcttttctacaagttggtagataatgtggtagaaattcagctctcaataaaattataggcagattagatgctatttaataatttaaatgtaaagtttatagatgatcttgctcaagcttattgggttgaatatgatttacctgcactaacacatggaacttttcctacctttttttttttctgacttagaatgtatttggaaatataaatgcatcccccctgaccctaaggtgaactaatttaaaatactaaaaaataaaagaaaatagtattcatttattccagagttcaaagaaaattttgttttaaaagttcagcttaaataaccacttatttaagtaatcctggtagtaagctcagtgttatgaaatgaatcctctggataatgaaaacctgtcaagtccagcataaatgcatgagacagtggctatatgacccacataaaataaaatctttattatctacatgaaaatttgcctaaaccatgtattcaaattcatcttacatggaaaattaggcattatatatgtttgtctgaacaacttcatcaatactgagagtgcaaacccatgtttcactcttgatgttaattgttatctagaaagaacaagtgttggataaaactgaatttaaattaaatgaaacaaaggaaggacccttttatcagagatatttaaacttcagtagtgattttatagaaattttcaaaggtaaaaagccaatgatatggtgagccccaacattttactaaagcacccctctctctaaaaacaattagcattctaaggaccagtgattgctggagggagaagtcctgctgatcttcctactgagattatttaatggcattaaatagaggtagaagtcacacatataatcattaagagacattttatgaaggaaaatgaacagtgggaaatatgagggagaaaatatacatatatatgaatgaatgaaatctcatatgggggaaaaaaacaaaaacaaaaacaaaaccaaccaaccaaccaatcaaggaaacaaaaccccagtagccctgatctctgacttccaaccatcccatagagggcgctgttgtgacaggctttgatgacagaaagttttggtttacttgtcaaggagactggaagaggtatgatacagaaaagtgatttattcacattggtggacaaaatcctactttgccattttaaatgggctaatagctcctatggtatagttgaaaaatctctagtcattctaactgcagcctcattgtaagtaattgctctgcacaacccaattgctttcattatcaaataaataataataataataataataataataataaataaaataaaataaaaataaaaaataaaaataaataaaaaagcaaagatcgactaaaatggacaaaagcttgggagacagtagtctttaaagtatgatggagcgaacagaaaaagaaagcacgagcctcagaatgcagtgcagtctgttacttggggacaagaagataagaagactaactaacaccattcaacactgcagtaaagatccagaaaagttttggacaggtcagtaaacagtgctagaataaaacttgaccagctaaggactgggactcagcttggacacgtttgttggtttcagaatgaaaaccaggggtcctgtcaatgattccggtatagtagaacagaatcatggattgttatacgtgcctctgatattttgaaaaaaatgtggatttatttcaattttccatgtttggtgggctgtgcttttttaatctgagaattgtctgggattctttttttttttttttttttttttaacaatctgaggatatccttagctatcatgactccttcctgttgtcattttctaaaatcgtaattagagttaaatgatgtcatgtcttacttacttccatgaatcctaacttttgtttcagatatgtcattaagttctcccactttactttgggtaatttgacctttgcgaccaagttcattaaatcttgctttattaatgcacctcttgttattaaacatgcctttttttaaaaattaggtattttcctcgtttacattttcaatgctatcccaaaggtcccccatacccacccccccccaatcccctacccacccactccccctttttggccctggcgttcccctgtactggggcatataaagtttgcaagtccaatgggcctctctttgcagtgatggccgactaggccatcttttgatacatatgcagctaaagacaagagctcccgggtacttttgaattttactttttcatttgtattgaaaatatattttttctcatataatacatcctgaccgcaatacattcacttccccccacttctactcctcccaagtcccaccccactccccagtcccccacatccactcttcctcctttttgtgttcagaaaagaacaggcctccaagagacaaaagccaaacaggacaaaacaagatacaaaaagacaaggcaaaaaattctcctattgaggctagacaaggcaacccaaataggaggaaaggagtcccaagaacaggcaaacaagtcagagatacacctgatcctactgttaggaaagggatacaaattggaaagaaagaagtcaaagtgtagttcttggcaggggtatgataatatacataagtggccctaaaatttcactagacaactcctccagctgccttttcaattttattctgcattacagtttacattttaatactacatcatttctataatttctggtagtttttaaatatagtgctatgttttccattatttagttttgccagtttaaatatgtgtattttataaattctaattaatccattatctgaagttcttgaaatttatttttgagcttttaaaatcttttatttaaagtggattttctctttttaagtcttttatttaaagtggattttctcatataattttcaactgtgtttgttgatctcatttacatttgtctcaaccaggatgtcttgatagttttatattaatttcacatattgacaatacttggaatatacacataggaagaaatcagctttaaacctgtccttaatatatgcatgtttataaatacacaagaattttttttaattatcttcatataaatccaaggtcatggcagacaagcttgtttattttcccttgtacaaaggaacagaacttgttctagagtacacttgagcatagcattttgagggttcatatacctgcgccacttaaacaccaaccgcaatcccagccttttaaagccctatttatctgaatgactctatttactctaatgactgttaaaatgtatatctttattaagtccctagcaagaaagatacagcataatacaaggtcatgtggctctagtttacaattcctgctatggtgggtttggcttttgagcctgtttggtttgggttttgtctttttatttcttctgccagggttctccacttgaaaatatatgtgtgttatttatctttcttttctaggtttttggagtatggaatgaagtgttggttttggggagtcttgttgttgttgcagttattgtatttcattttgatttggattggggtttagctttctggtatagtatcattgtcagaaatggggttcttaatttactctattctatttccatgtatcttgattttaaagtaacaaattttctctttataacataagattatgatgttaaaaaaaagatgcatctacattcagagaaaattacattgcttccagggcaagtagaagagcttagggacatgttaggctggggtactcgaaaatgctttgaccaagcttactattgtgtcactgaaagaagagcagatgtcttgttttagagagcactagaaaggcatgttgctctgtttttagtgtaggtcattgcttgtttcaaggaaattgctctaatgttatctgttttctatcgtctcataagaacggtaaggatataatcccacagtaacccagatggatagatgtgtacattgtaaagttttatttcatcaataaagacttacttttcttaagaaggtttgagttcctgagccctataaaaacaagatacaagaagccaactgctagcttattaccacataaggttacatcttatgacaaatattgtgcaaacatgagtcaatatccttctagaaaatttttaaagtttcattttataaaaatgacaataaaaggcatctgctattttataatcagcccccttacaatcccttttatattgaaaatatccttttcctttgcagtatgttataatattgctttagccctcctattaacttaattttgaattattatctagcaagtacacagtcaaaatcagagattggctttgtaaaattttaccaccttttatagggcacttaagtgatgaatttttaggtcatttaatgtaacaaagtctcataatttttaagacatgtcatccttatagcagagctcaagtgaaaagtgcactgaactatcacatgtaagaagggaatgcatttcacctgttgaagacaatcaacaatttcagtaccacaaagtaataatgatgcaattattgtaattatttctacgttcaaaccagtgagcctaagggcctccattgtaggaccatccatgtattacacttgagagtaactgtaaaggatatgatgaatgctatttgcacttaataattagtaaaatttactctttccaaattaatctgaaattaatagggtcttaaaatatttctgctgattttttattaaatattaatcttttctatgctgttggaaagcacagtttccttttcttaaactgtttttcttttgagaatggttgtgtttattcgactcacatatttgaatttcatcttcacttactcttgcaattagagctgttcatgtcttttctacatttaaaacaattctttgccctactcattgtgaatgtgtggtcagagacaagggaggagtagataatatccaatctgaacatctttcctactcataattgaaggcactcactgcattctaaactgacatttacggatggctctggactaatttatccttctctcttcagcctgcatatttcttctgtgcataattccttcttgaagttaatgggaatttggcatgtgacatgagtacatgtttcatgagatgggaatctgggatccgtcatttaataaagaatctgccttttcccttaattggtctgtcttcctaatgtctttcattataccgtagtagtgcaggcaggccttccatcctaatgtgaagtggaactgttttaaaatgcaggttatatatggcttaccatgaacagaaagcaggtgcatgatctattggactaaagatggattttgaaatgttatacttttgaatagaagataaaagtaaaaaaaattctgtgtgcatgctacattgtaaacattttaagaataagacacaatatcacttgcctaggctaagtgaactctcaaaacaccttacttaggcaatgaacttgaaatctgaaagaaactacagctttgttttttttttttccttattgttcttgagtgttgtgcattactgtgctgaagcttagcttggcattgctaatatctgcatttctggtttgcaaataactttcatttatatgtatggtgaaattattttattatctacaccattttcaagaacttactgataatgtcacaacacattgaataaataagctatagtgtcaaagcaagagaatgccatgcagaaacaaagaaaagtgagaagagatgtctctatacttattagaaggatcttaatatgcaaaattttaaaagtcaagttgaaaaatgtatatataacacattatgatatatatatacaatttttaagaggccatgcatttaaaagaaagaagattgtggatgcatggaagttttaaggaaggtggaatgatgtaattatattgtgatctcaaaaaataagatcatcatttaaataaaaattgtgaaaatgtaatgataatatattcttatatttgtagttggataaaaattgactggaattattaatagaaaatagtaaatacatttgactccctagaagggaaagaattgaatgaatagaaagaaaacataaatgaagcttttcagtatttgcctttctacccataattggtttttaatctcattgatttattacatagtcattatttacttactcacttttcctgataggaatgaagttaaaacttagaacctagatttttttttcacactgccactaattagctatatgagactttgtatatgtcaccaaacctatctggactttaatagttataacttatggaaattagaataaatgatttcaaaagcaattatttgttcttatgtcttgagagatagaaaatgtataacagtatagtatggcgacatgtagatcactttcttaaggaataagaatgtgagtaactgacaataattttacctactataggatttatatgctttccctatttattctctgaaattatagttaaaataagttctgtcaataagtcaaacagataggcatgcctttaccatttgaaaacccaagtttactgccatgctaaaactaatatctatcttttaaccttaagctaaaactttttacaaatatttgctaaaatatcctaagtgttgtaatagcagatgaactcaaaacattgacttttaactgctaatcagcattttgataagcttctgagtctttattaaatatgtgttcatgtttgatatccattctgtttaggcttcaattatttaattacaggtcttgatatgaaacgaatcatgcacacatccatacgaagcttgcatactgacaggagaaaatcattaaacagtcattactgtaaactgacgttggcctcaaatctttgcagttaacgggggacttgatgcttgatgaacaatccaattaaaattggcaacaaaagacctaaaatgtcagccaaattgctttttaatagtcaatgcagccgtcacaaaacataaacattaaagtccccatagaagcataaagcttcatggtgaaacaattctagaaaatgaataataattacagcatcctgaggattcttttaatagatgtgcactcattaaaatgattttgttggttagaaataagatgacaaagtttgtttctctgaatatttctttttatttgttatgttaacagtttggtttagagaggtgtgatttcagttagtaaccaaagaaataattttcaaagggttttaaaaatcctgaaagttttgacaaaaaaggagtataaaaagtatacatcatagcatgctacactttaaaataataatgacgaatcatttacttccctgacttttctcttttattgaaaatagatttttcttttataatatatactgattatgtttttcatccgtctacacctctcagttccttcccatctcctttctgtctctcattggaaatcagtcttctaatagataataataaaataaaaataaaaagataaaaaaatatcaaacactttggaaaagacaaaaccaacagaggtaaaacagtctaagaaaaggctcagaatcacataaagactcattcattcagaaaacccaaaaccataatatatatgcaaaggacaaataagctaagaagtaaataaataaaataaaagtaaaaataaaaattaaaaaagaaaattaaaattacaaaatgaaataaaaagccctaataccgctttctgagaccagaatccaaaggtaccattgaggttttttgtttgtctctctgtttttctcttggccatctacttcagagcatgcagactacccaaagagccatttgtttgcttattgagactccactggagggaaataagttttcatttacaaatggttatcaattatagattgtttctacgttatgaatgaaagcacgtgtctacttctttcagctctaggacctcatctggtgcagacccatgtaggccctgtgcatgctgcctcagtctctgtgagttcatatgtatgtcaatcttgttggtttagagggcctttttttcttggtgtcttccattccttctagctcttatcctccatgtacctcctcttagacatgttaccttatgccttaaagggtaagattttatggcaataacccatttacagctgagtgttccaagatctcctactcactgcattttgtctgaccatatgtctctgtattagttcctgatcttgcactgacttaaaaaataaaattgattgcatatttcatagatatataacatgccattgtaaaataacatataaatgaaacgggtgaaaaccagtcagtaatctctgagtagcaattaacattcagaggcttcagtctctggataagcaatatcaaatacataagtggattcatcacattgatatgccttatggagcagttttatttttagttgatggtacagattcaaaggtattaatgcatgttttttttttacctctggttcaattgttttgcacatggagagcaaagtagtagattttaggaaattttattttatgtgctatgaaaaacttacttgtcattattggtatgtatttcaatagatagagaaagaaattgtgtattttttttatctgtttgatgttgccacaggggggaaaacaccaaatgtctcctaaagaaaatgttttaaacattatgattttaataatacatatttattttctcaatgaattattgatacatatataatgtaccaacagagtattgaccactctgataatcaaaaatgagtaagatttgtatatgatcccaaacttactttttacttgaagtttagacatataaacaatttacgatagttcttcaaagtattcaaatcaagaaaataagaaaaaagatctccccaatactcatgagagtcttcttaccacatcttatatatttttaaaacgacttacccacattgatagatgagtagagccctcattcagatggtgccctaatacatttatgttttgaaatatctgtcaattaaacatagccttcctctacaatcatagactttaatttaatgtgtgatgaaggatatcttgatacttacacttctccagacgctgttcctctcttttatatattggataacttgatgctatggtttcagaacaacatttattttttttaaatccctcaaaggggtaatagatatattgggacttcaaactctattagctgaagcagtgaggagaaaagcctataggaatataaatgaaactttaatggcaccatatcacaaaatattaaatgattcaactcttcataaaaattgctcatgttttctgctctttttcataatataatgatgactacctatgtacacacatatatttatatctagctatctctaagtatatataagagagaagtgatatttaggctatgtctttaaactaccatttcagcctgtgtggaaataaagatgccttggtcttttatgcgcataatcatataaagtcctgtcagtaatttggttaagtgtgttttaacaaaccaaatctaccagctcttttgtcactgcatggactatagagtaacggagttaagcataatgtgtatacaaaaatagtatttagacattcacaaagaatttataaaagttcagcttgcaaaataacaatagagagtgataaagtatgtatgtgtgagagatctaaaccttcttctggccaatataaaactgttttctgaatgcttcatatttaccagtttcaattcaaagttaaaactctttattactttactaaacaaaaattgaaattgagtcctgttatgacctaagcgtttgatggacattgagaatttaaagatgaagaatatacagaattactcccaaggtcgaggctgtcaatgaaaaaaaaaaaaaaccaatcaaaacaacaaagagaaaatactatgataatgcagtcagatttctgataggtaactgtaatatatgacttgaatatacaaagtatagtggaataaagcattacagacaaagtaacattgctaaaaagatcacaggagcatcacagcaaaggcgacatatacaatactgtggcgatgcataagaacaagacaggtataatggaagttatccaggcttatatgttctatcaatgattttgaactgtatcttacaagcaataatgaaacattttttcatcatacttaataaaatgatgacaaactaattcattttgatagtgtattagaaacacacatgattaaataaggtgttgataaattatagaaataacatttatttatttatttatttatttatttgactgttcatttgtttattcaaatattttgatgagactccaacatgttaatctcaggaaaaggtacaatcaatattcctgaatatttttaattcatataaatcttttactgcatgttttctttgtaaagcacaatcagcacattttcatatagaaagaataaaaccagtttcataaccattttaaaaatcttcatttttaagttacagtattcagacacaacactcaataatattcaagatcgtctcatcaaggaaacttctctttgtaatgggcagagatcaccacagaaaactaaagtcctataaaaacacagttggagagcccaactccaactgatacatctacaacacaactctcttaaccaaggctcagagaatattgaagaagaagaaggaatggaatgtttctaggagccagggcatcatggagtttagaacgagattttgctttctcgtaatttcttaagctacacccaaaaagtgtcaacaacgggaccacccaaacctgactaactccagtgtacataccaaagtggacagaaaaaaagtgaggactccaacctatacaaagaactacaggtaactaatgatgctgagagaggagaaatagtcttcatcagggaaaagtacatcaattgacttctgatacaatatgatcaggtctgaaaatatacatacaagtaacattattcagactgatctggttatacttatgaatatgtatatacatatattcatgtcacaacattgtttttaaaaaggggccatgaatttgaacagggctatttgggagggtttggaaggtgaaatgatgtaattataatcttaaccaaaaaatagcaaaaataaaaattattcaaacaatgaaactccccacataattaatacttaactaatgatatgcaaaagtatatcattttaatccacaattgttttacagttaaaaccagtagcatgataaacaacttgacatatcaatcatttgaccagattgtaaatcaatgttttacaatttatttgtctcactatattccacatttagaatcagattttaaatcatactatacaaaactaaaaccaaagtttcatggaacaatttattcctttactcattgtgatgctctaccatatatactgttttatttcagtttttaacatgttggtcaaaatgttgttttcataacacatcaaatgatcatagttggactcctgaaaacaccaatcaaaatcgaaaatgtggcaaacagtgaattcagagtcagagagagagtttcacgacagccaagcaagacaatgttaagagactgtctcaaaatccttaggggaaaaagactttgtgccctttgcctgctttcttttcactacttattatctctgtgaccttggtaaagtcggttaacttatttggtttttatatacaaaatggaatgatgccttccttgtctatatcacagacttctgttgtagggaacaaatgagataatatatttcaaagtgctttgcaagccataaaacactatgtaagtgtaaggaggtgatagccataaaatgagactatacttcatagttatgtatttcatgtgactttggtgagccttttaatccttcaaattcattcatgaaaaataatttccttgagggtatctagtcacaccagatatatatgaaaataagtttgacaaagtgcttcccgttctgaataaaagacatcagtgacatcaattcaagtacagtttacatttttagcctcctagaaaagagtttgatacagatcaccacactttaaactaaaaagactcttgctaaaataatgggaagagtccatgactttatattatataatttgcttatatgacacatcctttgtgatacatggcactactgctaaagttagcctttggcaaaaatatgtcataaacacgtttgcagagctctaatagaaagaaatctataacagtgaaaaaggcaggcaagctatttatttgaaaaagcaatgcttagtaaaacatcattatgaactgtgttcatcacttgctttaaaaaaatttaaaaagacctgaaattcagtgatatggggggggggggagttgaccaattttgtccataagaagtttgttcagtactgactgtgtgccaaactggaagtgctaagaatctctttccaggagctttatcctctgttttttgtttgttgggggttttgtttgttttttgtttgttgttgttgttgttattgtttttttctaataaaccaagatacaaaaattcttttttattagatattttcttcatttacatttcaaatgctatctcgaaagtcccctataccctccccctgctctgcttccctacccacccactcccacttcttggccctggctttccactgtactgaggcatataaagtttgctagaccaaggggcctctcttcccagtgatggctgactaggccatcttctgctacatatgcagctagagacacaagctctgggggtactgattagttcatattactgttccacctatagggttgtagacccattcagctcttgggtactttctctagctcctccattgggggccctgtgttccaccctatagatgactgtgagcatccacttctgtatttgccaggtgctggcaaaggctcacaggagacagctatatcagggtcctttcagcaaaatctgttaacaatagtaaaacaggcaaaaatgtagccacagtgcctgagagatggctgaatggataaaggcacttgttgccaaaacaggtgatgtgagttcaagtaccataattaacacagtggaataaaacatctgaactgactcccacaagttttcctctgacctccacacaaatgcaagactacacacatctatgcacagacatgctacatagtgtaaaaaaataaataaagagcgagctatatgaaaattcacagacacagtggcaggcctggtttgtattaccttactcaaactcccgcaagtgatgaagatttatagatttattacaagtgtggggtgtgtgtgtgtgtgtgtgtgtgtgtgtgtataaagttcaaagtaaaggcaaaagtaaaagtgactctcattcaggaaatttcagtagaaagaatttgaatgttatggtgtccatagaatacagtggctgtatttagtcctggtattttgtgtatctgttctctccttgctactacatggtgtcagatatattaagaaatctgtaggtatatgtagaatatcatgtttttggaggttaaaatagaaagtatctgcttattttttaaatctcaatcacaagttacaatatagagggttagaaataaagatggcattttttgaacaagtgtgttttagcagattcgccttccccttcatctgcttttcatttagatttcaagaactttttagtgaataagacaggactgttccttagagagaaggaatatggacaatgaggcatgaatgtaagggcttagaggtggaaaccgtcaatggtctgttggatggtaagcaatggagtttgacaggacatgaagtatagaaagtgagaatagactgaaatcatgtgtttttcgtgtttaaatttttaataaaatcaaattcaattgcaatgtaataattctggttgcattttaaaatacagtgggcattttctaattaaaaaaaaacaacattattttaaataaggcattcttcaaaagatgtatcccattggcctttttagaaactagaacccagttttcactccaccatcaagcttctctagtgttaggcatggtgttagatcatacatagcctgataacatgagaagctccctattttaaatttctctgaggcacaaggacaaacacatacagaagacatccagagatgaacacttgtgcaaacgcctccattggatttcttgctctgttatttttccatatcccttactcctcagtcttccttatattcgacagctgcagagacacctaattggttatgaaattgaaatgtcaagccaaagatttatgtccctctatcagttatacaaccccccctctacttgtccatattcttttcccatattcctgtttccaggagcataaaataaatagtttcccataggaatatattgtccttaaagaatattgatgcctttagagaagtctgggatgtggacagtgaatctctgataaaatttgattatactttatagtgtcacattagtaaatattttaaacataaattcctgaataattgttgaaccaaagcttagccaatccttgcaaatataagttctatgtagtcgtttgtaccagtagaagacttattttttgtaataattctccaggtaatacaggttcccaatatgacacagttacaatggtatccaacaagatcataatccactttgggatagaaaagtatcattctaatccttctgaatgtcttccagaaagaaaaaggtacacatctaataaggttatttcaatttaatccccaaattgggatctattgctaactgtattgagtaccaggttcagatgatcatctactggcatagcactggtcatatgtgtaaatggatctaaagccaaagaaatatcttcataagaatcctataatatttataaaatgggtatttacaagttaatcatgagacactagggtaacaaaacctttctggagagacagagccttcataacacatgccttcccactgatttcaagcatttgtatacacgtgcttatatttgtgtatatgcatagtagaatttaatattttatgtaatctagtagatcagcacaatatttcactggcttttacattctttcttcatcttcttccacaattctccctgaggcttagagagaggacagatgaaacatacatttaggactgatattccccagtattgtattctctgcacattaacaagttgagtgtctctgtattaataaccatctattttaaaagaagcttcttgacataagataagttagatgcatgactcacagtagctgggtcttcatgcacaagacctttgcagtactgagccagctaaatctccatcatggaagggagtagggtacactctttaaagtcatacttctggctggaagctgctggctattgatgactgctgggagagagagaataagttttcttcagagatgtggctcccaaaatgctacacatgctccagtaaatagccctatatgcaggcacatattatataggagtatccagttggtgaaacatgaagttgggaggaaataatggtggaaggtataggagagatatttaaaatttttccttttcaaaacataattaaattttaaatgattcaaaaacaaaaacaatgagcatacaattttctgttgaacatttttttccaggaaccctgggttaagaatacttataatggaggcaaacaaaatactttttgttcaaaagaatgcattatagtacattcatagcagacaacattttacaatagcggacaaaagtaaatgaaattggcaagtgaaaaatactgctgaaactaaggtcatgtcgaatgctcagttgtttatatgatgtctcttatggcctattgagagaagtgacattcacttttaacattatgtcttgcgtatattacaaagccaacaataaccagtataaacactcttgtttagataacaaaatagacagcttagggtcagaaaaatttcaagtcaacattagagcatctgtcatttttgttctctgtctttatccatttgtttatttccattcattgctcaagccacccagttactttgttcctttacaagaggtccatttcccttttctatgtaccattcagcctttctgtaaacgttctgggatctctttgcaactttggcactggttgctagacctggctctttcagtcacctctgtgcatgtacatacacttgtcctatcctgatgactactcactgttgcttgtggttatttctcagacagatacatccagtaggtaaaaaggaagatatatttaataacagcttgatttatatacttttttttagaataaagtgagtaaaggaagcataaatgtaactgttgctcttttatttccaacatatattttctgaaagacagatgctggtaaccattctatatagaggtaaaagggttattaatacttggagggaaagaagtcatgttcctctcaaatgcctctaatggtttaaacatgtgatcttgagaaaataatataaatttttcatgcttcatttttcctcatcttgtatttaaatgtatttatttattgcaccagcaactttataatagcaataacttaccacatcttataatgagaatgatgatggcgatgataaataaatggaatgatatttgcacctctctctgtcagagacctgaaagtaattaaacacagtagaaactatttactcagaatgtcttagacccgatctcttctagattaattatattagaatttagatatcttaatttcaggcaaacataacaatttttaaaggcatgttagctcataaattttcctacatagtgtgggatgcaaagcagagtaagaaataatttttgaaaaattctctgtgctttagaaagcatgatgcataacgtaaaattaagatttgtataaaataaagacatgttttaaaacctgtcttgataacgtttatagcatgctattatgcaatcaaggttaattaatgctatatactgaggtatgttcccccaaatccttgtgttaaaatcatagcagaggtgatagcatggtcttgctaccctatataccaacatgattgtatttgcagatgggacttgcagggatcattgcgtctagataatgccatgacagttcactctcatgggagagtaatgtccttatgaggagagactcattctcccttcaccctatgagcacacagcaaaaagggtgtcatctgaaagccaggaataagatcctcctaagaaagcaacaatgttggcatttggaaatttatacttctcgtctccaagttgtgagaacataatgttctgttatttaagcctgactttttctctgggtaaaatatcttccaggtctacctatctgtgccattgaaagtggtaggatttcctttatggttaataataccccattatgtctacatatcacatactatgtatctatttatttgttaatgggtgtttgggttgacagcatttcttggctattacagccaaagcaacagtgactatggatgtgcaaatatgttttaaaattctgtttccaactaatttatttaaattctcttaagtgaaattgctggatcatgtaggaactaaactttttataatttgaaaacttcattatttgtgtttcatagcattctaagagcacaaaactgcatcttgtctacactctctccaacatttgttatttttctgaatatttataattcacatcataatggggtaagtgacagcttgctgtggtttcatttgcttttttataaagagctgtattgatcatctgtagatcttctttggaaaagtatctattgagcatcttttatttatttccttaccaagttattcatattttgctgttgacttgcatggtggtttgaatgaaaatggcccctagaagatggtagatttgaatatgtggcctctagtttggggaactgttttgggaagaattaggtggtatggtctttttggaagaagtgtataattaagcataggttttgagctatcaaaagtccatgccaggcccaggctcttgcatctctttctctcctccttccttccctccaacttgcagaactgggtataagctcttagttgttgctccagtgccgtgcctctgttctccaatgaaatgcattcatttataacctttcttggttatagtgactcttcacagcaacagaacagtgactaaagtgactaagatgatttgtatgcattccatgcatataatggatgaaaattcctccttaaacttgtacttgcaaatatttatcccatttcataggaattttcaatttactcagtgttttcctttgatacatgagataaacaagcttaaagtaatttcaaaaaaattttcattgttcatatatttccactcattagtcttctatataaacttttgttgtattgtttagggcttgaggatgcatttgtttactgcacatttttttgatttttataaataaaaatgttgtttaagttgattttatctacatgttgtattttgaagaatataggtacatatacataccagatctccaaatatgaaataacaatcaacatgtttttacagaatgtaattttaaattcaattttaattttaatggacaagacactgctcacccttggcccagataaccacctcttttgtcatggtatagaaatagaaatgctttatataacacatgtattctgtctatacatattaaatttattttcattatattatgaagtattatgttttatatgtataaatataattctttcatttatgatttttattagagtgtgattggaaaacaaaattatatatatacatatatatatgtatatcattatgagaacttactcaccttgtttaatgattcttataatgatatataataaactcctcacttgacacagattattcatgcatatacttattttaaactgactgtcagggagctcagactggccttgaacttactatgtagttgaggataaccttgatcttttgatgtttctgcctctacaagctgagtgcttaggttgtaggcatgcaccattaagcacagttagtgcagtgcaaagtaccaaacccaatgcttttatctatattattcaaacacagtatcaactgaactgaatatatccttagccttttatgcacatttttgagaccagcttagtatccacaaaattgttaaatattagatgtgggtatatctgtggaggatttcactatgggtatatttagtataatcaaccattacagctattttactgagtaacatatgcactgttactatttgtagagttactaagcccctagtatcccctcataattatccattgttgtaattataaagtacatttagaggaaaatccctacacataattcataacttaaatagatctattttattttgatacaatttatttgatactaacttggcattccccataaaggaagagatggatatcaggaatgatcaaactgactaccagaggatatattataatatactccaatgaacatatgtacaccacggcatacatgaacatacacatgaggatatacatgtgcatgtacacatacagaaataaacataataaaaacatccttaaagtagaaagtgatctaaatacttgagtagccttgcccaatcccatcactggtggctcttacagagaaagagggagggatttttttctttgtttcttttttttttttttgtatttttttcaggaacattttaacaaatagtagaaaaagcagtagtaacagaaacaacaacaaacatgaatatgccagtcttctcttaaaattatttttaatataggttaattgaatataattgtattactttcccccttcctttcctccaaccaaccctgccagccatcctccctcaaaccagccccatgttcctcactctcaagctgatagcctttttttagtattggtacatacatatacatatgtgtgcatgtatgttcatatattcttggatatataaatacaacctgctgaatccattttaatgatgtgtgtgtggaggtagcttgaatgaaaatagcccctatatcatcatagaaggtggcactgttaggagatgtggccttgttggagaaagtatgttactacatgtgggcttttatgtctcagatgcttaagctagaccttgtgtcaccttctcttgctactgactttgacttcagatatagaactgtcagctgctcttcatcatgtctgcctaagtgcttcatacttcccaccaggatgataatggactaaacttcagagctataagacagttacaattaaatgttttcctttaaaagagttgccttggtcatggtggctcttcacagccatagaaattttaatgaagaagttgatacccaggaatggggtattgctgagttagacttgaccatgcttttgattaagagaacatggacattgggacgttggatttggaaagtagtggaattctttaaacaacactcaatgggccataatagtataagcacagacgacagtggtgctgagagtaatttgaactgtgagggcccaaagatgtttcagatgtattagtctatgggctggaaaccattcttgtaatattttggctaagaaaatgtttgctttctgcccttgtgcaaaaaaaaaaaaaaaaaaaaatctgcctgaggttaaactgaagagatatgaattaatagctttggcagaggaagtttccagatagcctaatagtgactgtgttacttggtaattagtgaccatgcttatgcagatctatagtgtaaagtaataatctgagccaagaaaaataacaaatgtacagtttgaggataaaggagtacaaggaaaaaggtttttttttttttttttaaagtctattgctaaatggattaaatggagtgaccccagatcaaaacctcacctagctaagcttccaatttgtggaagggcgttaaggagaagatgggtagcaaacacctttaatcacagcagaaatcaggaggaaacaggcagtggatttctgatttcaagaagagcctgggctatagagctaattccagtacagccaaacttaggcaatgaaggaaacagtggaaaacagaaattgactgaaaatgcatttgaccaagggagccatgtttcactcccagcaaacagtagaacttgatagcttcagctgtgtgcttctggctttagagtcaaggatacaagaaaggggttacagaatctccctccataactaaagaaagccaaggctaggaatatatcaggggtatcccacattgagtattagagagggcatttcatgttcctatgaaggtgaaacctggattgctttggagaccccaaatgttggagttgtcagaattgtgcgatacctgcagaagaaagctacttatatgagtggaaccatcccaagagaaagaagtgttgcagtcagcaaagctaaaatgagttatagatctgaagagcactttgacatcagacatggagatgtagagtttggagttttcccagctggtttttggtcttgttttggctcagtatttactatgcttcatttcctgcttttttgaatgtaaatatgtattctgtgccagatatgtcagaagtatgcgatctgctgtttgattttgattttataaaatactatagttaagcgattgtcatagatttcaaaagagattttagcctttggccttttaaacaatttgagacttatggactatggagacttttgtaggggagctaaatgcatttctgcaatatgatatagctataagcctattggtcagggagaggaatgtgatagtttgaatgaaaatgtagccacaggtcattgggaataccactattaggggatatggccttattggagtagatgtggccatgttggagctcattgttggtaggctttgaggtttcaaatactcaagtcaggcccaatgacactctctcttcctgatgcctgtggatttggatacagaactatcaggtccttctccagtaccatgtctgcctgcataccaccatgcttcctgtcataacaataatggactatgcttctgaacctgttggtcagccccaattaaatgattccctttatatgaattattttgtcatggtgtcttttcacagcaattgaaaccctagctaaaatagtgagtatatcgtttttaaggatgtctagtctgcattgtatagccaacaaggggttcatccatatatgaagctaattctcctttcccagtaataattggttacctgtagttctttgtctagacgactctgtacacgtttcctatttccatgttaacatatccattgatattttcactgttctcatcttgtttatgcaatttctagaagactgtttcaccaaagacttactggtattctggcttctccactattctgacccctcttctggataatgttctttgaaccatatatgcagaaactgtgatggagaggtatctgttgggactgggctcctcatgatctgttgatctctaaattatgtcagatgttttattttgttttgttttgttttaatttcactggcttaattttttaaaatgaaaaattcaggtgatgccagtgttgtttacatataatataaactatcatcaatattgtcatgtattaaaattatatttggggcagggtgtcttagcagttaagaacactggctgctcttccagagatttgagttcaattccaagcagttgaatacatgctgtctcataaccatctgtaaagggatctgatgttttctcctggcttgtaggtttaaaacattcctacatttaagaaatgcatgaagaaattaattgtaaagactatatttgggtacatggtaaagcagggttattgtatgatgacaaacagctcagatattattagcttataatatggctgctggtctttatgtctataaagtttctgcttatatatctactgtaaaaaactctacttgtaggtcattattcttctaaatcacatagtttgttatgtggtatttcacgtatatgatctttagatgtttctgaaaattctggcactttgaccagatatacaaactcctactaacctcatgaggtctgttatactttgagaaaattctttgaaaggcagctttgcttgaagcttggcccagtgaataaagcatcagataatatttgtgaaagtctttgaggaacgcagatgaaaggtgccttgtaaatacaaagcactaatgttgcatgcatggaaatactttcccttcacatcattgctataatagctaagttctgaggtgctgttgaaatagatactttcagaaagcatgcatatccccaaattattgagtatggaggcatatgcaagataatgcatccaaagtcctcaaatgagaaacatgaagcactacttgttatgggaagtaaaagaaactgagactaataaaaaagccaatcaatagaggggttcagagtgcttagaggaagcataaaggatagacatcagcaattcttgtttactcatgacttcaataacatctttgaagactattatatgaaaaggagaaagtgaaaaatctagaaagaattttaactataatggaggaattgctaaaaaccaagtgtcttgaaaccaagtagatttcatttcatttacttgctagatggtacttgaatattacagatctcatggtgttcacaaattcatcattcatttactaattatatgcattctttatacattataccaagtactctacacattcgtacatttgattgtagcaagtttttaaagatgctaacactatcctaacttcatagaagagaaaacagaggcttgaaaagttgtatttgcactttgtggtaaatggcacagccatgctgatctgattctaatgcctgaaactgagttcatcatcacttagaaatgtcataatgtagccactaacctaaacttatataaaatggtaccttttatgaatattttcattaattccttgaggatttcatacatagtattttgatcgtgtctactcccatttccaaagacctcctagatctacccctgattctgtatctatccatctctttcccatctaataggacaaaattcagtcccattagagttgactatatattcttaggtatgtggtcatttactgggttgtattagagacatactttaaaaataattaaatttaaattaatttaaaaatctccaggcaactacaaattaccaacagctcctcaatctaggagtggaacttcatactatcttctaattttatactgtgattttgtctggcttcaatgtccttgggccttgtgcacatcatcacaatttcagggaattcatatgaacaactgcctgggtgcgtctggaagtcacagtttcattgaagttatctattgcctctgtctattacaatcttctttaagtaagcaaggtagtaatagagaactcatggtatacttaatccactttacttaaaaactaaacaaaacaaaacaaaactgaaaccaatatgtttatttcttcattctgcatcaatgtgcaagtattccacaactaattaggtcagtttctgtttatcttttcctttttgataatttgtattaatggtcacaagtaataatagcacactattaaggttttactcctccttttaaagatagatatttgttcaataatatattacccttgagtttgtactttctgcatctataggtcttgacctataggtgagttttgataacaactgggagatcctatggtagactatgatcaaacatgccaatagacatatttagctagataaatggagcatacttgggctctgtgttctgttttctgatgagacaagtttccgtaatgttggcatagatttgaagatcaaagagctaaacaataagcttgagtgacatgacatcctgaaaatcacaatcatgatttatattacagtttcccaataccagtgaggctaagagtacacacaacatcaatcacataattttatgttagtgtatgctgatgtaaaaacatattaatgtgagtgagagcttgactttatagagtacaagggatgtaaaaaggatccatgtacccacctgaatcctgatttgaattctgtctttacaatgagtttttgacactcaacaataaaccaaagcaaaagcaaagttgaatccaatccaggttatcatcaggaccatccatgaacttaaatcactgtgtggtctatgcaaatttagacattcaggaaagagcattatgcactcagccactgagttaagatcctagaattctcttttagaaactacttcacataagtaatatgtctaatgctatgttcctcttaacatctcacacaccatcagcacaatacttctccccccaccttggatattttctcaaattatatttaaattagcctaagttaaaattaacttgttcatgagacttgcttgaatgaaacttaccaatcactaccatgaatttttttatttctaggataatgactagtattgttatcagcataatacattcataatgttttcaaaacacattcttacttttccttctgtgtatataatctgattttcttccctttgagatgagctattttttcatttgacctattttctagtttgaaaaacttctatttatctatgccttccattaatctcaatggtaggagctgtccaatatagttttcaatccacattgaatattatagtagaacattctactaatttgcttattttgatgaacatttttcacttgatccagtaagggaagtatctacataaaagtatgtttcctaactgagctgtttccttattacttctttagctgtctttcagttagtgaattctccaaacaatgtacatatagcttgaagctgcatgtggaaatctattgctacaaaaggatttatgtcaacatttttggattctggatgatattcatctaagatattgtatctctttgaagaaccataatgatctacttaattttaaagagtatctgtggagattagcaataatgtaattgaagggaagaatcagatattgaaagaaaaataaagcaagttaaaaatgaaaagcttaccacaagcaatgcttgtaagatagctttgtaatagtttcatagatcctcaagttgacatctcagaaaatatctcaacataatctcttataaaaaatgttgaaagagaaaaataaaatttatgataagagaattaatcaaatgacatttcaggtaaaagatatttttcagatataagctatgtccacacaatgagaaaacagttagtaaaaagggaaaatgcaggcaagtaagttattaggcatcataaaacattctgcacaaacacttggtagtttttgacaaaatggttgaattaaaattttaaagatttaaatttgttcaaattaattccttttgaaaaaaaaaaccttgaaaataaaataatacaaagacaggctagacaggagaatcgtaatggttattcaaatccaaatcataagggatatattccctgagttcacaataggaaatcaagggtgcctgtctatgtgtgtgtctctgtgtatgtgtgtgtgtttgtgtttatgtgtgtgggtgtgtgagagagagagttaagcaatgagaaaaaatcctttcagatcttatatatatatatatattcatataattgtgccatatgttcccattttacaagatggaagcctattcaactgttccccaaaataatgtcatgccagaattccttcacaaaactcaacttactcctttcaactggtattctttgtccctaaaattgtgtttaaggtgggactgcagagtacagggataggttttcatcagatgtgtaggaattgatgcttggcagtaggatttagaacctgaatgttttctttggctttggaggactttgggtaatgataaaaatcctctctaggcttccctgctctctaggttttgttcatatttcttagactcatctttttatttttgtagctaatgttgctgtttttttatttctgttactatttttataggatgctctaatcaattaatatatgataccttagaacttctgacattaaataccaggaaggtaagatggagaggtgacatgcagcctggattcagtttcttttcacagtgtttatttgacactaaggtgttaagcaaagtaaaaccaaagtttctgatttgtgcttcggtgttctaaattctgttttcacaaataacactgcaataatttttatgcattgctttctgagcaaatataagatgaccatttataacagtgcaatataaatgaagccctgaaaatgaaaatcgtaaaattctagaatatctgttattaatgtattaaatgatacactgacacttaattcaggactttccattagtagcttttcaataaataatgatcttcgggctgaaataacttacatacctacatgtaactttaatttcagtgtaaagtaaatattaaacatccatagatgattacttttttatattttctttatggtatacttcactagctaaaagtggaagccaaagaatcaatgttagcatgctataaaatatgccaattacctatttcttgttttatggtatatactggatgacagtttccattaaggacatatgagtacttattttaattttattatcttatattaatatatagtgatatttgaaattccaaattatacaataaaccatgtttgtttgtttgtttgtttttacaattctgcttacataaaggataatttcttagtgtaacaaatgctttggctctaatagacatgcttaaataaataggaaaagaggtttgaaccatatcaaaagaactacaggaaactaagaagagtgctaagagtgggaggaaataggtttctttaaggaaaatcaaaccaattggctatttaatattaactgatcacccctggaaacatgcattcaaataacactgtatagactgagcagattatatttagtatgtatgtatgtgtgtggatagatagatagatagatagatagatatgcaagtagcaacaattaaaagaaagaaagtgacatgtgtttgaaagagagaaagaataggaaggtttggtaaaattgaatgaatgatataattaaaaacaatagaaaaattaaaatatagaattgccaatttgggggaatgggaagctcatctgttaagacttgtggctcctacaggccacatcaggcacgtttcaaacacttgttagctctagctccagggatttaacactgccttcccagcaacactgccttcccagcacacacacacacacacacacacacacacacacacacacacacacgactcaaatgtttaaaattgtcaattagtctaaaatacaagcaaagattcacagcagtgaaaattaggtaattttactactacagtaataatttaagcaaaacagcatttactagagctctctccttcctcttgcttgtaaagtcctagtttactcatcatagtctgaattgaagaattgtcttagcaaacaagccacttataagcagaaacattaactattatgcctaaggttgggtaatttgactaagtaaaggcaatccagtgcacatctcagcgaagtcaggaacaattgggctcgaggcatgctgctttgtggattgtttttcttgtaacgcccatgaaataacaaaaagaaaaaaaaaaggaagtgaagaagacatagaaactttctgaaggttgatctctcgcttcaaatgtaaacatgagagagcttacgtgtaacatatgagtttcagcataatcatctcaaatgggagatccttcagcattgacctttacacctagtagttatgacaacacaactaacaaaacttaactatgaatactactttacttgatggcttaacaagaagataatacaaagtcttcaaagaggtatattttgccatctcagagacactgaatggtgtcagagagctgtgggagcatgcctaggtcactgatacagtaccaaactaaactcatgtacaattcaaagcattataatttattggtagcctagccccagaacttctctgaggcttctcctccagtaatccaccttaattgtgaattctccctttctcttcagctgctctttctattgttgcttggatctgcctcagcagcatggccatacacatacataaacattcgcactttttgagattataacacgattacatttctcccttctcttttcactctgaaccatcctgtatacccttttgttcaaattcatgaactctttttgcttagttcttctgtgcattgttatatttgttatgttaaaacctcttgagcctttcctcatccatttcagcatctcctaggctatctctttaatagaattcatttttctcctcaaaccacttgaatgcttaacaggtgattatatatttatatgtgtgtgtgtggggtgtgtgtgtgtgtgtgtgtgcataaaacctataagtacaatagaggctggggagatgccttggcagttaaaatcagttgttggctcttgcaaaagacccaggtttcgttgccatcacccacatataaccatctgtcactccagttccagaggatctaatacactcttcttgcccatgtgggcagcagttacatggtggcactcaaacatacattaagagagaatacccatatatacaatataaaatgtattaatgtttaaagaaagaattacagtcacattaatattaaagatgttttggttcatccagagaaaggataaactatacttgtccactctcttttcttgaaaaaaaaaaaacaaatttcttagctttttgatcttctactctctaatagtaaattgtacgtttgaaacctcaagtgtccataggcagatatacttaagattaacttcttgatcactgagcactgtgaaggtaacagtcattagccttaagattaacatttatgtgctagtttcacatgagttataagaacttattatgacaagtgaacaatttaacactataaagtagacatatatgcttaggatttgtaggagtggttaatactagtaataaacccctctgccttcctggaagcccgtttcctttgatttcctctcaagcctaggagaacagttgagaaagtaacaccaagtggcacagccttataattatccttgagatacctgataaaagtagttatgacaaaagcctggtgttatttgcacacatacattatgatgatctttatgcaaatgcattaatgttacttccaaaaattcatcattactaacatatgccaataattcctaattcaatatattttgggtctacctgattcaaaatttcaatttttttttctgaacttataaaggcaactttacgcacacactgtgcattgcataataccatgtgttgggttgtaggctaatatcctttaatgaaattcactatttttccaatccaatgtataaacccccctttaataaaagatcataattatgctgaaacaataccactctgccaccagaggaattggaaagaaagccaacagtcttcatgatctttttttactttagcccagtaagagatacaatttctgactctttatgacatttatcctaaatgatagaagtagatatggcctctttggcaacatgcacaacatgatatctttgggggaaaacaaatttgagagaacataatcacagtatcactaaagtaaagagaggtaattttaatacataatattgttttaaaaacggatagtatatctactttggttaaattgtccaagagaaatgacatagttggcataattttaatactggtaatatttttaacatccaaataaaattattttttatgttcagttaattctgctacagcatttattttgaaagcattaatttgttcctttgctattcggtgtctttaaaacagcttttaaatttaagccaaaatttgtgtttccaacctgttaaaaacaagcactagatgaatgaggaaaaactgcatgcagaggaacgccacatgcaaatccatgcaatgggcacactgaaacacccccatgcatattagtagccttctctatgaacagctgacattaggactactgtcacaggcagataatcctcctactattttctttctatcttttattatttattaatcattttactatttaaatttcaaatgttatccccatcactgtccccccccatgaacttcctaccgaattcccctcccctttgcctctatgagggtgctcctccacccaatcacccagcccatctcacctctctagcattctcctcctctggagcatcaagcctccacaggttcaagcgcctcccctcccactgatgccagatgaggcaatcctctgctacatatatagtgggagccatggacaggttcatgtttactctttggttggtaattaatccctgggagctctgaagagttctaataacacaatgtttgcaaccctccaacacccattttcacaaacagatttcaaatatttttgaaaataaaatatcatacttggtttgccattcgtccatttgttaattaccaatatgtataaaactctactatcactcttactaagtctctttctttaaatatatcattgatagtttagggagtattatattctgtattagttcttctgttgccatgacacaatattggacagaaacaaattagaaaagaattgttgtcttacaagtcctgggggtacagtttaatataacaaggaaggcatagcagtacaagtagaaggtgactgggtacattacttacaaggacaataattatagaacaatgaataatttagctcagttccatctccgcttttcatgaagaagagggtccgagcctaggaaatggtacccactacagctagaatggttcaccactgtcccggttaacttaatatctcttcacaaattgtccacttgcttgtcttttcaatgattctagctcttgtcaagctaaaaatttacattcactatcacactctccaacataatttttaaagaatttcaacgttgatttccatagtataataaattttaaaaatgaatgcaatgccttttagcagaactcaatgttaatgaaatataaaaggcaagatatcctagagaggttttgtaatttctgctgaaagtttatacaacagtgatccatattaagcatcatctgcaaaatcagttggggaagatgcatgccaccttcttaccttatagagaaaaaagaagtactctttaaaagcatatacttctaccaacaaccctgccacatgtaaaatatcttagatctacagtttggagtgatttccccactgagtgattattttacccagttattttaggacctcacacctgaaattggttcatttccacatatattatatgaattagaccttgccatttgaaaacttaatttacttctagaaagctttagaactgtgtttgaacattgatatttgtgtaaccccccatagctcccaattttgcttctttcacttgggcactggactgtatggttgccaaaaacatttggaagtgcgtgcatacaactccaaacctgacagaattagtgctctatagctcctaacactgaacactaatgtatttttcattactgtttaatgttgggaaatcccatttcatggagcccaaggattaaattgctttacttggagggaacaagtgcattctccatctttttcctgaggtgataaaaagaaaaagaaaagaaaagaaaagaaaagaaaagaaaagaaaagaaagaaaaatgagtatgagatcatttgtatttcataaaggttaaggtctgcatgtaagaaattaagtataacataccaaaactgtgaaagcatttaaagaaaatattagcattatgaatgactctgcatttgaaatatgggaataaaaatagatagtaaaattcattgttatatgcatatgagtaaatatgcatatttaattatgcatgtatgcacatgtatcaatatacacatatataattatgattactgtacataacaattctacctgcagtagaagtgtaataatatatactaatgtgtgtgtgtgtatatatatatacacacacacataaaagtagattatattgattgatttttattttgtacaacactactgaatggcaactttcttttgaataacttccttaaagaaagtatggcataggctagtaaatatcatgtgtttgtttagaggtattctaaacttgaacactgaaataaaacttcctctggctgtgaaaaaccacaatggcttctttttctctacatcattaaatgtttcttatacgtgattttggatgccaaatctgtactgtgatagtattcctcttgacactttgtgagagaattgcttaaaatgcctccttttgcatagtattgttcttccccagggtcctaagaaaagactttcaatgaagaaacatacctgtctatgagcaatcaactagatattcagtagatatgcataagaatgataaccaaagaaaacactacaggaaattctttaggacccatgaatgaatcaaaatcctttgggaccttgctttaaatcagtactgtactccatggtttctgacataaaagagaagttgaatatgacaattcactaagaaatacatattcttagagaaaaggcaaaacgtgtgctctataaaataaataccatagtttatcaacctcaaaggctaaactttattaagaacagtaaatgttaaaattatagaaaagagtcaccttcattatccaagttaatataatagagagtactgaataatgaatcaccacacaggcgattttataacagtttattctgatgggcagtgtcaattttcaacttgatagacactagaatcatctcggagataagcctctggtcttgactatggggaataattttggttgcatgttgattgatgtggggaaagtcatcttaatccccaaggcacagaactgcgaactgtataagatcaagaaagcaagctaagcaagagctcacattcagtcctctctgttttccaattgtggatgtgatatgatcaactgcatcaagcttctgctcccttgacttccccactacagtagattgtcctttgaactgggccttagtgagggtttcattgctgtgaagggacattgtgactatagcaactcttataaaggaaaatattttactagggctggcttacagtttcagagtttcggtccattatcattatgacaggaaccatgacaacatacaggcagacactgtgctgaagaagaagcccagagttctacattttgattcaaagactgcagaagtagactgtgttccacactgactatagtttgaacacaggagacctcaaaggccacctcaacagtgacatgcttcctccaacaaggctgaacctactccaacaaggccatatctcctaatagtgccactctctatgagccaagcattcaaaatcatgaatcttgggtgaaggcatttctatgaaaaccactacaattgtaagttaaaataaaacatttctccttgaagttgcttttgtgagaatatttttatcatatcaaaaggaaaagaaactaaggtagtgcgtgactgggcatgtcatttcaactctccagggccttccggttcatcatctgaagccagactacagactctgtattcttcccattcttaacatcttctactacagtcagcatatagtcatcagcatattatcttcatctccatcttttagcagccaaattcatcaaaaggatattatattagatataatagacatattgtaagtgacaggttcaagtttaggtatgaaagaaactgaactccaagccaagtttgacattccgccaaagcctgtgctcttttatagcattttgccatccactacctttcattctgtgttttataagttatagtaacttaggaaggaagcagacacataaagataagtgaaacatttagaaaatgtacaagattttatgtctgtgaatcataaggaaaaaaactgtattagccatatctgtaccatggtactggtcaaagaatcatatgtgcattctattcatgttaaactactaatttgctttggttcctagacaactttcccatctgaaaaatgagagaatctactagcactttatgcttccttgaatctaaaaaatgcaaatcatatttctgtctatgtgattatgaatacggatgcaaacgttttaaaatattaaaaaaatgttaggtactagtgatgatgtttggggatttatgggtttggtgttgaacagagagtcctagggtagtttaggaattttacggattgctttaagtatagaaagataactgaactcctagaggaatctgtaaataacataatcttcactctttaccctatctgccttttgtgcaattcatattttcatatgttgagtttatttaaaaggggaaccacgtgtactagaaaattcaaccaagaatttgtcatacttttgctcctgggatagcatttttcttttttgatatgaaaaccaagccaatgtctttaaaattcatgtctgaagtggaaggattgaaagaagtgattttttttcctctgatcagtccctgcaaagtgggcctcagaacacaccagctgagccctctgttaggcagagaaagcctctggcatttttctgcttttcaattctgtcattggggaggtgggacaaagctgtaccatctacaaagtttatccagaacgtgctggtgttacaagctatacttgacatctattatgtttctcctgtggaagaggaaaaactatctgttacaatagtgatttcttttcaaagggctttaattggggtatttctcctgggccagattctaactaactttcttgatatgtgcctgtccagacagcgatggaaaactaccaaacactagcaacatcaggagtctgaggacttctttccctatctgcaaacaagcaggaaaaaaatatctttccattgctacctagggtattctaacatagcagagctcctaaaagggtgtagcaaaaggcaaggtgttcagacttcgctttgcatggccatggaaatgtgtatagtagccagaacaacatccccttagcctactttttacaaggagatgttgggtttatgaagagattagttccgcacagttgagttacacacttgtgaagtatttttctgaaatatggatttcctcctgtgtaggcaggctaacatcctttcctgaggtaagtcagaaggtggccttatatttttatttgaagtacagaatgatttctcctcacaacaaatttgtgcctctcactagtattttcagaaatgtgatttttttttttgcaacggatggaaatcatgtcccttccattctgtagccgtatatctcgttgatgacaaattgtgtgaggtggcctcattacttttagcttctatattcctgaagaatttacacataaatgtaaccatggatgttttacatttcatatgcttgctggacgtgcttttttaagtgacgtctttacagatgaacttcaaacttttcttccaccccacaggttacattatctgaaagcccagtaagtctgtcatgctgtgctcccaaagtaggagagtaagttttttattttctgtttttcttctctcaattttagacatgcaaagcagcccacacaaccagttcaccttcagacccctcccaccaccgccacctcctccacatgcctgcacctgtgccaggaagccacctcctacagtggactctctacaaagaagatcaatgactacccgcagccagcccagcccagctgctcctgctcctccaaccagcacacaggattcagttcatctgcataacagctgggtcttgaacagtaacataccactggagaccaggtacttaagctattattcaccctactacatttgaatattgacagatgatgactctcctgattgcaggaactcctttcaccatagttatctgcaaagaaacaaacatgtaccattacacacagccaggtatacaaataaaagggcagatcccttcataggcacacatggaataatgtactgggcacattttcacatagatgtatgtataaagatgcaatcccgtgcataaatagctcattttcagacaccctccaaaactaaaataaagcaatgatctgaactgtcactgtgcccttaacatgaaaaataactgtgttgtgtttcaaagatttacagagagagagagagagagagagagagagagagagagagagagagaaaagaaaagagagaaagagaggaagaaaggaagaaagaaagaaagaaagaaaggaaggaaggaaggaaggaaggaaggaaggaaggaagaaagaaagaaagaaagaaagaaagaaagaagaaagagaaagagaaagagaggaagaaaggaaggaaggaaggaaggaaggaaggaaggaaggaaggaagaaagaagaaagaaagaaagaaagacaaacagttggataaatagtagtcactgccatattatttcttataaaaatcatttgaaaagaaagtgccttctaatagtttagaaagggtaacatgaaaattgtattctagtagcatgactcgtagaagggaaataaggcactatttttctgtcatatttgagtttctaaattcattccctaaattttattgtgagcaaagttctactcctctgtagctctgggtcctctgagcagaaaggcactttggcactaggcaaatggaaagtcactcgccatttcccatcgttctttctttaaaaatttaccatttttagaaaaggcagtctagctcagcaatagagctcttgccagtcattcagaagaccctgacttcaatcctcatcatcacatacccaaatgtcactttctattaacataggaaaggataactagtgaagcatactgctctgttgtcaaattccaggagttcctgttgacttctttatgtcttaattatttttgaaagacaattttatataaacaacattcataatatatcagtcaataaacaatgcctgtcatgaacttctatcttaatatcctctgggaatcataacagaaagggagtgactaataaactcacattatgaggttttcctccttagtagcatattaaattagagggcatcagcaagtatcaccattaacacactgaaagtgctgtggccgcaatccagaaaactgtatcatttaccacatacttgattaaaaaggttttataagccactcttttctgctaccttctgatagaaagcacagtggtagtagtcagcacctatggtgaagacaacagattttgaatactagtaatgataaggtttgtgcatttttattatcattgagaatttcatacaggtatacgtgtttttcgataaaatctaacctttatttcttccccattcctttccttatcctcctactccttgttcatcttcttcttattttttattgtaatcaaagggagaaaatgtataaagtgagagaagcaaaggttaaaggaactattcaggggcagaagaggtagctcagcagttaagagaactctctgttcctccagtagacctgggtttaattcccagctccaaggtcactcacagctatgtacctctagtcccatgggatctgataacattttctgcctaacttgggcaccaggcatgcacatggtacacagatgtatgtgtgaggcaaaacacctaaagtaaacatataaaattaaattttttgaataataatagaaatccttatagttttaaacagatgtatctccctcattctcctttcgactcttctgtggggcttgcaatagctaaggaaagagtgggacaatatggttaactagctgttctgtcaagtaacacagttccatcctcaggaagacaaataacaggaaatctggaaggaggatgagcaggctcaggcaaattaagaaataaaactattcttatttgaaatgtgcatctaggcatgtttgtacaaattgcacccacggaccttctgtatctgtacaaggaatgtattaattggtctcagtttcctaagatgtagagacaaacataagtttccatgtgatactgagaagagagcctttttagtccatttggaaatatattcagcatcagaaaaataagttaaaaatacttggaagccttactggcctgattaactaaagctttccaattttatccttgaaaaatattcatttcatgcttagtcaataaagcgtaagagtgagtgcacagtaacttatgcacaagctggataataggaccctttagagctttagcttcctcatttgtaacaaaataaatagaaaattgccttaggagcaagcacttagtccctggctcccatcactagcacacccccaaaattgcctaccatgatcatgtgataaaaagaacaaactactccaatatagagtatgtcatgaattgtaaaacactgtacatttgaaaggtgatattattatccctactaagtagttgcctgcctgtttgtgtatctctattaaaagaattgactaataactgaaatattcccttctatctcggacaattactcagattccttttaaaccaaacttgaccgtttttaattagctattttgtttatttacatttcaaatgttattccctttcccatttctccaccccacctggaaaccccctatcccatcccccccccattctcctgcttctatgagggtgtccccacccacccattccctcctccctgccctggcattccccttcactggggcatcaaacaacatcaggcccaagggcctctcctcccactgacatccaattaggtcatcccctgctactacatatgcagccagcgtcatggatcgctccacgtgaactctctggttggttgtccagtccccgggagctcgggggattctggtctgttgacactgttgctccccccatggagctgcaaaccccttcagctccttcagtcctttctctaactcctccatcagggaccccatgctcagtccattggctggctgcgagcatacgatgagttggtttgttatatgtaatatgttatatgtttgctaaattgtctcccagttacttaaagtaattgtctcccaattacttcataggttcctcatatttctgggttccaacttcctctttaaagcacactcacttttcacaaactgctctcagattctaaagtctaacactcaatgcatcctgaggcttagtttctttgccttcacagagcaaaggtcattcaggtttccctgaaaacctcacattttcaattggatattagtccctggaaacttggaaacactggtcaacacccaaagaaaaggcaaagtttgtagacacatattgctactttccttttccagtagctttttcttgctgttggctctatttcttgtgtctaccgcactgtctgctttgaccactgcaatacaggacttcttatgtaacacttaatacctctcaccacatttcttcatcttcctgtgtcattgctaactgtttcatttcattgtggtactaggttccaaagtctttaaacgggaatttgattagcccaggtcatctcttatgtatcctgatttaagcattttagcaaaccttgtcagttagtctctcccccactgagactagggccaagcagaaagccatgaaggagttacagagacaaaatttggagctgtgacgaaaggatggaccatctagtgattgccatatacagggatccatcccataatcagcttccaaacgctgacaccattgcatacactagcaagattttgctgaaaggacccagatatagctctctcttgtgagactatgccggggcctagcaaacacagaagtggatgatcacagtcagctattggatgggtcacacggcccctaatggaggagctagagaaattacccaaggagctaaagggaactgcaaccctataggtggaacaacaatatgaactaaccagtacccgggagctcttgtctttagctgcatatgtatcaaaagatggcctagtcggccatcactgcaaagagaggcccattggacttgcaaactttatatgccccagtacaggggaacgccagggccaaaaaggggcagtgggtgggtaggggattggggggggtgggtatgggggacctttgggatagcattgaaaatgtaaacgaggaaaatacctaattaaaaaaaaaaaaggagtaataacatactgaacaccaaccaggcatttgacaagcactctcaagatattcctaagattgctggttggaaaagagctgggagcatatcacatgccctttaaataggattcttggtagttgccttaactcatctatccagggatctatgctatggccatatatatatgcaagatgatgagataatcatccttattttcatgtaagtcactgacaaaaatgtatataaaaccagtatcttgcgagagctctccagaatgcaatgagaaacgcttctgcatggctgtctttgcagtcaggtagcatactactactaacatacaacccacagttctgcctcttattcagagacataccatgtaagatcttgccaaatgtcttggtgatatctacataatacggcacacctacattattactgatctgccaatctaataactgctcaaacagaagggaagttttacctaacatgaatacctttgagataatttatactttcttctcaagagtttctcaaaatcattttcaaaaataatttgtactacatttatcccatgatgtttggactctaccatatggagactatatgttgcctttccattttcaaaactaatgtctctgtttaccatctccagttttctgccacattttacctgtgccacagtccctgaaatgggtattgccctttggtaaatgcccttgtgtatgtagaactctgtgatcaggcacataaacacatatgtctgtgtgtgtgtgtgtgtgtgtgtaagggagatgtgtgtgtgtgtgtgtgtgtgtgtgtgtgtgtgtgtgtgtaagggagagagagagatgaaactcaagcatcattgttcagataccatctatcttgtttgatgaaacaaggttttgcattggtctgaggtttgcaaacttacctagtctgctggccagcatacttcgagcacctgcctctctgcctccccagaactgggtaacaagtacaccccaagtttattggcttccattttatttatccattttattaattttcatgtaatatatttttatcatattcttccccctcccctaattcttcccatatcctccccttatccaactcatgatcattcttataaaatgaaaaaacaaagcaaagatgatataaacaatcaaacaaaacaacaacacacactctctctctttattaacttagcctcaaatgtttttaatgaatgcccagtttgtgctttaatgtatatttactgatgcttgtttgccatattaagtgcttaggttctttttgcaaaaaatgttagtagttaaaaaaggattccctaatcattcattccaatagcagttgcaaaaaacaaaaacaaaaaaatttgctataatccttagtgttttctcaaaggtgtgggttcattttggatgtgaatattattggtattattttcattatacattctatacctttgtatctctggtccacatgaccttatttcggtacatacccttctaatattgaagctaaatggagacgatatagttgagacacacagatttctatcattaacaaactttctgatttccattttaaagagcctcaggatatgtaaccatacctactgtacttaaaaaaaatagaactcttttcctacagtctaggatcttagcttcatactctattcattaagcccaagataaaataatttctttctcaaaagctttaacctacaaattcctctatattttagctacttatctacatttcatttatactagcttctggggtgtacagtcaagttgagactttgctatatatttgagtttaggtaaataatatatcactatgggcctatagtcattttctgttcagtatatatttctcttatggcacttctcggcctgtgttgtaagttaacagatattcttatttatatggagaaatatatcatagatttctgatctgctatttataaggtaatgtgtctttgtatgtgctcttcagcatcaccatgttctagttttctcatctctacaataaagatgatagtaaaacctattccatgaggtctatatgagtattttaagaattaaataaattaaatttgcagtgttcttagagcagccatgaacccaggaagcacttgataaatagtaataataataccaataataataatacaaggactagttgtccttcttattccctttcaatttctttcttcatccatttaaaagtgtttctctctttatgctcatgcttgccccaaagtaaaaacatacttactgtagtgcctttcttggcatccttttacataaaatattcactgtaatcaccttattccagtattcagagtcatagtgccttttttgtatttttatgacaaaaacatgcacggtttagtgagcctgccttgtcatcaacgtccagaagagctttaggattgctgctacctgtttgccatcaatcagagaaacaatgccctaacaacccactacattccaatttataccctgccatgaacctttccttccttagccatcagcctttttacctcctcttttatctcttctctcaacagtgccagtactaatacattttggatgacctatctttttcaaccaaagagtgggcaccttaccaaatcagagagagttaatgatgtacttagacatatggactccagcatccctagactaaggcacttaactttggtcatggcctagatattactagctgccaccagcctcagttcctctaagtgttatatggagaaaattgcaggccttatattgtgactttgtctcaagagttgaatgaaaaaatatttgtaaaatatcagttcaaagtcaagaacatgtaaagtatgaacaaaatattatcatttccagttcggtttaagatcctggcaggaaccagatgacaaggagagaaattcagagtcactacagttcaaagagccacattagcttcaatctgttctaaaaaaatcaactgttcttaaataagagtagtctatgacttactgagcatgtcttgcagagtgagacattcactgaacacttactgatactggttctctgtggccccttcaaagatctctgtactccagaaccttaattctgtctgtcctctttcaccctaacctccatcttgatgctattatatagctttgaccctttgccattctaatgaaagctgtcaagagtagatcacagaagccactagatctagtgatgaatttcacttccgtaatgtggccaggggaaatttgtggaattctaaacctcagttttctcatcttaaaaatgggctcctcctcactcatatcactcactgacatccaatcaactgtgacaaggtttgctttagaacttatataggatttatacacaccttttagctttctctagatttttagaatctcctgtttgttttggtttggctttgcttgcctgtctgaatgtccctcaattccatccacacatctttgagtttatgtggccaggcacactttaagatccggttaagtggtacttctttctgtggtaacatctaaaagccacacccacagcctgcaaaaccagagcatgaccttcagcttctcaaacttctcatgcagcttctccttcaatgacaattttcactattatagtctcccttaactatgctcttttgtgtctctcaagtcaattccctaactcagtttatagcctctcattcatcagaatatttagccaagtgctagttcaagaccatggaagttggtttgccatgctcctgaaaaggtaatttatttattttgaatgacagctatagacctgaaccttggtcttccaccaaaataattcctacttaaaacttttgctgttaattttccaatgctagggagaacatgagtttaagaaaagaatagtcacatcaactaataaaggcaaaccagaacgatgtgaaggagttatgcctgcccacaggagttggggaaaggtctatctatttatttttagcatattctgacagatgactataccttggtatgacactaattgcctttattggttttaggcccatatatacaggattattttttttaaagaagaacaaaaacaatcagtgaataagacagtgactggcaaagactaaagaaagaaattaaatccatataactaatgcttattatcatacttctagacctagtgtctgtctctgggaaaagtaacatttggaagaaatattaactgtaatgacagtattataaatatctttgaaataataccttttacatattaacccataaatataagctatctagtgataattttatttctgtattataaagtagtactaaaatctacctaagatttataagtagctttttccttaggatatttgcaatagaaaaatagatttacagacacaatttttcctccaataatgactaaaggaaaaaaaaaagcttggatgtacacattcagtgcttaaatttgacaatttctcatgttctaatcctttaacagcaccggggttagccaaatctatcttcagccacagatttaaagattcattttaagacaggaaaatacttctgagaactaatctatgacctataaatcctgtttaatacacatgaacagggatcaaccaatcttttcagactataacaaatgataaatgtggaatattttaaatttaaataaagataactctgcattctcaatatattctttggatattggagatggagttttagtaataaagaacaatacattggacaccattgtcacaacagtctgccatcattttggtgatggtatttttaatcatgctttttaataaaatatcctcaggtttatctcaaaataaaaccataagtaaacataatttgttatattttataaggaaggggaatttcttccaagatgagaagaaatctaattttatatggagatttatctagcaatccaaatgtaaatgtaaacaggtgtttttaggaatttaaagagatgaactgcttgatgtaatatatgagaaaaacagtcaaaaattaaaatgtagacaaatcaatctctctgacttttttccttccctcactgtatatctacacagttccctactgaattcaatatttaacacaaaaatgcctgattttcagcaagagagaaacctcttttaataattatcccactccaatgatatttgattaatcataatcaatatgttcattgtcgtgtcaagttaatccacacttgtgtgatatatttttctgaaagcatggaatatatttgacatgctagaaacacatttcctttttctttttttctacagaagtctctctctctctctttctctctctctctatctctctctgtgtgtgtgtgtgtgtgtgtgtgtgtgtgtgtgtgtgtagtgagtgcatacacataaatgtatgtgtttgtttctgtgtatgtatcaaggagattctactgaatctcacccattgggagaaaccagctggttctttattaatccacaacacaaaaatgtttgtgctctaaaagcagcagataaaattgggttaagtattcagatctttgaagcatctctgcaagatctgtgaaagcttgatactgagcatttcatttaagaacttgaaagctcaagaaagaattgccccctttggcaaagagataagcaaataagcagtaacatctgcttctctgttctattaaaaaacaaaacaaaacaaaacaaaacaacctcagcttcggtgtgagggtataagactgtgcataagaaagactttaaatggaaaaactgttcattataaatgcaatgatggattaaatgccatgtagatgccttttaacaaatttcatcaggttattattatttctttaccatgttccagtcctgttctagttgctcgggattacaacatagtacacaatgaaagaaaaccctaccttcaaagatcttatattctttttttttctttttttttttttaattacgtattttcctcaattacatttccaatgctatcccaaaagtcccccaccaccacccccactcccctacccacccattcccattttttggccctggcgttcccctgtactggggcatataaagtttgcgtgtccaatgggcctctctttccagtgatggccgactaggccatcttttgatacatatgcagctagagtcaagagctccggcatactggtggggagtatagtcttttctcttagaaaagtgaacaattgacaacagcagcggtcgccatcttggtccgggacccgccgaacttaggaaattagtctgaacaggtgagagggtgcgccagagaacctgacagcttctggaacaggcggaagcacagaggcgctgaggcagcaccctgtgtgggccggggacagccggccaccttccggaccagaggacaggtgcccgcccggctggggaggcgacctaagccacagcagcagcggtcgccatcttggtccgggacccgccgaacttagggaattagtctgaacaggtgagagggtgcgccagagaacctgacagcttctggaacaggcggaagcacagaggcgctgaggcagcaccctttgtgggccggggacagccagccaccgtccggaccggaggacaggtgcccacccggcaggggaggcggcctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagttatgaaacaaatggatctgacagatatctacagaacattttaccctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaaaaatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcaactgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatcccggggcctagcaaacacagaagtggatgctcacagtcagctaatggatggatcacagggctcccaatggaggagctagagaaagtatccaaggagctaaagggatcttcaaccctataggtggaaaaacattatgaactaaccagtacccctgagctcttgactctagctgcatatgtatcaaaagatggcctagtcggccatcactggaaagagaggcccattggacacgcagaccttgtgtgccccggtacaggggaacgccagggccaaatggggggagtgggtgggtaggggagtgggggtgggtgggtaagggggacttttggtatagcattggaaatgtaaatgagctaaatacctaataaaaaatggaaaaaaaaaaaaaaaaaagaaaagtgaacaatttgtaccagacttgtagactaactagatgtggtctggaagaggaaagatacaactcaaagaaatattttaactttccccttttcttgctttcacatttgttttaattaaaactgtgttaatgaaatctcttaaactgggtaatttgtgaacagcagaaatgcattactcataactatggagctttggagatctatgatcaaggcaaaaaggagtggtgtctggtgaggatctgtccttcatagatggcatatgttgctatgtccttctctaggggtagttgttcacttgactcttttatgcatggacattagtattattcatgacctaacaatttcccaaatattctaactcactagacattagaattcaacatacaaattaaagaagactaacacatttaggctataccaaattcctaccacagctttttgtatgaaaacatcttatctgtatttttatagcatgctgtgggagtagtgacacatatcatttattccagtccttgaggggcataggcaggtagatctttgtgaactaggggataacctagtcaacatagcaaattcctggctactgaagagatattcagaccctaacaaccaccacaccaaattttggcagggtacatagaaaaatagaataactgagagtaaacaaaagaatatatgtaaaatcaggaagaggggttagtagaaaaaaagatagttttattctggaaatattaggacacctgtataagttatacaatttttcatgtaattaataattgaaaatattaatctatatccataagaagagaaaaaactatactgtcacttttttcagtgtctgtgtgtatacgtgtgaatatatagattcaagagtatgcacataatagtgtgtgtgtgtgtgtgtgtgtgtgtgtgtgtgtgtgtgtatgtgtgtgtatgtatgtaagtcagaggatgattataggtttgggtcttcatttttcaccttatttgaaaccatgtatttttgatgtttgctaatgtgtatgccaagttggctggcccacaaacttccagggattttcttgtctccacctcccaacttgctgtaatgtcagtcattgtttatgtggcttcttgattttgaactcatccattcatcctagcagagcaaatgctttcttactgagccatctctccatctatcattttctgaatgcttataatggagaaaacattttaccatatttgttttaacttgtggttttaaaaccaatagtcacaaaagtttaacaatattcctctaggtcactaagtagtttgcagagaatctagtttaaacctaagtgtttctgggctaggtgttgtaatatatacctataattttagaacccagaaagttgaggcaggacgatttccatgagttgaggcccactttatataaataatgaatgccaaatcactccatgctacatacagactgagaacatctttgtctcaatttaagaacacacgtaacaaccagaaaaacctacaacaacaaaatttggaggttaaaaaaaacaaacaaaatttgtatattgtctgactctagagctcacctatgataggtacgggaaagtaagagtttcacagatagacatgatgagtttctgtgaatgatgtatgaaatcttggacatattaaaatagtttaatgcaagagtgagaaaactaaattttcgagaatactgatataaaagtctaaagaaaaggacaaaattgctgaaaaggaatagcctaaaagtatagaaatgaaaggagaattatttcaaggcaatggtaatcacaattttcaatgttagagatgagtcaaattaaatatggatgagaagagagacctttgactctgactgttaaaagtgttatgcagccagttttactaaaatggtgagtaggaagcagcacagatttggattagaggaagcaggacaatggaggcgtctgagaaacagcccactgttttacacaaagctgagtcaaggtaaatccctcatatacattgaaatgggaaataaaagaatgactttctataattatgtatttggtagtcagaataattatagtattgagaggtataagagagtaagaatatgggaaaaagtacaggtatgaccaaatggttgtaaaggaaggagcacaattccacacagcaggtcagtcttctaaacctctcacaagggtgatatggtgatgattcagtttgagaattcctccattgcccatctgcaaaacgattgcttttttcagtatcaaggcagaagaaggcattaaaatccccccgcccttactaaaaatctgctgtcaaacttaaatcatatattcccaaaggcaaacagctaccttgccaagtcatgattataagacatatttctttcccccatctgacatacatacacagaactctaggcagtcccacattactgacaaaaatactcagtagtgacatatgtacacctcagggcttacattgataaaacagctgctaacttatgactacttctaattcatccatggaattatcaaatacaacatgatattagcccccttagaaaatttaatttcttttggcataaaatattcacaatcttctgtttctcctgaattcaattaaaataattgtccttcatgtgtgacagtccaatcgctcaaattttgtcatctactgtagtgaactatgtcaagaaccgaggtaactttgtagcaacacattactggttgcctttcaacagctaaatatttttaacaaagtcaaaaccttggattttaaataatgcattggatatatgtaaaaatgtgtgcatgtacatataaacatacatgcatatatgtgtccataggtttttattcaaaatacttttacatggcatcttatctcagactgtgcaaccctggcagggcaatatgataggaagcagtcccaatttaaatgcaagtaacagaatcttggggaaatgttattaacagagtaagaattgaaactttacaaaatcaacacaataatctttgcgtatgaccatgtctctgctctaagaagaactccagattatcccattttgtctatttgtgagttggtttatggttcagctaattttccctgactatgaatgtatgttagtttgtattctattaatatgaaaatcttaatgaggctaaatgctcagaaaatggcgggcttctggttaattggatttggtgattagcttaatgttaaaaagaacttttcaaaaaaaattatcattcttattgaaaatcactcaaaaatgaatcaacattttaaaatccaaatgataataaattcaatctttcacagttatataagaattgtcattttagacatgaatttttattataaagtgctctaaactggaaagatgttggagagtgtgtaaaatatctaatggcccgaagatatttgttgcaaattttaatagtcacctgtgagtagtggaaaggcacaagatttgaagttagaaatcttgagcccaagtccaattttgctgctaaataagtatatgacattgattattttctttcttcaacataacatcattttcatcaactgtcagatgagagactgaagcaaaatgtttaagatcacttatggtttgcaatttctgtcactctgtggcttatctttctgtgacttgctcctccattggaagaattctgataatttaagctttccaacaagttgagttataattaattgcaagttggttaattctatgtgacatgcctatatatgagaaataaatttaactcggaacactgagataccttcagaatttctattatgtaaggagaagtgaagaaactaaacatgccagcctgtcagaacagagtagtaatggcagtcaagtatacttacgtcatgctagcctaagcaatgatctctttgatacattctctctctctctctctctctctctctctctctctctctctctctgtgtgtgtgtgtgtgtgtgtgtgagagagagagagagagagagagagagagagagagagtattttaaaacacaaacttttcatggacataggatttaaagcacttcatataaaaatttgtcacacatagggccatactttgaagctaaagtagaatttcaatctctttcctcatacttttattttttgtctaattataaaggaaatagaacagtatgtcatgtagtctgagttacactcacaacccaaccagccatttttatgctgcatcttatgaatctttgatggaagttcttttcccaaatgttgacaattatgcatagagaaaagaagtatagatttctcattctatttatcatataggtcaaaacagtgcatggaatcattgcactcttgacattgaccttctgttagctgtgcccctgtgttgtattggaggagaaaatgtgaaccaatgcttctctttatgttctaacattcatacagaagtatggacaattcagagggaggcctgatttttcaaaaattctcctgtgattcaagggggattgtacttactgagttttaaatcacagcacagagcctgatttggctgtttcataggttttcaaattgtgggggaagttaatgtttaaattgatgtgattattatatatttcacatattttaatcagcagttaaggatttggatttatgctttgtggcaagttcatgaaagctgcaatttgaaaagcaaatttttaaaattgaagtaccaaatgtcttcaattctccataacttacaaagatttcctatgtttggtcagcaagggtaaatatttacggcaattatgaatgagttgtatatgattgtatatgtgttctggccctaaagtttggggcatttgtttggataatagagaaatcacaagtgaaaatagcctcaagtagtaataactgtgagcttagagaaaaggataaaatcataaatttccgacagaaaaatatttccctggaaaaatttcaagagtggctagttccctctcatagagttagtgatactgaagactgcatgttcccattaaatgaatagttttagaccatgttatttccaaactgtcattgacatttcaaggtgaacaaatcattgatgtgtgcatcttgaagagacaacttgccaggatgttttgcagcctctcccactgcatgtcagtaacaagaaacaccatcccccagttgtggaaatataaaatgttctttaaacatttccatatgttcctttctatgacaaaatcaatccacagttgaaaacacatctaacttcacctaagacagaattttctatggttgttagccagcctatcttcagtatctgggaggcaaaatctgtcattgtcttctcactctttttgttttatttaaattaacttatttttttacactccctattccattccccgccccccatccaccctccgactgttccacatcccacacctcctccccacccctgtctccatgtggatgctctaccccaccccaccccccacacctgacctctaatctccctgggcctccagtctcttgagggttaggtgcatcatctctatatgaacacagacccagaagtcctctactgtatgtgtgttgggggcctcatatcagctggagtatgctgtctgttttatggtccagtgtttgagagatctcaggggtccagattaattgaaactgctggtcctcctacaagattgcccttctcctcagcttctttcagccttccctaattcaacaacagaggtcagctgcttctgtccattggttgggtgcaaatatctgcatctgactctttcagctgcttgttgggtcttttcgaggacagtcatgcaggtccttttttgtgagtgttccatagcctcagtaataggccttgggacctccccttaacctggatcccactttgggcctgtggctgtaccttcttttcctcaggctcctctccattttcatccctgcagttctttcagaaaggaacaattctggtcagagttttgactgtgggatggcaaccccatccctcccttgatgtcctgtctgcctgctagaggtgggctctataagttccttctccctactgtctggcatttcatctgaggtccctccatttgggttctgagagtctcttacctcccagatctctattgcattctggagggttcccccccccctgctgcctatttcctgaggttgccttttcccttctttctgctggctttcggggcttcagtccttttccctcactcaataccagatcaggttcccctctccccaccactccctgtcctgttcactttccctcccaggttcctccctccttccccacttgtgattgcattcttctccctcccaagaggaactgaggtgtcatttgggcacttcagcttgttgacctttttgagttctgtggactgtatcttgggtattctgtactcttttttgtggctaatatccacttattagtgagtaaataccacacatgtcttttggggtctgagttacctcactcaggatgatattttctagttccattcatttgcctgtaaaacccaggatgtccttgttcttaatagctgagtactattccattgtgtaaatgaactacattttctgtatccattcttctgtcgtgggacatctaggttgttttcagcttctggaactatcacagataatgccgctatgaacatagtggaacacgtgcccctgtggcatggtaggacatcttttggatatcctcccaagagtggtatagctgggtcgaatggctgagaagcacctaaagacatgttcaaagtccttagtgatgagagaaatgcaaatcaaaaccaccttgagattccatcttacgtcaatcagaatgtccaagatcaaaactacaggtgacaacacatgctgagaggatatggagaaagaggaacactcctccattgctggtaggattgcaaactggtacaactactctggaaattaatctggaggttcctcatgaaattggaaataggtattctcactctttacaggagccttcttctgtgtcttaaccccccttttttcttctccatttgaaaaggtcacgttggaggatttagatagtctctaatctatagtttgactcacattggagaccccttcagcaacttgggtgctttctctagcttctccattgggggccctgtgttccatcctatagatgactgtgagtatccacttctgtatttgccaggcactggcatagcctcatacgagacagttatatcagggtcccttcagcaaaaatcttgctggcatatgcaatatttataatagtcatacttacttttcaccttgtttagcttttaatatatttgattttatatatataaatgttctgcctacatatgtgtatatgtgtaccacatgaatgcctggtactaatggaagtcagaagaaggcattggatgccctgaaattagagttactagcagttataagccaccatgtaggtactggggaccaaacccagtcctctgcaagaataagagcctgtagtcactgtgcaatctctccagccccttaacattaagtttttgtaaaaattagatatacaaagcataaatataacttaaataatgagtcatttactaaaaaagagtatgatgaagtttatacacactcatttaatgtatttgagggtctaccaaagcaatttgattaaatattatagagttttcagtatttttgttttctgtctataccaggaccacagtcccattttacctttaagttgctttatcagaaatgtttggtttatatgaaaattcagacatccctcacattataaatggaagcagtacaacaacttcacttttctgatagttttcaatatgtataaccttcttaatataattttctgttttcattaattttgatttgatagaaatatttccattaaaagattcagttaggtactttgcatatatataaacattcatctttgaaattataaataacagattaccatgagaattaagattatagccgggcagtggtggtgcacgcctttaatcccagcactttggaggcaaaggcaggtggatttctgagttagaggccagcctggtcttcagagtgagttccaggacagccagggctacacagagaaatcctgtctcaaaaaaacaaaaacaaaacaaacaaacaaacaaaaaagagtacacatgggggaactcatggctctagctgcatatgtagcagaggatggcctagtcaatcatcaattggagaagaccttggtcttgtgaaggctctaagccccagtatagggaaacccatgggccaggaagctggagtggatgggttggtgagcagggggaagagaaagaggagggggttttcagaggagaaaccaggaaaggggatagcatttgaaatgtaaataaagaaaatagctaaaaaaaaaaaaaaagattacattgtctgacaagggttgagtaatgtactaatctatgggtataatagtaggtcattgaaagttatgttaatattatgaccatttagcagagtaatagtagattgtctcatagggcttatgagctgtgttactagcactgataagtcagaatctttttgcagtagattgcatttaacattaagacccacaactggtgaagatacaaaaataagagactatagaatgatcagccctaaatgagacatctctaacacgtggtgtcctcccagagttcagagatcattgcaggagaggcagtagaaaggttgtaagacccagaggtagtgaatgacttcaaggaaacagtatttgatggtcacagcagggaagttgcacatataaaatcacagcagttgtgacagcatgcacaagatgtgtacaatgtcaagacagagaaaatcccagcatggagagggaaggaggacacaaagtgccactcacagccaaggagctcttggaaattgatagcttctgggagaagaagaatcatttgatataaatgatgtcttactcggccatcatgatagaagtgtcctcctgaagtagatgggaacaattcagagactcaaaattgtataattttcagagagtgataccttcgaacactcggtcctaaatgggatgcctctatcaaatctctcccctcatagcttagggaacttagcagaagaggaggcagaaagtctgtaggagccagtagggatagaggacaccaaggaaatcaggcccgaagacacatcagggctgatatatatatgaatttacagatactgtggcagcatgtaaaatacccacacagatcaaagccagaaggggttccagcactgagaatggaaaaaaaaacaatcctccatcactagcccagaaatgatcaccagttgacaattgtgccaaaataaaaaactacttttgttcaacggagtctcacagaatatacaaaccacacttaatggcaggcctcatggcagctgtagatggcagacacaaaacaaactcagtggtatctttaagggtttatttttactcataatgatttttctatgattttatttttaattttataggtcttttacttatataatgtgtgtgagcgtgtgcatatgcatgcatgcacacatgtctttttgtgtgtgtgtatgtgtatgtgtgtacatgtttctcaaacttgttctttagatctgattattctctttgttttgtcttattttgatatgtttggttacttctttgttctgttttctaatgagggagataaagaaaagatgattttgagtgggtggggaagtgaggaagctctgagaggattttggaggagaaacaatgataaatatattgtatgcaaaatatattttaaatacaaatattaaataacttaacttgtggtatgttggccatgcttcagtgaaaggtcacacatccaaaagcttgtgaacagtacaaagtatactatattggcttaatcaaaaagaagagacaaagcagagtgagtagagaacaggacttggataagggaggctgaaggaaaggaaggtgaatatgagcagaatgtactgtaaaaaagtctcaaaaattagcattatgagttatagtgagagctagtatacccacaatcattgagtttcatgaatcatgcataagtatcaaaatattcaccgatcacctatttttgttgcatatgttttcagattgtaagaatagagtacaatgtaaaacagagaaatacctactctcatgtaagtcattttgtagtactcaaccaaactgaagttaatattaaactcaataatttaccagttgtgtgatcttaggaaatttgcaaactatctggtctttggtcacctcacctacaaaatgtagctttcatctatattattggaatatcatgagaatataataaaaatataaggtaatttacccaaatatctagcatgtaataaaattttcattaataatgtcctttgtcttgctattgctattgagtatttaaaaatcactagcatttttattgaaataatccttcattaccaaaatatctcataaaatttgagatatgaatgaactttttcttttttaattcagctatctttctatttaataacacacacacacacacacacacacacacacacaattcagggctgaccagttatacttctttggaggtgggaagaaactatttctcttgttttcagccttcctttgttgtctatagttctttgtctagagtttagaccctgtaagatttcctctgcaactttagcatgcctactgatgctgcccttgttcaggtcttgtttagacagtcatagttttaatgtgtcagaggtacagcttctctgtggtatctgataaacacgtggaaagcattgtaaaaggagcaaaggcatcctgcaaaccagtgtgttaatgttttcttatatacctctgacataagagaccataaagctggaatatgtgtcctgtgttcagctgatatgtaatcagggaaatattaacattcaggacagatatttcttcttacagaaaaattcatctgaaaaagaccataatactaatgaagatcacagaatattgccatttgagaatggattattagctcagatttaaacttcacaaaattaagaattctataggaatgcagaaacattggtaagaactacttaaaattataaatgacacaagaacaggagtttctcaatatttggcaggtgaaatttgcaggggacatgtgaacaaaggctatctgaatatttggaattaagaataagaaacaaaaatgaaatcctcctcgatgtaactattcatagagaaataaaattatttaccccacttcattttcaaactcataacactaataaggtcaagaaaaaatatataattacctttcatgagtatttattctacgttggagtaagggaaaacagagtactgaggtggaaatacctttccacagtcagttctagatattttctcagcagagaagaaaatggggctgactcaaaatattgttttcttttcttttttatatgtgttttttgatccattagattgaatacatatttctccaaagacagttaacaaaagcccaaaataaatgtggaaatatgtacaatcacaaaaatgcaagtaaaaaccgcattaataagactataatcaaaacagaagctcaagggctggaaaaatggctcagtattaagagcacttgctgctcttccagggaaccaaaccccacagcaggcagctcacacctacccatctgtaaccctagttctaggagttgagaagtgctcttttgacctctgcaagcaccagacatatgcatggtgcctgtacacacatatagccaaaacaaactcacacataacgtaaaataagtaaacctaaaaaaaaaacacaataataaacattgaaaagataataataaacatgtgaaaaattgaaaactttttacaatgttagtggtatttaaaaatataagcttctatggaaaagtgacattgaagtgtctcagaaaaaaaaaaagtagtatatgatcctataatgcttcctttaggtgtgtattcaagtcaactaaaaccagacatcaaagagatgctagttcccttgttttcaaagaaggatttccaaatagccaagagagaaaagtaccctaaatattgataagagagtgatcagataaagaaaatgtgatttatacatacagaggaatattatttgaccttaaaaagaaggacatgctgccacgtgctgtaaaataaacgaatcttaacgaagtcatgctgagatgattcagtcatgaaaatattaatactgtatattttcttaatggtaaagtagtcaaaatcacagaaataaaaagggaataatgggtgctggggaaaagagttatttaattggcaaataatgtttcagattttagaggaaagtgattctagaaacttctcacaaagtacttaacactacataattggaaaagtttaagatggcaaatttatgtcatattatttagatattttataaccaaactacatttaataactttaaaaataggtaactaaatctcactatcccatccaattgtaatttaggtctactcataatttttttaaatcaacttcactttcactagaagcaaggggaacctgtttctctgggaaaaagaaatgatccaaatgcttatagctacagtaatacaggctttgatgtgtctcataagaatgtttacaagatataaaagagaaaaactattgattctttatgtatctgttgtttaaaagctgtagatttttgcgtatttcctgtagaattttaagtgcgatattaaatcacagtatttaatgctaacagataccttcagaattatgtagtataagggcttaaaagagttcattttcacccttttatagatgattttaaaatccatacaggagcatttatgatgctcccatttacctctactgggtctcatcagtcctgaagatttttttttcccaatttccttatgttccaatttcctttggtaatatcttactttccttttttaaatttgaacttgaatattaaaacagaggcaaaaagaagcagtacttacacataaactcttgaactgcattttcatcatttgctctgtggcagaaaagaaacccaattgtatgaaattgataacaacattttagtatatcctcgggacctgaggggaaaagcaatgtgtgtagacagatgatctgattttatgagcacatagctgaagtcgagcactgtgcatttgtctttatgctcctactttttttcaaggactatgaaaacacattaggtaccagattcactttccacaatgacctgcaaagctaatgacagtacacaccatttatattgctgtttctcaggatacacatcacagtatagattgcttttagcatagacacttaggctgggcttgttaatatgaaaacaagaaccttagtatacaaacttattttattatctactctcactgaggactgtgatttggattccactcaaacatgaattagtttaaatgctgctctgctgtgactgttgaatttattcattaagatgtaatattttacttatgaaactgcatttggaaattctttggtgtacatcagatgaaattacagtgctcagggatattgattattgcttgtaattgccataataatagccaacaattctctctctttcttctacctcttaatgatataccaaactaaatcaatatctagcatattgggccacttacattgtcttcaaaatccaattgttgttcttcataaatatgcaaaagattgaagaatttttatcttcaaacattaggtaaaaaggtctctactcctgggttttccctttagctcataaaagtacatcagaaagatgctatataggattagttatatgtctgtgacactttatcacctcaaaatactcacagggtagaggtcagaggttagtaaggctgtattgctcataaattgctaaatttcttactcattagtaaatttaatgaccaatgaggaaaattctgactggaagaggtctctgagcattgaggaaatctgcatctttgagtctaagtttatttaaatacctaaaagaagttcaattacatgaaaccaaaacaatggtataggtcacttatccaataaaatatattttctcttattgctatttatataccatgtctccattatttcattattgagataaattagatgccttttagaaacagcaaaacttcttttatctcctgaagggtagcttgccctggaatatttgcctattctcccaaaataatcagtctttaaaagaggctataagaacatatggcatacaaaagagggctcaagagatgacttagagaatagagtacttgtcatgaaagtagagctacaagaacttgtatcataagtatcttagatggactttctactgttgtgctaaaatactattatgaagaagcaacttggagataagatggtttatttcattttatacttctacctcatagtccattattgagagaagtcagagcaagaactgagtcagaagcatagatattccttactggcttgctcaccacagcttgaacatcctgctttcttataccttccaagaccaccagcccagggttgatactgcccagaatggtctggtaactcccatacccatcattaattaagaaacttctgtatagacttccttctagcccaatcttatggaggcattttcttaattgtgttcccctcttcttagatgactctatcttgtatcatggtgaaaaaaaaaacaaacaaaacaaaacaaaacaaaaaataaaaacagcaaaattgacacctggtcaacttgacacagaaacatgctgcttattaatccatggcctttctttcctattcatctctaagatctcatgttaatatcaatatcaaagtataaatcattccaaagccccacagtctttttttttccattttttattaggtatttaactcatttacatttccaatgctataccaaaagtcccccatatccacccacccccactcccctgcccacccactccccctttttggccctggaattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggagggaaagccccacagtcttaaaaaaaaattcagtgtctttaaaatattcaaatactttaaaatgtcctgtctctctaaaaccccaaacattctctacaagttcaaagtctctcaagtgtgaactcctggaaaatcaaaatccaagttacatactttcttatttcaggaggtgggaggtattcaccacggcaaaatcaaagtccaatagtgtaaacttcagtgtcacatatcaggaaatcatggtcttctacgccccaagaggattcatttctccattccgctgttggcagcacacacagcttgttggaggctcaggccagctccactccacactgtcattggcagtcatcccatgatattgacatatctgatatgctggggtcttcatgaaaactgagacttcaccttcaccaatggcctctcagagccaagctccagctgcttttcatgaccatttcatgccttcaaaaccagcacactctaggaagtgtacacaatacctggttgagttgccagcacaggacacagctttggccaactctagactacagctaccatttgctgaccctggggaaacacttgcagagaaaatggtggtagtctctttttttttctaattttattttatttttattaggtattttcctcgtttacattttcaatgctatcccaaaagtccgccatacccacccccccaatccactacccacccactcccccgttttggccctggggttcccctgtactgggacatatacagtttgcaagtccaatgggcctctctttgcagtgatggccgactaggccatcttttgatacatatgcagctagagtcaagagctccggggtattggttagttcataatgttgttccacctatagggttgcagttccctttagctccttgagtaatttctctagctcctccattgggggccgtgtgacccatccaatagctgactgtgatcatccacttctgtgtttgctagaccccggcatagtctcacaagagacagctatatctgggtcctttcagcaaaatcttgctagtgtatgcaatggtgtcagcgtttgggagctgattatgtgatggatccctgcatatggcaatcactagatggtccgtcctttcgtcacagctccaaattttgtctctgtaactccttcaatggatgttctgttcccatttctaagaaggggtaaagtgtccacactttggtcttcgttcttcttgaatttcatgtgtttagcaaattgtatcttatatcttgggtatcctaagtttctgagctaatatccacttatcagtgagtacatattgtgcgagttcctttgtgtttgggttacctcactcaggatgatgccctccaggtggtagtctcttaatcgcagcattttcttatgacccagctgccaagcatcaattgttcctgcaaaacaaatttttcactttagtagttatagtctcttgttaatcatagccaattcttcagctccagcagaccagaatctcagagtattattaaaaatagcacattaaaggtcctgaaagaatcttttcttgcctctgaaaccccataagacaggcttatgttagcgcattgctcaaaagtcttcccttccaagaacccacagtcaagaatctactgagctctgagcatccaatgtcttttccagcctaaagttcaaatgctaccacaatcctcctcaaaatgcatgaccatatctgtcacggcaataattcccagtctggtatgaatttttgttgtaactaggatttctattgctgagctaaaacaccatgaccaaatgcagctttgaccttatactcttatcagtgagtgagctcaaagtaaaatctgaggtagaaaccaaagtagaatccctgaaggaaaacagttactacttattccccttgtcttgttcatcatgctttcttataccatctaggaccaccagtgcagagtagattaggcacttccatatccatcatcaatcaaaatatcccacagacttgtctacaggccagtatgatggaggcaattccttaactgagcctccctctttccagatgatttcagtttgggtcaagttaacaaaagaaccaagcagcacaaagacatacaaaagaaaatacatacattgtgtaacacagtttgaacagatagtgtttctttattgagtcagctaacataggttattagaccatgatgcttctttaacgaggattattgtcactgataacatcagacaatggaaaatactaagtggggaatatctgatactagtttcattcacaacattaactagctgttacctaagtcacttcaattctttagttcctagttattgtcattgaaaaatgagggcattggctactagatgatttataaggaagttccttcccattttctgaatctataggtgccattctcatattcttctcacattaagccaaagggagaagtaaataaagctccattgaaagtttacaaaatgtgctgcttctgacctttaagagaccaacattaacctcgtaatgtttttcaggagctgcataacctagtacacttattgtatgatagaggtggctccaggcttcaaaattgtacatcaccaattattggtaatggaaccatggacccagtttctgcttccctttgttttgttttctcatctgcaaaagggatataaacattagtaagcttgttaggaacataaagtggtataatactttatgttagtgttataaaaataatcagttatcacttgtactcaatttttgtcatctgtagagtaagataatagtgccaatctcacacacatataaatatcaaactaatacatttacagaaactaacttgggacctgacctctttagataaagaggagactagaaaatttacgtgtctctagctgcatatgtatcagaagatggcctagtcggccatcagtggaaagagaggcccattggtcgtgcaaactttatatgccccagtacaggggaacgccagtgcctagaagcaggagtgggtgggtgggggagtgggtaggggagcatgtgggggacttttgggatagcaatggaaatgtaaatgaagaaaatacctaattaaaatgaaacaaaatatatataaaaaaagaaaaaaacaaaaaacaaaaactagccagcacaggtgggtcatctatatgtggcttacatctgaatggttagaaggacagttcattatgttgaggaatgagttttgtaacatgcatggtttcttcttgggactggctatgtgtcatgacacgggtcatagcctggggaaaaaaacaaaaaagaaaatttaccaaataccaaccttttaattttagctataaagttgacatgagatcaagaacatttttcattaataaaatatccatactttctaaaagtaaattacattttctctatgaatagcatacctttttattttaaaaaatgatattttacattttgaagcctgtcttctttcccttagtactttacgtaaatgcttttcttagtgaataaatatgttggtagcacaagttgtaatgcgggtgaatcatgtgcttttaaaattacgtaatgaaataccaattattagggatatgagtaggtcattttggctattataaatatcacttcaatgaatatgctttaaaataaattgtcataaacatcatttcatgagaaaaaactcctacaagcataattattatgcaagcaaatatatatatttaaaatatcttggtatggaatgttaaattgccctctagaaggacacaagactctcaatatcatccagaaacccagctttctagaagaaaacagttaacctacatgatactcaagcaaaattccctattgtcaacctttctcatcaaccggcatgtagagcacatgtttctttgcctttcaatgtggagtctagaaatgaaacttatgcatttgggcatatgttgcaaggtgatgttgacttataacttactgagaggttatgtaactcaacagcagaatgtgctttgttgagcagcgcattttactgccatagaaggcaccatagagtgcttaagacccagcactgtgaagcctggataccctctatgctgattctaggtctgtcacttgggtggcaagtgaaacaagctgcttaatctatgtttgccttctcattcttaaatattcaatgaggagcataacatagcctgcttcacacgaataaaaaaatgaatgcaagccaggcgatggtggtgcacgcctttaatcccagcgcttgggaggcagaggcaggtggatttctgagttcgaggccagcctggtcttcagagtgagttccaggacagccagggctgcaccgagaaaccctgtctcgaaaaaccaaaaaaaaaaaaaaaaataataatgaatgcagtaatgaatacacacaatagaacacatggcacttagtatctactaagggtaaattatggggactaaatacatatatttgtttttctcaagtccttacttatgaatatatcactattctttatgaagacccagttataataataatgagcaacctgtgatcatcctataagaatataatataataaaaccattagtccacttgtttgaagtttcatactaggcataataaatgtatggtgataaagtatacagatgaatttttgtctctgggaatggaggtagaaatttgcttcaaaaaataagtgagaattactggagttatgaaactgttctatatttggatagggggtgtgctgcatgagtgatcacatttatcaaatctcagcaaagataacactgatatctagaatgttctaattagcaaaatgtgatggtacaattcagtcagctcttcagaatcatgattaataaatgagaaaagcattgcgaatatcaaatctggaagagcaacatttacttgtcagcaagaaaggaaggaaggaaaggagggagtgagggggacagagtgacacagaagatgaggaggaagagaaagaaatggcatagataccaaagaaaattcagctaactctgaattacatgaaaatgttgtctcgcccgtttttggtctcaagagttttgccatagcatggtagtttgaaatcagtagtgttcgtgggattgtagcaatttgctctggtatttataggaaaacttttctgtttctccctattaggcatttcctgttcaaacatggatctggttcttctgctatcttcagtgcagccagtcagaactaccctctgacatctaatactgtctactcaccaccacccaggccgctgcctcgaagcaccttttcccgacctgccttcacttttaacaaaccatacagatgctgcaattggaagtgcacagccttgagcgccactgcaatcacagtgactttggccttgttactagcctatgtaattggtaagccctttattctatgtgtcagctttcttttttaacctgcctgttttgtttgcagtggggtaggaattcactctcaatgttgtgatggacaaatttgtagcatagttaactgctgtactaacaaatgtatttctagttagggttttttgttttgttttttgtttgtttgttttgtttttcatccctaaacttaagtactgttgttggtgtggaaagagtacacttttagaagaaatatttgtagtactaacacaatcttattgattgtggttactgtagttagccatgttcctttcaattaaagttgttatactttttctcattaaaagtcatacgtactaatctacaatagcttcttaaattacaggtgcatagtaatatggctactgagtcctcaggtactaatttcaccaaagaaatattatttaagagctttcataaaatttagtgcataatgtcttcccaaagattcacagaaaccaaaccatatataaccttattttcacaagaaagttggaaagtgtatagttcttgagcttgggagagtaattgtatacagcctttgaagggaaaaatgttgttcttcagtcactctgattaaagtcacccacacttaatagaaaattgtattgacttttctggatgacattttattttgactgaatattaatttctgtgcttcggtggttctgccagtttaaaatgtaaatatgtgctttttgaaaaccttattccaagaatagattggagatcctgataaaaaaaatctatctaggtatgtcattaacaactttttttcaggtttaacctgaaatttcatttcccaactgaagcagaattattcactaagatataccaaatatgattctgagaagtgaataaaaagatttaaattttttcataactgtaaataacaaagcatgcttggttggttcctatttttcaaagtgttaacagatccaagacttcccatatacagtttttctaggagctataatacaagaggatgaaagcaagtaaacagataacttttgaagaactattactattatgccagcaataaagagacatggcctttgatggcctccatgattcttgcttagaaatcctcatcaagcaatctatattctattaaacatggatattttcctgtgtcatatatatttcttgcatatcatgtttcacgcaatgcttccattgtatgtttatttagtttacaatgacctttaatgagaaatacttttgttgagatggaaggataaggacaaattgcaattccaataaattttatcatgaactcattcacaataagaaataggaatcagaaagatgacttatcatgaagagacataagagttaaatgtcctgaacccatcttattggaggagagaactttatcctacaagttgtcctatgaccttcacatacataacatgacatgtgtgtccacacacaaacacacaaacacagtaaataagtgttcaaaagaaaagatacaaataaggagtaatctgagatgttccagtaccataaagacccttcaaaatgttattgctgaattatgaaatcaacttggtgttatatgtgttagtttctattcactttattataggaaagtaatgtttttacatgtaagatagaacccttactacaaataaatccagatcatatgagactgttttaatgacaagttcacattatgtttaagtctatatttctatttaaatttatatgatataagatttcatacttatgtcagaaattttattatataatcttagactcagtggtttacctttttcattttcttagtagtcatttcaggggatgatattttatatagaatgtgattttaacgtaacagacggtaacagcctacaatagttatgagcatagattttaaactttctgctgcttactatacctcttgccatgagtgaataattaaatctgttcagacctctatttgctaatggattatgaggagacataaatgaatgaataaaaattaaattaatcaaaacaggaaatatatgaaggaagacattacaatggtaaaataataatacaattctaattttcacttattatttttgttcctgggtccaaatagttaagcatattgctcattgttcatttatgtttaatgacagggcaaactcataaaacatgtttttttttaatattagccttcactttctttttagcatacaagtaaatggtctagtttactaaatgaactggcctgcctgttttaaaatttaaatagctataccatgttatgtcttgcaatggtgagtaaaactaaatagtttgattggttaagaggtatcttttgaaaatatttactgtgatgttttctaattttatccaaaatgctaacctcatacaaagaatgggttcaaaagaagatttcttacagtgaatgttgtgactttcttcttgaccttcgataaattagggaatgcatctgcctaaagttgggtgttatatagctcaatggtgacatgcttgcctagcatgcttgagaccttaggttcaaaaccaagt

SEQ ID NO: 624 - DNA, 531992 bp, mus musculus; identical to SEQ ID NO: 623

SEQ ID NO: 625 - DNA, 32148 bp, mus musculus
gtaggtgggcggagcaccactacggcttactcgcgaatgctccctctctccgaacctgcgcggcgagcatagtctagttgacaacggctaagcagctactatagctgcaattctggctcgcacctttacccctggctccacgcgtgtcttcttcgagcagccctgcccgcgcttgcctcctatccctttgccgctgtgtggacgcggctgccaagtaagagttggggcgacgtcagggggacacccaggcagactggggccctgacctccagtatcccgcttagccgctgtggcgctccagcccttctgctctcctggcagttccgctgggctgaggacgcgagagacaggaaggaaagtagcccgggctgcctctgcttatgggcggggttcagagttatagaaacttagagacccctgattgtgccggctgcacactcccataggagccccgcaaacggctggtctggtggcctgaggacccctggcgtaactggcgcggcggccttcccagggactcagtgggcggcgggcgctgggcgggggtgcccagtctgccctccttctacttcgggggacatttccaggaaggcttcagccccatggacttttccgtcggcccctgcctcactgccttcccacctggacaactccggagagtgagctgttctcagggtagctgtgcagagcgagttaatcaatacttctgaataagtcgctgggactcagtttgccaggaggtctcacagaagtttagattagaaaagctcagacgaaaggctattagatggaagtttgggggagctctaacttgggtagtctcaatgtctcttccaacacttgctcaagttcagcactgaattaccactcaggaaaccggggttccgccagtccttatgacctcaggcgggtcatgctttcctgagtgacaagtgttttcaatggcatctcaattggcagctagatttctgtatcagaaggaccccggtttcttcagctctgatactggctaacttggtgcctgggcccagtcttttaaaccagtaagtaaagaaagatggtctctgagacacttgggtgactggaggtaggcagtcagcggctcctatgatggttatgcagctagattagctggaaaactactgtggggtagatggcaaactgaatgtgaggaggggcaggacttttttttccccagacaccaggtttctcactttggggaccccagagattgcacttagacatggtattcaggcaaaggactgactggtgtcctagtttgcttgggtctcactcagcgcacccagtaatcctgggagaagagggtaatgaatcacccagggctattttcaaaccttgactcctgctgcagttctagcgcccacgcccactcggagggtttcagtccctgcctgtgccatcagtattcttgctgtctgggtttcctctagccttcccttcttggaatgaaagggagacatttctttcttgggggactggaggtgagcagcccaaggcacaagtggtgtctaggtgagtggtcgagtgggagaggtggagataaagtttttatcctgaagttgtagctgccatttcgctgggtagctggtgttggtccttacttcagagtgttggtctttcttttcgcccaggttcccgacttggaatttctgttccttgaacctctatagttattgctgagagatgccatactgaacagaggctgtttgcccctggtcgcttaccctcattccacagtgctaagggatctttgaagaatgccaggcctctgtgtacgtctgagcttctgccttcaggagaggctgccaggagatgatatctgaagatgtaaagatggcacagtggctatgcaccttgtgtggatgcaaaggaagggacaacgagtcttgtaaagatgatggccttaatatgttcaaggctggagcagaggagcaaaagaaagggggttaccaagagggccaaactggccttcagtcttatctttattaatttttagttaatgagcaaaataatgaatgccactatagtatttccatacatgcatgctgttgtactttgctcataatcactcctctgccacctcttgctccccccatatgtattgacattttaaaaaaaaatccattttggagactacagattggaatgggagcacaggacatctgcagccaggtataagcatagcagcaggatacaccggcaagacagtcacaggggaaggaggggcagtctcgggttgggatgccgctttgccttttgttagctaacttctgcagcatccttgttccagccctggataatgtgtgttccgtgaatggcaagttcttggggaaggatggaaaagagggtcctcatctgaaagaaggggttactttattcttgagttaaaaagataacttttttcttttctctttcctccccccccccttttccccaatttgggtaggatcaaaccttaggccacttggctgcccagtgtggagttgtcagagatttcagggcttggaataggagacctatctatgtgcatcaatgtgttaaagtcttcgaggacctggggctggggggttgttttcttttgttgttgggatgtggggatggaacccttggtctgatgcattctaagctagtactgagatccacccctaaccattggtaagttttatagtccctctcaccccacaaccccaggtgagatgtttgagcactgtgctggtcatgcagttgttggtgacaaaggtttattaatgctttcctaatttgtgactcgggggcttggagtgtgcatgtgcgtgtgcttttatgtacatgggtccttgtcggaatgagtcagtgcagtagaggtctccagtctgcgccatagtcacaagtctgaaatgctgagtttgtgtattgagtttcctctggtgtggtcctccatagtggggacttgcacgctgagcacttgctgttccggtttatcccagccacaagcagggatttcagaatccactgttaagtgccttagcagtccagggtgtcccagaacaaagaacaagggattggaggtctaaatccagtctctgttgttctctccacactgtcacccctcgggtggctttcttctttgtacttcaccggattaaacaaggggatcaatagctaagtgctttgtaagctacaaaaggctagggctagctagttctcaggaaggacccatggttctgacacccactattgggaaatccgccatccagttgaggggtttagtggcctgagacactcctcattgaggacttaaaaatattattaaaaaattaagcatatttttaaaagggaagcaatcagtgtaattagggctcaagaaccatatagtcccacctactgcttttcttgttactttgaaacaaatctcagacttgtgtgttatcaaattgaactaaaaatagaccagtgtatctttctaaaagagaaaggacttgcagcaaaataaccacagtgtcagctatcacaccaaacctagtcccctagtgtcacccgaagtgtggttagtagtcacatttccagttgttttgccctggagttcagaccagggggaattgctgaggaggaggtgactgacaagtaggagacatttgatctgggctgcagaacacaggctagagggattatagagctcgggcctcttcattttccagatgccacattgccagtagcagatgtgagctgctctggggctcctgatcccgcggctgacttgtagaagcttcttgcagaaacttcagaaactcctggccttcattcctgaagtagcaaaagagagattgaattcccacttgactcctgtgctaggggccacccaagagtttgaggtcaacaggcctgggagaattcctaggaggttgctctctttctccaggcccctccccggctccaggaccccgaggccaatttgaagcaaaacaggatgcatccaggatgagcgccttttccagcttgtcatctaatcaccaaggcccagcttggagcttcctctttcatttatgataaaaaaaacaaaacaaaacaaaaaaccctttgctgtctctctcttttccctccttcctcattgagggtagctgacttccttcatttccggggccagccctcctctagccccatgtgggcagggtggcctgcctctgcctcacctaccccactgttgctttgtcaaggagataaagaccccaggaatgtcctgtctgaagacagcttcttgctcttgggctgtccttgggagaggagtggcccctttccaacaagcctggggtcctgccactgcttggttaatgattgagccacatactaaccaccttgcaaagtcacctctacagaatggccattaactaactccctggctactccaagccttaaagggaccccatcctaaacctttccctcctcccagagggataccgactaataccaaatcatgagaacttctggagccaattaaaattctgctcctctagtctatgtttaagcaaacagaagcagttattcccgttgtttgaagtatgtatacttatacttggaatagatgtcaatggggtttttgttgctgttggtggtggtggtgtttttggttggttttggttttggttttggttttctgttggtttgtttggcattagagtaagaaagaggtttgggtatctctagcagcttaaaagaacaagaactaagcctggtagtacaagcttgtaaccctagctactcagaaagctgcatcagaagggtcctaagttcaatacatgtcttactacagagtaaatttaaaggacatccagacaacctagcaagaccctgcctcaaaatgagagggggggagacggagaggtggagggagacggagacagagagggagggagggagggagagagagagagagagagagagagagagagagagagagagagaggtctcagctcccatcccaggtctcagtgtcccatcccaggcgctgctgctatggggagctgggagccagtgagccaagagggaagagcttcgggcgtgaaagaaaagagtctttttaaccaagaacctgtatctagacaggtagtgagaagagtccaactggaacccagaaacaatttagaaagttctaggccacatgcacttctctatagtcccagaaggaacagaggaatcaacatttcacgaactctgtgtgtctaccggagccaggaacttggcctccgtttctgtttctgagtgacttcaggaaaaggcatgtgtacctgaggggtcttggggcctcaatttctccatctgtaaattgggtggggcaggtacactgactcagaatttcctagctccctttccagctatgcgagcctgtgttcccacgtaataccttttgcttatccacagtgtgatacaggttcagggtgatacagattcaaccaggtccaggcactaatctccacagcctgtgtctggttgagctgtctgagtcctggagtttcctcaaaggcatgtgtaatctggtccctagcccctctccatgtaggtatctgccttaggaggtctccttctgatccattcagactcaagttaatgagtgactttttcctcggggggggggggggaatataagcccaaggtgtccctgggatctcaggactctggggatcagggagggcttggcctgtttctctttttctccccactcaccatctcccctagtggtaggtatgcaaacggagtcagggggagaaggacatgtagaggacacgagggccccaccccttctgaagctagactctctcccctgtcattgcacagtcactatttacctggcttcagcatcctggaacaatagaagttacaagacgttgtttcccatcaatgggattactgcaagttagtgtcctgttacacacagaatagtatctccttgaggcatcgaagcctgacacccagttctgccccttggagctacctagaatcgcctttttgcctctgactttctgacgtctgaagactgagcacagatccctccgttttctccagcctacacagctcagctcctgcaaagattccttctagacatgggtcgacccctgccctcctcagcctcatcattgtcccctggatgtgctattgcgtgtggcccttttaacagtgcggtatgccccattctctgaacttttcaggatgaccatctcagtcatccctctctaatgatcacaacaggcaggcgctaagccccaggatcttgagccgagacattttatacaaccctatcccggtccaaccagatctctgacttggggaacctttgttgcgaggcctttctggtatcctcttccttgacagataacgagactgttgagggtaggtattcagctgattataatgtcgcctgggtaggggggcttgaacactgtgcttttctgccgtgtgttttcagcaactggtatggtgggaggaagggggtattttagggactactgaagccagaaatgaggatgagctaggcccacagtggggactatgagagtgaatcagaccagagagaaataccaactcagtcactccttcctgtggcaagtgatgaggagagcaaccaggcccatttctttcgtttccaggaccctgtgtgctctcagagtagtctgaccaagtagctcccccagccccatccctctgctgtgatcctcaggagaggaagggaacggtttgcaacgaggcaagatttgggacccaggtctcctgacactcagctctgcctgttttccacaaaccacacccagcagccagggcagctggggctgacgaggcagcttcctcaccacagaggaagctctgcctgagcggcagctctgttcctgcagtagatggagcaacctccaggggagctggcctgggatttcctgtcctttatctaggctggccaaagactggcttgtctgaggtatggacttgtatcccaccattttgctccaggctgaggtcaaatcaggccgggcagggtcagagactttttgtaggaagggcttggctctaaacaactggctcacatagcctgtaccccagcacgaccttctcaatgggcaaaaaacagagaggctaaggatgaagcacctttgataatatacttgcctagcattgcaagaagtcctgggttttagggattactgaaagaactacggggtactgaattccctatgccccataaacgggatgtggtggtcatgaacacctgatcctagcacttaggaggtagagcggatgaatcagaaagtgaaggtctgtcctcagctacctagcaattgtgataccagcttgagacatataggaccctggcaaaaagaaagaaagataaggagagagcgcggcgtggggaaaagggcaagagtcgagcctatgtcaaaagcaagagtgtgctgtgaagaataggatctctgctttgatagtctcctacaaagccttgggtggcttcacctctctgaacggggcatctgccaacaacgaggagacatgtacctacctctcagggttgctaagcattcattctgactatataaacaaaatccttgtgtgagtgtcactaagtagtacttgggggagcctggttcttttgctgctttcactgacctggggttctacagggcttcagcgcaccacctccatgcattgagtctggactttcctgtgacttcaggttctgttccatctaggaaatttctcttgttgtccttatagggctccttcctctggtcatctttggtgacatttgtaacactgcaacaggctgtgctaatgatgtcaatagcaataatggtgccctattctaaattcttgacaattttttttttaccatacttagaccccgtgacaattccttaaggcagttagagctattatcttccctgccttacgtataatgaagatgagtaaggagagatttttttaaaatgcccaaggtcaggcgattgaggagcgataaaaagaccacccaggtagtctgactatacctcctataagctgcatagctgactctctttcttgacccttgacctggaggaaaaggcacaggtttggacctctcttttccctccaagtgcacatcaaatccagaagcaattaatctttctggccagtcagtctcccagatcgcttgcctccttgcacccccaccccaccccacccccaaggtaagaggaggaaaaacatgaagtagtgggataaagactccaaaatagagtctcagcagggttgaggagggcctgaaggagggaccgggggtggttctggcatgggcacggagagtcgggagcagggtgctgggtgtcactggggaagaagagacattttaatgtgctgtcttgacaacgggttgcattatttagaacgtgtgggtgggtaggggtgggcagaagatggggtagattagcgcttaggagatcccgtcagctcctgtagcccatgcttgtattgggattatgtgggtggggaagttgaccagaaagaacatctagcctccctcacccccttcaagtttacccatttcagactctttgggggctgcaagcttccttccttagactgtgctagctgccagctcccctgctttggagcttgttccctgttatcttgtcctcaaaggatagtttgtcccagtctctgcccttcctgagtaggatgggccagataacacctctggccaaaacactgggagagcttttgttgtgttttcggaccttggtgtccacccagcacagggcctgctactaagtaaatgctggagtactgtgacttgaggccactcacagttcacaaggaatggttttggaggggaaattcaagagaggctgacatgggaactcacgaataggaggggttctggcacttggcaggtttctggccccatctgtactccagcagaagagacctgatctctcacaacattccgttctatgtttgtgcaatgggcgttacttgctttgcactgggttgctgtgaccaccaggtggactgtgaggtgatccagtgcttctcccatggatgggagttacttcacgctaagccttcaaactgtgctcccaaggactcgcatgcaggcctgggggttgagagggtgggcaggttggggacagtgagatcagtggagggccagtggttagccctgttttgagatcttcaaatagccatgcgcacaccatccaccacacacacaggataactgggctgctatctcatttgatctttacaaacaacacgttggttctgagattacaaccccattttagagataaggacactgaggcccagggaaattattaagcttaaggaacaccatctgtgcagtccttggaaacacactaactctttagtaactgtactgcctgtgatagtatactatctgtattcgttgttgttcaatttggtatcatacattttgccactaatgagcagagcccatcaacaagcagcaagcccaggactgtcttgaggctcgtagcctctcttttcccaccttatcccacgatgctgttcctgtaggtcttacacatctggcaggtcaccattggaactctccatctgatggtcctatcatgaccaaagcactcgaactgtcagtccatgtgcacaccacagccctctctctggctggtggcagggctcaggggaggggttgtgtcagctcgcttcttgaagaggccacttctttcagacccatttcctttctgtcagagacagtttttttttttctggatcccagggtggggccaggctactttaaggcatttcctgcccagagtttatatttggcttcagcaaaaggaaagggaaataggcaaagggagtaggactaaaaggtggtggcgcggggtcaaaataagtgaacaccgaagcttggcaggccgagagggaagtgggaggtaatgagtgctcctgaacagctcaggtgaacttccttgcccatacttaagctcaagtgcaagagctaatagctcccccagggcggaatgcctccacccttaggcagagttcattctcagttctcatacctggatagtcccgaccctttgctttctgccccagggcatgatgttctgctgagcagtgctgcctgaagtacagcagctgcgagcctcaggtaggatgcttgcttcagaagaggagctagagccagatgtgcatacactgttaagttgggaagcagagcttcctgtccaggcattgccagaacattcagtatcccttagcacactgcattgagagcaccaagacaacaggacccagtgcaatggagcaatcagtcaaactgggaagacagcttcgcatgccggtgaatggtgagaggccaggagggaggcttcatgggttggaatgctcgatctagtctgtagcttgggtgtctgtttagaagtaggccaatttctgccctaggctttgggcaaggttgggtttttgggggccagttaggtttcagaaccggaagcgtaaccagattagggctggggtctttgggagaagaaggctggtagggtagcctgttgagaggagagactggagactagaaaaagagagggctgaggtgctctaggcatgagaacctagaacataattgtatggaaaagctgaccatttagtgggagaagttgttagaagctgagatgactcaatgtgtaggaggagacaggaggacaaggtggtggatggtttttgaggcaagaacatcagcagaattcttccctcccatttcctccttgaggacctaagcccaaatgcatcttcctccacaatcaaggacaactcctttgccgaaccaccaactgcccttgccagctcagactccagggcttggggaatagccactagaagatgagaaactcggttcatacagaaatagtggcttcccaaaggttacacacgagttagtaagggagctgaagctataaggtggcttgcctgaccttcagcccaaaagtttgaacccatattgcagtggagagagcggttactcctggtctagcatctgccttagactagtttcgttggcatctcattcctctaggctggagactggaaggagtgaaatagcacatggcttattaaaacaaatatctttccttgtcactggtcaccttgtcagagcacctaggactgagttggagacagtaacccctaggggcaagaaagctaagagagcaacttcagcagagcaggtggcagctttgaccttcactgtcacagggaagctctggactgggtaagaatgtcagctgtctgctttggccccactgtgtcagttactagccttggagaccacaggcctggctgtgtctggacccagattctcaaacagcccgagtgaaccaggatttacctcagagctcatgtgaatcttattatttacagccaccagtactttggggagttggagaggagacactgttctagtgtcttttggggggtcttgaataatttccatatatgtagaacttcataccagagctgccacctctctagctcacccgtaaagtctagggaccaccactgacaaacgtatgtattctttacttcatcaccaggacatctcccaaaatagatatggctgccttaaggcatctgaggcccccttggcaagattgaagttaacacttcagagacccccctccccccaaccctgcatctaggtaggatggccaaaaatgtctccagacattgtcaaatggcaagggaatttgtccctggatgggaatccattcattagagactccaagttttaccctgtgagcaggtacagacatgaagtgtcagaggagaggcacattacagggtctgcacaagtagccaaaaacttcagttgtttgatggctcgctaccgcccgctcccagacagcctccctgtatgtaggctgtttgctttgtgggtacttcatttgtgacaggaagactccaaaagtattgctcacatgggcccaggagcttggcatccagctgcagttccggcagagactcgggctggcatctgaacaggtgcagccgggcccctagtcctgccctacgacctagcaagcaggaggccagccagtgtcttgtactgccaaagtaggctggctgaaatacagcggcccttgctgtggtgcccctccagtggggttcggaatgtgggatgggagctattttggtcttgtctcccttcctccctgtgcctccctcccctgccagaattgaattagagtggcaattccagctaggagcagcaatagcagaaagtgcctgtggatgtgccgggccttctagtaggcaggaaatcatctactctcttccacttcatggtcaagaagggacgtttcagtggccccagaatacctgctagttgagtaaagaccctttctctttgtcctggagaggtagggaaatcaactagttacctgttacagcgtctctcacccaggactgctgtcaacatgcacaaactgcagtgaggctatacctgtaagagtcccattcctgtgccagactcaaaggctatgtggacaaggtgtgtccatatgctagacatgaaaggaactggtcataagcaaggatggtagcttctaagatagaaagttccctcccaaggccattctgtcttgaaaaggctcctttccaggggttcggagggaaaacaggaaatggaccttagatcagccaagaagaatgaactaagaaactttttggcagagctagttgcagtggcagggtcggtactggtatgtagctccactgtctgcctccctctcctagcccaacaacacaggggctcaccttagcttcatagagcccaccctgagaacttacattgacccatagacagtggtatcccagtacccttgggatgctagcgtttcctccggttcatgctaaaagtgaaagagagcagtgttgataccagaccctgcttgtgaggcatccaacctatgacaagggccacagggaagatgcctttccaaacaggaggctaatcattaagataaaggagatcaccatgtttgccgaaagataggaagtcaactaatgatttaactgacctctgcaagtacctgagactccttcccctttccctaccatatgcacccatatcagtgttgcttgtattctcttgtctataccctcaaggcctggagcaaacttcagcccgtggcttagaacaggcttgattctgggctctagagaacatcttttcaggactctctctctctctctctctctctctctctctctctctctctctctctctctgtgtgtgtgtgtgtgtgtgtgtgtgtgtgtgtgtgtgtgtttcattgccaagactgttagggcactagttatctttttgttctttataatcacttgtagaactcacagaagcaaagaaacaaatgaaaaccaactttatcccaagagattctaatttaattagtcatgggcagagccagggcactggcacatttcaaatctccccaggagttaatgtgcacctagtataagctgagggagaaatggcatacccaagagcagtaattaacaagagacattttcttgtcagcccttgtgacatctgttcattccttcttttgggccctttgtcttacctggtacacaaaaaagatgggctttttttttttttttttttttttggtggagaaaaagaacgatgaacctggagcctgggcagcactttcacagatcactgagtatctatagacagaaggaccctaatttaaggcccttaatcacatgtgaagaggggtacccatccctggactaaggttcaagcggctggctgagtgaagccttacttacctcctgcaacatcgttctctctctctctctctctctctctctctctctctctctctctgtgtgtgtgtgtgtgtgtgtgtgtgtgtgtgtgtgtgtgtgtgtgtgtctccatctcccccatattaaaacaggatctccatgtgtcttaaagtctcacgaagttacaaagttcagatagccttaagcaaactagccccctgtaatgacaacttttgtcatatttcaaaccgatgaaggaagactgtgggtgtacggctcaactgcagagtgcttgcctagcctggacaaatggggccttagagtctatctccagtgcagaaataaacaggaagaggaggggaggaagaagagggggagaagaatgaagagggggagaactggggaggaggaagaggagcagtcgtacagctaaaggttaccacctgtatggtaacctaggaactcagaagagaatcttcttttttttttcttctattgatagtagaatctttccttatatgtcctgattatagtccctcccctacgcctcccagttccttccacttctcctctactccggatccacttaatttccttctttcattagaaaagaataggcctcaaagatataacatccaaaaaaaaaatgaccaaataacatataagaagaggaagcaaaaactatcagatcgaagaaaaaaaaaaaaagtaagagtcccaagagcaggcacaggagtcagagacccacttgttcattcaggagtcccataaaagcactgaactgaaagctacagcaaaaatgcaggggacccagtgtgggccctgagcttgctgcttcagcatctgtgagttcatctatgccttgcttagttgattcagagggctttgttctagcaggagcgtctttaatcctcactgtataaatgtgggaaccgtagtttagagaatgaagtgaggtacccagggaacctggctcaattcgaatttttttctcaatttacttattattaggcattatcctcttagacagatactgctgcttttttttttctgagtgtatgaaatgttcccatgttcatagaatgtgagctataggacccctggttttcaccttggtccctcctctgcaaaacaaacaaacaaacaaaaatttaaaaatatctatgctaagaagatctatggtatttgacttgtatacctgcaggtacgtatattgtcattgacttctgaaaccttgtgacagctctgtataccagtatcctttttctgacattctttacaggagaattgtgggtaaaactgtgaggcctaactcctgtcaggagcttactattaccctaggccctgtatcagttaggcacttcccctgaggagattgagctttaatatagatggaatccagtttgtaccagctaaatgctgttactgacctgtcctggctttgaccagagcactagctgcagagtacaacacttgaaactactggcagtcgtgctctggaatttgcacatctggacacagaggttacggccaggggctacagacattcctaccccactcgcctcagcctgccctgtgtcactcttcctgctgggcacataagccagtgctcagtctgggctgtgctagttccagcctcaggtgagttgactctgaaggaggggggggcggggtcacttctggccttgccagacaggctggggcatgttggatgaatggaacaaagtactttagctcaccccttaatcaccaagacatatgtccctgactgctccatctgagaaggagcctcagggcctccaggtcttcctgaaatgctggattgtcgaagtcagtgtccctgacatcctgctctgtaataacccattacattctctggattcctgctatggagaactgctgaggaattcagtcctgagacctaccccaaactcctttgtcttgcagcccttccaaagtccctgcttcttaacctcccttccctgggccatttagctccaattctgagagtgatgggactcgttgctcagacacagaggcacatgtcagccaggccactctccagttccccccttttattcaggactttcaaaaccagatctgagagggagcacagttagtgtgggcttggcataagatgccaatagtttttccctttttattgttttgcttaatgctctttttagtggaggcaatagagagattatatagcttgctcactgtcaaagagttggtgcctggaaatatcaggatttgagcacaggcttgtgatttctcagaacttagaattggttctttgcttgtatggaatctgagggctggtagtgtaatgtcctggaaaagaatactgaacatggaattaaatgtttaggtttagagcttcagttatgatacttacttctgggggatactagagagttactttaaaaaattatttttgggtgtgagtgtcctcatgcattatagatttaaaaatattgatacagggctggagagatggtgagatcgcatgtgtgcatacatgtgtgcacacacaaacaaacaaatacatttaaaaaaaacacatgaaatgtccctggcatgcagaggattagtgagcataccagtttcgttacctttttaccttttagaggtctcgttgccttttcacacctctctggaaagtctgaccagctccattctttagatttttttatcctagtaagaggacagcaaaagcgggttgccgtgctgtgggtgctgagatattagaaatgccttctgttggggctatgatggaaacagaggacaagggagtgactgtggacagcagcttagttgtccttgtggcccaaccatatgcttcagatgctctctcctcgtgcaattccacttttcccttctattaaccctgaacgactggcccggggacatgcatctttcatttagacctgcattgccccctgccagatgagctgaggtactgctagtagggctctgaccctaagaagcctcacagaaggccccttctcctgctctgctctctcttgtgtacttgagtgttttaagagtccttcttctcatcaatcctggctgccaggatctcctcctagacttcctcgtctgggcactaagattatagagctctttctgtctttgaagaaaccctgcagtctccctagagttctttggtcagcagggccaccacacagagaggaaacgttgagggcaagactccatggtcaggggaactctttggagaccagcagctttcccctgccaagcccatagtgccacagtccacggtggcaggatcctccggggcagtgccttggctacacctgcgtggggaacaggtagctactgctggatagttccagagcactgctgctagtgtttttgtgtctttggtggccagtagagcctcttctgtagctttggttgtgcgctgtgtccagttctgtgctaggccctcccagaacagaagagatagaccagtccagctattccccccccccaaagccagcactgtgacagcctaaagttcagcactagagtgttccacaaataggctgagcccataaggacaggtagacctgtcctgggaagccacctggggaaggtggactgcacattaatgagtagggagagaggggaaaaactagggaagctggtatgctaagggctggaagaccagaaaagagtcagacttatctaggactctggtcccagcataggtaaatctcctctcccgttctttccacttccctcctttcctctcagtttctcaagcccaggctggccttgaactcacacctcccacctccaccacctaagtgctgggattatcggtatgtcttatgtctggcttgagtcattctctttccgagtttgtctctatggctgttgtcctgagaagaagagctttctcttacaggcaatgcggtgttaaatgagacttaccctttcagtgggttggatgatggtaagtatgttaatgagaaaggaagtagtaagagttgttggacattttgcatccccaagctgaactaggagactctgactaggacctggaagattgacaatcctagaagccactgggggtattgtgttctggtctaggtcatgggttgggagagtgggaaggatttgggacaggcagggaatgagattcaagaaagctgagtgatacagtaaatggagctcagggagcagagggtgccctcattggccagtcaccttgtgccttccttgtcaccagaactagacatgcttgcctactgggtgtgaggcagtactcagccaacaatttgctaatcccattactctgcctgtttcttttcctctgttctcttttagaagcggaggccaaaaaagcatgtgaatggctccgggccacaggattctctcagtatgctcagctttttgaaggtaaagtcactcaattgctctcccttccctgttccaaaacctgctttctccggcagcttttcatctgcagaatgggaaaaacacatgcctactgcagccacacaaaaactcctgtgcatcctgatcatctttgtgcagggaatttattccgggtgctcagaactctctacctcttagttccagacaagttttaaaggactccaacccacccccgaccccaccccccacccccggcatcctgcttatcctcctgttgtgtccttcctggtggctcagtcttggaccccacttcgcccatggcaatggcctcacatctgttttccttctcttctctgtatttttctgggttctgttcttagagttccagccctcaccttactcttctctctcaatagtatttggtgcgagtagccactcccttttgtcttctgaaatacctcttcatctctgcctgctgccctcagtctgcttgctgcctctgcttcttctaactggcattcaaacattagggtatcccagggctcagccttttgctttcccacatttctttgctatgagatcctcgttgatctccagtgacagctcctggaggggtctgtccaggcctcatttcaaagcttctgatttcctctagtgagccaccaatttaatgtctttactctgagacctttaggtgcctttgagatttttctaagccaggaaaaaaaaaaccaacaacaacctcctaaagacatagccatccaccctattccatatccaggaattattctgaattcccttcttccccatggccaaacatcctgcaagctttttcttctggaatgaattcatttcttaacgcctccgctgccaggtctgttgtgatccaccaccgctcactcagactagggtaccagggtccttcttgacctccatgcttctatttcacttccccagacctgcccttgtcagtgactgaccatgcgactcagatactttgataagtggaatgcgtgccagtactacactctggctagctactgttctcctttgctcactacacccttgctctttcctacttgctctaacccaggctctccctcatcataatcttagtcattttatttcttctggacaaaatactctttccaatttctctgcttagccacctttttctcagtcttcaagtcttgctgtctctgtctccgtctctgtctccctccccctccttcttcccgcccccctctctgaaactgcccctagaaaggcctgggctacctctatctcattaagtagtcacactgccacagccagccaccagcctctctttgccctgtcaacctgcttaggcttttcatggcctttgtgttgttcatctaggttttgcacattgtttcttgcctgtttcctatgagagcgtaagctccctgaaggcaaggacctgtttctgtgttgttcaccactactttgtgccgtgctcagtgactggatgtgtgatgggttttttttctctctctcccttttctcctgatgtcttggtttttcctctcctttccctgagtcctgagaagatggctcccactgctctggaaagacattgtatggctacatgcgggccgctctgtccttgttccctccctccatcccattatttgccttgggctggcaggaggtcccctatctgaaagctcagaattcgaatgaaagagaacacaagatggctcttggcagccatggagagtctcaagcttgttgtctggacctaggcctgcttgacttgtttcttcatttcatctcaggctcccaggacattcttgagattctccctcaactaccaactccctgggtcttctctgcctcattaactttcgttccccgtgacacaatacctgagacaaacaactggaaaggagggacaatttacttggcctcggggtttccatccatggttgtttggtcatgttgctttgggcctgtggccaggcagagcatcacagtggaaagtggactggaggaaagttccatgtctcagggtaggctaaagaggaagggtccgtaggaatagagtggacagggatgcaattctgatacccattcaatgactcaactctttctactgggctcaacttcctaaaggctccaccaccttctaggcacctgcagttggggacataagcttccatcccatgccttacactctgcagcatggttctcaagttctaaatgcttctcacccttcctaatgttgcaaccctttaatacagttcctcacattttcctaaccccaaccataaaattatcttgttgctacttcataactgtaatttgctactgctatgaattgtcatgtaagtatctaatatgcaggatatctgatagggaaccccatggggcgaaggtctaaggcttagagagactttaagaaccaaaccctaccacctctattgtattcccaggctctctgtgtgctatggcccctgccttcttgcttcctgtcttccttgctccaacccctgcaggtcaagtgtagctggggccatttctgatcccctactagactcatcgttgcttctttccaccacacagaaggtgtattccccctggatattggctctgtgaagaaggactacagttttctggaccaggactctctgggggccctgtgcaggtagggggctgagggccagacctaggaagccttgagcccaattttgtgcttctttgtagaaaagacaaccgccttgtaccttctattagaagggagcataatttatgaatgaggctcattttctgcagtcacattgctcattatagttactgtatctatgatccccaactctacccctatcactgtagctagaagatccagatctggtcttgattcaaattcctcagagcatgccttgcactcagtctctttcaactgaaaccagttctgctgtttcctaaggttaaaccactatttctccttgagtttattaaagttgcctcagtggctagcccctgttttctgctcctccttcccaacaaagccatcttctctacagccaccagaatcaccattttaaaaccccaggtaggcaccctctcctgtttaaaaatatgccactgcctctatgcaaaaatacaaaaccatctcagcatgacacctttggcacccttcttttgacctccctcagctttaagcacactctctcctgctagcttctttgttgactgactgtggccttccttctttaccttgtcacaggctcccacagaagtctggaatagctattcctgtgtcttttatcctcagtaccccatctctgctttccaggaagccttctgagactgtaccccatctcttcctgaaagttcctggtctcatccttggtgtgtctgctgtccctctgcatgctctgttcttgatttctatatctctcagtacccagaagacagagaggctctaatcttcccagcatcatacttaagacatcatggacattaatcttggaagagttttgaccacttgaccatgggaaatggtggatggcatcttgcaagtgtcttggtaggctatctcaggctctggggaattgaggaccttgggtgaacacatcctttgtgttgcaggaggctgatgaccctgaacaattgtgcttcgatgaagcttgaggttcattttcaatgcaagcaggtgaatcctggcaaggggtgaggtcacggtacctggcacagtgctggaacacgcacttgcgaacaagctctagcgtgggggtggagatgcagggacctcctgtactgcaggtcctatgagatcgcttaggcttttggtgagcatcacctatagggacatgtgcgagcaagtaccctggctcatgcctgactctactccgtactcaatccacctctcccatttgtttatgtcaataacttgatgtaatgatggccttcctcagagaaaaccatttacctccactgcttggtttgtcatagctaaaattccttgaacaggagaagggacgggacagtgtagcagaaaggtcattggctcgatggtattagaagtcaggatcaccatagccttacctccataagatcttcctcccttggcccctagcctcatttttcccatcactaaaatgagtcaggcgactggactgataactgtctaaggccctcccgtaaggcctctttgtatacagcctcaaaaatgagccttatggcctcattgtttctgcaggacaaattttgctggtttcctctggagctttccctaccagaggcctgcagtcaggtagggtagccaaactgacaaagcactgcctggggacacttcggtcactgacaactaaaagtgccctttgtcaagcttcaactcctgtctggatgtttcctccccttgccaaggagaaaatgaattagaaaacctaaaatcctctccagctcttagatgccataattttaatttaaagctatggccaatgaacatttaataatctctttcattgacgtaaccatgacaacaaatgatgttgggcaaatgtctcctgatttgagtcacattccctatctgtgaattggggacagtagattaattagatgacggtcactatacatctagattccatctacgattactagtgagagacagctttctgttcctactccatgtcctctaccagaaggcaaagttcctcaccctgccctaccccaaagcacttggcagcagagtagggcacaagcaggtacttgtctgttgggcttctgtgaccccttcctatgatgcctccccaggatgacgactcagaagaggaggagcaatgcaccattagcagccactgggcctttgagcaggaaagcaagtgtgggtctctcatgggctcttctgccctgctggccccaccaagccctagcctcctggggacctcaagctgcgaaagcgtcctcactgagcttagcgctgcctccctgccagccatctccgcgagcctttcaccagagtcagcagaccagcccttgttaggtcttgtccccagcccaagtaaccaacccttccttagtcccccccaaggccaggagggttcccaagacaaagtaaagaagcattattctcgaagcttcctcaagcaccttgaatctctgaggaggaaagaaaagggtgacagccggcagacagaacccgagcaatgccttgccacctcggaaaaggccaccaaagcttcatctttccgcacttgccgtggcttcctctcagctggatttcacagggccaagaacagggtcaccacttcagccagggtcagagatggtgagactcagaaagcctgggaggcttggcctgtagccacattccggcatcctcagcctatacgcaggcgtgactatctggtgcatgtgcctggggaccataagccaggcacgttccctcgttctctgtccattgagagcctttgtccagatgaaggtcgtcacctggcagattggcagtcaagtaggtgctggggctatgaagggcgccggggctcctgtggttccacaggcagccatgccagcacttacgacaacttgcctgagctgtacccagctgagcctatacaggctgaagctgaggctgaagctgaggagggtgaaggcagctatgcccatctagatgacatcctggagcatgtgtgggggctacagcaacgggtagagctgtggtctcagaccatgtacccagacctgaggcctggagataaggaggaagaggaggaggaggaggaggaagaggaggaagctacttcatcagtggaagtagccacagtggaggtggaaggccaggatgaagatctagctcaggcagagtctcaagcccacagagggttcccaacccaagtcaaggaggaagtcccactgattgttctggatcaggccccaaatgtggtcgaaccattggtacaggctgaggctgaggctccagctcaggcccaggatcttgagcaagaagctaactcgactgcagagccaatttctgcctccagcctgtctgtggaggaagggcattccatttctgacacagcggtttcctccagtgagcttgacagtagtggcaactccatgaatgaggctgatgctgcagacgcccctgcaggactgcaagcatcagtaccccgtgaacgtcgtgactcaggtgtcggggcctcgcttaccagaccatgcaggtaggagtttggagtagggatgggggtgggactccttctcagcctgtgccttctttctcatctgctttcctagttgtaaagcccaggggaaagttcttgggggccaggagatcatttccaggcagccagtcccaagagaaaaggaggccaagttcaagaatccagagttctaagtgttcagtacaagctctaagcctggtgtggccttgagaaagtgttgcctcttctggacttggtttcctcatcttagcagcaagggtgttagagatggccactgcttctcagctttgatcatgacagttgcttgccatggtagccttagaatggggtcgagactggcactgtctcttgggactaaatgggtctgagaacttggtgccaccctccatgggagcttcttgaaccttgggtgacccaaaggttgaagtcaatcatttgctaccccaaagcatcgtagtagcaatcatcgcgtccccacttccccatttccccatacttcctttctgggcagggataggatggggctatatatttaaaaaaaaaaaaaaaaggaccagaaggagatggccttctctaaggcctagaaaaccggtgtctcaggtactctctgcccctctcccttcaggaaacttcgttggcacagcttccagaattcccaccgacctagcctcaactcagagtcactggagatcaacaggcagtttgcaggccagatcaacttgcttcacaagggctcactgctgcggctcactggcttcatggagaagtacactgtaccccacaaacaggcctgggtatggtgagtgcctcttgagccatacaggacgggagctgtgggctttcttagattttatgccctgggagcacagcccagaggcaggacagacaggcaggctgagcccacaggccagtggagtggtactgttccaggaggctgggcgttgggggggaaggggcgggccgggggatactgagttagaatagacatgttctggaaatccccaggtccaccagctgtcctttctccttcccaccctccctactgccaccagtgagattgtcctaaagtacacttcggttgtcgtgtattgagtaaataaacagccttgtggcttcccgttgtccagattcctttctgtcctgatcctctcatgtagccccatccctctggccctttagtcacccgttctcaagcaatgtcatctgacagcctgtgggactagttgaccttctctctgtgcctttgttcatgctgtcctttctacctggagtgcctttgccttagtcctcctatgggacaagagtgctctgtcctgcagtgagtggtctgcggagttaccacctccactctgtaggcctctctaacttagtaggtggacttctccttcctaatggctcttcttctaagttcaagacctactgcgggccacatgaattacgatgagggctcctatgttcctatggcttttgccagctgaggctaaagcaggcgctcactgaatgtgcttcctgagggcataacatgatccctggctctcacttctggacaagagacagtcttcaagccgagttctcttttcctgatttcttgttaacccctccacacacaggtcaatgcccaagtttatgaaaagaaacaagaccccagactaccggggacaccatgtatttggggtgccacccctcattcatgtgcagcgcacaggccagcctctgcctcagagcatccagcaagctatgcgatacctacgaagccagtgcctagaccaggtgagtccgcctcagggagcccgcatggaaggtggaagggatgctgggaagtgaggaaggcccaaggctgactgctgtcccctttctcttgggttcggctactcactagaaacctttcctctctttgcaaggctcagcaagattgatgccaaagttcctttcctttctttatagctggagccttctgcccactttgggggcagcttctttctgtcccaggctatgtagtcttcctcgcctcagagactgccttagcctaaggccacctgttcaccctcgcctccatgacagccatctttctctttggcaccaggctgtaaagcagcatccctctggacttgctgagccaatcaggaagcctagcaggcttcccagtctcccaggggacctatgttccctacactccagtcctggcctcagagtctcccttctcttctttccctcaattggttaggtgggcatctttcgcaagtctggggtcaagtccaggattcagagcctacgccaaatgaatgagaactcccctgacaatgtctgctatgagggccagtcggcctatgatgtggctgatttactgaagcagtatttcagagacctgcctgagcccatttttaccagcaagctcaccactactttcctacaaatctatcagcgtaagtcacccggacccctccttagtaacctacctgatcctgggggcttgtgggaaatgaacctggcagctggccacatgggctcatgggaacttttactccctggatttgaaaaggccctcggagaggggccacaccctacgactgactccctcagacctagttttggtaaggtaggctgaggccccgaggaaagagctttcccaaaggctgccctgagattagagcagtgccagaggttgccggcagctacatcacagaacccatctgaccctttcctttggagactctgtcaggccttgtgcattctggtgctttgggggaaataaagaaggcccttgtgcctttctcgccctacagtcctccccaaagaacagtggctggcagcggcgcaagctgccaccttgctgctccctgatgagaaccgagaagtgctgcagaccctgctctacttcctaagtgacatcgcctctgccgaggaaaaccagatgacagctggcaacctggcggtgtgcctggcaccttccatcttccacctcaatgtctccaagaaggacagctcctcacccaggtgaagctggtagcgcatgctaggaccagtccaggagaatttggctccatgggcttttgggccttggggagttaccagtgctcttcctgccttcacccgaaggggttttagccttagcctctgtggagcaggcctctcctaaaagaggccagatgattttatggtcaagacaggcaagctggcttcccaagaactaagaggcacctgtcacccatcttgtcctatgccttcttgccatcatcatctgtccctatctccttccaggatcaagagcaaacgcagcctggttggccggccaggccccagggacctgagtgagaacatggctgccacccaaggcctatcacacatgatcagtgactgcaagaaacttttccaggtaagccaggaaaggctgtggtacctttggactctgtatcctgggtctctagagcagtggttctcaacctgtgggttgcgacccctctagcaaatttctatctcccaaaatactgacattacaattcatagcagtaataagattacagttatgaagtagcaacaaaaatgatgttatggctggggggggggggtcaccacaacatgaggaactgcattaaaggaccatatcataagaaaggttgaaaaccagtgccctagatgaacataattgatagaatgaatatatgtgtgtgtatatagagatttattcgaatggctttcaaggctgtgagctgagtagtccaacaatggttgtctcccaatagaaaggccaagaatccgcttcagtccatgaggctgggctttgatcctgaaataggttgttctaaggccagtgaagaagggcctcggcagcaggagagagaaacttgccagcaggagtgagggagcacaggagaaatgcaaaaagcttctttttcacgtgtcttctcatgtgggctgccataagaaggggtggcccagactttgggtgggtcttctaacctcaaatggcccagattttgggtgggtcttcccacctcaaaggagccaacaaggaaaatcccccaaagtgtgcccagctgcttgggttttcattgactacagttttagtccagctgtcaaccaagattaggcagcccagactccaagtcaggcaagcagcccagccccacacatactcctcagactcttcatttgtgaaacttctccctcagtttctgatctgcctcactgtggtgcagtagccgcgtgtctccatttactcttaacactgacatttgtggggtaccctactcccccacagcacccactcagtgtgtgtgtatgtgtgtgtgtgtgtgtgcgcgccctcccaggtgccccaggacatggtggtgcagctatgtggttcatacagcgcagctgagctcagccctcctggcccagccctggctgagctgaggcaggcccaggcggctggggtgagtctaagcctttacatggaggagagtgtgcaggagctgcttcgggatgctgcagaacgcttcaagggctggaccaatgtgccggggccccagcacacagagctggcttgtaggaaggtgagcatcacactctccattttgttgtaggctgtgagagaacactaggcctgtcccatagacttgctctgtcagcctacttgggctcctgcttggtacttgtgggcataacagtcagctagctgagtaagtgtctgaaggagttaggaaccgtatgaggccaaggcatctttctggggccaccttcctgagttctcttctacagctctacttcagactcactgtcaccatgatgtagttcaccgaaatgcctgggtcttctttggtcctgggaaggcaaagctccttgtaacaccccctctgggtttctgtttctgttgtcctgctacctggactgatatgcctccaagttagagcctctcccagacagcgtttagatgccacattatagagctttctctatccagtgccttcggtcccgactaggactggaggtgactcctaacactgcccctgtgttaggaaggagccttgctacctctgggatgaccgctttgagtggcattgtaagccagacattttctgtttagagaatgaagatgattaaccttcccatggggttaaggtaggaaactggcaaagaacccggctcatgcaaaacacattgatggcaaatccattaagggtaatcacccccttgtcttcccccctccagaaataccacacgttatgcccacattgtccataggccctgtaagcatctgaatatgtgggattcgtctttgctttgtgctctagagcagactaagaagcaggcatataggaaggacagagaagtatgggtacctgccagattgtctgggtccaggtctggtcagccaaggagcccagtagccataagaagggagtgccaggccctgcagtctgatgactggcatgaatttagagtgctctcactttgatagtcttcctatccctacccatttggcttgtaggcaccagatgggcacccgcttcgaatgtggaaggcatccacagaagtggctgcccctccagccgtggtgctgcatcgtgtccttcgggagcgggccttgtgggatgaggacctcctgcgggcccaggtgctggaagccctgatgccaggtgtggagctgtaccactatgtcactgacagcatggcacctcatccttgccgtgattttgtggtgctcaggtgaggcattcctgtcaccttcctgctgtccggggccagaaaggtgggccaagggtcagcggtagggacctaaacatgggctcttgccctttcatgttccaggatgtggcgctcggacctgcctcgtggtgggtgcctccttgtctctcagtccctggatcctgagcaacccgtgccagagtctggagtacgcgccctcatgctcacttcccagtacctcatggaaccctgtggcctgggccgctctcgcctcactcatatttgccgcgctgacctcaggtaccaggcctgggatgcctgcctcacccccttggccctgagcccatccattgcacttaccctatgtcagtgatacccagtgtgggaaagacttcctttctctcttggacggaaaccccatttctcatatctgcctgcctcttcctccccaggggccgttctcctgactggtacaacaaagtctttgggcacttgtgtgccatggaagtggcaaagatccgagactctttcccaacccttcaggcagctggcccggaaacaaagctctgagtcttaggctgacattgccaggtgtctgccaccaaagaaatgagtgggaatatgaactgagaagcctttagagacacagccaggcctcggtggcccagctacctatcctcttgtatcctaatgctactctgcacacacacaagagaagagggcgtaggtatcctacctccacccaccttcatccccgatactgcattctgatctcacaagcgaagagaatcttgttagtggcaagaagatcattgctgtccatctgaccaagaagacgctgctgtatctggaggcccagcaggggaagaaggtggagagccttggacagcctgggctctctgccataccaagtaggcaggccatcttatttggtgctagggttcttttgagtttgaatatgaggtctgatcctgcctttggggccaacattgatcctgaatacaggtctggaacaccagatcgggtaagcacgggggacacaatgaccaccacaatccattttatatgtgaacatgatgctgaactttctgaagattgacagtggccctatgggcccttagtaggtaacatgacaaactgggataacttgggatctgaggttagaggacctttcttcctcaagcccaagaaaccaatgaaccatcctcccctactttgacccacactttatccattactctctagagttgtgggcagcctttggccactcatggccatagatacaagtgaaatagctcattcccatgacacaggccaggccaaagctgacagtggcagcaagaaatacaaatgtatcctcatgccttttgcctacagtggtggtctataagaacagtccttttggctggagaggtggcatagtggttaagagcagtggctgctcttccagaggacctaaaagttcaattcccagcaatcgcagggtggttcacaaccatctgtaatgagatctgatgccctcttctgtagtgtttgaagacagctacagtgtactgatatacataataaataaatagataaataaatcttttataaaaagcaaaaccaagtgtccttaaaaagaaaaagaaaagtccattcctagagtagacaccctagaaaaacacaaagaagggcgtaccttagccatcctggctgataccagcctgatctatcccatctagtggttatgtttgttcagatagaaaccgagcagccattcagaggccaagtggtgctttctttgtctttggctgagtaaactggattgtggtggtttgtagccatcgttgtgatgttaatcctgttttgtctgtgcctataaatactgtacagccataatatatatgtgtatgtgtatatatatacatatgtatatacctatacatatacacacatatttgcatgcacacacagctactccctcttgagtgcgttataatctctggatgggagcagggtctggactaacacacttctgttctaacgagagaggagaggtgaagggcaggccgcagcagttccctctgcagaataataaagcaggactggagatgca

SEQ ID NO: 626 - DNA, 4672 bp, mus musculus
aagggcccggagctctggcctgaggaccttttcgttctgaagttacccggtgggtgtgagttattgtgtgggcaggggggagctgggaggcccggtttgggaagttttgccggcaggtgcatgagccattacctggcagagttttagaaatgtgtaagaacagcaaccgagagtcaagacactagaagatccaagcagaaggaaggaaattgatccagatgaaggatggaggccaaagggaaggggctagaggctttctccacggcttagctaattttcaaagtgggatgcctttactaggcagttgggatttccgttttctgggagctgttagagaaaagaaggcaggattccagcatttaataacccaaagcaattccaaattttcattagggtgcatacttaaaatatccagagggtctgggtctcagaaggggtcaaactacattttaagttatgagaaacatcaactactggtaaccaggtaatgtgtttttctaaagctctcttccttggctcttgtctgccataagggttaaaacaagcctggactgttttgaacacctctgtgcagaagaagtggtaaaggtgagggtgaggtcctctctggttcatcttagcctatttccctatttttaagggttcagactcttggcagaaaatgcctctaaactgtgatgaagccctaagtactttacagtgtacacagtgaagagttttaccgccgatacctcattgaaccctaatagaaccctttgccatagcccaagaagaagttcctttttattgctaaagcaacactggaaatttttctctcatgggagacactccattttgttgacaaacagagggtggaaaagttttcaaatctgggcataagaagagaaaggctgaggttattgttatgtgtcaggtttacacaatgcatgtttcccatctacattcttctttccactgatctccttagctccacggggcagataacaaacattatttcatgtttaaaagaacatgggacactgaatcagaaggatgagtagctgtcgttccaaatcaagctggctggctggctgggactgtgtctccatacatacatacatacatacatacatacatacatacatacatacataagaaagcattggaagcatgggttatgatctagaaccagtaaaccagagggagatggagatttgccagtctgggttctagagttaccaatgacttttctgtctgttatcagctcttgttcccttcaaaattgaaaagagacatgattttcggtagacagtaccagtccttcaagaaaaaacaaacaaacaaacaaacccacatgcataagtgtctctccttgtttggggcgcttttttgtcttgcaggggaatgccatactaaaacttccccccgaagactttagtgggaagaaatttaaaattagaagcctgagtcatcttatctggaggaatggaagagctgactggaggttgagggatgtggcaaaggaaatgagatgggaaatgagtatgggctcagggctgggaacctgaaagaggagtttcaagtgtaaaacttgaaaggtagatccagggctatggtacacagcttaggcttattaagtaacccttgcttaagaactatcttttgaaaggagcacttgacacacactccagaaagttattgggtatactcccattttttttctttaaatgataagatatacccaacaccagtcctaacttctgccaccttctcctagtctttttgatagccaaaagggccacaaggcccaagttcacactccattgccatgctcttatctcttggtgggggacacaaaactatagatcagatgaccagggtgctcttcatacctggcagcagtagtaggaaagaccccgccaggagggaagcaaatgcctcagtgttcccatccccctgcagctgaccacgacctgggccgtggagggagcaccccatgtccacgtgcatccggcatgtcctgctaactcttcttacataagattcccaagtatggagtcagggcagctgtgaatccctcttacccgacgtctaataataaatcgaggctaaatttccggactgcagtcactctaggttcaggattgaggggctcttttgcaacccggacacacaagcattccggtcatcccacccggagagtgcgcgccaagcccgcccagcccgcgcgcgccagtccgccctctggtttggacggcggctccttgggctcagtgcctcgccctccctcccccaaacagcttgttctgggtttggtgctggggtgcggccgctccatcctcccagccctaccctgccttgccctgctgggccgccctgccttagcccgggtatcaggcgagaggcggagccacccggcgtgccccgcccccgcggtagaaagggttgggcgagtgttactcgcggtcagggctgggaccttttatctgtgctgctggaggaggtaggaggaggagacatcaggggtggtcctgggcgcctgggacacctttcccggactataaattgagcacctggaatgggcagggggccggagcaaccacagtcgcccttactcacagtccgatcagtgaccgcagcagcgcccttgggcagccaccgtccgcaacgcaagcactgagaaccaggggatttcgcagtgcaagaggtgggtgtccccgccctttggcagcccgggctaatatggttgctttcgcttaggttttagaagggagaaaccagagagtccgggatgggggagatttttttctccttttttttcaaaggtcttctgctagtattggaggaggtgataccggctggtcccaaggaaccacccttgtgccttctctggccagccttggtcagggtgggagcatcgcgcggaccggatgccgggcatcctaaccgggtgggtaatttgttcttttcgtctctgtctcccaagcagaaaaaggctagacccagccacccaccgtcaatcctgagccaaagataagagcagccgggcctcacgaagggctgagctgagaaagaagcaagttagagagggcggagaaggatctgggaatcccgtcacaccggcttcaagcaggctcccggcatcagcctctgagagcgcttgaaggcggcatcgccagcggtctatctccgtgtaccagcgtccctgtgtttccgcgcccgctcggccaccatgatgcaaatctgcgacacatataaccagaagcactcgctctttaacgccatgaatcgcttcattggcgcggtgaacaacatggaccagacggtgatggtgcccagtctgctgcgcgacgtacccctgtccgagccggagatagacgaggtcagcgtggaggtaggcggcagtggcggctgcctggaggagcgcacgaccccggccccaagcccgggcagcgccaatgaaagctttttcgcgccctcccgggacatgtacagccactacgtgctgctcaagtccatccgcaatgatatcgagtggggagtcctgcaccagccttcgtctccgccggccgggagcgaggagagcacctggaagcccaaggacatcctggtgggcctgagtcacttggagagcgcggatgcgggcgaggaagatctggagcagcagttccactaccacctgcgcgggctgcacaccgtgctctccaaactcacccgaaaagccaacatcctcaccaatagatacaagcaggagatcggcttcagtaattggggccactgaggcgggggctgtccccgctgcccagcaccctctctcgggtcggctctaccacccctctctttcctccaagctattttcttcctggttgtggggcgcgaagggcacactgtaaagttgggctgtgtacttggtggggttagtgtggagaagagggcctcatcgcgagagcagaggaaagtagtcgccagagaggggggttcaaagacccccggagggggcctactctgtgttggtgggaatggaactgggccgatgtccttcattcagcctgtgcctttcttggggtttcttttctgtttttctttccggaagagaagggcctgagaaagggccatgccagggcacagtgctgggttgccacacatgggagggcagcttctagccgggtgcttgggggaggcggggctcagcctcctgctgccctgccttgagctgccagaggaggccttggcgttgctaggattgcgtcagttttcctgtttgcactatttctttttgtaacagtgaccctgtcttaagtctttcagatctctttgctttgaaacttcgtcgattccattgtgataagcgcacaaacagcactgttggtaaccggtactactttattaatgattttctgttacactgtacagtagtcctgtggcaccctatccctttcacgccacccctcccccgcccgtgtgtgtaaactggcgatgtgccagctaggatgaagcttgccactcggctagcgaaaataattaacattattatgagaaagtggatttatctaaagtggaaccagctgacattatatctgtatcgtatggagaatgatgaagggctccactgttgttatatgtcttgtttatttaaaactttttttaatccagatgtagactatattctaaaaaataaaaacgcagatgtgtt

SEQ ID NO: 627 - DNA, 2989 bp, mus musculus
cgtgaccaagagccgcctagagccgaagtcctgttagtcgcctctgactgggtaccaaccccctattactctgcaggcgcgtgaaggagaaggaaactcgctgggaccgtgcaggtcggtggaagctgcttggaaggcgatgtgggtgggagagggccaagagcacctcgcatccaagtttggcgaatatgggctatgtccctttctcacctactttttaaatatctactggacccgcatctcaccctcggttcttttagtagggagaagtggcaggcttcaggttggggtgaggtgggtgaactgcgattgcacaaaatccaagcaaagaaagaaccgccaggcatcgcgtcccgggtgctggtctgtcccccaagcactccgtgccctcggtcccctgtctgttataggtctccgctggagcctagacttgagaagaagcaacccgccttggttggaaccttgctgcaggtttgaaggtgggattcatcctgatcctaaaggtaggagatgaggggggctgggatctttgcgggtcaggtccgagtcgccctctcctggccccttctttctccacaccccctcccatttcggtgcagggaaaggggtgtggcggcctttgctggggaaatggcggacgaggagggggcggggaggccctcgttagcaaagtcgggagggtgtgagaaataatatttttactcaaaaataccaaattcagaaaagcaccaatcggtgtagttatctctgtccaagtacactttcaattctccattgctgtctgacatcgcttttcgattgtccttctgccagactcggtccacctatctccgtggagggaatacagcagaagccaccagaagaaaaaaggaattcaattggtttttgtagaggttagttagaaaacatgcggtgttctgggggtgggtaggaggaggagagaaaggaggtggtggtaaagaagcctacatgagggttatctgttcctttcacctgcctgcctatcaagtgagagcctcgtctactgtctatctctgagaatcctggaagcataaaggtagatcctgagggtagatatgggaagggagtaaagaacaatgagatcattccctaataatccaactttctcagggagaattcgaacgaacgcctacctgtctgggcaggtactaacccagtcacagctcagagctctaatgccatttctctcactcttagattcatgacaagaatcgcagaagcctagaagaggctgaagattactagcctgacctattaatccacacatccgctgaccgttctcttcaatcaggtgaagaaaggccctcttctttctggccacaaggctcacacacctataatcatgggtcgggcccgggaaatgggttggatggcagccggactcatgattggagctggtgcctgttactgcatgtacaaactgaccatgggaagaagtgaggggaacgagctggaggacgaggaggaagatgaatgggaagatggacaggatctggatgaagaggaagcagacaattggtttgatttcacagcaatggctcgaccctggagtgaggatggggactgggatgaacctggggccccaggtgggactgaggacagacggtcaggtggtggaaaggcaaacagagcacacccaatcaagcagcggccattcccttatgaacataaaaacatatggggtgaacagagctttaaatccttcacttgtattcttgacctgaacaagtgtgtttccactcaaagaaagaaaaggttcacgaagaacataaatgctggcttttcccttagccccaatatcagtaaacatctggccagcctatcagtggttggaaacaggagtcccaccccccatcccactgtgagggagaaggctctgtttgtccctgaaaacccaaacagcagccttgaaaatcagggccagattaagatgtccattgatgaagtgtgtcgagagacactgttgtgttgctgcaagtcttttctgcagcaggcaggattaagtctgctaataagcatgacagtcattaataacatgcttgccaagtctgtttcagacctgaagtttcctttgctatccaaggggagtggatgtgcagaggtgcggggcttggaagagctgatgagtttgtctgaaaagccagtgctggtgggggaagcactggctgcccaaatgctctcctccttcatgtgcctctttaccagaagtgggagcagagagatgcttgtggaagccatctccccttaagtggctgtctcagaaagaatgagactgaagccacccagagcctgagcactttcctgagggcaaagaggctgcagtgagtgccactaaggatgcagctttagccagtcagctcctccctgggtgagagttccttccactgtctaaatggagggctacactctgactggccaggcaaggctcttccagagctgtgggcaacttctgggttttgtagtttgcaggtaaagtgcattgtaaattgctgccctgcagccttcttcatgtggtaaagggtaaggggctccccgtggccactagctggggatgactaacagcaaatcacagcatagaggtgaagggtaaggggatgcccgcggccactagctggggaaactaacagcaagtcacagcatcagagtgaatgttgctgttgcctgtggtgatctccctgtctaagcgctgaaccacttagcagaaatgacacccatatgagagcttgtgccaaatacccttctgctgctgctgctgctgctgctgctgctgctgctgcttagatagaagtagttcccttctcctctgtcctacactagctgatggatggctagcatgttaatcaagagatgcactcccttcctgtccactgtagtgactgaccctcttactccccagtcccttaccctcacccccagtttgtatcctcaataaactgtgtgctttgattggcaagacaattaaacaggg

SEQ ID NO: 628 - DNA, 33661 bp, mus musculus
agcctgttggagtctggggtgggtgaagaaatgcccgaagtatcattccatctcctagcaatttgactcaaggtggagttaagaaggcaggaggggagcagggctgaggcaagagaagccgctgggagatcaaagtgtgcctgcagcagtcctgggcaggcctcaggtggccagagaaggcaacaggggcaggtagagtggggcagggctgaggtaggagaaactggcaggagatgccagagtggctcttttcatgcagcaacagaagcaagggagtcagggcagagcacagaaagcacaagggggttagggcgaaagctgcttttctccaggctgtggcagagctcaaacgaccaggcagagacagtggcagccttggcggggagagcgcaagaaccctgcgctccagagagaatacatgtgtaggtgtggcggatggtcgtgtggacacagaaaagcaatgtctcaactaacagaatccctggcagaggtcagggccagaactgcttttcatgaggtgagttgggaacagaacaaatggcgagagaatgagggagggggcagggagaagcctatgctagttgacacttgttgttttaaagtgccagtttagtgggcttatagagatattgcttgctgtgtgtactgtgagttacacctggacatcccagtaagtagggacaagttggcgaagactaaccaattgggagagagtaaagttattaactacccctaccaacgtcctgagaacactattcataaccagagagactgacagccaggccagaccacaagtcttcacatgatagtctggttggtaagctctgggccggtgccctgagtgacagagttcacccaggcctgggatttctcagcactgagaaaggaaccatcttagaggagagaggaaaacctcacctaagggaaaatgtcctagaacaagggacagtgaaaaacctgaatgtcttcatcctcaagggcagcacaggggtagctctgagctcaagaactctcccctgggactatggggacatttacgatgaccagtgtggggggggcttaccagttctcagaagtttggggtaccgagcattggttccccatgttgtagcaggggggatgcaaacgtgcagagcttctaaatctgagtcttggcaatgttgtgttttataaaaagacgagggagaaggaatatgtttggtgcatgtgtagtcaggtgtgggggaagggggagtctcagtgggcccatgctgaggtgtcccttcctcccgagggaccagccacacgaaggtatcgatagaatagagtttattcaggacgtggggagggaaggtgagagggtagtagagacagagaaaggtagagagaaggaatagaggagtagaggccagccatgcgcacatggagagagaggggaggagaatggggagggagaaggaaggggcgagaggacagagcaggagccagaaggcctgagcaagacagagctgttcccaggtaactggggtagaggttagacaaaatgttaatgtggtgaggacagagtgacatgattcctacccctagtacagagccagtggtgttgggcctccacaagtatcgagggctgccacaggtataaggcttgtctgtgtaataatgtacatatttcacactcctccttagaggactgttctccctgttaatgttagtgactccatgataatcagagacagcacaagtccaggagacaaaggtgtggctaatgtctcagcaaaatggtaaacactgggactttcaggacagcctttaagactttgaaaaagaactcaaaaatagagagagagagagagagagagataaaatttctcaactatgaaaatataatgatgcaatgtgaatcatgaggggcttcatgaatctaaaggaacaaaggcagctgcactcagagccagccttgtcaggaagacacaaaggcaggcagattcctgagttaaaggtcagcctgagacacactgagtcattttctacctcccacctcccaagggaggtagaaatgttaattacagggcagggtccctcccaggtagttagcatctgtgctcaacagaggcaggcagatctctgagttcttttgcaatgttaaaagaaaatgtgtgcttgctgtctcctaagagttaaggggctggagtcccaggatgctgatacagaggttaatcaaaagggaacctggagtaaatgactgagttgatatgtaaataaaacctgggcttttggtctgcaagagctgagctagcacaaagcaatagtagttcttagaactgagaagagaagagaactgagaagagctgagtacctggagatatctggagagcaaaaacatctcttcaagtttttatttttctaaccggatttctggcttggtcagaagatccaaaaatttttaagagaagattctctgactttggtcagaaaacccatgagttatccaggtagcttttagaatttttactagcagagagagttgtctcaaccagagagtttacagactagcaagaaaatgctgtctagagcagaaaatacacacaggcacacacacacacacacaggcacacacacacacacacacacacacacacacaaacacacacacacagagagagagagagagagagagagagagagagagagagagtaagcaatctggaaattcatctcagcagaacctagggcttgaacccatgacttgacttcgagtggtttcttttcccaactcctcaaaaccccttctctctggaacccctctcctagaggaggctgatccttggcacatctcttaattccaggccagcctgatctatttagttagtttcaggacagcaaaggttacacagagaatccctgcctcaaacaaagaacagaaacaaccaaaagaaatatgttttttctctctttaattgcgtgtgtatttcatcattatgtgtgtatgtctgtctgtctgatctgtgtctggtaattttagactcatctctgacctttgtcaagtcaaacagatggttcttggctctattttctgtctatttccatggagaaagcaggtaaacaatttacacataatgctgagcataatggctcctccctgtgatccaagcatttgggaggagtttgtggtcatcctcagctacatagcaagtttgaggcaatcctaaactacttaagactttgtctcaaaatcaaacaaaaacaatttgcatgtggcaacagttctttgtgcatatatgaacactgcctcttcatgtacacatattaaaataaaatatcattaaactttcccattactttccttgttcttcatgaaatcacaaacctgttactgaatgccaagtatgctgagtataatgaatttgtatagtaagttctgctgaaataccaatccaagcatttcaatatgtttcttacatttaccaagaaatgcagctagtatccacgcacagccattgcaagtctgctttagttcttctgcctggaactcaaactaaaggaatcaactttaatgttatggatgtgatagcagaagaatagcgagggtacaaccatgcactctatctttatttttgtttcttcaaagggcttctgcatcctaaactagtgctgtctactcgtgctgtatgagtacagtgcactcttctgctgtatcacgtctctatccccatacactgtatattaatgcttttgttcaaagatatgattcaggggttgagggggatagctaagcagtagataacttccttataatatacacagagctatggattcaattccgagcactacaataaaaatagtaaatgaaaaacacaagtaaatgaaaagcacgagtggggctggagagatggctcagcagttaagagcactgactgctcttctgaaggtcctgagttcaaatcccagcaaccacatgctgactcacaaccacccataacgagatctgaccccctcttctggtgtatctgaagacagatacagtgtacttacacataataaataaataaataaataaatctaaaaaagaaaagaaaagaaaagaaaaacacgagtgaatgtaaagtccccaaatgagaaactctggaggtaggccccaacaagaagagcctctgtgtgagtctgatatacactcaagttgaagaagcagttcctatcatttgtattccctgtaaggcagttgaatagtgggattgtgggtagcttaaaatgtgtttgtcatgatctgtcaacctgactagattgagatgcctagtgacacacttctgggtgtatctgtgggggtgttgtcagagatgattgacatgcaggagagcaattgagggggaatgtagctgttctgaatgtgggtggcaacatcccaataggcctggggctccaaaggaaaaaaggtggagaaatgaagattcctagccagcgtgtgcaagctttatacttcttcagcagatacgtctaatggccacggcatgttctgtggccaccagattccagagtctttagcgtctcaacactaactcacacagagactctctaagaagcttgtaggcaattacagatgccacttcttctgagacttccagctttcttggactgcatagctaacgtagttttgcttcttccgggggccaatagtcattgtttggattatccaggatcgaatgtgggtcctactctaacaaatccttcttttgcagttgtgtatgtgtttgtgtgtgttatgagagcttcttgctagcatgcttgcacaccgagtgcacggtcctgggttccctctagatacagcaggcagagagtgataaatgggggtgggggggtggcgatcctagggagatagatttattactatagtgcttgctttgcaaggatcaggacctgagtcagagccctagaccttgtgtaaaaagagacaggcatggtggcacatgcttggaactccagtagtggggaggcagagctaggcagattcctgggacttgctagccagccagcttagcctacttggaacgttccaggccagtgagaaaccctgtcaccctaaacaaaggtggacaatccttctcaaggaatgacacctgaggttgccctttgacctccccccacaccccacacaggggaagtatacatggacatacaaacagagcactataggcacaaaagaggaggaaaatgagggtagagagaaaggagaaagagaagaaaataagaaaatataaaagagaggagagcagagaggggttggtatttattgggaccattaacccatttggaaagctcagaaggtcccgttttccaagcagacccttcatttgaggctatgggaaatggtgaaaagttggatgattggttgcaaattaaataggtggggacagaggtcaaggagaagcaggctcagatatatagatgggccacataaagagctagacgctagccgggcagtggtggcgcatgcctttaatcccagcactcgggaggcagaggcaggcagatttctgagtttgaggccagcctggtctacaaagtgagttccaggacagccaggactatacagagaaaccctgtctcgaaaaccaaaaaaaaaaaaaaacaaaaacaaaaacaaaaaaaaaccttggccgatacctctgcctctatctgcggatactgcacacaaggcaggaagatcaagggaaccaagttgagggctgacttctaggccgcgatcctcaactccagagtcccagacttgcaccacctggggtgcttctcttccttctagccagatcaactcgcgagcgcactttagtctctcagggaaccgtgggagagcgcagccagcagagggcgctagagagcccgcgggcgccgtctgggcggggctggacccgagcttctcctccttgaaggcaagtttgggcgggaggcggacactgtgggcggggccagagggggttgggaccagaccattccggaaggaagtggttccgggtcccggcccgcggggagagctgggtgctggttggagcaggaggcgggagctgcgcgacgggcgaggcggtgagggagcagcaacagcggcggcggctgtagcggcggaggcttcggcgacggcgacagcgacagcgacgggctctggtgacgacttctctgaggggtgagcggtccggggagtgggcagagtgaggaagcccgagcctgggaaggagggagggtgtgtccttcgcccacgagtggcggttctcacggtggcgggcgggaacgggactgcgggcggacttggcttctccggggacctcatcccttctccggttcacgctggggccagcgccttccctaagcggctgccgcccctcgaggctcaggctcccttggcgcgcccgcttggctctctgccctgagggggggtgggttctgaggctgtccccgccggtgctattcctgagccgccgccagctcgggcacctgcccgcccccccccccaacccccaggtctgcccgcccacggcggcgggcaggtggcggcgccaggctcctgccgcgtgggtccccggggaccagggagggggcggtgccgggaggctgaagcccgaggacgcggagccctccggagcggagcgatgctcccggctttgtccgccaaagatgctctggcctcgggagccgcatcctccgcggacaaggtcaaaggctagttagctagcgcagacctccctgggaggaattcagtcaactgggccaccggtcaggaccgccctagagaaacttagccctcgaaatatgcttttttttttttgtttgttttgtttttttttttttttttgagttacaccttgagtgactgcttctctggaacacattccaaacggccaggagaaaatagggccctcgaggcttccggtcaggctacctttttaacttttcttttcttttataagcctggaaagaaaagctaggcccttccccatggcaagcaagcactccaccgtagagctatgtaccttttgagatagagtctcactcaacacaggatgctgtttaactcattctattggtcaggctgggcagtcctcgaactttgtacccactctccatcctgagtagattataggcctgcgtggccaggcctggcatatttaaacttttctttttccctagatgtgaacaggtccaaaactttaaaaggcttgtttgttcatttatgttgaggctttctttttttcttccttttttttaaaaaaagggagtctttaaagaaaggatggtcttgaactcacagtgtagccaaggatagccttgagtttctgactcccggtctctggcccctaaatgccagggttgcaggtgcatgccagtcatgtttgttttattttcctcggttattgatagcagttcagcttcccagttactccgtgttctaaaaaaaataaaacaagttagtaagggtttttctaagtgaacaaagtttgaagttatgacttacttgaattatatctgattaccttgtccaaatcacttaactttttctaaggtatttcctcagcaatgaacaagggattataatgtgtgtcttaccttttagggtcatatgagacatttatgaaagtatatttcacatactttgtcttacttactgcaggttttactttcttgtaaaaatttcagagcacagaagcattttttttttgtttttttgagacagggtttctctgtgtagccctggctgtcctggaactcactctgtagaccaggctggcctcgaactcagaaatccacctgcctctgcctgtgcctcccttgtgctgggattaaaggcatgggccaccaacacccggcgcacagaagcatcttgaagcacaaaaattttaaatgtaaacttttggagctggggaaaatggcccagtcagtaatacttgctgtggaatcatgagaactggggttaagatcccttgtacctgaataaaaagccagcagcaaagtatttatctctaattccagctctcaagaaacagacaggagagtttctgaggctggctaaccattcagataagctgaaatggtgaacttcaggtggtataaaagattcctgtcttaaaaaaaagttacgtagagagctactgaaaaagatctatttctctgctcttcttgggcatacacacacacacacacacacacacacacacacacacacacacaaggacatacatatttctaaaaggtctagtttttgaaatctattctggggctaggtatggaatagcattggtagagtacttgtctagcatgtttgaagccatgatttgtattgccagaactcaaaaggtaaagacaaaaagattgcaaaatcatgtgtgaggtgtgtgtttcttgcagtgctgtgaattgagctcaggatttcctacatgccaggtaatcactttgtaccagtttagctgtatcactagccctcagtttttttgttttttgttttagttttttgtcaagcaggatgccactgcttagctcatgtttgcctcaggctcttgagtgtttggattacaggtatgtgggacaaagtttggttgagaagcagaagtttgaggccagtctaggcactattaagaccttgatttaatttttttttcaagacaggctttttctgtgtagttctggttatcctggaactcactctgtagaccaggttagcctcgaactcagaaatccacctgtctctaagaccctgttttaataggtgtagtgggccatgcctttaattccagcactaaggaatagacataggcagatagatctctctgtgagattgaggccatcctgatctacatagtgagctccagagctatagagtgagaccctgtcttgaaataacaacagcaaaacaaacaaacaaacaaacaaaccaaaaaaggactcattttcaaagactcttaagtgatactttttggccctacaccatactctttcatactcaagtttgaactttaagttgtttttcatagtgtatactgtgtacattgaacatagctccctttttgtttgttttttgacacagggtcttatttagatcaacttgacgcaaatttatagtccttttacctgaccctccttcgtgctggaattctgggattataggcatatgtcaccacacctaaatcacttttctttttttttaaagattaattaatttattatatgaaagtacactgtagctgtcttcagacacaccagaagagggcattggatcttgttacagatggttgtgagccaccatgtggttgctgggatttgaactccggacctctggaagagcagtcgggtgctctaacccactgagccatctcaccagcccctaaatcacttttctttcttcccttcattcttttcatgtgacaggatctcacttagtccagactggcctcaaactcagtgagcatcacctagatttttcatcatctgcctctatatcttaaatattgggattttaggcatgtgtacatcacacttggtttacaccagtgggtctcaaccttcctaatgctgtaaccctttactacagttccttatgttatggtgatccccccaacataaaattagtttccttgctaccccataactgtaattttgcaactgttaggaaacaaaatgtaaatatctgtgttttctgatggtcttaggggatctctgtgaaaaggtccattaaaggggttgtgactcacaggttgaaaactactgatttatatggtgctggggactgaatttatggcttcgtgaatgctagacaaacactgtactaattaagcagcgtcctgggccttcttcctttgttattttattttattttttgtttttttttgggggggggtttgtttgtttgtttgttttttgagacagggtttctctgtgtatatccctggctgtcctggaactcactctgtagaccaggctggcctcgaactcagagatccgcacctgcctctgcctcccaagtgctgggattaaaggcgtgcgccaccaccgcccgggatgttattttaattttttaatcttgtaactgaacacatatttattctttaacttttactgataaatatgtttaccacagtgagtgtgtatatgtgttgtatgtgtgtattcattcatgtcagtgttttccttggttgttgtctatcttatttttaaatgtttatgttttattattagagtgtgggagggtatgcacgtgtgtgtgctggaacacacgtggaggtcagaaagctttgtggaatcagttctctctgcctttacatggatctgagagatcaactcagtttccaggctcgtgtgccaagagtctatctgctgatctagctcattgtcctgtgccttgtttttgagacagcgtgtgttggattggctggccagcaaatgcctttccagcccaggggttacagttgtgctgctgtcttagcttgtttggagggaatagggatctgaactcagggcctcttgcatggtgaaggctttactgttgggtctgttccttcagcctcctacaaggagtatttgactggtcattgtttttaatgcatctcaaagaatttgattatttaggctttgtgtctgtacgcacacacacaagacagggttttactctatagccaggctgacttcagactaactgtaaagcctggcttaagattcatagctatcctccaccttccagcctccaaagtgctgggattctaggtgtaagctgctgcacttggcttaacttttacttacttttttttttttttttttacttttaaataaacagctctttagggctggagagatagatgacttggcaattaagaacatttgttttcttgtagaaaacctggattcagttctcagcacccacatgattgttcacaagtattgaaactccagttccaggatatctgatgatttttttttttggccttagtgggcaccacatgcacaaataatacaatacagaacatacatatagaccaatactcataaacataaagtaaaaaaataaataaaaagatgcactatttcacatgtattgtatgtgtgcatatatatatatatacatatatatatgtatgtatatatatgcatgttcatggcatagcatgtatgtggaagaaagaaagacttgtaggctctttaaaaaacacatgggttctagagatccaacttaagtcattgtgcttatatggcaagaagttttacctactgaggtatctccccagcctgtaagcacataagtatttttgttttagtggcctatctttgtatttggctctttctattgtgtttacttttcaaatactttaccccttgtgatcaaagtaagaatgataagcaaaagtggagtgctgtgtgcacttaatgactcttccttactgaagaactggtgagaaggtaacacacgctctgtgacaatgagaataatccatgcctggtctcctcacctctgcttgctttcccctttcttctgagctccttactgattgccctcttattcctgtgctcttttgctgcaaagggtttcctggggaatttttattctttgaatttgtaaatacttgatttgcatttagtgtggaatctttttgcataatgtacccatcttaagtgtagagttcagcatttttagtattttgatacaattgtgcaaacatgatcataagtctaattccagcacagttcttcccccccaaacgttctgttgggtgtggtgctagatgcctggaatcccaggattgggctatatatggagggagggtcaggagatgagggtcatcatcctcacagcctggtgtacagagtgagttccaggactacacagaaatgttgtctgaaaaaaagaaaaaaaaaaacaaaaacaaaccaaaaagccagctctgcattttacacagatcagttaattcatttgtcttttccactatccaccaaacagcttttagattagaattggtattttgcaatatcgtgctctaacatcatataagactattaataagatctttctttaactcagtactcaggaaaaaagtctgacttggaggcctcttttatttagtaggctcagagatgaggctttttactgctgcccaaagtggtctgtgctgtttcaggctgcctgcttaagggaaggctcctggtaggtacacacagttggggataaacacttgatgttgtacaggaaccttctgaatgcctaggagaaggtcctcccagctcaacttagactttgatggcttgctcctccatcctggccatgctgttttcaggtttagcctcatgaaggcctcaggtttgtgaatcttgctgtggacatacttcatctgggcaatttctttctttttttttttaattaggtattttcctcgtttacattttcaatgctatcccaaaggttccccatacccaccccccatctgggcaatttcaagtgaatatactgtacctctttattggccacatgggacaagtctccatgaatcgtgtccagggcctcagtctggcaggcaaacaggcctgtgctattgcagcaccagcatgttgcagcctcgtctgtcctttggtcctcagggggtctcccatattccagtgcacatgattgctgctgtagctccatgatatatgaccatatttccaactccagattggtatccagcagcctggccagtagaatggtggtgagcctccagccctctggctgatcatgacctgtttcagcagcttagcttcccttgttagaattcttcacagcataacatttcaagtttgatgaatcctaattaattttttcttttgttgtttttatttttagtgccatattttagaaactattgccctattcaaggtcgtaaggattatttatatgtgttttagattttgtgtatttagttcttgaatccattttgtttgtgtgtgcatgtgtccatgtgcatgacatttgggttgtaattgtatattggctgatataaattccttagttcacattttcctctttcattgaggctttcaagatactacctttatttttctttgtattgtgtgtgtgtattttgaaactctaattccatcatttctctcttccctttcctcccccaactcctcccatgtacccttattgctctcaaattcatggtctctttttctttaattgctgttacatgtatacatatatattcctaaatacataaatataatttgcctagccttttgaagaatttggttgtcatggagagctaggatagccccagggccatatggttccagaaagatgtgaaaattctgcagggttatgggaaggatctgatgaaaagggagttgctacagtctgctctgtcagctgaatcagggtgtgttctgctaaggctgtcatcagggttcttctcagcatcctcctgggagtaaatgaccctgctatctgggtgtttgtgttcagaggtagccagatgattcactgcttctggtcttttatgttttactctgaagcagtaatacaattgtatttatcatctgtttctgacatctcagtcaataccatattggttttagtctgttatttcttttaaagcttttttgtcccttttaatcaacattgctggcaaaagaaatgacatttaaataggataaatcttttctgcgaaggccagatagtaaatattttatactttgtatgctacgtgtgcatctctattgctgccacttcttttagcactaacaattcctcctttttgtggtaccagggttaggatctatcaatctctgttagtcaatcttccaggtaattttagtgcacactaagatttgagagtctcaactccaaggtgtgtgtgtttgtgtggaaatggtgagcttttgggtatgggcattttcaatattttggagtactttcatactgcttccaagctacttatatttcggtatattctagcagtgtattagggctccttttgtgccaaacatttgcctactcattaaagcaataaccactgttttgggtgtgaaatggttgggtttttatttgcatttcccaattactacttgatcatattcataggttacttgaattttggttttgggatacactagttagaaattttgccttttaaaaatactaacatgtaaataaataaaatatgttgaaataattactgaacaaacccagaatccccaaggaggaaggaattcagagtttttaaaaaaggaaattcaaggaagagcaccgacaatgatggtcagacaactcaggaaagctcaggtaaactgaggcaaggacattgaaataggaggagcagcatgaccagattagggaaaacaaggagttttatatggacgattagggtaagtagaggaggagaccagaaattaaaaaaaaaaatgtgtgtgtcatgtatttaatcattaatttatttattcactgttttgtgagacaggctttctcttactatcctggaactcagtttgaccatgttggtctttaactcacagagatcctcctgagtgctgggattaaaggcatatgccaccacacctgaatttaatatttcactaatagtgaaatgtttggattaatttggctcgggttttgctttgcttgttataaatatacattctcagtttttcccattttaaattatttaagacttattttatgtgtatgcatggatggttatgctacacatacatgccttggtgccagaagggggcgtttgttcctctggaactggagttacagctaggaatctaatgagggtcttttgcaagagcagccaaaggtattaactgctaaatgatcctgctgctattgtgggtcctgtcgtcattgctgctgctgctgctgctgctgctgccaccaccacctccactgctgctgccactgcctctgccaccgccaccacctccgctggggtgggggaagggggttgcttgaattatttccttgctgggctaaggcagactgacaggtggagtctggggcccgccagccagcctcgccagtctcgtgcaatccccaggtcccaaaaagaaacaaggtagcaaaaagaagcgggaaagcgcacaaacagctgaaggttggaggagactgggctctggcagagcaggacacataaaccgcggtaatttctgctgttcaggagccccttcttcgttcttccccgtccgcccccccattcttacgtttgtttgtttatttgtttatttgtttttttccattgttgtgagcgacggttaggggctgaaactcacgtctccagagaagggtaagacttgattttgatttctttctacctgctttctcccctcttccacaattcctttctgtcattttcccctcccagttgcgggtcttccgcattccccttggtggccactggttcatggtctcagcgcctgagtggtggtggagtaaaggcggcagcggacattttgtagatacgttcgcgcccttgccgagctctgcgcggcttttatagtcgagtccaaatgattacgtaacaggagctgcgcagcctggtgtgcggcttcttcccctctcctgcgccgatggtggtttgggaaatgtaaggtttctccctgcagaagaggcacacatactcatctcccaccctgcgaacttcacttgcagggttccaagacttcaatttggcttgtatttaagctagtttaatactatgtccaagccgggcgttggtggtgctcgcctttagtcccagcacttgggaggcagaggcaggaggatttctgagttctgaggccagcctggtctacaaagtgagctccatccaggacagccagggctacacagagaaaccctgtctcaaaaaacaaaacaaaacaaaaactatgtccaagaaaagtgcttggctgccgatagggaagaataactagttctatcttcatttttatttttaatttaattttgaatattttgtgagagtttcattttgtagcctttggctagccttaaatgcactatttataacaggctggccagggcagtggtggcccatgcctttatttccaggaggtagaggcaggaggatttctgagtttaaaaccagcctggtctacagagtgaattctaggacagccagggctacacagagaaaccctgtctcggaaaaccaaaaaaaaaaaaaaaaaaaaaaaaaaaaccaaacaaacaaacaaaaaaacaaacaaaaaaacccaacaacaacaaaaccaggctggccttgaaatcaagaacagtcttctttaccttcggagtgctggattaaaggcatgtagtactcttttttacttttgattttatgactggctagtcctgattggcctgaaactcctctttgtaaatcaatctggtctcaaactcatggagaaatgcctgcctgccctagcctcctaagtgctttggttaaaggcctgtacgttgtgtgtggccacaattccatattagaactgctgttccacaggctcaagtgaatctaaggggcagatgtattcttcggaaagtcagattcaaagacaaccttaaaagtttttgccttcccacaggggttgcatatatcagctaacctgaaaataagatatttagattacgattcataactagcaaaattagttataatatagcaatggaataattttatggttggaggtcatcacagcatgaggaaccctattaaagggtcatatcactaagaaggttgagaaccactgttctatcataaaacagaaaacaaagtaaatgttggaaaagaattaaataattcacttaattcaaaagaggtaataaagggggcacatcctgtaaaatgatgcctgaggttagcctctggtctttacatatgtacacatatatagaactctttaagccagatctaaagactagtaagaccagattaatatcttttttatagtttttgcttttttaaaggtttatttattatgtatacagccttctgcctgcatgtatgtgtacaggctagaagagggcaccagatctcattatagatggttatatgccaccatgtggttgctgggaattgaactctggacccctggaagaatagccagtactcttaatttctgagccatcactccagcccccaacatcttttttgtttgtttgttttttgttttgtttttgttttgttttgttttgttttcgagacagggtttctctgtgtagccctggctgtcctggaactcactctgtagaccagactggccttgaaccagctcccaatatcttaaaacattaatggtttccatacctgggttctatttttgtactgctgcagtgaattttttaatttattagatattttcttcatttacattttaaatgctatcccaaaagtcccctatcccccccccccgcctgctcccctacccacccactcccacttcttggccccagtgttcccctgtactggggcttataaagtttcctagaccaaggggcctctcttcccaatgatggccgactaggccatcttctgctacatatgcagctagagtcatgagctctgggggtactggttagttcatattgttgttccacctatagggttgcagaccccttcagctccttgggtgctttctctagctcctccattgggggccctgtgatccatccaatagctgactgtgaacaaccacttctgtatttgccaggccccagcatagcctcacatgagacagctatatcagggtcctttcagcaaaatcttgctgctgtatgctgcagtgaattttaaccttaagacttttttttttttttttttttggttttctgaaacagggcttctctgtgtagtcctggctgtcctggaactcactctgtagaccaggctggcctcgaactcagaaatctgcctctctctgcctcccgagtggtgggattaaaggcatgcgccaccattgcctggctaaccttaagaatgttaacttttagaaaatgttattttttatgtgtatgcgtgttttgtgtatgtatgtgactatgcaccacttgtgcagtgctggatgaagcccaaagagggcgtttgatctcctaaaactagaggtaaagaggatgctgagcatctatgtgggggctgggaactgaacccagctctgcggaaagagcaggcagtgttcttaatcactcaactatctctctagcccctgaacttgaaaaatttaacaaccttcaattatgtacatacatactatatttaaatttatccttcagaaaacgtctttccttgttgtcagttatgcttatttaattgtatagtaaattaatcatttcagtaatctttgtcagctgttatatccctttgcaaaaccctggtctctgaacttaaccctggaactttattccatcaattaggggtttccttgcagtacactttgaagttcttgggaagaaaatttaacccaacccatatttctttctgtccatttctgtcaaaaagtatagtgtactttaatgtatggccaaagtgaacatttcgagcagctcacttgatgctgcgcttcaggactttttctcataaaagcaagaagccagccaagtcttcttaccatcgagtcggccgagcacagaccgaacgactctgaactagagttaactctctagaaagcgttttctaacctaacttggacctttgtgatattctgaagctttcttggttttgtctttcacttttccttttctgttttggaaaaaaatatggtgttttttttcattattgttttttttttaaactaggactaaatcttgtttactgtataaaatcttttttttttgatactggttttcaagacaggatttttctgtgtagggctgttctgggactcactctgtagaccaggctagccttgaactttgtctctgcccgcctctccaagacctgagattaaagttgtacacaactatgcctgctataaaaccttaccctaaaatagtctttattttgtgtatgcatatgtgtatgcataggttatatgtgcacacatgtacatgtggaagccagaagatgagttactttaccgtatttttttgtgacatgatctttcactgaacttggagattgttatttcagctagactagtaagcaagcccctgaactttctctgtctcttgtctccagtgctgagattacagacttgcacagccgtacgtacctggcttttacataagggctggagatttcgagcacaagtcttcctggctgatgagcacgcatttcagctattcctcctcagcctcatttgtttttgagttggtttcttaagagcctggactgtgctaagtaggctagtggcctgcctatttctatctccttagcactgggattacaaatgtacaccatgggcctatctttacaaaccctttctgtgtttttgtttgttttccttggcaaaaatgcatggtcataactttcagatctgtttcttttccttacccgttcccttctatgttttctttctaaatttaacaaaatatttagtaatgaagatctaatcatgaaacagagcaacacaataagtttgtcagagtaccaaaaaggagttgaatacaaattatatttatgatatttatgatataatgaagattacttgtccacacattgttagaccacaggattcttacctggtacaagtcttagattttattgttacctgggttttaagtattaaaaaggttctttatacatttcttttaaaatttagtctcatgttagtttaagttatagaatgttaacatttcaggaatagttggccaaggtatgaaaacttcaaaatgacctctaatagggaaactatcttagtacaagcaagaaaggcagaaggaactgaagatagagtcaacagtctttctatgttaaccttgttatttcagtttgaaatataaaaggtttctggtcccctaaagtgctatgggacatgacctggggtttagagaaggagccagtggtgcagggacccagaattgctgttgcacctagcctgcttcacttttatttcaccacacagctatctaggagtagataacctgtagattagtgaagacgttaaggggagtcaagccttcacggcccctcgtttccttaacctgtgatagcccagtgtccattctgagcaagtctgtcttaagtagagtatagaagatcagagggagtgatagttgggttaattcgtggacaggcttggaggttatctccctcaggttctgggttccttggagggatttgtagtttttccaccattgtatattccatgtaactccagtggcctcctgtgaggactatagctagtgtcttaggattcagtttatagctcttacagaggccaaagttataccataaggttataagcttttgttcatgaagaagggaaggaaagtctgactggatacatggtcagtccgggaatggcttaaagataatctaacaactccatctacctatgtaaaatctcacaattttacaaaaaagccttggcgaatggctgagtgtttgacaattctcatgtcttcatcactagtcgaagaagtgaaataagaatgctggttagcggtagagaccacaaaggggtttgggttgtagataatggcagagataataggcaggaagactacaggctgtaagtgaatgattagaaggcggcagtatctgtggaagagactatgttttggatctgaagatctactgattaattaggcttaggctaaagcgcttgcttattattacttgagtttaggccctcccatctacataaaagccaggtataatgatacatgttaggaaaaccagaaatggggggaagataaccaagacatggatttcagcagctagatggctagtcagtctagatgaaaaggtgcactccaggacagttagagaccttactgtagaaagcgagagagagaagacatcacctgaggtcaggccctgactcattccacactcatacacacaaaaatggaattgatgtttaaatccatgctaacaaacaaggcaaaaataccctcagtgttactccagaatcacttttcctcaacaggtatctttaagatagtggtggcaggagagagtgaaagcctcggttggtccctgcactactcagatacagctgctttgaaaatgctgcagaaaggcaatttcaggacaagtcaggggtggatagcacggcttatagatttatagaccataaaatgttcataggggtgaggtgggcttttcacagctgcaaagatgttgtcagtctggagtagttttttcctgtttttttgtttgtttatatatactgttttattttttagtattggtgtgatagcaaaactagagatatgtacatatctcagaagtagcctaagagtataaataaaaacaaatctaaacaatgacaaacatactgggtgtgattaattctagcacttagtggtacaaaggcaagttgaacttacagaagaattaagctttctcttggcaatcaccacgttttaaagcatactacaggcactttttaaaaaataaacaaacaaacaaacatgctaatgctgtatttctttgcagtgtaaaaagtggatcaggcagctcatatgctaaaggatggcacggtcaagatccagatcccccaggtggaaacaaaggtgaggagtcccatgcttctcctagttagctcggatttagaaatcactgttactgctcaagcctccataagctcactggacctggctgctcatagtactcgattaatcatggtaatggtagtatttgtagatttgaggagctgataaatttgtttaattggggctagaattactttataataaaaaggaatgcagtgaccacatccagaatgagaaatgtctttgaggttacttttttaagctattaggaggtttacaacttttagtgtatgttttgtttaatttttttcaagaaatttaatcagaaaatgtttaatttttttcaagaaatttaatcagaaaataaagtatttcctagcttcttggcaaaaaatcagttttgaatagctcaattgtagttcaactctcatttgttttctttgctaggaggtatcagtactatagtttccataattagattagaatagttcaaccagtttattgtacattagatgcctcccagttctgggacaacaagagtgagtatcccatcttccatggccttagcaagcacacagactggctactctgatacagtggggaaagcgctgtgcttctgacaggggcaaagctctctgcatctctagggagagaattcattctgttttacaaccagtaaggttcagactgacataaaggactattattacatacaggaaagataaacgatggtttttatgttaatataacttgttccaataatagagtgaatcatcagtcagtaatttagttttcattttataaatgtcacaaaatcatgttcaatttgggagaagtttcaaaaagaaaagaaactgtaaagacaaaaagactatataacaaggaagataacacagagtgtgccttcttttagccttcttttagttttcttttttttccattttttattaggtatttagctcatttacattttatccttcttttagtatgactattagagtaatggcctcagagactctgccaatgcttagtgcctagttttctaattacttataggtttttggtttttttgttgttgttaagaactacaaagagtttggtactttgttcctacttagaagtcaatatactactttgctacaagacacttccatgttagagacattttctctaccttctaagaacccctgagggccagtgctctagagtggctctgggtagatgatgcaaatttgtcacaggttctggggttttgacacagctgaggaacttgagtcacttggagtaagcattatcttattattatgggcagcaaacaagtaagctctctctctctatccatgagggagacctgatctctgtttccaaggctgtttcctggggaaccaaagttgccagtgcccccactcataaggctagagaattatctcctaacctttaggagaattggaaatgctaataacctttataacaaatttttctggaagggagtactacataataagatataaaacaatgtcagcagttttaaatgtgaattaagggctaaagttagatcttgagtgtttcatcctgtctgggaaacttgtgcctctgactcccgggttctctgcttagcagtgaaaagagatgaaatcttcaggaattcctcagagacttgagttgtttcccccctgggatgagataaaccatgaagatggcagagtttctgcttctgataagtaatatttgccagtatgtctagcttggcaactctaggcgacaatattgccaaatccatgtaaatgtcctaatgggtactggagaagatagatgtgtttcctttttgtgtggaagacacacatttgtccttagaaaaaaagacttattcataattgaagcttcttagagcaggtaattttattttattttttcgagacagagtttctctgtatagccctggctgtcctggaactcactctgtagaccaggctgcccttgaactcagaaatccgcctgcctctgcctcccgagtgcagataaattttaaaatggccagggtattctttttttactgatttggagccattaagccctaaaggaggagatggaaaattggacaggtcacatgggggttcttactcagatgcaaaagtgagcttcttctttttctttttccctttgaggcagggtttcagtggctgacctggtatttagtatatagactacgctagattcaaactaagagatctgtctgcctgtgcctcacaagtaccaggaacaaaggtgcgagtcaccatagcccgccccttccttacttttaaggctgagtaactcagagagttttccatggatgtgggagtcttctcagtaggaatacaagtctacaatttggcgatattaagttacagaaacaatagatgcagaagagctatataatactgtcccctagagagcattatagttgcattaaaacatactttgactagagtcctaagttatttcaacagcacatatttcagttgatatgtaagggaggagattttggaaagaatagcagtttatgttagaagtatttatggagggataggcatagtagtgcacacttgtattcccagcattttattggtggaggcaaaaagattgtgttaagtataaggtcagacttgtcaacagatatattcccagacaaaccagtttgggttgtaaagtgggactctcttatttttcttagaaaaaaacccctgttgtatggaggcatagtatagaaattgatggcctatgtctctctcatttatttcttccctgcccatggtacctggtaagcgtctcctttggtaaagcctcgagggagagaacagtcagttggaagcactataaaaacatttttggagtttggattgtagcatcattgtcttaggatgtaatttcagaggtcatctttagttttcttcacactttcaacatatttttaaaatttatatatttacatcgattctgcccccctcacagagagcattctcccatcccctccccttgtgcatattttttctaactttactcatgcttgtttctcagttagctattgaacctgaggtgagcttttcttgattggcactttgaaggtactacatctccttttgctagaacttgctatcagtagtctttcaaaaacaaggttctgctttctacctggtctgctcctcctctaatatgatatgtatatttaacccattttgatgtgttcatagaatacatcagtaaggatgacaagagtatggttgtcaggtaggacaaaagaatcattaacccatctccctcacaccggtatacaattccaagtacatataaaacaaattcctagattaaccttgagtgggatagtagtagaattctagcaaagtattttaggtaggtcacactaaaacagttaattgtctcaaagtgaactaaacttctctctgcttgtttacataggtcattatcgccacaatctagaaattttgaataccatgaggaaagacatttccatgggcactatgaccctgaatatagacatgatcaacaaagaccctttacttggagaatggatgatgaaaaacatggacaaaataaaccaaggattccccctcgtgtgaattcgtatcatcggtcttatgtaaatagatcaccttctccaaatgtaaaacctgttgaaaaatttgatacatataagcctcaccaagaatattttcctggcagaggagatgatgacagacgatctcagtatatgcccacatacacagaaagtgcagcaacctacatggagcacgaaagggattgttatatccctacagtgcaaggaaggtatactcctgatgatcacagaggtagaggtagaggaagtgggagaggagagaagccacctcagatgtcactggggaagccacctaagatgtcactggggaagccacctcagatgtcactggcagattccttgagatttaaagagaaatggcatgaagatgaattgagacaccagagggtacaagaagaaagctaccctcagtcacccagaagaggctcagaagactttggcacaaggaacccttttcaaaagaggtacaggaaatcattaagtctggggaatttggcataaagcctccagtaataaagttacttttacgttgaatatcataattttttatctcaaaagataaaataatttatattttgagtaatttatgtggatagctagaatgtagttttgtttgtttgtttggttggttggttgttttttgagagggggtttttcctgtatagccctggctgtcctggaactcactctgtagaccaggctggccttgaacttagaaatatgtttgcctctgcctctggagtgctgggattaaaggtgtgctccagaatgtttttaaaagatgttgcttttaaatttccatgcccctcttaatgagttcacatgaggtggtcttgccgttgcatgatgtattttaaggccagtctgcccattattctagacatcaaaagttttacttctgtatattgcaaatgtaaacttcttttttaataaacaaagtttaatcatatttattaataacaagactttttttttaaatgtaagtataaattcaacttccatcatttcagttaacttcaaattattctttccaaattaaaacaatataccaaacaggacaagtgatatatttaaatccaagacttctattaagttataaatgagtaaatcatgaaataaaaaaaattttttttgtggtttttcgagacagggtttctctatagccctggctgtcctggaactcactttgtagaccaggttggcctcgaactcagaaatccacctgcctctgcctcccaagtgctgggattaaaggcgtgcgctaccacgcccggctacatggggtcttttatggtacaaactctgccacataagcttctttatgtcattacaggtatcccgaggatcatgatttcagaaagtatggctacacatcaaaaagacctacagatgcagcaaggtatgaaaatagagatccagccagaatcccaaagtggaagcctgagcattcttttctacctttccaagagaagaaagaagagtggagctttggagcccaaggtcacagatatactgagagagagtacccagagagaagctcgacaaccagagtatcctacgactaccgtcacaaacatcataagctctcagagagcgagcaggactttcctgatggcagatttcacaagcacttaaaggaagaagacagaaaatacagttctataaaagctcctgcaaatagagagttagattgtttcagtactacaagaggaagagaaattgagaatgagcaaatcaatggacctttttatctctacaacaaaaactctgtttcctataatcatacaaatataaaggatgctgatttggagccttgcaatgacaaatggaagaaaaaaattagtaaagaagattgcagaaaagagaatgcatcttttagtaaacagtttgatacaagcccaaaacctgaagagaaatgctattcacttatcaagaagaaaccactttctgtcaaagtagacagaaacaagacagacacatttaggtattagctttttaagaaatattaatagatttttacaccttaatttgcagcttccaagatgaagtttatattattggctagagtatattacatgttcaaaagattaccaataatttcttccaaagtcctggaatgaagataaattatgaagttagtaataggtggtgatcttgtgtcttctggttcccatatcttatctccaagtaattcttgggtatgggcatttcaaggaattggtaatctttaagaagttatatgtttttatactgccaggtttttgtttgtctttttaaatccagggatatactaaggagaattcagcttttgttgtttttttggtgttttgttttgtttcgttttgagatagggtctcactatgtagctctggctgtcccctatgtagaccaggctggcctcaaactcacaaagatccatctgctgctgcctcctgagtgctgggattagaggcatgagacactcaccaggccagcatctattttttatgcagcttctcaggctgtcctttgctgcttttgacattcatagactcttttagcaggaagagatcttagcaggttcttattctgtagagaaaagttaggtttgagaaacgaatagagctcaaatcctcatgccttcttggggtcccaggagacatgatttgatgtaatccctactgtgatttcagcatgactttagtttgactagattattcttcaagatagaaggaatgagactgtagtgtttctgtatttggctgatggaagaatgctagtgcacatgtgccatggcaggtatgtagcggtcagaggacctcttttgggggacaattttaggagttgttttctttccttccaccatgggttctaggaaccagacttgcattgcaggttctttcttgtacctgctaaactgtcttgctgttccacagttaatttctaaatagatttagtttcaaaacattattctaagcttctcattgcttttggtgagaattttttttaaagatttatttatttatttcatttatatgagtacactgtagctgattttagacacaccagaagaggctatcagatcccatttacagatggttgtgagccaccatgtggttgctgggaattgaactcaggtcctctggaagagcagtcagtgctcttaaccactgagccatctctccagcccttggtgaaaattttaatagttaaaattttaggtttcgtaatagcttttaaagtatggtggtatttcagagtggctgattaaaacgttttgacaataataaagtagaaaatagtctgattatttttttatattaggtgactttaatgccttatgtgtttgaaggtaaaattcacttagaattgtaattattgttatttgaaaagagctcagaaccatttatctatacttattttccatttgtggtttattagttttataacatgtaattttagtgcctaaattatggcagaataattaaatctttttaatatttagctatcttagcattaacaaattccttccttggcaaaatagcaaaaattacaaatttaattaaatatttgaaattattttaggtctacttctagatattctgcagagagacagatatcacatgatttggttgctattggcaaaacaagtgacaattttcatccagtatttcaacatcttgactcgactcagaatcctgaaaataaacctactgaagaatttgctcaggaaatcataacactaatccacaaagttaaaggttggtatgttttacacaaacattaagtatagcacaaaaataatgtaccaacttttcccaagatacaagtacctttaatgtagcttaattgtaattaatattccattttaagtaggtcataaattaggaaatctgttggagagagtaccagacattcactcaagactagtttttctttttatgtattttcaataacttcctgcttttaaatgctagtagattacaaaaaattagtcagaaaatgatcagactactccaaatgacagacattaaaaagcctaataaaggaggaagaagcaacaaaaacaggtatacgtcctagacactgcagaagtctaggttattttgtgacattagcaacacttccccaaggcctttctaggactttatgctataagcttgttcatgtataatcagttgatgattccattctttatgaaatcaaaaagctaaaggagggctttaaagagttgtattgcttctcataagtgtccattggaaaatcagtgatgtaaaacaactcttcctagtagtactgcataaattattataagcaagagattcttaagaatgtcaaatttttatttgctttaatttttaccttaataaaacatttttgattttttgagacagggtttctctgtatagtcatagctattgtgcaacttcctctgtagaacaggctggcttggaactcagaacgtagagatctgcctacctctgcctcctaagttctggaattaaaggtatgcatcaccaccacctgactatgaaacatatttttaaaataatgatttgggctgaagagatggctcagcagttaagagtactggccctagattccgttcccagtacctccatggctgcttacagacttctgtagctccagctctagaccgcttttggacactttgggcacaagtcacacacttagtgcacacacaaaacacttatgcacataagtaacatacattgaaaaataattactttctctcctatcccttaagtgaagggaaccaggtagatgggagctaaaggtttagttcaatattaaagctcttttccaagaatgggtaaggccctgagtttgatcccctaaaccttaattttgaatatgaaaaaatacagtttgtcagaaaccgtttaccctctcaactctacctctttttatccaaagagtatagttttcagaaagtatggtggtagtacagaaaaacaagagagtgtcccaaaatgggactagtgaaataggagagaagattgcttgtataacattttgatgtattctttctgtactactattaagagcttgtagcatagctgattttagaatgtctttatgagctgaagttaatgcaaaaatgacgtggtgttggaatgtactctgtggtatttaagcataacttaattcaacattcattcagagattagtgtgattaaattgttaattgatttaattttcactgttgaactatagagtatcttccaaacttcctagagtatggccttaccatgaagaagaatgattctcactttaacaatttcttctagataagaaagcaaatgtggcagataggaagaaaatccttgaattcataagtcaactcttgtttgggtttggggaggcatgtgagcattataagttaatatacaaagagtgtgggccatatttcttttcaaaggagaacagtttggattattttgatggtcccttcttgatgttgagttttatagaatcttttaagggcattcagtttcacattgacatggaactatttgtttccttttttagcagatagttttgtaacacctgatattactctaaatgaacgtttctcaagaataaaaaacagacaggatgcagatttcaatcaaacgaaatcaaattcagatccagaatttcacaggtaatgattaattactgtcttttcacttacctcagaagaatagtccagctttctgagctcgctttccttctgagcttggtatagaacctagaagtgcactttgtacgtaccaaaagcagtctgagcagctgctggacccatacacagtgctaacttaccactgtttgaaaagaaagattcacttgctctcattctgctatgtctgtagtagctgtctactgaagggaatgctggaaaaggtcagccattgaaatcagggcttactttaagtggtcacaaatgattgttctgaggtctgatgaaaacatgcatgccttctgtcggtacttgtctgagcagagggtgcaccctgtatgcagtactgagatgaatcaatgttataattttatccatcaccaaaattgagtttgaggtcacactagtgattggagaaccaccaagacttccctacaatacacccatagggtatgtatggcttagtagactgccatgtaggtgaaagcctatcatggcgtggtggcacacggcattagtcccagcacttgggaaacaggcaggcagatacctgaatttaagggagtgagtttcaaaacagccagggctacattagaaagaccctatcttaaaagacaaaagaaatgaaaagctacctgacagcaggttgttttggctttttctaagacctactggtttatttctaattctatcctgtagtaaaagaatcagtgtataacacaattagcataattatttaattatgtgcctttattattttaggcgaatagatatgtctttggatgattttcagaataaatatacgatggtatatgaaccagataaggtaagtgagtacaattattattgctatagtagtgggaaaggagttaaaggtctataaagaaaggatgacattcaggaatataaattgaaaaagttctccaagtgactgatggcagtccaggatggagtgagatgctgaaaaggacaaactttttctttgggaggcatggttagtaagcataacaactttgaaaagttgatttaaaattacattgaatactcatccccaaacttctcagagtaaagcttatagaaaatatggttgatagccagccattttgcaaatctggcatgtgggatatacttttaattgtatgtggaagcaatgcaaaggaactgtggcatttggtgctgcctatctgtttgctgtagaatttaggaaagattctgtggaataaaaactagcaaaataatgaagctaatactaaatttttttcattatcattatatatgttttctacccaatacttcccctcccactctctatttctttcctgactagaaagacttctatgactgatcaggttagaaaacaagtctttaaaagcatgtcaacttctaaatgtatcattaatttttcctttgagaatttttctgtagtgaagagattttaatttatttctgatagactatataaataatttttatttatgaaataaagattcgataaatataggtagcttagtttattgaataatgcttttgtaacatttctagttatagttgatctccaggaaatttgaagacttaaaaaaattcataatcccagtttggcatggtacattttaacagtctttcagatgcaattcagtataccaataatccatagcatttcttttatgtaaaagttctaaattctccccatggtcctttataattgatgtttttaagttttaaaatttttagtaaatgtttttctatattgacttcataatttattaatttttatggctgtatagttttgtttgacttatttgccataacatcctgcatcattcttttttccccttaaattattttcacatttaagttgtttcattttttgttattttcagtatttttaaagaggcaactttttgggataaaatcttggaagtaggattcttggattagtataagagcttttctgattctgaaccatggtggcccacacccttaaccctatagttgggaggcagaagctgacaaatttctgtggttcaagactagcctggtctacatagttatggccagggtagccaaagctacacatagaaaaaccctgtctccaaaaacaaacaaaatagaacttcagttgtgtctcaaaatacttttatcagtttatactaccattagctgcatgggtataaaataattaaggactttaagtttctttttagaaattgtctttgtgctactaacaataatgtgaataatttgtcttctgtcaaaattcctcagactctggtcaaagtaatagaaccaaatgatctacgacatgacattgagagaaggagaaaagagcgattacagaatgaagatgagaatatttttcacatggctagtcctacagagaggtaatcagtaaatgaaaaacatcctgctatctgggagcttttggttttaggagcttttacattttttgtgcttaatttttgcccgattgttcgatctgttttgtgtgtttttaaaatgtttcagttattcagtggtcattacaggaagcttgttctacacattaaaaatggagtgggtgaatatttgaggtcttttaattctagaagtgaagaatatccaactgtttgactattagcaggagctatgaccagcaacccttatgggctatttgaatccagcagtttgaaacgaataggtttagacccttagattctgacttaggagtacaacattttttgatgtcagtacagttctctttgggaattcttgggtctatgaagtagacagttgcagt

SEQ ID NO: 629 - DNA, 604646 bp, mus musculus
ttttttgcacaaccgcgaccagccttagagcgcggcggcggcggccagggcaacatcagcacagccatcagcggtgcagacgcccggcacccggccgcgcggcgagctccggctcagcctggagttcacctcccagtgcccaggaggcttgtcttatcccttctgatctctctgtgtctctcttcctgtgtgcctctctccgtgtctctttctctctgtttctgcctgtctctctgtctctttctctctctttgtctctttgtctctgtctctctctctgtctctctctgtctctctctctgtctctgtctctctgtctctctctgtctctctctctctctctcacacacacacacacacactcattcactcactcacttccatacacacatacacattatcttgaagaagaaaaaaaccgacccccaagcaaataccctcctgggcagcgatcactggcacaacagtagccaggttcggttcctgcccagaagcgaccgcgggctgagagctccgccactgccagctggaggagagcgatgcgggggcccgagcggcagctcgaacagtaatgtggatttacagtcatttcccgcaggaaccagcaaagacgccctaagtccagcgcacttacagcacaccagcagagctgagtacctggcaaggaggcgggggaccgcacctgaggacatcactgaaacttgcgcctggactaggtaggtccgcttcttctggcttacttccttcccgcttgatcctgcctgccttccgccccaaggactctgggcgaacttcccccctaggatgtgatagaatgcatttgcggattgtgactcctgatcttgaaaagctggttgcgcccgctctgggactcctggtggaggaaacagagcctctgcaaccttttctctgggtctccttctgcccccagggatctggacctctcaggagagatgggagattggccttgttgttagtttaggcttccagcgggcactagggacactgtcctttgaaggtttcgtgggtttcccaggtggcacttttaccatccaactccttcagtactgtaagagggctgttcgcctccgctttcgcgcagaccaaagcactctaacaagtggaccaagatgtttggagtggcaggtggggaggctgtaccccccaaaagaaggagatgatcacctccttcattacttccacctggagcatccaccaaggttctgccactcggggtcacctactactctctctgaaagaagatgcccaagggctagaacatactgtagaacctgtttgcttccgaattgctattccaccctcacttggggagttccagctctaggagaatgccaggaccctcactgaggccccacccaatgtgttatccaatctcccaatctgtgtcaaaggaaataatcctaacggggcactgggtgcttcagtagccatcggcgttggctttaaccatacgctcatctgtgcgggattgtgtgtttctgcatttcatcctgaaaacctggtgtctagaattcagcaatagccagtacatctgccgagagccaagcacccgctaggcatgcctggggaaatgtaacctcagcttctcccattccgggaacaggcggattgccaattcagttttaagatgctttgcctagaggtgtggaaagaaccttagcgctacttggtgagcggatgtgctagaaaccagtagcctatttaaacatttcagcaaaccgggtgcagctgattgtttacaattgcagagacagccgatctcactccactagtggatgtcctgtccatgtctgtttcgccactggcagaataggggcgggggccagagctggcttgcagctagtacttgcatttggcagcattgggtttagcagatctgcatcactgctgctggagacatgctaatatggttcaaaaaaaaaaaaaaaaaaactctacttgagtacaaagcaattggtcaggatttgtctcaaacttctcagttttttctgagcacactaacctagtcgtatatttatagtggtccaaagaaacaggaagagaagttccctgtgccacaggagagaaattaaatgtcatttgaatgaagacaccaaaagcaaaggatgtgccccagagaactttaataggtatccttagatgagcatttaattgatcatatttccggtaaggattacaggcagcttccttgaattggagattgttgttttataattataattagcaagccaggtacactgcactgtaagcatcaattgctactttagtctgttccgtgaagacattgcaaatgtctgctctattgtacctttggttgaaaaaaaaatcctatataccttcatcctctgaaatcttctgacctgtagcagagggcacgggaatagtgtcaaatgatagcacaacctaaaagggtttgaaagctcatttttaatgaaaagactgtccacggctttaacttcttctcagtaattatcctgcacttgtttacttgcttacccctgccatgtattctatgtatctcccaatgtgtgtgtatgaggggatgaatttgcataaggcttcatatggctcttaaaagtagataccagaatagcaaaacccaagttttgacatttttatccaaatttgaaagacttttaaaatgatatgttgaataatttactattgcaaagttcttaaagggtagtcaaagattttcaggtatgctaaaataaggttgcaaacttttgatgctaataaaataaagccataaagtgcatttgcaaagtggttcaggtattttctaaaatgagcccatgctctagatattaattaaaactttacaggttgttcatcataattttctaaaaaaaaaaatcaggtgtttctgctaaacaactatataaatgaatactcaacataatacatttgataatgacaataataaaatttgctttctagaacaataacagaaatttaggggaaacacgggattaaatgatatggtgtttacaattagagcaaggactcaattatagagtaagaatagatagacatagcagttgataaattagagagaaagcttaaaggaaaacattgttttgtagaatcatggtgctgtgatgatggctaactgaacatccaaatattcaaacatattagtgtactgaaaaggtaaatcatagtgtatggaattatcaactacctcaaggccctgcttcaaagtttgaatgtcctaaaggtctcagtgattgagttctgctatcatatgtttaagtaacattgacatgatcatagcttcccttatcattgtacctttctcctgcctttatacagattcttgctgaaagagaacaacatagccgtcacattcattctgtatgatactatttttgatgatcaaactgaaaattactatttgatgttacttttgaaaacaaaaacaatgggattttattttctatgacagttttagaaacttaaaagcggtgagaaattttagtgacaactaacataaaaaaatgtttttgattttatgctggagataggctttcagaattcatgcaatgttcgcctgaagctcccagttcctgaaagcccatcagtttccgatttaagtaaagctcttaactcttcagtatacattttgattgatcatttccctaaggtttgcaaaaatatgttaatttattagttatgaatatatttacttatgaatgacttgaggtcaagataacattggtactttgagtacctgattcaaagatatttttaattgaaatatttttatcatattagtcatacttgttacatcctcatacccacccccccccccccacacacacacacacacacatacactttcttggaaggaatcgtccaagatttcttagctatttctattcattggcttattttatttacattacatgtatataattcttaattttctgaattttaaagccaaatgtaatgatttgtgaatattttacaaagcttccacatcacttatcatttggtaacaattctgagttgggttataagcacaactacaggtagataaaatgataaaagctattgccatatgactaccagcatatatccataacttcaaatgtgagtgctataatgaaaattaaacaaatttacatttcagaattgttccacataaacaataactgatttcaatcacctgcagactactaggttagatccttctttttaatggaggttgagcttatgttttcgtcctttaagaaatgaaacaaccttcttacgggatataatgcttagctattgttaataaataaaattaaggcctgaatcacctggcttaagtttatttatatttcttttagtttttttttgtttgtttttctgtttttgttcctgatgattgctgttaatgcagagaacagtaaatactaactagcaccatgtgcagttagagcaggtgaatgttataaaaggttttacccagcttttgattattgtgaacaatcttgatggttcaaccatagctgtctcctcagtatcagtgttcaattatgtagcttatagtaatattgtagtttgctacatgtggtttagtatgattaagcaaatccaaagatattgtttaaatagaaaactcatagaaaataggactgaataaatttaaatataatggtatgaactgaaaatcattgtaaaacatacatgttcatttatctgctaatatttgcattaataattcaaccaactcattttatttagtcatagcaaaaaattacagttgatgaggatcactgatattttaaaaatagtaacattaataaaaatttaaaactataaaattcatatgtaactttaattcttatttctagacctgaaagtataatcttggataatttataactttaaaaatattctgaattatatttcctgcccaagcacctacttttggtaaacaatagcatatggtaaaatgtgtgtatatgccaaatagccactacctcctggatgatgtttttaaagtgatgtaatgattctgaaatattaggcttttctctcctaccctaatctaactgtaagaatgaagagttaactagaaaatcaagacatcaatatgtattaagaaactgttatcagattagtggatcatttttttgaatttgtttcttaggagccttcttatttgtgtttctcagaggtctgtaacatgattaatatgctttctgggtatttatgattgtatctgagactctatgattataccttggtaagacccaaatgtctgcatgcaacagccaactgtttgggacaattcagactaacctctgattgatcaagaaaatgttttcctcagggtctgagtgttttggaatcatttaacaggacgatgaccactgatatctttgcaggaaaagaaaacatgcaaaacaaaaaatggcgtcctagagccttctctgaattatataagatgctactggcatcccccaactaatacaaaaccaaaagcatactgactggtctttgctagaacagagaaaatgcaacaatttaactttaatctgtaattcttatacatcaccctccaccccgtgatttatcagtttagaaattaaattaatgggattgatatgttagcttcttatgattttctatatctcatttcccaacagtccttctactgccatggaaactagatggcacagacagcggagagtcactcattcagaacaggagcctcctttttaatttcatgtcagcctgttggtccctgaaagtaactgaaaaggttggaacaatgaatttgtcagaaatatattattaagcggagcaaaatttctgccaattttttcttaggattttatttgtaaacctcttctgtttctactcatcaagcagttctttcaaagtagtcatagaaatagaggtttgatttgactattcttgttggtatttatgtagtctacaactcatttttgttctaatagagcattcacagctttaaaatagtttcgtaataatgattacattggaaaatatgttctttcaaattttgagtctgtagactttgaagaaccctacttagttatcacagtaaaactaaatacaagtggtacttgaattttccagtactatgggttattttccctttttaaatagaaaagcagttctgttaaaatatctatgtcccacttttttttttattagagaccacatgtatttgaatgcatttatttggaatttgtagaattattgtactcatccctataaagcatgcagattgttttaattttaatcaactaagttgtcatttgataagtagtcaacaatgaggaaattgccttttaatgtttctcatattttgttctaacatttttgtggctgattaaaacttataaaattgaattttagaatcacagtctctaatatgagctgaactgaatctcatgctgtcttttgcaatgccagctatacgttctgagaatctaatgggttttcttgcaaattattgtttcaaacttttttttaatattatagctaagaaaaagcaattccttagtgaagattttttgtaatgaaaaaaggcatatttgtttgtcatataaagatcagaaggtctttaatgttttaaatgaatacacacacacacacacacacacacacacacatatatatatatatatatatatatatatatatatatatactagacagaattatgagtgatagaatagggtaattatttaaaattttagaaaaaacagttgtttacagttttgtataataggaaatattgagaatattagtatcctgtggctggattttgaaatgcatatattttattagctgttttgttgctattttcttatttgagctaaagctatataatgacaaaaccaaaaactaggtcactcatcactgctgcacatgtagagtacctaatacttgaatcatctctatcactttgatttttttaaactttatgcaaatacttgacagtttaggggaataatgaaatagtatattaactatttggctcaaactatctgataaatcacattttgttgtatagccaaatgctcaagtttggagaaatgatagccttcatttctcgtttcaaagtataatatacttactattcaattgttttcctatttagatgaaatatattatcaatattgagtgtgctgatgcagatagagtcactctcagtagaattcaaatatggctatattaaagaaactcccattttcacttttttgggaaatagtttagtgtttttagctgcctatatgaatgagggtttgtatattggccaaaataaaagtaaattactctccatttgcatacttaagggaaaaatcttattactggctaaggtcacagagaaaatttcccagttgcatggtttttgtctaattggtggattctaagtacaactattacctctaatgtttctatctggtttagacacctgtcaaagagaaggtgccagattaaatggacaattggtttattagatatcaccacccctgcatcccagctgcatgtagacatttaaagaaaattcttccatttttcagctaaaatagaaaaaaatactacagatggcccatctcaataatccacattttttcaggtacatttaaaattaaatgtcctaagagatgattaattcaggaaagttattgataatgaactcatcttatgctacacatcctttgcacccatgatgatgccttattaaaggtgtctcaatcttgctaattaccacctgtgtttaaatatagaggtgtataaatacactacaactgcacagtggctggaagcattctaaacctgaaattttggctctattcctagctaacttagttcctatcaacaaaatgtttctgatcaagattttcaatttatagtctgcacattatgtcccttacttttaatgttagtgatttccttttctaaagctgctttgcttaattgcaaacatttgagagatattgatgtgtgatctcctgctttattaagtagccccaaaatataaatgtgtttgcttgtgtgtgtttgtgtttgtgtttgtgtgtgtgtgtgtgtgtgtgtgtgttcataagattgctttctctggggaatatttattaaaagtatatatatacatttcacatcaatttcacaaacattgtgtacagacacataacaatctcctctgttgctactatatactataaaggactatgcttctttgactgagcctccactacatctataaagctttaagcagcataagacaatttaggtagaatttctaggcaagtcaaacaaagaaaattattttgagaagatagttttaattttactaatgagatctagttacctttaagaaaaagggctatgcaattgagtaggaggtgtaacaacatacacattttctggatttgaattcttttcatgttacatttttttatatttatgtgtgtgcacatgtagaaatatacatatgctatttgtaaaggtcagaagacaaagtaaagaagtaagaattctattctacttgcaccatgtgggtattgaaaattggactcaggccactgggcaggatcacaagtgcctttcctcctgagacatcttgccagccctggatttatattctttattgaaggctttactttgagtatacttcttaaaatatttcatatttttgaatttctgatggttagtatgagaaaatcacatcatgtaggtgtaacaccatttaaatttggattggaatccaagaagtgttaacaccagcatgctactttttaattatcatcattttgtcctggtctcctatttaagatttaacaacttgtgaaagtgagataatttcaatgtaaacaattagaatccagtacaagggaaatattttaatggttaacttatcacaacaaaaggaattttcacaatgtaggttttgaatatggaatacaacatagttaggcaaatgtataaaatatgagagaatacttgtcccacagattcagtaaaatacttagtgggacttggctgctaaaggcacagagcaatataattactatttacagaatttaggaataattggttttatatttccattcatttcctctaaaggagctttagttgtcatgtggtgaccccttcttttaacaaaagcttcagttttacataaattttgtcatataccaaagaacactcttcatgaataaagcttttcatgtgataatttttaatgtacttgataaacttttacacatgcctctatttagctaactgtacaaacttattcaaaagacttacctatttttgaagacaaacatatataggtctaatatgatcatgtaaggaattctctaaaagcaataaccagaatattgtgaaaactcaaacatgataaagctttataaaggatagactgcttaaattaattctttttttagatttgtaaagtctctctcgctcttctctctctctctcctgttctcaatctcgctctcgctctgtgtgtgtgtgtgtgtgtgtgtgtgtgtgtgtgtatgtgtgtgtgtgtgtgtgtgtgtgtgtgtgtgtgtgtgtgtgtgtgtgaaatgtgtattcaggagcccatggaggcccccaaagagtgtcagataccctgaaaccattacaagtatttttgaggtgcctgatatggatgctaataactaaaattgaatcctctagaggagtaatatacgttcataatggccaagccatttttcctgtatccttaaattaattcttactgagtacccctggatattttagttagacctgtgcttctcaaccttcctattgctgaaacattttagtacagtcagttccttatgttatggtgacccccaaacataaaattattttgttgctacttcatatctttaatattgctactgttatgaattttaatgtacatatctgatatacaggatatttgatatataactcagaaaggggtaataatgcacatgttgagaaccactgatagagactagaaagactcccatcctgcatggtataagggctatgaaagggcacaggctaagctagatacagagcatacctactcaggataaaagtactttctatctaggtttgaagaacaagatcaaacataatttctcatttggtattcctgcatgtgcctagtactggtgtttagtacttacatacagaatggatcaacttatttgtatggagtgttattctagaaaaagtaattttcctgatgcttatttaaaaaaaacaaacaaacaggaaagttgctatatttaaaagcagaaattatctatattgttgaattggtggaaggttttaagatagcattggggtgaccacttatactaatttactctcttaccgtgattaataaaatgaccaaaagcaaatcaggaaggaaaggttctattttaacttacagattatattaatcgttgagggaagtcaggacaatagctggaggcaagaatcaggagataggaacagactcaaaagccagagaggaaggctttttactgagttgcaccctaagacatgcttatttagcctcatcatacaacccaagctaggtgccacgcatagtgggctgggccttcctagaccaattagaaatcaagaaaatgccacatagacatggccacaagctaacctgattaaagcattcccagagttgagttgtttcttcctaggagtgtgattcttttaaaaaggtaattcctatatggaggataggttaaactggattaagagtgagatatgtgaagagactatactgcaagtgtaaaagtttctcaggatgtggaccaaaacgtgacagtgacaatgaagagaagagaatatggaacctactgtaaaactcattatgcaatataaggactgcaaaagaaaaaaaaatgtttgagtgggcaatgaggtgaggtttggatttatttaatgggcaatagcacaaagacatccagacagaattagattttagattatttaaattgaattatcagttctgaaggtagatatttgggtaccatcagcaaacacagtcattaaacttccaagaatgagtacttaggatcccctacagactgtagagaaaataggaagggaacagtttcagaaatattgcactaaggatgttagaaacccaagaggaagtattccatgggaagttatgatataagccaggaggaaaacaaaacaatgaaataaaaataaaatctaagtgcacaaggttttgtacatgccactaggtaaagggcatgaaaaatataatgcatgagagaaaacacaaatgcaaattgttctttttaaagtcaaattttgccgggctgtggtggcgcatgcctttaatcctagcacttgggaggcagagccaggcagatttctgagttcgaggccagcctgttctacaaagtgagttccaggacagccagggctatacaaagaaatcctgtatcaaaaaaagcaagcaagcaaacaaacaaaggacaaatttcagtaatcaaaagaaattctattatatatctgtgaaatttcagatgtgaaaagtgaataacttcttatgatgtgtatagatatgcatgtatacttgcaatatagaaacaatacagaaaactatatatgtgagaaatttattaataagataatacagttgtgcaaggccgaattcttaagagtcattcctcgggcatggtggtgcacacctttaatcccagcacttgggaggcagaggcaggtgaatttctgagttcaaggccagcctagtctacagagtgagttccaggacagccaaggctacacagagaaaccctgtcttgaaaaaaacaaaaaacaaaaacaaaaaacaaacaaacaaacaaacaaaaccccaaacaacaacagcaacaacaaaagtgtcattcctgccaggtaaaacctataatcaaatcaattaacaaatggctaactcatttgattctacctgcaaactctagtgtttaaaaatgagtcattttttcccctgctaatcattaacactctcaaccaagccattgttttttaattaggactgggttatagtattcacaaagattcatccatcgattgttgtccctctatgattttcgacaccacagccagtatgatttttaaatttcattaagctctgtgtttttatctcttctttacttcaatcttcatcctacaatctacaatcaaacataccacttataagatacaatttaaatatttaagaaaaaatatcaaggccttcattattttgctatcagactatgtactgtatttcctatccaaacttgctcaaaaccttctatacactttgtcttctgctttgtttctgaaacataccatgaatggtttgtcactcaggaactttaggcatgcattttcttctcttagtttgaaatatttttccatattcctactggttgtatttctcattttattcatacatttaaattattatcctttcatcataactgtatcctctcccttttgcattgatttgtgttatacttcttcattttctctcccattctctacctctattttctttcttattagttagaactacttggaatcttactgtggtttagtttgtttataatttatcaactcctctagcatacgggatccatggggccatgagctacttgcctttttatttaccactacatccatccatataaaatagaatagtgccctacatgtaggaagtgcttaggaaatatcactttaataagagataataaagacctgatggaacactaattggtagagatttgacagttttctgcaaaataattaagaattttgtacacagcaactatggtggtagattaccagtggaacatttgtctagcatatgtagaccctgtgttgtagtaccacaaaaacaatattgttatcacttgtcccaggaactttacttctgagaatctgtcctaatgtaagataaaattcatttgcaaagtttttttttcacagaacatattttgtaatggtagaatacatgttcaacaaaggaattgctaaatgattatctgttgagaaaatacaatattttatgtgtactaaagatgatgtttacaaatattctatgtaaaaggaaaatgtgcatattatattgccaagtaacatagtcagataagtaaatgtttgtgccccatatacatgtagggaaaaagataaaaaatggatgcacaaaattattaaaaacaaaaagactgttttgggaggaagtagataggaggcagcatttaattttttctttcctctgctttatatagtaatagactatataacttcaattatcagattatatgtacaagagaaagactaaatacaatgcacaaataattactggtgcattgcagtaaagtttacatggtagcttagtataaacctttctccttgggcggtatagctatagcagtggttctcagccttcctaatgtcgtaacccttagtacagttcctcatgttgtggtgactcccaactataaaattattttgtccctactttataactattttttgctactattatgaatcattgtgtaaatatctgaaatgcaggatataagatgtgcgacccctaaagagagaaccaatgaggtagaggtaaacaaatcaggtagaaatgttctctggaagttttgtttaaagaggtccacaggcaagggtaataattgaaagccactaatgcaatttagtcttcatttactagagaaccagagagagctgagtgtattctgccagtatttgaacaggatgttaggggaagattaggcaagctaagccttctacatattgctgtgaaaagcactagcaatttgcttcatgtaaagcagaagtgattactcactatatttcttcatgtcgtgtagtaataacaattaagagaagttagactacagattacttgacaagtcagccacagtcacctctaatggaaaagaagaaaaatagcattgacaacttttggcaagtctcatcattagaaatgcccatattgccagaaagaaaagaagctgcatccaataatgtaaaccaaaagttctttaggccctgaggaaagaagtgacaatccgaagtagagaggcattaattgtcgaggagcacagatcattgtaatggggaaactgtctctgttattaacacaattattttctacaaggtccttgagtaaaggttcctttggaaaaatcgcatccgagttttcaaagcatgggaagcaacaccgaaagatatcgtcattagtaaaatcaagtatactgatttgtacgctacctaagggccttgtaaataggaactgtgttcatataccacctacagctaaaatttatcaagaaattgaataattaaatgacaattttcttaaattagtagaagttattcttttcaaatccattgaagatagcaattccatatacacacatgtatattttatatatgtatatccataaattgatatattaacattttgaatgagatttttaaagtcttatctgcacaccttcaattcactaattacgtctccatttatggatggcaattatttagagatactaagcacctcctttgtgaagacagtagaatattattcttttcataggatcaaacaagaggtcatagaatctgaagtctggactagatagtctcttaatgagctgtctagatttggatttataacttggctgtcaagatgtagcccatttctaaatcataagtcagttctgtgggctgtctttctaatgtttatggcttctgctattttgcatctggtatacattatttgcttcattccagtgccaatactctcaaatattctaacttctttttgttaagtggtggttagcacacataaagtcattgaacaatttcttccatttagaattgaactcttgggtgagatagagatttgtaaaaacgaagggatgtggaacatgttggcaacttgtaagcaatggcatggaacctggggtatctgacatagatcaacctatacactggccttctataatcttaaatggggtgattcgcttctaaatgctgaagcaggaaagcaattctgaagtgagcagagaagagctatatctttttaaagccagttttcttctcatttctctgtgtacctcaccaagccaaaatgctacatataggacagtttattttttcaagtacattttttttgctagctttcttgcacaatcagccttatgggtatgaagccaatttctacagaattactctggtatgttcagcagaagagacaggaataattttgtagtctagatgtcagtacgtactgaagtatcttcccttgaaagattctaacttagcactattatggaaccacttcaacacttgagcagaactatgccttttttttgagcagcattaacaatgataaaaaatgcacatagagcaattagattgcaactaatcaagagcacttcttcagtttactatgaatgatttatacatagtacattgggcatggaaatcattagtaataatatcatactctattatcattacaaggtcatcttagtgatttttttccaaaggtgacaatgttgtttgcctacattcttttttatttctttgtttgtttggttttggtttttcaggacagagtttctctgtgttgccctggcggtcctagaactcactctgtacaccaggctggcctcaaactcagaaatctgcctatctctgcctcccaagtgctgggattaaaggcatgcaccaccattgcccggcggcctacattctttaaaagtgtatttaaatattgtcttttatcttgatatactcatagcatttttgaaagatgtgttctcatgtttgagaatttccaaatataaaataagtagatttgagaattagttgattgataaattggtgtcacaagattaactaatgtcaatcataaaatatcaaaatgttaaagtttaaagttgacattttctttttcttatgctttgatttacaatactaccttttctacaatggaaattttaaggaattaaaatatatctactaatacaaggtaatacattcattaaagaaatgttagataatggaaatatacacaaaagagaatcatgtattttgaatacagttttctatactgatcacattttaaattactttattacatgcattgtatttaccagtattttgataataatttctaagttaataaaaaaatatatatggagagaaaagcagtaaaaaaataatagcccaaaagagatctaacacacttcatcgaatggccccactacatcaggctgcagtggcaaagagccaccctctataagtgcctcaaagtccctcctgccattaccgagttcacccaggccctggacaggtaaacaactactcagctgattaagcttgcccacaagtacagtccagaaacaaagcaagagaagaaacaaaggctactggcacatgctgagaagaaagctgctggcaaaggctacgtcccaactaagagaccacctgtcctcggaactgaagtcaatacagtctccaccttgatggagaacaagaaggctcagctggagtgattgcccatgatgcagacctcactgagcttgtgattttcctgccttccctgtgtcaaaagacagggatgccctactgcatcatcaagggaaaggccaggctgggaagcctggtgtacagtaagatatgcaccattgttgtcttcacacaggttagctcggaagataagggtgctctggttaagctggtgggagctattagaaccaattataatgacagctctgaggagatctgccactactggggatgcaacatcctgggtcctaagccctgcctcacattgccaagctggaaaaggcaaaggctaaaggactcaccactaaactgggttaaatacacagtgctaagttttctgtacataaatataattatatatgtaggaaaagatcaaataaactgcatatcttaaaggattaacatctactgatatgctgctctccaaaaatgtatccatatgcattgcttatgagggtggggtgttgtaaagttcatatgttaactatcattagattacatattgaataaattatgccacagcaaaatatgtatctttcaagtagagcatattagtgtggccccttttatgatagtaaacctttggtccaagtgctaagttgttgatatgtgttaaaaatattttaccttcatttttataagtgctgtataaagatagcatgtgagtcattgaatcaaagaataaagcaaaaagaaaaagacacacatcttgatgctagctctgccatgtaccatttatattattcagtgcagtaatgctagctattgaagatctatgaaccctagttttccaaacttaaaacaattactaggagaaatagattaagtctgtataagaaggttttcagtaagtacaagtaactattatactttaagcaattattgttagcatagacttcatgttgttaatgacattgtgatatcatatcatctcaaaaggtttagtataaattaaatgaggttgtatggggagtagacataaattccatactattctatgtatatacactgaaattaaaatactctttagcctagaatgtgacttagtggtagagtgcttgcctacattcctaagaagaaaagttccataccatgtacagcaaaacattaaaacaaaactccttctattagcagtgcagttaatataatggaagtttaaagcatacctttagtcaagaaacacaattctcatgtgaattagaaaataagctaccctagagatggaacaacattatgaactaaccagtaccccggagctcttgactctagctgcatatgtatcaaaagatggcctagtcggccatcactggaaagagaggcccattggacttgcaaactttatatgccccagtacaggggaacaccagagccaaaaagtgggagtcggtggataggggagttgggggagggtatgggggacttttgggatagcattggaaatgtaaatgaggaaaatacctaataaaaatattaaaaaaaaagaaaataagttacagtgtatatatagtcccattatatagagtgtatgtatagtcagtccctctcagtatgtatgtgtgtgtgtatgtatatttccctcatggaggaaatgcactggacctgtttgtacatctatatgaaagataatttggtctaatttttttacaggaattacaagagcgacttttattctgtgtaacttctcttctggatctaacaaggtatgtttaatctatgctgaatcttttaatataatagtatgtattattgagttgattttagctgaaatgcatagtttaatttttggaatttatttttctattttatatataaaatgtttatagaatctattattatgagagagtatttgcaaaaccaaatgttcaaactgtctgaaaagtttgaattattaattctgcaacattttctatacatagtaactaaccttaggagtttctataactagtgatatcctctgtagagtgagtaggaatagcagttaccaataacgaaatttgcaaaattatttaatagttctcgtggactataataaaatgacacttttccctatcaatggaacaaatatttctatttagaagatccagaacaaaatttgcctccagaaatgtatgtcatgattctttaagaagtagcaagtgaaatatttagatttgcatcttttgtttaacattccatttttcttcttttcttctacccatctatccaaccacatatttgtccaatgaacattcactaagaaaccatcaaaaatcactgcaccctttcttctgataaataactaatgtagctatagttcaattagagtatcgattaagtgcttttagagtcagtcctctggtggaatatatacaaaaatgtggcaagatttgtaacataccttacagttattaattttattaaaacattagtcattattaagttcttagtaactagggaagagatagtattgctcttttaaactttggtccctatctgtgatagtgctatacaccattaatcaaatattaattctcattccaagtggaaacaatgaaaggatgatctgaatttgaagtaaggtgttaagtctttgacatcacatagtacttttaaagtaaactatataaatatataagtatagaaaaaaagaaacagaaatccctcaaatcttaggatttgtatgcagtttgaaaaatatactaaatgtaaaaatattctaaatatataattagttagagctcaactagttataattattctaaacatgaacttaaaatatattagccaattgttaccatattaaacataacttcatttaccattcatctagatgtattatctttaggagaataataatatgacaaagtttagataattctacaacaaaaattataatcagataaccaaatgacaaaattaaaagaaaatttccttagagaactattcaagattttcacatattatgtcatttgtgaatttggaagttgtctatgtgccctaatatcattgcatgctattaacatatctttcatactaagaaagctttatagttaatgtaaagtaatatagtataattaaggcgaaacatccctggaaaaacttgaaagatgcacacttacaaaaagatattggcactgattacatagttcagagaacgtctaggtttgcttctttagtgagaaagcatgccatggcagaaggcctgaactctattgctactcttctattaacaatacatttctgcttaggtcatttctctttagtttcctcatctatgctaaaacattgtgatgaataataatgtttctccctggtcaaaaatcctgtagtttaaaatcgataggtagttgttagggcttgaaacatggataccttagtaagtttcttctatcttaatcatgaggacctgaggttaatcttctaaactcacttttcaaaaacaatgtacattgtattactttggaacatacctggggctggcacatagaatctaactgaatgagtaagatctatacaggttcagcgagtgatcctgtcgaaaaaaataaggttcaaagtgattgaggaagtgtgatggtttgaatgacctatggtctccatagggtcatatatttgaatgtttagttcctagttggtagaaccatttataaaggattaggaggtatagccttgtgggaggaggaatgtcactaggattgggctttgaggtttcagaagatctctgttttagctctcttgctctgactcatgcttgtctgtttgcctgctgccatgctccctgccttgctgatcaaggactcaaggacccacccacagaaaccatgagaccttacaataaaagctttgttctataagttgctgtggtcatggtgttttatcatagcaatacaaaatagtcactaagacaggaagacagctacccttgacctctggtttccataggtacatacaagcacatgcacccacgaatacattcccctaacacccccctctcacaaaccaggattcttctcaggtatgtgtatgagtcagtattggttgttaggttggaaaatatacacacaaatcagctgtccaaagatttcctgttaagtggttaaaatgaattagtaataaaatacttgtttctctttgaaacaaagtagctatgtattcttaaatgattagcacccacttacctctctccataacaatacttgtactggcattatattaattagactgaagtctaagtttaactactagtttcaaagtttttttttcccccttggtaaaaaggtttaaattagtggtggcatattcccatgctggttctctttgtgtctcttaaaagtttagcaagctctatgtttcttgccttttgcttaggtggtcattcaaggtcaagcatctctctgtaccttgaaagcagccaagtgcataacccgatgacttcaaactccaatgctttcaatctggcacctttcatgagcttgtgttcatattaaagcattcaaaatatattctccttcatctacatatcacagcaataacatcctgggccggacagtgcctgggagcaaataaccacttggagttaatgatctgaggggcagctgaaggaccattgactcttcctagtcttttcttcatcccaataaaatgtctattcctgaagtgccaagccttcaataattttccatcacacatcagattaagtagtggctataaataatagtatttaatacataataatgagatgtggcgatgcagtaaaataccaacaattcaagtgctatataaagatggctattctgatcaaacccaaaaagcagcagtaaatgaagttctcgaatcgtaatgttttagaagtgactttcatcttattgatttgaaatgaaatataagtaaaaattcatgtggtataagggaatagtttactttcttttgtcccatattccattgatgaatgattcagtttaaaaataattttataatgcctctgacatatccttttaaatggattttaagtagtataagttcatctccatatttagaattagattcatgcttttgaaatatatatagctgtgaactaagtaacaaatgctagtatacgatggttcccaaacgaactttcacttactttatttattacagtgacacccattaagtttccacaatggggcatggtactaagttctagtgaaataagaatcagcaaggggcaggttctacagtcagaaccacatgatatgtagttgagggctgaaattatgcatttatgtaccaggtaatcagtgttgttagtatgtattacataaatacatttgttttggacattattcttccaagtgaaaaggattcatacatcaaattcctacttggtaaagcaataatatatatgattgcaaataactccacattcaaaaaggaatcacaccttatgtgaggcataattccctgtacaagctcatcttttaatctgtagaatttgtaacaatgtcatgccatatgtatgaaagaattaagaattagaggtgctaatcagatggccttaaataacagaggaatatctgtatagaatcaatgaagttataaggtccttaaaagtagaagaaggtgacagaacagagctgcagaaagcatgaaaacaacctaacatggtattggcagctttaagatagaggaagggaccatgaaatatggataacctctggatgctaaaaaaggcaaggattcacattatatgtaccctggtgcctcatttgaaaaattcacccttctatcatcctaaatttatcctatcaagaactgtttaagatttcttttttgttaatttatttttttatcctttaatccttttttacagtacagacttcatacccctccctgtgtgcctcctgaccactcaccattccatacctcctctctatccatctgactccaagagggcaaccttcctcatcgcctcccccaacccatcacaagggcgccccattccttggggctcaagtctcttgagggttaggtgcatcttctctcactgaggccagaccaggcagttctctattgtatatttgttgggggcctcatatcagctggtttatgctgcttggttggtggttcagtatctgagagatctccaggggccaggtcatttgagattacgggtcttaatatagagccaactcctcctcagcttcttccatctttcccccaattcaaacacaaggtcctggcttccatccctttcttgggtgctagtatctgcatctgactctttcagctggttggggcagccatgctaggcttctgtctgaaagcacatcacagcatcagtaacagtgtcagagccccaggcctccctctgagctggatcccaatttgggcctgtcactggacctcctttttctcatgctcttctccatttttttttcctgcagttccttcagacaggaacatttctgagtcagagcttttgacagtgggatggcaaccccatcacttcacttgatgtcctgtcccttcactggaggtgaactctacaagttcctgctccccactataaggcatttcatctaaggtccctctctttgagttctgagagtctcacacctcccaggtctctggtacattctagagggtccccccagcccccacctcctgaggttgcctgtttccattctttctgctggccttcagggcttcagtcctgttccccctaatccctgatcatgttcttcctttctcttcctttcttctctcccgcacaggtccctccctccctccctctgtcctccttgactgctttcttcttccttccaagtgagattgaggaatccttacttgggtcatttggcttgttaaccttcttgagtcctgtgggttgtttcctgggtattctgtgcttttttggctaataaccacttattagtgagtacataccatgcctatccttttgggtctgaattacctcactcaggatgatcttttctagttctatccattcccctgcaaaactcatgatgtccgcattctttttttaaatatttttaatatttctattaggtattttcctcatttacatttccaatggtatcccaaaagtccccgataccctccccccaccccactcccctacccacccactcccactttttggccctggcgttcccctgtactggggcatataaagtttgcatgtccaatgggcctctctttccagtgatggccgactaggccatcttttgatgcatatgcagctagagtcaagagctccagggtactggtaagttcataatgttgttccaactatagggttgcagatccctttagctccttggatactttctcaagctccttcattggggccctgtgatgcatccaatagctgactgtgagcatccactactgtgtttgctaggcatagtctcacaagagacagctataccaggatcctttcagcaaaatcttgctagtgtatgcaatggtgtcagcgtttggaggctgattatggcatggatccttggatatggtagtctctagatggtccatcctttcgtcacagctccaaactttgtctctgtaactccttccatgggtgttttgttcccaattctaagaaggggcaaagtgtccacactttggtcttcgttcttcttgagtttcatgtgtttcacaaattgtatcttatatcttgggtattctaagtttctgggttaatatccacttatcagtgagtacatatcatttgagttcttttgtgattgggttacctcactcaggatgatgccctccaggtccatccatttgcctaggaatttcataaattcattctttttaatagctgagtagtactccattgtgtaaatgtaccacatttttttgtatccattcctctgttgaggggcatctgggctctttccagctattataaataaggctgttatgaacatagtggagcatgtgtctttcttactagttggaacatcttctgggtatatgcccaggagaggtatagcaggatcctccagtagtactatgtccaattttctgaggaaccgccagactgatttccagagtggttgtagaagcttgcaatcccaccaacagtggaggagtattcctctttctccacatcctcaccagcatctgctgtcacctgaatttttgatcttagccattctgactgctgtgagatggattctcagggttgttttgatttgcatttccctgatgattaaggatgctgaacattttttgaggtgcttctcagccattcggtattcctcaggtgagaattctttgtttagctctgagccccatttttaatggggttatttgattttctggagtccaccttcttgacttctttatatatattggatattagtcccctatctgatttaggataggtaaagatcctttcccaatctgttggtggcctttttgtcttattgacggtgtcttttgccttacagaagctttgcagttttatgaggtcccatttgtcaattctcgatcttacagcacaacccattgctgttctattcaggaatttttcccctgtgcccatatctttgaggcttttacccactttctcctctataagtttcagtgtttctggttttatgtggacttccttgatccacttagatttgatcttagtacaaggagataggaatggatcaattcgcattcttctacatggtaacctccagttgtgccagcaccatttgttgaaaatgctgtcttttttccactggatggttttagctcccttgtccaagatcaagtgaccataggtgtgtgggttcatttctgggtcttcaattctattccattggtctacttgtctgtcgctataccagtaccatgcaatttttatcacaattgctctgtagtacagctttaggtcaggcatggtgattccatcagaggttcttttatccttgagaagagtttttgctatcctaggttttttgttattccagatgaatttgcaggtttctctttttttttaaaaaattaggtattttcctcatttacatttccaatgctttcccaaaagtcccccataaccaaccacccccactcctctacccacccactccccccttttggccctggcattcccctttactggggcatataaagtttgcaagtccaattggcctctctttccagtgatggccaactaggccatcttttgatacatatgcagctagagacaagagctcaggggtactggttagttcatattgttgttccacctatagggttgcagttcgctttagatccttgggtactttctctagctcctccattggggaccctgtgatccatccaatagctgactgtgagcatccacttctgtgtttgctaggacaaacaagagacagctatatctgggtcctttcagcaaaatcttgctagtgtatgcaatggtgtcagcgtttggaagctgattatgggatggatccctggatatggcaatcacaagatggtccatcctttcatcacagctcctaattttgtctctgtacctccttccatgggtgttttgttcccaattctaagaaggggcaaagtgtccacactttggtcttcgttcttcttgagtttcatgtgtttagcaaattgtatcttatatcttgggtatcctaagctttctgtcccaactggtaagaaggacacatgctccactatgttcatagcagccttatttataatagccagaagctggaaagaacccagatgcccctcaacagaggaacggatacagaaaatgtggtacatttacgcaatggagtactactcagctattaaaaagaatgaatttatgaaattcctaggcaaatggatggacctggagggcatcatcctgagtgaggtaatccaatcacaaaggaactcacacgacatgtactcactgataagtggatattagcccagaaacttaggttgttctttctaattcgttgaagaattgagttggaattttgatggggattgcatttaatgtgtagatgtcctcattcttaatagctaagtaatatttcatagtttaaatgaatcacatattttgtatccattcttcaattgtggaacatctggtttgtttccagcttccagctatcacaaatatggctgctgtgaatacactggaacatgttgcccctgttacccatggtgtggcatcttttggtcatatgcccaagagtggtatagctgggttttcagatagatctatttccagttgtctgaggatcctccagattgatttccagggtggttgtaccagtttccagttccagcagcaatgaaagagagttcctctttctccacatcctctccaacatatgttgtcacttgtagttttgatcttagccattctgactggtgtgaggtggaatctcaaggttgttttgatttgcattttcctgatgactaaggatgttgaacatttctttgcgtactttcagcccttccagattcctctgttgtgaattctcttagttttataccctacttcttgattgggttgtttggttttaaaaacaatttggtattggtacagagacagagaggttgatcaatggaatagaattgaaaatccagaaataaaaccacacagagaaacttcatctttgacagacaagccaaaaatatacaatggaaagaagaaagcatcttcaataaatgatactggtataactggcaatctctatgttgaaaaataagaataaatacatatctgtcaccttgcatgaagttctagtctatgtggatcaaggacctcaaaataaaaccagatatactaaatctaatagaagagaaagtgggaaagaacctggaactcatttgcacagggagaaattccctaaacagagctccaatggctcaggctctaagataaaaaattgataaatgggacctcataaaactggaaatcttctgtaaggcaaaggactcagttaataggacaaaccagcaacctacagattgagaaaatattttcactatcctcacatctgatagagggctaatatccaaaatataaaaagaacttatttaagactcctgacttattcgactctaagagaattctgtgttgtttcatatcataatatcctcactaatttatcagagtgaagtccttgagaaaacatggaagtgtctagttgtaatccaaacataattactaatagacatggctcatgttacttctgagatatttcatccagtgatcatctccaaacccccagatatcctttaggacattccttctgagaaggaatttgttaggtctttggaaacccattctcattttcagggagaatttggacctttccccattccattttctgtaagctaggtgttaaactaatgaccttcaaatagcatcttgttttcactagggatcttacagatatcagttgaaacaatataacttagataattcaatcatgttttatgaaaatgcaccagctacctatttttgtcccatattcattcgcatatctgcatatgtatttgaattctggatgcattttaaaggacacagctgactagatcttccttggaatagaaatgatagcaactatatcattcagtcttttcaaaataagctattagaagtcacagaagttcccattgtccttaagtttatctaattctgtaacttcctttgttaaaaaacactgtgattgatgctataatatttttactcagcttaccacaacatcctgtaggatctgtcattgtgtcattcgttctaatttgtaccaaaattatagttttaatcataagtgtgcatgaagttaatgctcattttactgctgacagtcctttgaggaggtggaagacagcgctgaaaggagatcctttggtaatcctaagaaaggctgattttctgttaagtacatttttgtaagtcatttttgtcatttcgtaaacatgaaatgattattccttcagacagatgaaatattcattaagaagagaagtgaggaaatcacagtactattaaagaatagcaaatgagtgggatggctgtcaagcatcccctgacctgaggaaaaagaaatcagagtgccatagagagggaccatagaatgaaaacttttttaaaggttatttccataaagtctgtagaaatcttggcttccattaagatttttgtccctgagagcctaaactgtaagtatggtatgtgctttgtctgcagaataaaaaagaagatcttcacttaatcattatcctgggagctgaacagcctgctaaatttgaataaaaatgcctccttcattactgatgggaacacagagttccatgtatcagtgatttatggagagcttactaacagggctaacttataaatgaatggtcagtttaaagaataatacaatttgttaatgtgtctagcatcaactgagatacattatgcttccaaattcaaagggaaaaaatgctaccaagtgaacactgccagtgaaaatttttactttgctttccatatagagtgagggatcatagccaaccatctctttgtaaagttcatttctctgtttcatctcggtccttctgagatggcctccttccactttatatagtttaacaccttattagtaccttcccaaagcttgacgtttttctttgcttgtagcattgccagtgtattttgttttcgttgttgattgagtttattcttcctgtaagaagaaccaagttacttcgaaagcaagctttttggtacatcttttcttctaggagagtttttctctctttgggaagttgttgtgtatattttatcagaatgactatcatatacttgccttttatgaaaagaaaagggaactggagagatagttcagcaattaggagaacttgttcttccagaggtcccaggttgggttgcaaacattcaaatggtagcttacaaccacttgtagctctagctcttcgggcctctgagggcactgtacacatatggtgcacattcaagcttacaaacactcatacaaaggaaaaggaataaatgaataaatctgtaacaaaaaggacaggaacaaaactgacgcacttatactgctttagatggacaatcagaacattttatccaacaagatcagataaaaagcttcatagaagtagtaaccatatgtattttatctttaatgactagcaagtgcctagaacagcatctcacacttgtagatatttagcaaacacgcgtttaatgctttaatgaatgaatctcagaaacagaactgttctaacccaacagaggggaataaaagtctcctcttgacttgccttattcacttcaatatattacactgtacctaacatgctgagattttcccacatagtcatatatttaaggtaataattgaatatctcagtgcaatttatgcccatgctaaattatacttcttgtgggacagcatggcaggattctactcagggtactacaaattatattgatagggtgaaatgtgttttcatgtctgtttgtaaaatgtggaatattattgaattactttaaatgtcatgtttgagatgagctcaggctggtttctttgggcttgacacatttcagtctgtcatcttgtccttagagatgctgaaaattaaatggggatctttaaataatttaccttataagtttgcttatagctatgtgttttgtcaagccagatgtcagtaccctcagatgctgcttgaacataaattaaagttggtgctgcatatcaaagaacagcatgcaaaaaaagaaagaaaccactgtaatctgtgctaggaaggatgttttcttctttaaactgttagataatgtggaggagaaaaaaaggctaatcattcataaaagaatattgcttaaatatcatgggaaatcctgttccctgtatatataatgacgtaactcatatgtctggaactggaagtctataatagatatcatcttattctagttccacgcctttctatccttagaagacatttttttcctattctttttcaaatgcaatagacctagtgtaggttttatgattatagcatcaacacttccagtttatggttaaaaaaaaatggtctagacgatgttttaacagggcgttttattctagtgagaaattatgcatctgagctcatcttccctgacataaatggaaaacaaacaacagccttctatgtaatttaagcaaggttgtgggagatgacttaaaatgatagaaacaaagcagattcgttcccagcactgcacacatccacagtgggacagtcagctgctatgtctgggtttgtttctcaaagaaggtgaaaaatttaggatgaatcatctctcaatttccttgcatgcccagagttctttgagaagtagtagagtcttaccaacctctatctgaactctttgttttattaaattctgcctatgtgttaaggcccataacagatttacaatgatcctaattcttccatgattttcttaattttcctaaagtatatacataatcaggaaggcatattttccatgtttatgtcatcttgcttatccaatttttatctagttatctgatgtattttttcatattaaaattgtctccccaaatatattgcacaagactttttttttttgagacaaggtttctctgtggagccctggttgctggctgtcctggaactcactctgaagatcaggctggcctcgaactcagaaatccgcctgtctctgcctcccaagtgctgggactaaaggcgtgtgccaccaccgccctggctcatgagacttttatatacagcattatgcctaataccaattcctgcatggaatctgggacattatgaggtatgacaaaatttgtcaagtattttagatgagattctaatcacttagcattaggagaccaactgacttggtagctaaaagtataaaggcctgtgtatccatttatatggacttctacaaacaaaattactcattctctcgtggcttataaaaaaaaagaagagaaaatttaattcttacagttctggttgctaggaggtggtccatgatgatggtgctaacaaatttgattcatgtcctaactggccatctgcttcacagacaacagcttctcactattcttcatataatgtcaagggtgaaaggtctctctgaggccttagtttaagggcatttattcaattcaggagagcaaatccttatggtatagtcagtttccaaagaccgttttcctgatatccaccctggagtttaggatttaagcatattaaatcagtgggcctaggaagggacaaacacttagattctatcacttcctctgaaaatcattgccctagactcctacattgaaaggatattataattaattcgatctttcatggctacaaagatctatctggatatagcatttttgagaaataagtccttcttttttcaggaaggttattatttctgtcatttttcttttctggaattctgacatcaaaaataccttagttatgatttcttttactatgaaataatagtatgaccaaaagcaacttcatgaggagagggtttaagtggcttatacttccatattgcagtccatatttgaagaaagtcaggacaggaattgaagcagaggccatcactgaattctgctaacaggcttgctcccagaggcttgttcctgctttcttatacacccaggaccaccttctcatgggtggcagcatcttccattgcctgccctctcacagagatcatcgattaagaaaacacctcccaggcttgcctgcaggccaagctgacagagatatcttctcaactgtgattcactgttcttagaaaactcaagctggtgtcagattgaaaaacaacaagaaaaacagcaaaccaactgactaatgaagtccactcagcttcaagaaaggccatattatgacctactgtgatagccactctagtgagcatgaggacagttagtgtgcatagagtgtcttagttagggttttactactgtgaacagacaccatgaccaaggcaagtcttataaaaaacaaacaaacaaacaaacaaacaaacaacatttaattggggctggcttacaggttcagagattcagtccattatcatcaaggtaggagcatggcagtatccaagcaggcagagctgagagttctaggtcttcatccaaaggctgcctggtcttctactagccattggagaaggtatagcctcagctgcagttgatggcccaagactgaaggggtcatgcaacgaatttgaggcttggcaccatgaagagagcctatgagaggctattggtgaagcctagttggagtggaacaccccagtatattggagatgtcagtaccatgggatgattaccaagaacagcagccttagtggagtggattaatctgagcttagagtgctacagagggcagagctggagtagtgatgccagcccttaggaggagtccaaaagatcaagtggaatcctagacactgaaacaagaagctgtaacattgaaattgcctttgagactcaaagatgttaaagatgccagagccatgggatacatgttgaggaaagctgctaacagggagtggagcaaacccaggagaaagcagtttgttgcagtcaacaaagatgaaaaagtagtggagatctgaagactgctttgacatcatctatggagatgcagagtttagagtttgcccagctggtttcctgccttgctttggggattacagttaattatttggatgaatctcagaagagaccttgaactttggacttttaacattgctgagactgctatagactatgaggactttgaaagttggactaaatgcattttgcattatgctatgtttaagtatggcccccatagactcatgtttttgaataagtctatgagggccagggagtggaatgtgatggtttgtatattttcagaccagggagtggcaccatctggaggtgtggcctggttggaataggtgtatcactgtgggtgtgggcttaagaccagctccagctaaccagcatcaattgtcccagtagttccttccattcttaactctacagccagagccacatggctgaatctgtcgagttctgctgcttgcaggaattagaacatgacccacttgtactattacattgtcactggctttctgttttacaaatccttcactacttaagcttggctatcctgggtcttgctctgtagattggccttgaacgcagagatcaacatgcctgactcctgggattaaaggtgtgaatcaccatgcctggatctaaatttagctgggtaggatcttgccctgaggtcccactcttttaatctgttatcttctagaatataggattttgctccatttcacttcctggtacccctttaatactcgaaccatatattttatattttccctttctaagcttgctatgcttgttcaaacttctcttcataagacttaaccagagaacaaagtctctgctgagcttttttgaaactttctttgtcagtgcaattaatctgagtctcttcaccttagcctcaggcagacttttcaggcaagggcaaaaagtagccacattcttcaccaaaataccacaaaaacagtctttatgccacattctgaaattcttctcctttgaaatctcttgggccaggtcaacacagttcaaattactcccagcaacaaagttttccatattcctactaggatgacccattgaatcccatttaaagcattccactgctttcaaattccaaagtcccaaaatccacagtctttcaaataaaagcatggtcaggcctatcacagcaataccccagtccctggtaccaacttctgtcttagtgttttactgctgtgaacagacaccatgaccaaggcaagtcttataaaaacaaacaaacaaacaaacaaaataaaaccatttaattggggctggtttacaggttcagaggttcagtccattatcatcaagataggagcatggcagtatccaagcaggcatggcgcaggcagagctgagagttctatatctgctagtagaggactgacttccaggcaactaggatgagagtcttaaacccacacccacagtgacacacctattccaaccaggccagatgttgccactccctggtctgagaatatacaaaccattacatagagtatactccatgtgtttgcagtgaagaagatgggacataaaacaagcacacaaaataatttctatattatagtgtaatgaaatcatattaaaagtatatatgagctgaactgcaatcagagacaagtgggcttctggctttcttttggtttatatattagaaagtacatccaaaatgttacaatgatttgagctttagaaaatgttagaacatggactttaggagatggaacaaagtacattcaaggctgaatgattcgaataaggaaaatcataaagacacacaactgatatgtctgcctgaccacctggttttgttagattagagaaacggttggaaaaacattttagaagatatgcgtcaaatgacaagacttttcctgacttattattcacctttcaggttcatttaattccctcacaggaatagattctaaaatgaggaagaccatggttttgaacagaagcgtagctcttcaaagaattgtattttaggtaagcaaattaagatgggctgtggatgtatgcgtttgagataagaccaaagctgtttaaaaaacatctgagggtcagatataaacgagatatcccagttcgtttaaaagcaaagccaaagcctgactgtgaaccaaattaagaaagaggaaaataactctgatttatgccagccatgtgttggccactatagccagtttgttagtcagttctttgtaattggatttctgaattatttgttcttcctacattattgccatctttaggaggaatgtggtcatttttcagcttcctgcattgataagtaggtatacaactcccactgtttttcatgtgtgtctaatttttgccactctgctgaaaaatatgtgacaaatcagaagtcggtatattgcattttacatccttagtaggaaacagtttcagcaggaggtacagtataatacagaatactcaagtagaagcaattcatttaagcctgcaagcattcctgtggtacagtggtccaagcactagccacagatagaggggcaaaagatgcagcttttccctcacgtacttactcttaaggatgaccggaacacatacatgttgtattcattttctctggctaaagaaggaactcatgatctaaacgactgataatgaaaccaatttattatttcacaaattttgcaagtcaaatgtatggacgtgacttaaactgtttttcttctcagagtctcacaaggctgtagtgcaatgttggcccggcttattttcttttgaaggttgagtagggaacaatctacatccagttcttgcagaacaaatttcttcataaatgcaagtacatagcagtgtatttcttctgatcaaggaatagaaaggatctgcagtgattctcctatctaacatcagtgatgacctagacaccctttgaaaggactttttggattatactaggcttaacccagtataaatgatcttttgatgaagccaaagtctactaattggggacttaattactcctgaaatattactttgcctttgccatattctgttttctacaaatatttcacaacatcaacacatattcaaacaaaggacattaatacaagggcatgacttactatcattcttttgctgtcacatcccatacaacgtacaaaccatgaaaataaaaatccccctgtatgactggatttttaatcacagtggaaattatgtgtaataactgaggaaacacaaagcaaaagtatatgtggggatgacttacttattcaggaaatgcttaaaacaaatctatccatgtatcctttgatccgatgctaacctctatggctgaagcaagtgccacataccaagtggcttagatacatctttacagcattccaagatttcagaactctaaaatatgttcctgtctagaaaaaaaaaagcaaagaaaaagaaaaaagtaaagaaattctacaaaattagatgacaacaaacatatttctttatagctacagattccacatatttagttgtgtaagtaaagcttgcttttatgtgacagacgtttccatcagagatgcaatggacttgtttattcacttgagaaagggaaccctaactagaccaaagcaacagctgtgcagatgtacattcgggatcactgagggattttgtttgtttggttggttggttggatttggtgttttgttttgttttgttttgttttgttttgttttgttttgttttgtttcagtgggttggtttgtttgttttgctcattggacttattaacttgtggctgaggggttacatacaaggagatgttccttataactaaaattggttgcatcaccaaaaaagcctaccattacactgatgtggacttctgtaaacctgaaaccctggagtttttccctggagcattcaggcatcttgctatctggatatctctttctctgcagtttggctgctcagaatctgtgaccctacgcttctgtttcctcttttttataatgtggagtgggagccttcaagaatgttccagttgtattctccaggatgtgtaacctttgtttacctcctgaggtcgaagagcctcctctttccttcctagagctaatgtttcaatttggaggaaatgttgcaattcaggggaaatgttacaattcagataaaatgtcttagaaggacatacaaaaaccacaccaacagaagtaatgaaagtgtacttgaatgggtagaataagcttaacatatgtcccttgacaccaaattgtgattgatttattggcttctctatttactttgtgtggaacacagaaaattacaatgttcaaaccttggatttggaaatcttgctctctggtgtattcaggtaatgagcatgaatggggagcaaagcgacttctcagtacattccttgtagtcacagattgctgaaatttggtttgaacttttttcttctattatggtgctattgaatcagagaaccaagccaatcacacctacagagcaacatttagcactcccattttacaaaattgcttatatagatctggataagtagaatggtgaacaacatgaccttaaatataggtcctatactccaaacgcagactttctttcagtgtgtttatgagttaatgaggaagtgtgacagaagagcaatcgatacagaaaacaatagcatccaacctctttagttcttcattataataaaaggtcctgtgtttggtgcgctccctttgcattgttcattttaagctccaaatagtggatgattgtagactcaaagtatttatactgcaaagattaaaaaaatacatgatattgtttctaaaaggtattgttaaattccaatagaaagacaacttaagtaggttctctttgccccattagtgaattgatccccttactcagagtggaattttgcaagcatccttttcctacagtaattgtaatgatgtgagcatttgacctctgggaatgaaaaagcaatcgcaaaatcatttcatataggttattgcacaacagacaggatattacatttctaggcaatgttgaccatttgttcaaagctactttggaatgttctctgtctattcaatttcaccagagatttctgttatttttttttttttttctactcaggctactttgggctaaaggttaggataggtttttttttgtttgtttgtttttgttgttttgttttagattttgtctttgtttttattcttaatgactgtttagtcaccccaagttgctctattttttttttaataaaatgtgttgggcatcagttccaaaaaggaacagatattgccactccaagttgtttgcaaatctcccctgaagtgaaaacagtggtgttacttcagtctgcaaagctttatccctcagctgatagttatggtgatgtcattatgtcaatatgaagaagatgaaagttgtgatcctatagtttacattatcagctaacatgcaatttgatctacttttaattataggcaagtcatttcagagacatattaaatatataccaacctttctatctaagcatcctgttacctggtaaacagcaaaatcatattgtcataaaattatatattttgtaatctctgtatttaatgtgctggagcatatgtatcataagcttcttaatttacaccatcagtacatcaaacatattccagggccttgattgttggtttctaactttattacagttattagtagtataatgttgagaaattcatatattatctctaggcctcagtatttcagtttatttttcaaaggtttcctgacaaaacaaaaactaagatcttcatataatcatacacacacacacacacacacacacacacacacacacacacacacgagcttcagtgatcacaattgatagcatgaagaaatgttagcaacttggattagcctgatgattaaacttattatatggtaaaaacttgtagatacttctggaactggggagatgacttagtgggtaaagcacctgttgtgcaagcactaatatttgaacacagactccattgctgcttgtgtctagctccagcctttgagaggaatgaggagatggagataagaggaattcctgaagctcattggtcaacctattccaaatgcatgaacttcagtgtcagtgagactgtctttgaaaacaaaaagtggagaggaattcaagaaagacatctgactttaatctcagttcttcacacatgcatgcatataaccacttatctatacccatgtgcacccatgcacatgttatatacatgcctcacataatcaaatctctgataactccctagtataaatatgggaatttaagtattttatataaacttaaatgttctgtaagaaggtcacaatgccttataattgaaatgcatacttaaaaatagactagggtttcaaaattccaaatgtattttatataaagtactgtgtgtaattatagtttactctttaacaagaaacttacagaataaagaacagatattaatgtgttgtgttggaaatgctattatatatctctgtgtattttcaagacatattatattacatatctgaaactcaagtgccattgacactaaatcatttgagttattacttatacaagttactttttctccaatggcagaaactttggcttttaaaagcgcttggaaagtaggtcaggacaacatcctttaggcacttggaatttaggtatctaaattttttccatgaatttttccatgctacatagtaaaataaatttcgatttcctatgtagatggcatcttgtaagtaaaagagtattttagatatacatttacatttctcagtagtctcatataatgatttctttatgaatcatggatatagtgactattgcaagagccagagaatgtttaaaaactccaacttcctctatatttctgctttatatacaaaatcaattcttttttctactgtccttttccaacttctcttgctgtgtctttccatcctcataatggtaataagaactggtataatttcattaagtagagattatgcaaattaatgtagagttcttcttgtgatgacctagatagaatgagtgaaaattgttttgtcactgtaaactaatgtgttgggatagacactcagtgtcatttgtgacagctttaccaactcttgccctgtagtatggagtttgttttctagtcataatcatgattttcttttatgactagcatttggtaagaagctgaagggaagtaatatttgattgttaggagtaaggaacttcctttctagaaactttctgtactcaggaccaaagaagattaactccactttcgtgtgtttatagcagttcctacatttaatggtggagatatagtccaacttaatgagtcagtacagaaatatgtggctagggaactgtgggttggggtggggcgagtcggcccagagcaaaagtcagggaggagtaggatcattaccaccctgctccacgcctacctgacccagtagccctgcacccccacctttgcccactggaagtggtagcaatgttaaactttctctctccctttataagttcataatgctgcacctagaattccttcgtatgataatgaggcatcctcaataccctggcctggccaatgatgtaccctcatccccaaatccactcgccacccccaaaggtttaagtagccttcgtgccccaacactcccattaaataacctatttcattaaatctccctcccagaatctcttgtccccgtgctcactactgcccttctcacaatccactggttgtgattgctgctgatcatggcacaatgggctgggaagatatgtcaaagaaagaaaagaaaagaggatgtgtgtttcactaatatttacacaatgaaatattattttggaggtcattagtataccgaagacacattcgctgagaagtatcagtctttggttatagacttgctattcattcaggtacaaaatgatctctttaaaatgttaacctcctttactttaaactgcaagtttctacaaatccagaaaagagaaactaagtgtagcttatagagataatgggtcttaagaaagctctgaaatgtaaagactcataaatgaaagcacaatactgaatagacaagaagcaactgagtggagtatttttgggtacgttgaaacagcattaaaggagatagtggggctgggcagatggctcaataattattagcacttactattctcacagaaaatccaggtttagctccacgcacccacacggtggctcgcaattgtccattactccagtgccagcagatctgacatgatcttttgacttctataagtgctaaacatgcacttagtgttcagaacatgtacataggaaaaacactcatatatctaaataaaaataaatgaatttttaaaaaaattactctaataaaggagatattgagagtggttgggaaaggatgaagttttatcatttagaaggatattgccataaggcttgcctatgagacatttacacaaatggcaaatttaggcgttgtgtacacacatggctgaaattaaggaactactacttttggaacaaactgacttagaactgttctgtgaacaatcattttggttgaatttacctctttctctcaaaatcaactcattattagagaagaacagataaaataagctcattccattgttgatagataaaccagttagtaaattaccttgaaaatttggctcttcaactataagtttcagtgtggtattgataggttaagagtcatataaatattggctggtggtagtaaaatatttagacttaataggtattttcaaacagacatgccaaaataaatgcttatgcaagaatgtcacaaaataatatcatttgttttattacattattttcagtggttcagaatttgctaacttataaataaaaaaattagagaataaacaatattgggaagaaagtgacaaaaggcacattttatatgtcacatttaaatgctgggtattgagaaacaaagctcttatttggagaatggtatttctgaacagatagcttgcatttgtcaaaaaaaaaaaaaccagaaaggttaatatcagacataacattaagcagacctgaatgtcatttcaaacttacatttctcgaaagattaaagacagttttatccttaacaacactccagggatacagatatttttgcttcttcaagccaactttacaaaaagttatgctgattccttttgataattagttcctaatactttctaaatagcagttacagcaatgtaaatgatgttgtgaagactacctggttgtgacagcctttagcaaagatagctcacgagcaaatgacactgatgacagtgtgcagaggacaatgtgagacaagaaattccctttgggaaaagaaccactttttggtggcaattcttgcccaacagccatatacagctgctattgatttttcttcagcttccagtttatagctgtaacagtaacaacatccagagagactggaggcaggagtgccatttaccagtccactagcacagacctaggaaacatggagagtaacttgaattaaagcaatagccatagggattgtaaaacatggacacatggtatggacaatatgatggttcaaattttcaagtgatggtgactttggaatggtggaatataacaattaaaggtgggaaactcaagctgactctaaggaagtttcagtcatggggatcgaacgtgctggtgctgatgaatgaaagtgagcttacatgtgctagggtagctgtttaactgagtaagtccatcctttctgcatatattgcctctaatatggccataattataacttctgaggtgtttgcatttagtgtgtgtgtgtgtgtgtgtgtgtgtgtgtgtgtgtcaggggagggagggcagggaaatggttataatatatgagaatcataggtatcttcaaaacttaggctttatttcaggtgatagcaactaacgaaactgcccatacaagaaataaagagacccttagtaagtaagtaagtaagtaagtaagtaagtaaataagtaactccaagaaaagtatttaaggtactattacagggaacatagccaatgaaagagttacagcaaagataagcagactgatatagatcacgaatataagtcattcgtttaagtccttatgcaacacaaagacctgatttcaataccctgaacccacataaaaagccaaacatgatggtgatctcctgcagtccctgcaccagggaaaatgaaataggtaaatcattatggcttattagcctgccatcctatttccttggtgaattataaaccagatatcaaaaaccagaggaatgacacactcagttatctgctgctttacacatgcatgtgcttgtattcgtgcacatgcatacacacacacacacacacacacacacacttgcatgcatatacctgtgtacacatgcagttgaacacacacaaatatccacttagtacacgcgtgatagaagaaaaccatgatgatataatgctttggaatctaaaagaagagagaatcaaggtgagttatgatttagcatcatccatctgatgatgcacaaatattgaacaggagattggaaaaaaaggaacttagatttgacaccttggggaacagttttgcaaaaacagtgcatatgagataacaatgagttactgaggaagaagacctaggaaatatattctggggcacatactgttaatggtaggagccaccatgataaagcaaaaaatacacgtaaaaattgacatatgtttacgtattttaattctaactgtgcacagatgcttcatttggtggcatctccagttgatgctgtttacccaccatgatttaagtgcagcactcaaattctgtcaacaagcattagatgtttaatagcttagaaagcaaagaaacactcctgtattaatgccctgcattatcacaatagccaaattggactccacctatatctctgtcaatgcatgagtgaattaagaaaataaaatatatacatccaatatgatagtattcagtcttgaaagggaagaaatattgtcttttgtgacaacatgggtagattttaagagtattatgctaaagaaaatcaataaaacatagagagacaaaagaaactgtatattctaattcacaggaggaatgtaaaatgatcgaagttctgaagttggagaaaagaatattgtatatatgagaggggatgaaatgaatgaagccattataatcaaacatattagattagtttccagatcaattgaataggatcaggattattgctagtaaaaattgtgcacatttcaataatgctgtcatcaaatccactctctcagaggaaaagagaagggggtatggggacagggactctgggaggaggaaccaggatatggagcaggatttttgatgtaaaaaaaaaaaaactgcatagaaagcacatgaaggaagcaaggtacatcttattcaaaataaatgttagtactttaaacatgctgaatacataagatggtgaatatgttggctagttcaatcagtctagattgcattaaaatattaatacagatttttcccacaaaactaggacattcgcatgcacacacacaattataatgtgtaattgtataatcaaaatggaagcaacagagatgaagtcaagtaagttatccttactgagtcctttttttttggggggggggctttctttgagtctcacagcaccaggaagtactaggcaatcagatcctatcagtgttgaattggataaaatcccccagagattctatattttaacacactgattgcctcgggagaaaacagtgaaataaaaggtttcttgctggccaaggccagccatgcggccatgtcagagggaaagaaatggacattcaacttccttagtatcatcaaattctaacccatggctagtagtaaaataccccccccccccgccccccgtttcttcattatctacgttcagagaaagctttaaagaaagtatgagtttcttctatgtcaggaaatggccttaacaccgttcttaaacacacacacacacacacacacacacacacacacacacacacacacacacaagcacataaccttaaagtatattctgaaatcaataattttatgccttggaatgaggatgtaaatttagcctgttttcattaaaattttgtaattccactgacaaaaaaattgctgacattattttctctaattggtttatcatttcgatttaagcacatgcattctgtctatttaactagacgattatgattataagtacttgtaaacttacatttatagtgcttaaatgctaatgatatttgtcttttgtctgtattatattaaaatttctttaatctcaacttctgtaagaaaatacactttctgggagacttgctaaacaatgacaaagaggtaagagacagagatgaggaaaccacatgcttcattccctgaagtttaaatactgtagaaataattattttccaatagtttgatggtaaagtttattgttacataggattgatgagcacaacatatgacttaaaagggactttttaacctttaaatgaatatttagtcatttcaagtcattttggactaagatctaatataataaattgcattttattaccttgaatatgattgactacaagttggaaaaaacaacactgaaacaataaaaacatttattatcttacatgctatcatattggcacattctaaggcggtgttaatcatttttatgcctcaagtcatttatttcctgttattccagccaaagtgttcagaatatgttgtcactcatattatctacattgatagaaatgcttctggcatgacatgttcataaaacaatgtaaaaagatgcataaagcatgttttttctgactcttcaatactaaggtatatatctatatttataaattcctttatttaaagaaaccttttcacatttcactggctaaagattaggtcaaatgaatcttccttagccaatctctgggcagataataataataataataataataataataataaaaacggtagtagtaatagaaaagaaaagaaaagaaaagaaaagaaaagaaaagaaaagaaaagaaaagaaaagaaaagaaaatgtagattctatattcctttacacttctggtgtattaatactagcacttccattggaaacagtgctgtgactgagcatagaatcttttcatacaatttcattgtgatacaattgcacataataaaatttgacttttgtaatttagtaatttactagcactggtctacttataactttgtgtatccattaccacaacaattttaaattatttcatggttgccacaatagtctacacctgttagacaatcacatcccacacctgattctcactgccactgacaaatactaatatacattttgtttgtgtgtagttttctttgttggatactttatatgaaggtgaccgtataatatttggctttgatgacaggtttcttcacctcagcagaaacaggttttatttatttatttatttatttatttattcttacccgcgttcacgaccggccaggaagaacgcagcaaaccggaatcttctgcggcaaagctttattgcttacattttcaggagccagagagcaagagagcaagagagcaagagagagaaaaggaacaagaacaagaaagcaagagcaagagagagaaaaagcaagaacaagagagagagaacaagagcaagaagaagaacaagaaagcaagagagagaaaaagcaagaacaagagagagaaaaagaacaagaaagcaagagagagaaaacaagaacaagaaagcaagagaggagagagaaaaagcaagaacaagagagagagcaagaatggcaaaaccccgtcccttttaaggagaattatcctccgcctaggacgtattactccctgattggctgcagcccattggcccagttgtcatcatgagaaaggcagaacacatggcgggaaaactgcccctgcacgtgtgcagattatgtttaccacttagatcacagctgtcagcgccatcttataatggcaaatgtgagggcggctcccaacatctcccccttttcttttaataagagcaataggccacccatattaatgagagtggagatagaggtcaaatccccagtgtgcaggtaaaggagccatgtacaggattagctcttaggctcacaggcttttacccagagcaaccctgacctgctcccgtgtcgtttttcctggggagaaggacacttggacactcaaccttcttgaaaaatgacatgtctccctagaataggctcatatatgccgcagagcccttctactgcagtgcttagccgtgcaactctctcgggctgctgaagcacactcactctatcccgtgcaatgagactagcctcgtggggtgcaagagctgaatggccagcgacctattgcttaagcatagataaccatatatcaggggaagcaccatgttctagagctgcaagtgcctgggcaataaccaccttgtctctcctagtttgggccttaagcttacagaccaaccaaagaagcaacactaatccacagcaaagtgtatctccaaataatcccacccatacccattctttaaagaaggaaaatgctgaggagatccaattgggtaatcctttgatcagggacaggtccaagcgcgtggagttgacctgaatgatggcaattctcaattcccgaagggtctgttcaaattcagccgtccaattctgtaacatatactgagaaagactttttgacaaattagctgccctagtaaatttctcatactgaatggaagtaacgcacaatcccggaaacttttattcacattccagctgagttatttgccataatacatctagttgtttctggacaagatatatgcgttgattaatttctgcccatggagcatttttgggattggaggatggcggccgctaagcctgcattggtgagaggtcccccaagctcccgacaaaccctgagccagtcttgtaaacctttgttctttcttggggctatggccgctctgcattcctgcgtggcttgctcataaataagctattctaccagaggtgcggcttgctccaaatctgcaaaaatacgctctgctgcctctgtcattctggccacaaaatctgagaaggactcctgaggtccctggacgatctttgttagttgtccagtggcttcacctgctcgggagagcgccttccaggccctaatagccttttcatctgattcagaactattaagaactggctccttgagctcatctagtgatgagtataggctttttctcctagaaacctccgctgattgatcttttttcttttcttttttcttttccttccttccaatctctccccaggtattcttacctgacctaaacttttcctcaggttcaagacccgtggaaaggcctgtatacttattttgtgtaccatatttcctctttgctccaactctctttccctgctttacttctgatagattgccctgaatttcatccagaattttcagccctgccttaaccacttgataacatgtgaaaaggaacaaaaaggctcctaacactagagaaagttcaaggccaaacataccttgtaaagctatttcccactttacttctgatagactgtcttgaatttcgttagaaagttcaagaccagacttaccttgtaaagctatttcccactttacttctgatagactgtcttgaatttcgttagaaagttcaagaccagacttaccttgtaaagctatacttacgggtaccctgttccccagctgaagagttctgaattcacgcagttgaatccttctcaacagtctgttttacgggaacactttattaccaccattccccagctgaagagttctgaattcacgcagttgaatccttctcaacagtctgtgttgtgggaacactttattaccaccgttccccagctgaagagttctgaatccaggctggatccttctcaacagtctgttttacgggaacctttatgaccgtgacccgcagttctggttccggaatgagggatcttccttgcgccagtgatggttaactcccgtcccgagttttcttgtcccaggatttctcgtcccgggttttctcgtcccaggtcttctcgtcccgggtctcagcaccaactcttacccgcgttcacgaccggccaggaagaacgcagcaaaccggaatcttctgcggcaaagctttattgcttacattttcaggagccagagagcaagagagcaagagagcaagagagagaaaaggaacaagaacaagaaagcaagagcaagagagagaaaaagcaagaacaagagagagagaacaagagcaagaagaagaacaagaaagcaagagagagaaaaagcaagaacaagagagagaaaaagaacaagaaagcaagagagagaaaacaagaacaagaaagcaagagaggagagagaaaaagcaagaacaagagagagagcaagaatggcaaaaccccgtcccttttaaggagaattatcctccgcctaggacgtattactccctgattggctgcagcccattggcccagttgtcatcatgagaaaggcagaacacatggcgggaaaactgcccctgcacgtgtgcagattatgtttatcacttagaacacagctgtcagcgccatcttataatggcaaatgtgagggcggctcccaacaatttatttatttatttatttatttatttgtttgtttgtttgtttgttttttctgtcactgttgcaaacactactatttcattattttcttatgtttgaatgatattttgttttatggatgagacacattttaaaatatgtgtatcaattaatgagcaagagaattgtacccacactttgactgtcataaaaatgctagtataaacaattgtgtactgtatatttataaaatttgttttcaattatttttttggtgatatagatacttagaagtggaactccttcattattggacaactctatgattaggattttgaggcactgccaaaggcatatccagagcgtgtggatcattttccatccctataggcaatttaggtgtatcttattgcaatttcttcacatcttctaaaaaggttgttattgacttttttattatgatagtcaaattgggtatcaactactattttattattgtttcacagtctttcttgaagtgtgtgcatgcacaagtagaaaccaaatgaatcttccaaaactatgagatgatattgacaagaaagtactgggggtggctgtcaaagactaatatcacagtctgattacaaacatatacagaaagcatccttatttaaataaatttaacaacactatttcttgtattgcaacttaactgtttacctatttttaagttctcagagtttctcacttgttcactggagaaataggaatattgtgaataaatatttctagatataatcatttttaatacttaagtatgtttttaaaagtatgttattatagttatcattgtatgtatgttcacattcatataaagaaatctattaacctttaatatacaaaatggatgatataatatctgacccacatctcattagttctcagaaaactacatttttaaatctcattttatcagaagcctatgagttagtttttaattgttttcatttcatgtgtgctttgtccattgaggcacgatgatgcaatggatcccctaggactggaattacagaccattatcaactgtcatgtgagtgagagaaatttaataataaccctctgaaagtatagcaaataccagccccaggcatgagagctggttttgataaggaatcacaaaggaaaaaaaacatattttaattacaaaggacatacaccagaggtaaagccaaagccaaagttaaatttagtgtgaaatctggtagcaagatttcattgcttctttatgataaacatttggactcctatagaattttgtggatctctttgaccaattacactatactatactcatactttcttctgaacaactcaattgcctgattgttttaaaaattggcagtctcaaaatcatattatttatggaatcgtagagtgtttctttcaccatggccctaagcaatttcaacctatgaaagctcactctaatcctccttatgaatacaagcatgctgtatttatttacgattagacactgctatttctttatctaactgtttacatctccttcattttaaacacaatgtgagagttttaggctttctgaaatgctagagttgtaagtatcctcaattttgtcaatggaaggaaatgtagaactcatttaccccctcattttctaagtatacaaattgaattccagcatattccttccacttgccctgacacacatctatcacagacattggttagtacacatgtcagcaaatgtataaagtttcttggctgcctgacaccggtgaaaccatcagcatagatgaatcaagtagaaatactgcataaacttttgccatctcttggtaacctgttaaatcataataactggagatgaaatccaagaaatggcatactgccaactctgtagtctagttaaactatgaatgtggtattcagaacctgtaagctagctgaacatccaataacactgttttgagaagcctaggtattaatatttttggctacaaccctaaatccactaggtacaaacatttaaacaactatgacccatcattcctgttctaaagggctgttccttcatttctctttataaactgactgacttgatttttagttttctttcatttctatttattgcaactttgtttcattttaacacttagttacaaacaagggacattttaaatgtttcatactacctgaaggtgctgtgcacacttagggagaagaaaactcatcatccatcttacttatttgtgaactctgaaaactgtaattattagctagatatgatatgtccacggggacaatagtggcacaaatgttgtactagtaaccaaccagtttctgattccatttaaggccacatccataagatgaaacttatatctagcaccactatctgtgccaagagcctgtgtctgtacaggtcataggccctagggaagaacgtactactactactattattctaaacagggagaattaagttaatttctattaattgtcattacatcatagagtaatacatctcttaagcctcatctgagatgcttctgttcacaatagatgacaacacagacccctaaaactgcccaaggtgctgagaagaagatacactggaatgctcatccctatgtgggacaccaatatcacacttcccaaggcacagcattaagttttattccctgggattgaacttgcactttaataatacattctaaacatgataacaagtatgtctcatttatagttcagtcatctggaaataaaaaaaaaaaaatagctagttcctaccaaataggcaagtagggagaccagccattgtggaaaattattcccaggagaaacatatattatcaggtttcattaattgttttttttacataaagtacacacacacacacacacacacacacacacatccctcaaaatacctataactgtaacaaaagcatactatccgttgatagataaaaaagcaggtgtaatggataagcatgaacattgtctgaacttaaggttctcttgtgatcttttggtttcttcttacattacatagacatagaaagtcacatacctcatggtgttattcaaatgtagtactatagaaaaattgatctcacaacagctgagaaaagttggtagttactagaagacagagaatggtgagaagatgatttctgtattaagtcataattagtggatgtagggctgatgttctattgaatagtcgggagactatagatagctgtaatatactttatattttaaaaactatacaaaaagaattttcaaaagcttcacaaaacaatgaagaaatgtggagatatatatgcttacacttatttaaacaaaacagtatgtatatgtttcagaatatcacatataccacataaatttatgtataaattttattgtcatgtattacttaaaatatttactttaaataaagtaaaattataattttgagcaaattatgtcagataggtctgctttttttgcttttcacaatgttatgaagaggtagaaggcaaaaatatattacacatcaaaaacctttgtagaatttacaagaaaatttccaagcctgttggcacaatgttgtctctcagttaaacttcttttattttgttcttctacttccttttcattaattaattagtttattcattttacatcctgacaactgtagcctcttctcctcctcacagttctagcctcacaacctccctctcttcattatcccctccccttcacctcagagtaggggatcctcccatctggtaccaacccaccctggcacatcaagtcccagcaagcctaatcacacccctcccactgaggccagacaaagcagcctggctactggaaagggtcccaaaggcatacaatagaataagagacagccaccaccactccattttagggactcaggaagaccaagctgcacatctgctacaaatgagtaggaggcctagatccaggccatctgtgcactttggttggtggttcaatctctaggcacccatagacccaggtgagttgactctgtaggtgtccttcctggggtgtcctcgactcctccacctccctcagtccttaccccaactcttccacaagacagcccaaggtctgcctaatgtttggctgtgggtctctttatctatttctgtcacctgctggatgaagtgtctcagaagacagttatgctaggcttctgtctgcaagcaaagcagagtcaaggattagttatctcccatgggatgggtctaaacttggggtagttctatctttattcctgcacatcttataggcaggaaatatttttggttgaaggttttgtgggtggattgatgtctcctttcctccttggaaagtcctatctggttacaggaggtggctacttcagtctctatataggaaactcccctagccccacccaccatagattcctgggaacctctctgtccaaagacttcagtttgtccctgagatgcctcccagtcctcttctcccccccccaatactgtttccacacctgaccccaacccccaaccccagtttcccgccccaccctgtttcctaccagtttcctccttccacccaccccgatatctgttttatttccccttttgagtgagattgaaacatccttccttggaccctccttgatacctagcttcttggggtgtgtggtttgtagcatggttatcctgtactttatttatggtaatatccacttatatgtgaatacataccatgcctgcctttctgggtctgaattacctcactcaagatgatattttctaatttcatccgtgtgcctgcaaattgcatgatgtctttgatttaatggtgtttagcttacaatcctgagatccagtacactcttaattgggcctcaaaaacttttccgaacagaaaactatcctactagtttctatcacttaccctttgtcatgacttcaatgacttcagagtcttatgttaaaccccaaggttatgactccaacttaaatatgtaaatttaagggttttaatgccagtgccctttctttttagtgtagattggctccacacagtggtgtagctggaatttaataatttgataattactgtggcctattgtaaatctagttgggtagggaatcaggtaacacttcactaattgattatatttccctctttattaattacatgtttgcagctgagttgagttatggatcaagcagtaaaaacactgagatgctttttgaaaatgctgttatattttatcagtgtcttttaaaacctaatgtttagagatgacgtgagggttgaaatgcagctttagctgaagcaagaaatactccttgataatagttgacacaacatgcatgtagtgaaaatgacaatcaagtgttctattaagtgcagaaacagatgtcctgtataaaagatgtcagtgtcactgctagggaacgtgtgtgtgcattattcatctctgctcaggcacaacattccaaacctttccacggattcctactgaattactgtctccgagtttgtgctttacatttaacactcaatttgacttttcacagaagcaggatagcaaagtagcatagaaactaagggtcaaagcatagcttaatcagaaaatcctagctttgtgcagttgggtctaagagggctgcagtctgttctttgtgaatgtgaaagctctgtcgatgttggatggggttagttttactcatgcaaactgggcattaatacagcacaagttttgctgattattacactttctcaaattacccatccaaaaaatatcaaggtaggaaaaacatgacaaaaatcaactttggttgtattagtcttacctaaggaatttcagtacttaggggttttgttgtttgattggcttctttttactcaagggcattaattcggttcccatgtatatgagcaaaagacttttctgtaagagctgaactagtatagaaagatttttaattaatacagtaagtgattctggaaattgctttccaatagaatcacctcatccccgccccctctaccagtcatctacaccaagggcattgtaatggtacaggatcaaggaactaaaggggccttctttcacttcctcttgttcaaagagaacacttggtggcagtcctctttaagaaccagctcttcttgattaagctctttcttgggggaaaaacaaaagacttccctggtggttctcaagagctcctaacaaattcctttctccttgaaacagcaaggagctatcactaagacaattgctccagtgcagaaacaagagccaggggatagtagatattttttttttcccctggaggcacaacttgcttagggaggagctttatctttgggctttaaagacactactcctttgcactacccttcatttaattgtttgttttccattccttttctctctgctgtttagccactgtctcagacagtctgatttggattaagcttgtcatgctgcccttgtgactgaataatatatatatttttaaatgctgagggtattttgcaatgccttctctttacaacaaaaccatttgtgtaaactattcaggccaatctgtttttgggtcttttggttttgtatgtttagggtagttgcttttcccttatgtgtttttcttatgggaaagtattatttacttctctccccgttgtaattaaatattagataagaaccaacatgtaggaagaaggaataattccaatgcacagtttcatggcaaataaattatggtggctgggatctgacctgagtttgggtatttgagactcttcagaccttgacagcagaaatgcgagtgggggacataatacacaatgggttagagggagggaaggagggagggagggagggagagagagaaagaaggagagagtgagagagaaagcaactttgaacaaagagattgccttgccctttaattaatatactcttcttccatgggacatgagtggcattgcatatgtgtgacttttcccttttaatttcaccagtagtggtcatctctttccttttaaacctataggcactctaacctgttcctctgaccattcacacgttgcaatcctcacatcctctcaaagagtagataaatacatacagtgattttattgtaatgtgttccaggaaaacccctcaaaataaaactaaagtcaacttataggcaaaaccatcttttaatattttaaaagtgcttaacagaagctctaagatgcttgggcatgacatccaagatgacattctttatagttattgtcagttcagattgctctaagattttagtagattcacttagggcagagttcttccacctcagcaatattgtcatttggggcaagatacgttttgctgtggaggggctgcacttcgcattatagaacattaaccaccatctctggcctgaaactactgcgtggtagtcatgtcccttttctgaacttgtgatagtcaaaactttttccagtgctgccaaaaaaaaaaaaaaaaaaaaatgaagatgagaggcccaaactgatctccactttgacatattgactttgaattcctgtgatttggtttctaactaaaaagatccaattgcatctcaatataaattatacaagcaatttttcaatacttctagatattctatttgtactattctcgtgatccttaatatcattcatatacaaggattttttaaattagttaattaacttattcattcactttacatcccactcactgcaactcctcccagccccccataccctttgtaccccctccccttctcctctgagagaatggaaattccccctggatattcccttaccctggcacatcaagtccttgcagacctagacactagccaagttaagggaatggattccacagaccatcaacagctttaggggtagtccccactccagttatttaggacccacatgaagaccaagctgcatatctcttacatatgagggggaggcataggtccagcctgtgtttgttctttgcttggtggttcagtctctgagagccccgaaaggattcaggttagttggctctgttggtcttcctgtggagttcctaacctcttcaggcccttgatccttctcccaactcttccatgagtcccaaagctccatccactgtttgtgtgtgggtctctgcatctatctaagtcagctgctgggtggagtctctgagaggacagacatggtgggcttctgttttatactgaattctttaaaaaaaatacctgaattcttaaaaagaatgtcacctattttccatgattatgaactaagtagtcaggaatctataacatccttaaccaaccaaactcctttcattcctattatctcttacaagatagtaacttcctgaatatcatcaatgctttctcagtactttcttatgtatatgtttctactattatgctaaacagcaattttaaagcagggctgctgaactattttgtctacattcactgctttgtaactttaatagaaagactgaaaaaagccatttattttaatattttgggtatttttcttaaaatttttaatctagccctgctgttaaatatatgatgtttatgtgtttgtttatttatttatttatttatttatttattcagtctactctttcagcatagcttctgcagtgaacttgagatgaagcacacactttaaaacttatagatccactgaaatgttgattcccttagcctttccagcaatagtacacagatgcattttatatttaaatatattttgatttctttttataaacatcattgtaccattttagcagtaaatattgagcatgaactaggtacattttctgctgagaagtgctaaaaacctttaactagaaaacagtagtaattgtcaaacattgaaccacgagcttaatgaagcaatttctcttaggaaaactttcatcacacagacattttatccttgttcaaatttggccagaagctatgtatggctaaaatctcttatgatgccatatggagcttttttttcactattttatgaataaaatgggtgtgttttagtgtgctactagcttcaaacttagtttatctcatctacatatatatttgaagtcaaagcttaagtttcatttcaggtcaggggctcattaggcaaggtacttttctttgggaaaagtgaccattggtaagttgttcatgactctatacatatgctcacatgggagcactaactgaactcagtgggttatttaaaaagaaaaagatggaggccatgaagttgctagagatgtggaagataatttaccagggagagatgaagtgatagaagtcaggaggatggatattcaaggtgtattgtaaacatttataaaattaaaaattagaacaaaacatataaatagtgtgtgatcacttgctttaaggaagtaaatgagagttctctccaataagatgctaacatcctgtcatcttgtcagtctgtgcctactacccaaggccagttgtcttacaagagactacgtgaaattagcataagcttgtcaaagatcatacagtggtgtgacacatttagagttatgttagccaccagattttcttcttaactatttttgccacaatatgctgctctcagtgagttttagctaagagttcattgttatcatctatataatagctatttaagacaataactcatactaatatcattcattcttacttctgaacaacatagtcggcatgtattaagtatgaaattaccctttacagctaaccaccattttaaatattccactagccttccttgctttcctcattccctttcttctttccatccttttgtcctttcttgaattatttgtttgatcctcatgtacaattttgcccttcagtcttgattagattttgaaatccctgtgtaggtactacaaacacagatttcttgctaacacaatggtctaattaaaataaaaataatgttggatgtgttggaccatcagatagaggttgtaatttaactgtatttacctcttgtatacttgcatctcaattaacagtaattgagcaagtggaaaatgaagaacaggactagtgaggtagttcatgttgagaggaggtcatgagcctgaggagaaaacttattctgctaaaggaacatttgcaatagaatgactcctaaggatacatactgctagtcctatagatcaaagcatcactcagctctcaccagtgagtctactttatccagtagataggaattaaaagagacctacaactggttgatgtgcagagagtgaacacttttggaacactcaagcaggcctaagtaggacggatgtctttatcagactccttacctcaaggtacagggatctatgcagaagagccagaggtgataaactccagtgacataatcttgtcctagcacaatagggtggtgcatacatgagctcatagagactgtgtcagcaggtacaaatcctagacaagttcaaaacatacaaaattccatcactgagaagggcaagtgagtacaaagtcccatcataaccaagaagcaatttataattaatacccgtggggaaagggaaatttagttttctacaatggagtgccactggctatattacacacagttcgggtagcccacatgcttaggagtacttggccaacacaaaactgactccgtgtgtgtgtgtgtgtgtgtgtgtgtgtgtgtgtgtgatacttttcatgttgttttggtttggttttgtataattttgtcttgatttgttgtgtttgttgtatttgttttgattttcattctgagacactgatagaaaacaatgtgaagttgggtgggtaaggacgtagggagactataaaaggagtagacagttaggagagtataataaaaagcatattatataaaaataagaaaaagaaagaaaattactatagaatatcaggcattttggaccttgcaacttgcatcaggacaaacatcagagttagagacatagacttaggggtaattattatagattaaataatggaaaatatggacccaagtaaaataacaggattagagtatatattctgaaagcagaacagaaacatggcatatatcaaggggaaagacatactttatagaattggcagaaaatcagaagcaggcaagaagtagtaattgtactagggaaagatcaaaatataatggtagtgagggagtaaaagaataactagaaatggaaataaagagacaagaaataaattaaaggagaaagtaatatgggtagaagaattaaacaatttaggaataataagaaagattaggtaaagtgtgtgccttagatggaagagcaaacatggtggtggcacatctatagtgtcagtactccacaggtgaagttaagagaatcagaaggtcaaaatctcatatgtattctgctatagagtaaggacaatgccagcctgggttctacgagatacccagggtcaataaagaaccgcatggtagtggtggggggagtggaggagaaggaggaagaggaagaggaaggaaaaaaagatattgaatgatgaaagaggaaggggaagaagtagaagagagactgatataaatgagtcaaaagagaagaaaagggagtgagtgagggagagatggaaggaggaaggtagggagagaaggagggagggtggaaggaaaggagagaaggagggaggagggagagagagagagagaaagagagatttctatctttatattttctcatcttctataagtttttacagctgcactcacagtcacatgcttcacaggagtttaaagattcttttcatgtgttactcaacattacattttagttttaaaaattagttgagccataaaagattttctatttaaatccacaggactctaatctcataattagactctaaaatatacttcttcactcccaatgaatctgaaatcccatcttaacgggatcatcaattgtatccctacttctgagttcattgtccacttcttcctgacttcccttctgttccttcctgatccttaccagtagacctgggtctgcttttccccttgggatatctaggcaccctagtatatgggactggactggaaacaatggagcttagccaggttggtgtatgagacaggatgtcttttgtcctcagtgagggtgaaatagccttctccggaaataatttttcatgaaacaactttttattagagggaaaaggggctatataaaccttggagagcggagagggttttgggggtgagtatatattgttggctggagttgaggtgctgaggtcctggaaatacttcatttgcatgtagagaaattccaggtggtaactggatcttataaagagagggagtttaacttgaaatctgcccaacagactgtgtgactacctcaagagtggtggaggtgggagtcttaaggtttatgtgtgccaatttatgcaggcccttttcaaagtcctactcctgctgctcccaggatgagaatttgggggtttggacatgtcttgacctcactctttccctggttatggggctttctgaccttgaactcagaagtgctcatgagttccttatgtactttactatatatatttgacctatcaattctgcttactttttccccacaatttgtttcttctattaagaagcagctggaaaaaaaggaaaatcatttctcctggctgttgactcccaacgcacatgcattatatatcacacatttggatctcaaactcctatcactgaaatgtattttaatataaactgggagtataatacacattttattcatttgatttatttaatacactacaaatagagaaaatgtggacaagtctgtgttaagtaaaaagtgaaagactggacctgtgaaacattcctctcgtttatttggtgctattgtaagatccattataagtaggcacagaattgaaggtgatttagtaatatgcaagtaatggttagtattcaaacacagtcagctgggtatggtgtgtcacaccaataatgtgaaatgtttggtgagacataataagaaaaatgatgtttattcacccccaggtatggtagtaatgacagaacaaaagaatgactctactcagcttgtgaaagtctagttattttttttttttgtcaacttgacacaagctagaattatctgagaagagggaaccatattgaaaaaaaaaatgcctccatgagactgacctgtaggaaactatgggggaaaaatttatattgattgatgtgtgaggactctgctccccattgatggtgccacccctagggaggtggtcttgggacatctataacagcaggctgaggaagccatgtgaaccaagtcagtaagctgagttcctccatgatctctgcttcagttcctgccttgagttcctccccgataaagtgtgacctgagagtcgtttcatgaaataaatactttcatccccaagctggttttgctaatggggttttatcacagcaatagaaaccctaagttagtaaagcaataagtgagtttactgggtttactttacaggaatatgggtgactgaaaaacatatccaactttgaggcttcttgattcattaaagttgtatttctgtagctccttgcacagactgcaggtgataccaaggagataccctcttcccatgatttgtttactacatatataataacaagaagatgggacttagaagttttgaaactttctgagcatctcagtctcttaaagttttcttactccttgagatttattatcctccttccatcctccagaaaggattaagttcaaagaaaagaactacaaaagatcccaacactttgaaaggtgatacaggaagactggccctagttcaatgacagccatgattacatagtgaaatccagaccagcctggactagaaagtttcagaacaaacacaacaatatgtaacggtggtcaactgtgacctgtttgtgtatattataattattggggaacaaaacaaagccatgagcaagggacagctgacttgataaccataagttatttaacattttaatgtcttaatgatatgtcatcatgacatctaatgtaaattagatccatgttacttaagacatatttttctttgtttttattaagtatatatatattcatatgcacattttatttatttttatatttaaacaactttttattagatatttttttcatttacaattcaaatgctatcccaaatgtcccttatgtcttcccctcgccctgctccccaacccacccactcccacttcttggccctggcattcccctgtattggggcatagaatctttgcaagaccaagggcctctcctccctttgaaataaaatctcatcatttcatccctccaaaccctattcttcctttcaaatcttcccatgtttccctctcaaattgaaggcctttttttattattgttttatatacacaaatacatgcacaaaatatttatgcatgcaatatatatatgcatacatgcacaaatatataaatacaatccactaagtctaattttgttgttttgtgtgtaagaccaagcactttttattggataaacaatatgagggcccatctttgagaggggctaattctatctctctgctctccttagtttcacgttctttgtcaaggggcagaattgatgaaatttttctccctccacattttcatgtttggtaatattgtcattgttcaggtcttcttaagcagcatttctagaagacagtctcatagctagctagcatcctggtcttccagaacttatggactttctgcctcctcttctgtgatataagctttaggtgtagaagtgatattgaagatatattagttgtggctgaactcataatgttttgctaaacactgcattgtgtatagttgtatttttccgtagttgtctttatttttctgtaaaaaaaagaagtgtctttgatgagggatggctgctacacttctctgtagatataagaataacttttagatgtagttaaaattatgctggtcaagtaaagtggcagtagtaagttctctacgatccatgaactcattggcctgaggtaattgactttctaataccagacatgatttccctttagttggcctttagtccaactaaatatctattggtttcgatgaaataatatcactattgaacttttaaggatatcttgccatgctgaatcttgttccagttcattggcatcatatcttggtcaaaatatatatatatatatcttccctctcttggtagcttgtgttaggccatgcccattgtgatattattggagtaagactaagcaaaagatgggtttcctgtaacccatcttttgcttagtcttactctaataatggctaagatcaaaaattcaagtgacagcagatgctggcgaggatgtggagaaagaggaacactcctccattgttggtgggattgcaagcttgtacaaccatcctgtaaatcagtctggtggtgccttagtcagggtttctattcctgcactaacatcatgaccaagaagcaagttggggaagaaagggtttatttggcttacatttccacactgctgttcatcatcaaggaagtcaggactggaactcaagcaggtcagaaagcaggagctgatgcagaggccttgctgttcatcatcaaggaagtcaggactggaactcaagcaggtcaggaagcaggagctgatgcagaggccttggagggatgttctttactggcttgcttcccctggcttgctcagcctgctctcttatagaaccaagactaccaaaccagagatggtcccacccacaaggggcctttcccccttgatcactaattgagaaaatgccttacagttggatctcatggaggcatttcctcaactgaagctcctttttctgtgataactccagctgtgtcaagttgacacaaaactagccagtacaattgaccccttgtcaacatgacatacaaacacatcactagtaagcctcaacccttagtttcttattcatccccaagatctaaacaactttaaaagtcccacagtctttacatattaaaagtcaatccctttaaaatgtccaatatcttttaaagtctaaagcctttttacaattaaaagtctcttaactgtgggatccactaaaatatttccttccttcaagagggaaaatatcagggcaaagtcacaatcaaaagcaaaaatcaatctccaaccatccaatgtctgggatccaactcacgatcttctgggctcctcgaagggcttgggccacttctcctgctatgccctttgtagcacacatgtcatcctctaggctccagatgcctgtactccactgctgctgctcttggtggtcatctcatagtactggtatctccaaaacactgcatgaccccttcggtcctaggctgtcaattgcaactgaggcttcaccttcaccaatggccttccatggcctctcacagtaccgagcctcagctgctctgtgtgaccccttcatgccttcaaaaccagtaccacctgggtgacccttacacattaccaagtcccactgcagcagaagtacaacctttgctatctctggaacacagcctctttgtgctttcagaaaacacttcccagaagatgtcacctcaacaatgctggtctcttcttaatcaccgctaatttcttagctccagctaaccagcttcaatggtcccagtattgcaaagattttgctttagtagttctggtatcttgttaatcacagctgattcttcagccccagctaaccagaaccacagaataatcaaactccaaaatagcaatggccctgaaaaaagtctttaattttccctctgaaatttcacaagccaggccttcatcttttgcactgttctcaacattatcttccaagctcctacacaacatctgacagagctcttaacactgagtggatcttctagcccaaagttccaaagtccttccacagtcctccccaaaacatggtcaggttgtcacagaaatacctcacttctggtaccaatttgccttagtcagggtttctattcctgcactaacatcatgaccaagaagcaaattggggaggaaagggtttatttggcttgcatttccatactgctgttcatcatcaaggaagtcaggactggaactcaagcaggtcagaaagcaggaactgatgcagaggtcttggagggatgttctttactggcttgcttcccctggcttgctcagcctgctctcttacagaaccaagactaccagcccaaagatagtcccacccacaaggggcctttcccccttgatcactaattgagaaaatgccttacagttggatctcatggaggcatttcctcaactgaagctcctttttctgtgataactccagctgtgtcaagttgacacaaaactagccagtacaggcagttcctcagaaaattggacatagtactaccagaggatccctcaatacctctcctgggcatatatccagaagatgttccaactggtaagaaggacacatgctccactatgttcatagcagccttatttataatagccagaagatggaaagaacccagatgcctctcaacagagaaatggatacagaaaatgtggtacatttacacaatggagtactactcagctattaaaaagaaagaatttatgaaattcctaggcaaatggatggacctggagggcatcatcctgagtgagttaacacaatcacaaaagaactcacatgatatgtactcactgatatgtgtatattagcccagaaacttaaaatacccaagatataagatacaatttgctaaacacatgaaactcaagaagaatgaaaatcaaagtgtggacactttgccccttcttagaattgggaacaaaacacccatgaaaggagttacagagacaaagtttggagctgagatgaaaggatggaccatctagagactgccatacctggggatccatcccataattagcctccaaacactgacaccattgcatacactagcaagattttgctgaaaggaccctgatatagctgtctcttgtgagattatgctggggcctagcaaacacagaagtggatgctcacagtcagctattggatggatcacagggcccccaatggaggagctagagaaagtaaccaagtagctaaagggatctgcaaccctataggtggatcaacattatgaactaaccagtaccccccttgagatcgtctctagctgcatatgtagcagaagatagcctagtaggcctcagtggaaagagaggcttattggtcttgcaaactttatatgcctcagtacaggggaacaccagggccaagaagcaggagtgggtgggtaggggagtggggggagggacgggggacttttgggatagcattggaaatgtaaatgaagaaaatacctaattaaaattaaaaagactaagcaaaagaggctttcaggtccataataataataaaattaagaataaaattaaaataataataaaaattaataatagcttgaatcttatgcctaaaatatgtgatacatggaggcttcagcaataaagacataccctcaaccaagggcaacagcagtaacctataatatttaggagtcacatagtctgtcctcaccaacaacttggaaggcagtgtctgatgcttggtgctgaggtgtttgttaagtaatcaggtgctattgtgactagcactttctcaagtcattttaggtaaagctaaaacaatactattcacttatgctttgttaaataacgtaggtgtacttctcagtctgtattgaccttccttcttcctccccagttatattccctctcccattttctcctcaatattgcccatatcctgctatctccctccagagcctcccattcattgccctttatacttgcatggtttctcttgttactccctgttctacaattacatctgaaaatttaggtttatgaaccacagatgaaagagaacatgagactttttttttctctgcatttggattgtctcactcagtatgactctttctagttccacccatttacctgtagattatttttctttacagatatatagtattggttgggtatatgtatcacattttcattatgtattcatctattaaaggacatttagagtgttcccatttactagcttttttgactaggtcagctataaacatgggtcagcaagtatctggggagtatgatgttgaattctttgggcatgggccaagtagtagaatagataaactatatggtagatttatttatttttctctttttgaaagttctccctactgatttctatagtggctgcatcagcttgcagtcccacccacagtaaatgagggcttccttttcctcacatccatttcagcatttgttgttagatgttttgttatacattgccatttttgcctagggtataaagaaatcacaaagttactttgatgtgcatttttctaattgctaggaacaatgagcatcttttgcgatggtgtttcttagtcattttcttttcttttcaaggtcttgggcccatttttaatagggatgctaattttattgacattttgggttttagtgctttatgcattataagtattaaccctttgttagatatacagctgccgagattctttcctactctgtgggtttgacttgtcaattgttcttaattcctgggcaatcaaagcaatcctagtcaggaagaccttttctacctttatcttgtggggtagtactcatgttttcttatagcagttttaacctttgagctttcaaattgaagtattttttctacttggagttaagttttgtacaggaagagagttatatgtttaatgtcattcttctgcatgtggatagtcacttttctcagcaccatgtgttttagttatatttctttattgaataagaaatatactgccaaaatatagcaaactgatggatatacttgagatagcatgttgacttattgacaagagtcttctattacatcatttcaaccaatacacatgacacaagagacttatttctcattgtgtgactttttttttgggggggggactcatgaaaaagcatccattgtcttcagatggggcatttaagcagaccaaagaaacagccctattcaagtctagattgactttacttcttttttttgatggaattatattttaattttaaaagaatttttaagtacagtcatatacgtcaaatctaggaatacattatattttgctataacattgtgcacatgttcttttatcttttaaaacaacagaaaaaagaaaaaaaaagaaaaaaaaagaaaaaaaagaaaaaaaagtagatatgctcaagtacaaagcacaaggcaaattataatccctcagataaacacaattacagctagaaaaaaatattaaataatggacaaataccttaagctacattagaactttctcttcatagtaaaagaacttttgaaatttcaattaaaatataaaaatgtaatatctctttatagtatttttaaatacatttaaaattagtgcacattaatcttcaagtattttcatattagaaggcaagaagactgtataaatctatgattatcatttacattaaaagaacttagcaaatggtttaaaagttaaaacgcactaggattgcacaccaaagcaatacattccttattggtgtgtttgacagccaataaacattcatggtgtgtatattttgtattcagattttgttataaatttggctttatttctttgtttttaggcataataaatcataatttagaagaaatgtttattttcaggttgatatgaaaatgtgtgcctattgactttacttctttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtttgactttacttcttaaggaggattacttatggcagcaagagtatgttttattcacaggtttacatgtatgtctgatgcctgccttggtatgtagctaatacacacagtgatactacattggagaaaagtgattttttttcctaactggtatcaatagtaaatagcttcttggttaggggtgggactttgctatttcctcctctcagtatcagctggaaattgtttgataaacatgaaggggaatcttgcaagtttgtgagcttcctcagtctttgtctttctcttttcctttctccaggatgaaacattattttttgtatattacattttatatttgaaaccaaaatacaattagattataatataaaggtatcatttcctcttcccttttctcactcccaagcctagaacatatccttcttgttctccctcaaaatcatggcctcttatttctagcattgttacatacagcaaaagctatagtccatctaacaaaattacactcctgtgtctgggaaacattctgtggcattcttggtcaagaaagaagtttcaatcgagaacaaacaggtatagaataaaaacatctcctttgtgcagtaacattttctattgctttattcaacatgagtgggactaaccttgtgtttgtatataatttgcatataagtaaaatttgtggataatttatttcaattagtagctaatatctgaatataaaagttctctttataaggtcataatggtttgattaactatcatcatttcctggattaatatgattttcatgattaaaaaagttagaaaatcagttgtgctattaaatgtgtcctcggctagtcaagccaacctcagtcaaacctatttaaagttccaaaaagctactttttcttattatgttttccacttgatttccctaagttgaagtgaaggggatgaataattttaatttatcatttttgcattcaaatataaaaagtcattgggtgctagttgaaaatttatgaagtgacagtcttgttaataaagataaatgagaaggcttgttttattaatattaatgttgcacataatatagctttctaagtaaatataggcttacattttgcaaactttgcaaattatgtatctatagcaataacagagctaaaacccaagttgtatctttcgggtttcattttatttgtaggaagtctttaaacagagaaaagcaaggatgcatttgaaatatatgtgagatgtttactaacagtatttctgatttctggtattttcactgatatcttatcatacttgtaagagtgagaactaatgaatggtatttgagtagctgaaacgtgtctggtttaatacaagtcaatccagttattatgagttccaaaagagtgttactttgggagagttacagtaaaattcttgctgtcatgagaaagaaaggcgaccttcctttttgtgggagaaagtatttaaattgacagaggtaataaaaatgagaaaaaggaaggacttggacaccccatcactcgttacttcttccttccttccttccttccttccttccttccttccttccttccttcctttctttctttctttctttctttctttctttctttctttctttctttctttctttctttctttctttctttctttctttcttccagagcctctactatgtaccaaaccttgtcttgtataaataagaaagatgagaaaaataaatagtcatcccccacacatattcagccctttacttctcaagtacagaagcttctgtagtcctatagtattctcttatttgttggaagtatgctggacatttctagtctctgtgttaacttaataaggtgattaatatgttgggatagagaaaaggggttagtgttatagttgggtagggctggtaaagatgtcagtcattctctcctttatctctcatcacttgaatagtgtttgactttctggatcaaggtcatcacactcattatagtattttccaggtccatccatttatctgaacaaaattgtgcctgtgtgtgcgttcataccaattcaccacttcatgatcttgtcaatcaccatatatgtaggtatctctgtggtaatatgtttattccttggtatataatagtagtatagctgggtcataaggtagttctaagtttagctttctaataacttttgtactgagctccaaattgctgtgtaaactggtacaggcatgtttttcagggaaagatggcatgggatttcaatatacaaattatttagaaaatggagtttactcgtttagaaagaattgatgttcagtctgtcatctgatgtaccttctgtttgacctcttcttcacagcatttcacagccctttgtgaacttctgtaatttcctagggatatgagtaataagaactaaaaccactgtggtgcttttatgatcttaatatctgttcactgatcatggcttatatttcattttacatttccaaactgtgatgttaattatttcgcaaaaaatgttaatttgaatagaaatcagcttatcttcagatattacatatgcataaaataaatgtaatgctaaggaatttgaaaggtaatttctatgtcatacccatctaactcctatgtttactagagaaaattagtatttgataagctgatatgatttgtcaggagatcagttgaaccactctagtctttttatttttttcttcataaaaggtctcaagatggaccatgaaagtaaaagttctgttttatatataatgcaaatttcacacactagtggagataaagaaattagtgtcccaagctaggaaacaggatatggattattagtcataattcagttgttctcagtgcatattttcattctcccagttttctactctctttttaataatttattttgcataggcagagatatattaaaaggaaatcaatcacaaggtagttctgagaaatatttgtaaagatatatttgttaatacatataatattatgactggggttttctgtctaattctctgagtcctgagacttctcagagttttacctttgccatctgtatatcgccatgtttgttcatcttcgtctgatttatttgcagtatactttaaatacccccttttcacccatcttctcccattctcctctctcttcttctttccctggtctctctattgtcatctccacagggatcagagccttcccatacttgagtcagttaggctataatgaataacaattcagttaagataggaaactaccaagttattaaaagaatatagagacacctcacaagatgccaatgcaggatgtaagtgtcatggcaggaagtgaggtggctttttccaagtctgggaatacatagcttttcatgtctgctgctctctcatggcttttctctgcacatctgctccaacttcctctcatttttttcttattacatctttatttcagtttgaatcccttctatgtgaatgtccaagtcctaaatctaaaggaactttcagacctagtaccggaacagacacatccagtatcttttctcttacactggacatttacaaatacatttatgtggactctccatccttttacacaaattacattttagaacaaaaagtcctctgaagttataaagatttataaaattaaaaacaaaacaaaacaaaacaaaacacaaccactaacaacataaaaccaaaacagactgttctactcaaaacttgtaagaaacatgtttagttcaaacatgcttgggtgtcatcccagtctgtggcaaacatcttcagaaacgttcacatagaaataagcaggattttgtccttcggcaattgctttaaaataagcttgatccttacttggaacatatatttgagttgaaatcaacatcatgaattgtctttcctgtgaagcacagttgtttgagatatgggtcagaaagaaagatattgcccaccatgcttgatggtgctatcttattcaaataactgaaattatgtttctgtgggaatgatgttctaaatattctatactcagaactaaagaatctataatgctgctgtgggtatagtagtaataatctgtgttgtaactctaaaaggttcaggactatgtttatgtcattgaccatttgtctaacacagtgcctatcacatgaaagatctcaatatatatttgagagatgaatgagataggaacagtagagcactattatctgtgatttttaagaaaaacacttatgctatgtttttaatcctgctaaaacatgtaagaaacctagtatagtgatttctgtgtaaatttggttaatttaaggaaagttcatggagaaaacaataaggagcatgagtaaaacacacaatacaaaaaaccctcacacaggcatttgaaaagaatcgttaccaatgttcaacatagttaaagtatccttgtcattagcatacaatataatcattttcacatattgaacatatgcaagcatacctgcttctggttagtgtcatttcgcaattaattgttatcctgtcttctaactatcattagatttgcccatttttcttttatattagtggagccatgtagtctcttcttttctaactctatgactttgagagtcaaccactggtcactatggttacatgtactacctttaattcttttaaaaatgaacaaataaggtacaaaagaaaatgaggggacatgatagtggtaaacagaacttcaatgatcatatgtagtgaaaattaaagatttattgaagtgacacatgttctattcaatttaatgtgccttctgtgtcttctccatcactgcttctcaaattctaatgatgcaacttacaaatatttgtccctaggaaaattacttactgaaccatacataatgtatctcttctactgaggaaaaaaaattttgaacctgtgttctctccctgagatgtgtcagtaggtgctatttctttttaccagaggcagtgtttaattattgattctccatgcatatgtcctgaaagtgtttattaaactgaggttagggacatagttctttccacctcaatgcatgaagttatgagacgacctaccaggaaggggtaatgaaaaaagtgattaagtttctagactgttacatagaattaggtaaaaaaaaaatagtagagtatgcatgatttaaaattggcaagggcaggcattcagtatgaagaaatctttttaagttattaatcatatttttatgacagcaaaagtgaaaggctttaattaaatacatcttactaatgctcccttaaaaaatcctttctaaaataaatgtggtatcaaataatctatggaaggtgtgaggttgattttctatatccctgcatagtaagacagcccttgctgacaaagaaggttgccaggcacttacacagattactaaagaagactggggaatcaatgaccatctgttcaacatggttctcatacaagtgtatgtggagccagaaggctagatgacatgaacttttagaaggaaaaatattttttccctgtttatttaacaattatcacatttgtgtgaaacagaaattcaaataaaatgcttaaaacaagaaataaaatgaagggtttcttttcttgaagtaatttgttggtctctttctaaagcatttcagaattgatgctgaaaagcacttggagatgaaaaccatcctttatttcactgcttctctttctagcaccacacgttgcaagaaaataaaatgcacactacattgttgcttggataaagagctattatttactgttgttcattttcaaatgtttttattgcttttcaaagtggtcaagatgacacttttaaaacccacaattttgtttgacctgaatattgaaccactctagacactacttgaaaggtctctgtaggccattgtggctccatacaaaataataatcaataacacttagacaatgtactgggtgcatactaggtgccaggaactgctaggcaatttatatatgttatcacatttaattctctcaataccctgcaaaacagatatcgctatcatttgcagtagtaaatgagagagccttgattaaaacaagtatgtagtccttactcctaacactaattcttccaagcactgatttatgaacttaggcctgttaccattactattctgcaccatattttccaaagttttgagaaccttatctcaattctaataggactttgaaacttgcatgtctttagatagtgatacatttctgtcttgttctggttggtcaattttgacatggtggataatttaggatttagaaatacttagacctagacttggaccttaccttcgcaacttgacagctgtgtaaccaagctaattcaccaaccctctctgaatttcagatttgtacttgtccaaacttttattgctgtgataaatacttaagaggaacaatttgaatgagaagagttttatggttctcagttttggaggtttcaacctctggttggatacttccattgtttctgagcctgcagtgaaacagaacatcagaaaagaagtgaatgcagtataaatattagttccctatgatggttaggaattatagaggaagaggagggaactaagaacaaaattcagattccaagaatatgcttccggtgactcactgcctcatgaactgtttaacacaaacatagtaatatcaaaatagtaatatcagttgcgtaccaagtcatcaacacatgagcacttagggatataatagtgaagtccctattctatgaagtcaattgaataaaaaagctagatttagaggtgatgtaaagataaaggagatcaaataactgaaaacatatattaaagagctggagatagcttcatgagttaaaagtacttgtagatttttcagaggacccaagtttgattcccagtatccacacagttgcttgtaaccatttataactccagttccaagtgatccatcaccctcaactggccccaatgtatactgcatgtatatggtatatagacatacatgtaaataaaatacacatacacaaaaaaatttaaaaggataaaaaatatcaaaatgacaatgtgtggtagacattcaagaaaaagtaacagcactattaatgttttttttttcaaatttgtaagatcttggcaatgcctctcctcacaaagaaactaacagtattatttctatccattcagatgttagatttggtgattggatataggttatcattacaaaataatcttgattcttgtatatggatatttttagcagcctgtcctttcctccataataagtaaacaatatatgggtatgcattaattttaggaaacttctatatgtaatttccttatgactttgaagaaacccttaagtattatttacccctctccatattctctccatcaatccccagattttctagccgactcctgaatttaacccgttttcttccattattttccttcaacccttatgaagttaccttaaaataggatgataatgctcttactagacagtataggctaacaaaagtctcagtgtcaggaatggcacggcttaccacttttggagttgtgggctagttgggtttaatagaccctcaaatattgagggctattgccagtgttcttgtttgccagccagaccttgacagtaagaccctcttgctgaagacactacattattgaatcactgaacacagatatatcaagctagtagtgacctgaaaatttcattcttactggaaacctttcaaggctttggaagacgccatatttactgctaatggaaaagtgaaacaattggtttttcgacctctggaccctgcacactgcaaaaatgactggcctggttatacatgagatttgatacaatactagcaggaacatcatggaattcatcattatttcctggctggatttaagtccctctccacaaaataaaacacacacacatactctctctctcactctctctctctctctctctctctctctctctctctcacacacacacacacacacacacacacacacacacacacatatcctcattgttgtagttatatttttgttactgttacgcgacaccattaacaagacagcttataaaagaagccatttcatagggtgagttgatgaccatcatgataaggagcatagaagccatggcactgagacaacagctgggagcttatatgttgaaataacaaccaccaggcaaagaaagtacaaactagaatggtgtgggcttttgaaacatcaattccacccccagttctcatccctactccaacaataacccatctactccaacaataccatagttcctaatcctcgccaaagttttttactgctgtggatctattcaaacatataagcgtctgcgggtcattttccttgcatcagaaatgcattctgtgtaccattatatgttgggaaagtaactatagcacaggtcataggcactagaagagaacctgctactatcattctgcaaaatgaatatatcaaaataataaataaaataaaaataagtaaaagaataaataatggcttggatatcattgcagaagagggcacagaaacagtgtaagagtcaaaggcagtagatgacatcattaatatctattacattgcttctaacttgaaatcatatttttgcttagtaattattgcttaccatcacaggtagacctcctattagtgcaaattagaacttacacaagcatatgctttatatattttttatgtcaataaaagtgatgcatatttagaagtgggggaatattattagccacacatttggtaaacatcattcgacagtcattctgtttatctgaaactctacatataaccaatgagatttataatgaagaatttaacttttaagctttctataaaattatttcaatctttgtcacacaatatttgagagctaatattatagaatatgcttcatgaatttatgttagaaatagttacattcccagagagattgcagataatgtatatatcatggttttcttttattttagctgtgagattagcgtttgttgggaaattgtggttagagtgaacatcagtaacttttaatgatttttaaaaatgtattttaatctagtattcatggactagtcacatgcaactttttcctctgatgtttagaaataatcctattttatgtgaatttagagaaaggaatttaaagacagtacatgttaataaggttcctttaacaattttctaatcatctgtgctttcttctgtttatggccctgtcagttttttcttttcctatctaatttcgtctacctgttcttaaagagattgccttgttagtaaaaaatgactcatttctactagtggcaagatagccttttcatccaccactatgagctagcaataatctgctaagctttcgtaaatttcactgtgaaagaacttaatttgtttccattatgagaacttttgagcactttaagttattacaactaaaaggaacataactacatctgtgctagaccgagagaattagagagattttctgccatctgagtgcccacagttacaaagagtaaataccacaatatatggattgttgcaaatgttaggatggtgcaagatcctacactggcgttagcatctgaatatcatgtgaaaatagcatacctgtttcacacaaggacatttttactgtaactaagaacatattgtatgtccaggagtaaagcagaatctaggttatggcatatacagtgtggaactgaatctagaagatcaatgactaaaagaggatccatgtcaaagtggtatccaagcatacaagaaaattggtcagaattcatagtaagcaaggggaattggtagagcaatatgccagcaatatgatctattagtgtaaaaatagagtaggtattttcctagggtctcaggttcttagtttcatcaacaagtgtcagctatgaggtctgtctcagggaataggccttaagcccatttttacaaatttgtcagttacttctataacactcatgaccctactgcaggactgggcacagtttgtagacagacctttattgtagcttgcagtttcacggccaagtgagattcgtgattccttttctcctctggtggcatctataatgcctttcagtgctataaatgctatctagtaagggtgaagctaccgtaagttgagtatcagctagatttttccacatttaatcaattaagtacgtggaatcttcagcaataggctcttttccttacgttgtggaaggcaattaatagcattggcaatggcttataatttttttggagaagggttctctgggattcttttgacctatgactcaaaaggatgtaacaattcctcatattggaggttttatttgctaggatatgctgcttagttgggcttttgttcctctcttatgtggtaaatctacttaaatggtctatctatctatctatctatctacctaccaaccttttctacagtagtagattgccatgtagcttttcaaaaagagtttattgttagctatctctcctcatcctctctcctctaccctatactcacattctagtatgttatttatcttattataatactatatcatatttccttttccttgagagagtgtttttttttacttcatttttctgcaataaatccattcattcacttagctatagacttttatttggatttctagtcatcatttagttttatgacattgaccactatactgatattgccaaggacagtgatgctatttctgcaaaatattgagtagtctaataaacaaactatatttctctatgaagtaaagtcaaatatagaccccagtgagtgtaaaaggtgaagaaatagattttaaagtgtactaagtatgttattaattactattgatatgagtataactctttatatgtattagaggattacttatggcagtttttcctggtatttctgttgcaattagttaaaaaataaagtgagaagtacatgtgaaaattaatagtgaatagaatatagagaggtttttggccacttgctaggatactatgcataaatcatttactagtatgatagaatcttgataactgctcaaaagattaactgttctgcaaccattgttatcatcatcctaccatcctcgaagtatcaaatactaaaaccaatgttgttaaaataaaggataaaaggaacttgctgtttctactagaaggccattggccagcaattgtcttagatacgatcttttgtatgtcttacagtagaaaaccattttctttctgaaccctaaagtctttagattatataaggggagtatatcactgataatccaagtattggataactttccattaagctatgctataaaatgtacctatgtggatttcatctaataaatctggggcctcattcaaagatgcctaaacactcattttagatcatacccacacaaagagaaaaatggtcaacctagcatgtttatctctcttaatttctgtcacttatggaacactatgaatgattaattataaagttatacattgactttgttggacctctaaataatcctaacttccaggtatatcaggtttcacggatttcctatgtacccaaatttgcccaaagcagaaatatttttgtacaaaatgttatgctgggcttctttaagttttatgaactttgatgtttcttatggataatctccataatctccactcaaaatgctcaattgtgtgtacctttcagaataagaataactgcgacaaatccaggtccgtaggaaaattaattttaagccagatggagctaaatttgccttatggatttatcttccctgcaaattaattcatttttcatttaaaaataaaatgatagtaaaagaccgttctttcttgtttctctagtaattgctcaccatttgtactgaatcattctcagcctctcattcagtccccaaagggaagtagccagatgccttctacttgacaaatctctggtcccacgttttaataaccttgatgtttgttgaaatccatacaaacaaaaataattgaaaaaaaatcattgtattagtaaggattctctatagcacagaacttagagaatgaatctgtgtgtgtgtgtgtgtgtgtgtgtgtgtgtgtgtgtgtgtgtgtgtgtgattcattggaatgataggtgcagtttatctaatccgaaaatgtttcactgagaatggaaagtccaagaatctagtagctgctcagtcctacaagactggatgtcttagctggtcttctgtatatgctggaatcccaaagaagcagacgccaatgccagagaagtaatggatgtgctagcaaggtgagagccagtaggcaaagagtgaaagcctccttttttcatgtcttttcattccagcagaaaatgtggcccagattaaaagcataccttctgtcctcaaattcatgatcaaaggtgtgtatcttatacctctcaaagatctgaaacagaagtagattcacccacttccaaccaagcaaatcccaggtgtgttttccttttctggattgtagttcattccagatatagtcatattaacagtattaacagttcatcataattatcaatatggattttaaccttttgaaacctagtgggactttttaaaaattggatattttctttatttacatttcaaatgttttcccatgtccaggcctttattggacctctaaataatcctaaacttttaatttcagggcagaaaaattttgccatcctgagacttagacttttgaccctactgggcagctaaattagtaagaaaaacagcaacctcttactctcactagatgttaggaacttcttactaaaaatgtaaggaactgcaacaagtacatgtttagatcattgtatcataaaaactgtcttttatagaaaagtgaatgcatgagaacatgagacatgacatgctaaaacagaatttatgagggaattaatcatttgtgttaaacaaaacaatttaggatttaaagcaagcagagcaagataaataatacaacttagaagaaataccacactggatcgacttaaaatattttttctctgtgcttctgaaagtttacttctttcaaatctctgtcaaaatgtcatttcattaacaagttatactccttctaatatgctataatccctaattgtggctgttttttttataacaacaattactatttcagtgcaacattgtattttacttggttgtttatgttttgcacgcctttcttttcccttgcaggataaaagatccttgggaacaaattcttgtttgtttgtttgtttgttcgttttttgcatgccatctttccagaataccggctggcacataatggatgattaatttatttttattgactgagtagatgaatgaccataaagaaattactgtaagcttaagctgacttaaaagttcaatttggaattattaattaaaattaaatccaattaagtataatataaatcacataggttcaaagtaaattattttataatatacaagctctagtctttttctttattcacaaaaatattaggtattattttctaaagaaataagtcttaatgttaacaattaatgatagctaagttaattgatttttaggtaataatgcctaatttattttctcttctcataccatcaatcaatataatgaaccctgtcattgataacaggacaacttagtagtattttggtggttaattttaggtttttggttttgttctgagaagttgtgaaatatttttgagaatttaataaaaatagatcagccaccatcagatatactttctcctgtagtagatgggaactaatatagagacctgcaactgagaattttcagagagtgagagattttgaaacactcagtcttaaaatgggatgttttcatcctacccctgatctcaggattcaggcaattgtgcagaagaggaggtagaaagattgtaaaagccagatgagatggatgatccagggaaacagtgctttccagacacatctggactaatgcacagtcatagagactgtggcagcatgcacaggacctgttcaggttccagccagattgggtcattggacaaagagggtgaagttgacatgagctcccacccctaaccaagaagctttctccaattgacatttgctcacaaagaaaattaactttcctcaatagcatctaacggggtatattaacctgatttacgggtagacccaggcccaattaaaatcctggtttgtttgtttttctatgcttttttgtttcctaaggagagaaaggaaagttatagagttgagtgtatggggaagtgaagataatctgaggagagttgggggaaaagaaatgtgaaaaaaatttcaataaaactaaactaaaatattttctagttccatccatttgcttgcaaaactcaagatgtccttgttcttaattgctgagtagtattccattgtgtaaatgaaccacattttctgtatctattcttctgtcatgggacatctaggttgtttccagcttctggctatcacaaatgaggctgctatgaacatagtggaccacgtgcccctgtggcatggtggggcatcttttgggtgtattcccaaaagtggtataactgggtcttaggtaggtctatttccaaatttttgaggaacgtccagattaatttccagagtggttgtaccagtttgcaatcccactagcaatggaggagtgtttctctttctccatatcctctccaacatgtgttgtcacttgaggttttgaacttagccattctgattggtataaggtgcaatctcagggttgttttgatttgcatttcagatggaattgcagaggagtttgagaaaaacaagattcagtggcaggcccaaagtgcaattcagctcaaggggaggtcccaagtcctgaaactattactcacaaaaaggaacctataatgactgccctctgaaagacccagtaagcagctaaaagagtcagatgcagatatttgtacccaaccaatggacagaagcagccaatccctgttgaattagggaaggctgaaagaagctgaggagaagggtgatcctgtaggagaaccagcagtctcaattaatctggacccccaagatcgctcaagcactggaccaccaaccaggcagagcatacaccaggtgataggagccccccaacatacatacagtagaggacttctgggtctgtgttcattcagagattatatacctaacctcaagagactggaggctccagggagttcagaggtcaggtggggtggggggtagctccatccaagtggaggcagggagtggggaggaggcatgggatgtggagcagtcagagggtggatggggtggggtggggaatgaaatatggagtgtaaaaaataaatcaattttaaaaactaaaaaaagtagctacaaaaactggacaagtgaatttagagcatgaatatgtggacatttttaaatacccaactgcctctggaagtaaatcttaaaatgtttatttgagatgtgatagaatgttaccagagataactttttatagagcctgcattttctaatatgtaatctcatgataacattttctgtcctttactttctcaaaattactgttacatatcagaattcccttgtccaacacaaagtataatttaaatacaaagggccatatgatgatggtaataaaaagttttatttgcctagtgattattctcttagagttaagagattttacttgaaattatatgttattgtcaaatgcttaacatggaaaaaatagtgaacaacatatgttagtattaaaagaagcgcaacatcactgtacattggatgtactttctaacaatgaggtaatcagtgccaacttctgagtgagataaagaaacatgatagcttaaaagacactgaactttcctctttgggaggttattgatttcattaacacaaatgcaaactaaatttcaaaatgtccaagtttaggttgaaatcatgaggcagatgggaaatgttttattgcattttggatggtataagaagtttgatactcatcctagaagcttagacaaacttcctagtcataaactggctgattggcatgcgttagtgtgcttctgaatctgcctgcagaaaaatagtatcatgtgacaggtcaagttgctgctatcttagaatttattatgcattttgaaaatccttcaaggtttagaatacaagctaaaaacaaagatctatgaaaccagaacctcaatcaaagtagattatgactaaagtattatctacaaggctaaggtactaaggaaaaattctagcatatggccagtgatatcagatacttccaagatgctcatccatatgacatactctcctacttggttttgaagctcactgtcttttgactgcctatggacacatttcaagtagctgatccagtgtacataggaaatacctgtcatggggggaatttcaattttgtcatgtcttgatgattggaaacactttcaaataacagataaccattctaggagaaacatatgaattttgggtatattacaaggttcccattgcattgtccgaataaatatgacttactgaaaattatcttcagtagtgtaatatcctcttttagaactctaaaaacaattcatggcttagccaggaaattctgccatacaaaatactatataatagatgacttcattaaattaaatttatgttgtgttctgaaatctagaagtgaaaatttaactttctgttccattcaattttcaagaggaaggaagggttcttttttgtctcagggcaaatgctttctcaataccttcatgtattttttcttcttgggaagggtattgacaaatagtgattaaaggggcttggcatttgttgagaatctagtaatccctcagattagggacccacctttattacttcagttacattttatgagacccatcttcaaaaagttcactgtgggagctaggacttttacataagaatttcccagaccacaaatgctcaacctacaacaaacaccaagaataccaccatactaacatttatagtggttacttttctttgaacagttttgtaaatatgatagagtgatagagactttaagcgaatattttcagtattacttaagtcaaatattccatgaattgaatttattatgttcccattaattccaccaacagaagctcttttcaatgcagttatttaaaacccaagtcttaatatcttgtgggtcttgcctcctatgagcctttatatacttcatttaccagttgactaagtgccttagtaaggatttctattgctctgagagataccatggccatagcacctcgtgtacaggaaaacatttcattgtacctggccttacaatttcagaggttttgcccattatcatcatggcagtaaacttatagtatgcaggcagacactgtgctggagaaggatctgagagtgctacatgttgatcctccatcagaaaaggagactatgaggtgcactgggcataacttgagcatatgagacctcaaagacctgccccatagtggtatacttcctacagcaaggccacacttcttaatagttccactccttatggaccaagcattcaagcacatgaatctatattggccattcaaactaccacattaagtaaataaagtgagggtggcacatgggaacaatttataattcatcattaaaataatacttgatgaatttttattagtaataacttaattcaggactgtaactaattattgagaaatacagccactgtatatattgaacaagagataaataggggaatacaaatactcatgagaattagctgttttctcaaaccctcttgtaatcatcaaagcaaacaaatgatgtgggtgtgatcactgtctgtggggaaatgggctatgcacagatagcctggtctccagagttgaggttttgaaccacggtgcaaccccatgggtggtaatttccacctacatgggacagaaggctttcaatcatgtctcctgaacccctggctcctgtcaaagttactgcccccacagcccccacaagagaggcctgtggctagtagtcacatagataatgccccaagcttctggcattctggctagactcctccccacagttatctagcaataataagagagcaaagcccactattatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaaagaggggctgcttgtcccatcctcactctctttaagctttcttactctctagccctccttctctctctctttcccttcccatctctctctctctctctctctctctctctctctctctctctctctctctctctctctctctcagcttttacctctcttactctctagcctttcctctctctctcccctccccccttctctccacgtggccatagccagcctctccctttctctttctaccttctctctttcccccctgcctttctacaataaagctctaaaaccagattatctgtgatcatcaaggccagccatgcttgaactctgggatagactttctcctaaccccatgtctaacctccggacagaaggccttcctaagctgcagctagggaccagactaaggactctcacctgcatgggaaccaccccagtgccccactccctctgcccctcttcccttatctctggagcccagtgcctcccaggggccactattgtgttctcagtttctctgctgtatccagcatgggatgctggagactaagcacttggtacctggggctgccccttgtctaccacctgccatgtggggtcagtggcttaacacagccagatgaccacctgaagctgtgtagaaagtgtctggcagtcctcctggtctgcctgcccagagcactcccctctttcccacactcccacggtcccgcaattgtccatattctattaattaaaagtagggattatgttcaataaaagtttactggtaatctggatttgtagatttagcactataagtagctgagctgttctacgtgagccatgatattatttcactatgtattaatgttttgaaatgtttgactcttttcaaaaatgccttaacaaagtccatcaagtaatagatcaaagattttctttcacctttgtttttattctaaaggaacaagagagacaaataggaaaagtatcatgggggaaagagagaagagaaaagaaaatagtggcattttatgaaggatttgatgatgtttattaaactatgtgctatcttacatgtattttctaatagcaatttgttcaccattagggctctttcctacagtggcagtaactatacaggacctttgaatgattttatgttacaattatagtgttaatgatagggagttttaatataatagactcttcacaaaagagtgaagagagatatcatatatataccttttttagaattcaagtaagtctgtccatattggatacatgttggaaggacacaaactaggacctgacttcccaaagaggccctgaagtaatccaatataggaaagatgggagaaatgccttttcttcttgctaaatagttacagaattgaataataattattataggcttctacatgtttgttacatcctagacaatcttaaagacacctagaccagatttcctatccattgtactccattaaaatagtatattgattggtttaaatttttaacaaacatctcttttctgttctgtatcagttgaatacttcttttcttttggtacatatcataatagtagcatagctaggttgtactaacaaaccacagtatgtgaaaaaccacagtatatgaaagtacaggcttctaaaagtttccttcctatcaatcacatttggctcataaaatgtgaacatttatcaaaggtggtttaattcagaattagtaaaccactagaaggaattgtctataaaagaaaactgttctaatttattaagccaaatgtctccaatactataatactcctggtaggctttcaagctggtgacagacagaatgtgtcaatgagtttaaatgttttctttctatattaaggaaagcagcattctgagatgctagtagcacactttatcttgaaactgagaatgaagggttagagaacagttgaatgacttagtactttgttaaaaatcaagtcaggtttgtggcatgtgcataaatatgggcctaagcaagagttcctgaataatggtatttatcaggctttgttgataataacagtaatagcataataggtaaataaaaatattatacaagtcaaatctgccttaccaatccaaaacatcctataatctgagaaagcactgcaatcagacttgtagaactgaattagagatgtgtgggtattaaaatacccacatccaatccatttccacatgtaccatctgttgtttccagatgcactgcttcctagaggcagtattcatgaccatggtattataacactaacaaaccggcattcctagttctgggacttaatttccagaaatacaagttttcattggctagacttaggggaattagagtcttctgtggctggggacgtgccattacaatcatggtaacggaaatagaccaatacagagcttaaaaggcttcagggagctttcaaattgggagcagtacaaagtttctctgatgtgtctgtaacttaagataagtttagaagcactattaatgctcttcccttggtggatagatatgcctagttcattgtagataaggcgttagaggtacctgttctatgtaacttgtgataagggaagttagaaaatgctccaaagactcttgagtatatgcttcaagccacatatatagtccagcaccttcatctggtgctgtctgtaaagcaatgggctgtcacctccctcaagaccactgcttgcctcattaataccactggaacaaattatcacttcacagcccagaaatcttctatagcagttgtggtgattgatgtaacaaggctaaaaaataatgatgaaatgcatgttccagaagacagattcaaatggcaggagcttcaaaggcaattaaatgtgacacagaaggagtcttcatggaataaagtattttcaaataaatggtaagataagtgtgataatctcctagactcgcattacacataaattagtttcctatgaataattatttctgaaggcttactatgtgttgaagtaaaagcttaaaaacagacactttgatgcatatacatactacggttttaagatggtgtggggagcagtgttgtggcactgaaaaacttggctggacttgaatttatttttagccagacactttgaataacatcttttgttatgttgaaaggtgtcttgtttgttggaaagtaaagaatcatgactacagatgtcaagtttaactgctttcctccgaagcaagttaagcgatttcattctttcttttttcttttttcttttttctttttctttttctttttctttttctttttctttttcttttcttttctttcttcctttctttcttcctttctttctttctttctttctttttttttttttttgagacagggtttctctgtttagccctggctgtcctggaactcactttgtagaccagactggcctccaactcagaaatcctcctgcctctgcctcccaagtgctgggattaaaggcatgtgtcaccaccacccggccagttaagcaatttcttatgatgtattcattctttcctgctacatttctgtgttgtgggaggaacctgtctaatcaaaacataagacaggcacatcaaggttaatacaacatagaaacttaagacatggaagtaactgaaacaacttgacaagtttaaaactttctgacatatgctggcaaaggcagagtggggggaggggcaagtatgcaattatatgcatccagtggagttaaaacaaataaagtctggacattaattgtagaaaagatgaagctcaagctgccatgttgaatctataagtactactcccttcatgtcttgaaattagaacacagggcaagtaagcagaggattggctcagatgcaggaggatgtagcaagacagattcttttaataaatctgaagacttttttgtaaatcatgtctgagttgcatataagctaagtagaaccttcactgcagtatttaatattttctctttggcaattaatggtgacaaaatctgataaatgtatttaaagtatgaatgtgagttgttctaattctgaattttcttgataaaacttcatggaatactagtacaccttggtagcgcttttgtcaattttacaataggttgcccagtctttttaatgaaatgattaaattattcagatctttttctaattatacagaccaccattaacatacttgtttactctgagaaggttgaagtgtccttttgaaataaaaattaaaggccattttgacctagttttaaaacaagcaacagatacttgggtagtttataggatgcacaaagaaatatttgccaactatcaaaagaaacaaagacgtctatttgaggatgactgcctttcacaaggttagtcactgaatcaagaaacttgtcttataatttttcaattgacttaacttcttaaaaattgagttgcaacttaagaaatctgcaaattacttacctgtcttcctaattggttggaaattctgaaaatgtgatgttcgtcttatacatatggctagtatgacagctgcttaaaatagaaaaacagtaaaataaccgtgcttttatgacacatttatagtttggcaataaaagctccttcctaaactcattctcccatcacagcaccctggtgatttgtgtaattattattttatctacccttttaagcaatggaatagacaaaatatgaactaatgaaccaggattcattttatattttaaccattatttaacacatgcacagtaacagtcatttttaaggaaaactaattcttttggtccaatacaaatattatgctactaaatcttggatcctgtaccaagtgataaataataaagtatacttttacaatcatggctttaaacaactttaattgttgacttatattagaccattaaaatgtctagaaaagcctttttaactgaatacttggaattccaagttaattttataataatatattaataatggaaaagacacttgcatgtactgagtgcctcctagaaacaaacacaaccacaaacaaacttatttaacagcaaattcacaatattgtgcagtatttatttttctcaccaattttatgaagaaaggatattcagccttagagatatttagtatctcttttactgtcacaccagctttgcagtgtcagaaccaatattaattgtgaatctgcatagtcctaacaaccatattccatagctttttaataaatgggaaatatatttgaagacaatttctaattcaaaatatatagggataactcaacaagacaaatgcagtcattctacttcttaaattgtacccaagacatttgaatgcattaaatgcataatgatatgaaaatttagagaattatgtttattacattaattctgtttgatatgacttcataatgattttatataagaacacttacatattatttaatagaaatatgagggaaagataggttagttcaacctacacattcaaaagattattaaagctgtggtttctactgttaaaaaaccctcatatataaatcaagtcagtgccaaaatagaaaaatgatatggactcataactaaactatctgttgctagctataagggctaataaagacattcttgtatgaattactctgtaaaagagggcttaaattaagtatcaaaagttgtgaaatgttctttagactttaagttataatgcaatcaattatttcaccgtgattcagtatttacctatttctgttgcagccaaagtccaatcactgtgaaaagcaactatatgattctattctacatgggtagaaaatattgcagcataattatagtccttttatttttatactaaacatttctgaacacttaaattattttaagattttcattttcaatccaattttctttgcagaatatagaaaagataaacccagaagttactcagttatttactacaaactttaaatttcccaaaaagtcaagatagataaataaggctctattttgccaataagtcttcaatgagtagttttcataatcctttaagtatatgtgacctgatagatttttctagactttttctgagtctattattttataatctatggaataagatactatttccctggccttcaattattaaaggaatataaagtgtagaaaaataatagtactagtactattattattaaatattaagtatagaacaagtcataattataatagtattttactagtcaatagtatcaaactgctcttgaaatgtgttgtatatacaattcaacactctatttacttatttttgaaaaattcatacatacatacaacatatcttggtcatatcctccccccccactctgttcatctccctttactcatctccatttcatatcatttaaaaatttgacttaatatctcatgatctgcccatgatattgattttaaaaagtaagattttagatttcacttgggttgtatcagttccatttgacaacaatggtattaacataatactctctcttttactagtattataaagacaatgaatcataattaaaagacatcaagcatttatttcccttttaattatcttcacttctttaagatatttgtagcttaaaaaaagtagaataacctgattaaatttattcatccaaatcacaaggaattctagattatttccttttcaattctgggagaacttaagccatctgttgccttgaagcagagagatttagtaatcaggcacagcagtaagaagatatttgtctagggatgctattaattaacaaacttggaaagcattctgcatttcttaccttaaagtcaaacacccctcacaagtacattggacaattagattagaaaacccggtctgggtcagatgctccttatgctccaacaggaaaataactcaatggaaagggctaaatccataaagatagcataaaatgcagtaaatgataagaattgcgaggctccaaatatatgtatatttagaaaccttcagttattctaaatgactatgttctttcataatccatttttcttctcttagaaagacctattctagtgttctttgtacttaatgccaaaattttaaactggaaaatctgaacatgaaattttgagaaaacttgaacattaaaaaaaaattctcatttaaaataaattgtattttggtataattactttgcaacaaatgcgctcattttaaagtacatgtactaaagtgatttgaccaatgcacatctacagaaacattactaagatttatgtcatagaatgttccatcaccacttcagatgttcctacactttttggagtcaattgtcaccatccccttcctgaaggaaacacctaactactttctttcaccccaaagattatcttcatctcttctggcgtttcattccagaagagaaatacttgtattcttctttttgtatgatttatttcactaagaacatggtattgtgttatggtttattttctatttcattgtaatagtcaataatatcaacaatttgggtgtgtttgtttgcttgtttttgttttctgttgttgattttttgacacaaggtttcgctgtgtagccctggctatcatgaaactcactttgtagaccagactggcctcaaactcacagagatccacctgcctctgcttcctgagttctgggattaaaggcatgcgccaccatgcctaactgatagtttcaatcttttttttttttattaaagtattttatttgtttacattacaaatgctgccccctttcctggggcaccatccctgagttcttcaccccccatccgccatactccacctcggagagggtgctcctataccctcccacccaccctcacctcacctatgatagaagttctaaggactacatgttgttagttttgttctttagtctttgttttactaaggactaatggtgttcaggatcattttttgagacatacacagtattgatatgcaaagtatttgtgccatgcaaagtatttgcaccataggctggctttgaaatcaccattctccattttcaagcgcctgagcactgtttttgtttgtttgtttgtttttgttgtttgtttggtttttgttttttttttctcccattttagttctcaagagagggtttctctgagtagctctggctgtcctagaactcttccctataaaccaagctgggtacaacctcacagagatttgcctgcctctgcctcccaagtgctgggtttaaaggcatactacaccacgtgcagtctgaggctgttttaaaggtatggttcatatgtttttatatgtgtattgaccatttttgcttttagttacatattggttcttcaaatcttctgcctagttctttttaattaggtatttagctcatttacatttccaatgctataccaaaagtcccccatacccacccacccccactcccctacccacccactccccctttttggccctggcattcccctgtactggggcatataaagtttacgtgtccaatgggcctctctttccagtgatggccgactaggccatcttttgatacatatgcctagttttaatgctcactcttctcttttgttattagtggcttacaaatgtcctttaaatattctatatactaatgtccttcccacgctaaagtcacatgaaagctgctttcatattttgtagctaatcttatgaatttttgggatagatgctttggaagccttaacaaacatttgatcttgaagttcagcttagcagttttatcactgattgttgatgggctttgtttccatcttatttttatatctgccaatatcatgacagttttctcccgtgctttcctcaaggagttttacattttggtctgtagtatattttgagggttttttggcatattatgcgaggtaagtgctgaattgcaattttgccatatggttatccagttgtgctggtatcatttacataaatatgctttgtatcgaattttacttttgattgttattttaacatcatttgaacatatatttgaatatatatgagtgtattttagggttctctacattgtttccttaatctatacatctgtataattacgccagtattatactgtcttgcctactgtagctttacagtaacttctgaaatctgtttccaaagtctcgtgttctgaagttcgctgtaaatcatagcacttggaggaagaagaagaaagagtgccatgattttgaagccagtctgatctgcacaatgagtccctctctacaaaaacaaaatacaaactaaccaaaacaaagattccccccaatttctttttattttcaaagacatttaactatttgaaataatttgcattttcatatgatttttaaaaatgagttctgaggtttcaacttggtttacttagaatttatggatcattttgagcagaattgcaatattaacatctttaatattatttataatctactactatggcatattttccacatcttaggccttttattgtgttcaataatggttttagttttacagtgtgcacatcattttcttctgttaaatttacacttatgtattagattaaacttcaaaaaggggatttgaaaaggagagagaagaatttatctgcaatctttgttaggtaaatatgttactattatctggtatacaaaacatgagtttttagttttataagatacacaattgtaagcaaatgtgactctataaacaagacattgaataatggagctgacgaaagtttattctaaaagcacctaattggagagggtaagggcaggcatgtccttaggttatggctgaattggaggccttcaaatttactttcttacaacaggtggtataaataatcgaataaatattttaatgacagttatttacttattttgtggggtataaacacatgacagaatatatatggaccacaaaggacatcttgtaggatgatgtcctcttttccttctgtataaatcctagggattgaactcaggtccccaagatgatagccaacaagtttactgactaaactatcttgttagttgtttagttgttgttgttgttgttttaattttttaagtaaatatatttaaaattgttttatttattcacattcctaatgtttgcccacttcccaatcctccttctaagagttcttcacccccatccttccccctttcatctgtttttatacttgggaattatgggcacaatatatgctaaaactttgtgaaacttgtaaaatggaattgatttgagtttaggaccttgtgtatgttagaaaaacactctgtcaatattcccaagctctcatggagccattatcatttcttttttactcttaaaatggaacgtaattgatatataccaattagtgtagtgtagctcagtcactaatcgtactgactctgagctagactccttagatttaaaatgtgacacattcctttgctgattatatctttttgaatggtccttaccttaccatacatcagttatttttagaatgcagtgttgacacttaacatctgatattaatatgaagagaaattaatactgtgaatattaactatctcagtataaagcacacagtgaaacagtcaataagtgtttgcaaaagtcactgctatcattacatctccgatattctcctcactttctcaacctcttgaaattaccttggtatgctttgctttcactactgcccttttgagctatattcataaaattcataggtatgtcaattgtagtatacctcttaaattcttatcattgtaacaatattgtaaatggtataattagcaaactaatccagccaaaccacacaaatctattaaatatattgccagactgattattctttaactcaatgactgtataatagcatgttcaactactcagcaaacatttattgagtacataccacatgtaaagcataattaaatgcttagatcagtgaacaaagctgaaattcggtgcttgaaaaacttatgttctacaaacaacagtcattcttcacagctgtcttccatccatctgctcaaatttaaggcagagccacaggtctttggatggcccttaagaagtcttcaccataaggtcaaaagaaagataacaaataattgataaacagctatatatgctttcttgtctttagctttgtctctagagaaaaaagttggtgctaagaacctagcgttagagccgggcatggtggcgcacacctttaatcccagcactcgggaggcagaggcaggcagatttctgggtttgaggccagcctggtctacaaagtgagttccaggacagccagggctatacagagaaaccctgtctcaaaaaaccaaaccaaaccaaaacaaaacaaaacaaaacaaaacaaaagaacctggcattaggttgtaggtgtctccctctcactccccctccccctcccccactctctctttcctgctgtgtatgtgtattgtgtgttataaagagtacatacatcaagaacatgatttaaattcaagcttgtccatttaccaccttttaacttttggcaagttaattaaccattctaaatttttgcttcttcaagtcagcattaataaaagcactatatgtacatagttattgctactaatggatgaggatgaatgtaaggtccttactagcagacttacataaaagttttcctatgcattaattccattttttctcttcgggtctcctaaaattgacttggttctcaataaatacttaatgcacattgtctttcccaagtcagaagtatgtatgtgtgtgtgtgtgtatatatatatatatatatatatatatatatatatatatatatatgcattatgctatttcccaaaactatcttctgtatcacattgtactcagtcatacaacattcaatggctccttattacctcctatgatacattaaaattgtctaatactagtagtggtctctaaatatcagcctatttcttctcaaccatccaacataaatatttcatatgaacccagttactcaatattagtgtttctttagtaggcctgaaaactgactagtttctaatgagtgagaggaatttgattttgacagtggcaggggtgcaggaggttaatggtacgagtgctgatagtctttcatatatgggagtgccggatcactagaaatatgtccattttccctctaatctccttcctgttaaactatactttcattatgcattaaattagcatgtaaatgtttgtttttaatcaatcagttagttactaggcactaactctgtgtaagaaattttcctaggaatgaaaaccataataatcattttgttaaagacttaaataaaagaggagacactgtgaatacaagtgtgtgtgtgtgtgtgtgtgtgtgtgtgtgtgtgtgtatctgtcaaatggaaatgtaagaaattaatgtaggctatttactgggaaggtgacagttgagtgttatcttgaaatatttggcactttttagtgaatgtgaacattgaataatattaagagaaggaagacatttgaaatgggggaaacagaagatgcaaaaagataaagtgggaaaagtttgatttattcagtgaaacacagaaaaacatgcaataaggctgtaccacagggtgtgaatagtgagagaatacaaaacaatgaaaaatcatgtttagagttttaattaaaaccaatgtggagattatatcacagcaaattgtgattatcatttattcaacacctactatatgtaagggactatgtaaaatgttgtctgtgccttgtaaaaagctttataccattcatataagatgtattttatgtataaggaaactaagtcaatgtttaattacccaagttatcatttgagaatggcagagagaggattcaggctagaaatataagatcacagaatggggatccatcccatatagtcaccaaattcacacactattgtggatgccaacaagagcttgttgacaggagcctgatatagctgtctcctgagaggctctgccagtgcctgacaaatacagaagcagatgttcatagccaatcattggactgagcacaaggtccccaatggtggacctagagaaaggaccaaagatctgaaagagcttgcagccctataggaggaaccacaatatgaaccatccagaacccctgagctcccagggattaaaccaccagccaaagagtacacatggagggacacatggctctagctgcatatgtaggagaggatggccttgttggacatcaatgggagaagaagcccttggtcctgtgaaggcttgatgccctagtgtaggggaatgccaggctagaaagtgggagtgggtgggttggtgagcagggggaggaggagaaggggtagggggtttttcggaatggaaaccaggaaagggatacatttgaaatgtaaataaagaaaatatctaataaaaaaatcacagacttaagaaatatgattgaatgatatatgacaggcagtaagattgtgatagaatataagacaaccgcgaggaatatagtattaaggtggtttgcatttattaaagaagagcatataggcattagcatataggccatagttgagtatatatggctgtggaccaatttataaagataaaagaagattgtaccaaagatggagttcagcttccactgagaatttctagaattttacttgctaaataatacaagatccttagagttacatgcagatttgtaaaaatcccttttcatttctattggattattagccacttgaggacattaatttctacaaattaatcacatttatcagatattcctacacatagtataaatacatctttaactttttaaattatttatttgtggggtgtgatggtgaatggcatatatatgtgggttaatggacaacttgtcagagttggttttttccttctatcattttggtcttagggctcaaactccagtcatcaagattaatgacaagtgtcatcaccgtctgtgctgtcttgtatatcctcaattcattctgttttatttctctacagaatttatagaatgttgttagggatagagctgtaagacggctctaattaggatctttctgtttgtttcttttaggagcgagattttgaactatgtactggagtcaatgaatactagaagaaagtgcctactttgctccagtataaccaagagctaggatgctttatagcacttaaatgtgacaacataattatataaaaggttcaccaataattatatcaacggttcaaagacgttttattctcagacttagtttttgataaaattagatgtacgacaagataattttttttcaatttgaccttcttcattctaaattaaacctcctatcatagtaaataaaccaactgtcattaattttacattttacatcatatatgacatatatgtataatttatatacatatattatgtacgtatataaatataaaatacatataaatatgcattacaactgtgtatctgaacaattttttattattctaggatttgagaagacatggggctctaaataaaagctgagtactgtttcattgttgctaagagacaaaatcaatacttgattactctgaattagtatatccagccatgcaaatctttaacctcagattaactaaatgtaagaccacgacccaacccacaacaggaacatttagaagtagagcattagctggtgcagagcctatttgtaaagtgtgggtttgcactgctgcccaaaccagtttccccaccattattctctccagaggagctgcagaattatgccagcagaattttaactaattggcatttctgcgatccttccctgtatccctacttctattgttcatttcatgatacacttataaatgaggccaatctaccctcagctgtaccatgtcatattaaaaatacttccgtttgtccatattttaaattatttttatgaaagtcacaacagttggcctatccatatattttataaaggagaaaatatatgtaagcaaatcagatcatttcaaataatgatctagccaataaagacaacaaaaaatactataatgaaattactagtaaagaaagtgaccatgggtacctgaggaaaacactagaattcccataaagaaagctttctttgaagagctggcatttgagctgaaacatgtattgtggaaaatacttgatcaagcaaggataaggatttcagacaagagaattagcaaagtgtcgctagaatgtatgaaatatagtaagctttagggaggaatataaggttagaaatgggagaagcagtggaactagagcttgtattaaaagtctggcctctggcagccccaacaaactaagcttattccttgtcttgataggataattaaatacacagtaatggtaaaaagcagaaaaggagttattttatgaggccacatgtgtaagagaaacaaatgaaaggttacaataatgtcatgttcattttattttttgtttttttgatgtgaactttaggctttaataacagaagaattgaggtaaaaggtcaaatgtatacataaattaaaagtcctgctttagaagtggcctcaatattcattgtcattacttttatcctgtaaggtggattgaaagtctttattgcctgagggattcttagaagcgataatcaaacacaaaataaagacagaaattcagattttcatcttgtttttagttatcatggacacccaagtgggggactcaatgcttctctttcaaaagtgttttctaaatacctgtataagtatggggaaaatggattcctcagagcttaatggattatgccattaaagatagtgataagttgcatttactattctaggttctgaaatttaccttagtgaatcattgtttcttcagtgtcacttcttcctatagtaaatggtgtttgcttttcatcctcctacaagagtaactggaggtgcattgctttagacccatcattttcatgttcttgttgctcctctccaattttaaatttctctctcatagatttcattgcagattcatttttattctcatcaaaaagcaagtctagaattctgaaattagatcaggatactatggaccccttgaatgaaaagcagcactaattttctgatgtaggctattaggaatttttgcatcagtcttcatgagtaagagctgtgaatatagagatgtgttcccagtagatatccatcatagagggaatcaatagaggtacctgtatcatccctgatttcaacatgtatatcatgacaaactgtaaagatgatgcaagttttttatatctaaaaagctgaactaatgatcatagtttaggagaaagaagggagggaaagggatgagattggggaacaaaagagacagagagagacagagagagacagagacagagagaaagagacagagaaacgctgtcaggtgccaatgaatccttttaaaagcaattcttgaccattaactttgtctgaatgtgggaaaattgtgtatagaactatctagctctacttttgccagttctacatgttccaatcctatgtctatcaaaagatattcttaggatcaaaactaactactctgaactataatcttcagtttttaatgatgttcacatatggtatctaatgccattatgaaaccattgtaatgccattatgaaatctggtgtgttttagcatgttaaggattaagctgaatcctgtagtacaagatcccgggaaaatatctatttaaaacatagggggaaaagtgaacatcttggaaagatatccaacagaatttttataaaccagctataaaaataaataatgtagcatttatcattactgcagacagaggttggattaggttaaagttagtacttaaaaaaaaaaactatataaatctggttttagtgtgaataaattacctgatttctttagtggactatgtgatacctttgggaatgaaagtaaatggatccttcagatgaaggtaagaaatgttttaattaaaagtaggtccattgtttcatacaataaactatatgacaaggtgaatccagaattctatgaaagcattttcaatagcctgcttggactgtggatttaggagtttaacctctttccataggctttaacataactgttgtaaaatgatcatgtagaagtagttggcatatctgtcgtcacaaatatttgtagcttactttaatttttaataagttaatatgtgtgatttttaaagaccgtatatgtttaaaatctattttattgcttaaaacatttaagatttattgatttttattttatgtggataggttcagtgcctctgtatatgtctgcagtgcatgtgcttgtagtggccagaggccagaatacaaatcccatggaacaacagttccagagaccttgaactatcatatggatgctgtcctctgcaagagcagcaagtgctgttatccagtgatcaccttgatagcctgtgtacaaaacttttcaatctttttgtttattagatattttctttttcttacatttcaaatgttatcccctttcctggtttcccctccgaaaatcccctatcccctccccaatccccctgctcaccaacccacccactcctgcttcctggccctggcattcctctacactggggcataaagccttcacaggaccaagggcctctcatcccattgatgacctactagtccatcctctgctacatatgcagctgaagccattagtcccttcatgtgtactccttcattggtggtttagtcccagggagccctggggggtactggttggttcatattattgttcctcctatggagctgtgaaacccttcagctccttgggtactttctctagctccttcattggggactttgtgcttagtccaatggatggctgtgagcatctacttctccacaagctattgctgtcctacaaacttaccctaagacccaccaaataatttccctcctgactttatgtcctttttactgaaaaagtctaatgaaaaagttcaagaaatgttctcttctgagagacatgcactaaagtggcaggaattgcagcaagatttctttctttcttaacttcttcactctcttcttttttttgtgaatgttattatatcttacaaaatattgacagagaattagaagcattgtttaaagaagggagaatactaaaacaaatcaagtagtttccttaaaggacaaaactggtaagcaatagaatctctattcacacccatatgattctgaagtctgccttcagtttatattataggtctcgtgttgacatgaattaatttttataaactttaattactaagttatctatacttttccaaatacaccatgaattagcttttgttggaagtgccttacacttacataatgaaaacataattgacagccctcattctagaaatcaaaattttcatttttgaaaaaatgaactgcagacttctttatggcctcctttttttctgcattatgcttagttgatagcctccttaatatcatcaaccctatttgattagctttggaatagcctatccaaacaccctgtatctgttacttttctgttgttattataatatgcattgaccaatggtaacttgaagaagtgtgcatttcttttgccttaaaattacagagtgttatgtcatggtagaaaagggtagaaaagcatatcatgagcagagggtatggtgctaggtgcaaaaaactgaaagctagtatcctcaacattaagcaaggagtagacagacaatcagagaaagaataacaggaatagcatatggcttttgaaactcctaagcctgccacccaggaattcttccaacaaggtttaccccctaaactccgtcaaagatcaccaccaactgggcaccatatgttcaaatattctgagcctatgggggatactctcaacaaaacactctgtagtcataggatcttagtgaatcagagcctttaaaatgaaaaaaaaaatcatgacatgagccaaagagaactccagtcactgatcagctgtaattatatcaattaacacctgaagaattagcttcaagtgcaaaatctgcaaccagaaacatatcagacatttgtgataaaagtataacattaaactaatcaaactacctttatttaaaagattattttataatatttaatgtctgggtttttttgttttgttttgttttgttttgttttgttttttcgagacagggtttttctgtatagccctggctgtcctggaactcactctgtagaccaggctggcctcgaaataatattttatgtcaaaacctacttagatcatggaaaacctagtaaaacatgaaaagaaaactatttacagttagggttttaaatgttacaaatatacaaatttcctatttttttaaacagcatcaggtttcgttatggatggttgtgagccatcatgtggttgctgggatttgaactcaggacctttggaagagcagtcaacgctcttaactgctgaaccatctcaccagcccccaaatttcctattttgtattgttatttttgctacttcaaaaagaatattaagattcaaaattatgattttaaaataatttgagattagaattgtttttatgagcatgtttttcttatatttcaagatacttcttctcataatttcaacttcagttttcatttccaggaaatagtcttgcaagatcacctttcacctttattttttggcaactgggtatagagataggatactatgaacttgatctgacaacttaataagatataataagacctgaaatagtggcagtgccctttcaactatcaagatctagataggtacagaatcttttcaaagatctgtctaactgaattccatttaagtttccctttgaaacattaaatgtcttttcctgtttcaaactagagtgtgatcacttggaatattggctaggaacaggtcattagcaaaaactccaatgaagacaattggctttgggtttgcttttcctgtttttgcagttagcttagcaccagatggtgccctagtgagttctgtataaataatacaatcatagggttgagtgattctctaccagtcacagactcaagcagaaaatagcacttgttttcccacacatgttcatgtagatttacttattgaggaattgttcttatacagctctaactgttaaactgttgttctggttggtgttttctctctgtttgtttattggataggcaagcagccaaatccttgctctgacctagagggaagagctacagaatttgacgatcttttccagagatatccacacattatgaaatggagccggaaaacagcaaaaatgtttgcatttcccgtatcatttctaaaagagaagagtggctgtcatccccttgacagttggtgcacattagggggtcatgagtgtgtaagtggtttcctacagaaaccctggggcaacctcttacacactttcaaagtctagctcaagtgccagattctacccatgatgctcaacaatctttcacagtttgttcttccaatctagctctcctcttttgcatttatccactcatagacctctaactttcagtgtaagtcttgtcttatctacaagattgtccatttctcaaatctagtttcttctggtctgtaccacttaataaagaataggcacagaatattgatttgctggcttaacaacacatatatgtatgtcacagctaccacacagaacaacaaggacttaatgacaagtattccattgagagaacaaatgccataccctgtaacatagagattctcaatttttttctcaaattggaaaaaaaattgagactctatgctctttctttctttttattgttctgaagatttgagccacgtagtagaaagccacaaaagaaaaaaaaagttgcagtagtgcactgagagaaaatagctagagttattacaatggttcgtctattgagaaaagcccataattgtagtttgaaataaaaaaaaaactatgtttcctattgtcatatgagttcattaaattaatccatgccatggtctttgtagatgacaatttagaattatatttccaaattattatttgttgcatacaaatgttttgaccaggttatttaagccaatgatttatccatcgaagaaaaaaatcagtcattatacattttctccaaaacattttgtgatcttcatcataatgctatgtaatattatccctcttccatcagggagaaatccaaaaggaagtacacagacatgtacatagggcaacctgatgggatccttccttaattgaggtattttcttcccaagtgaataaagtagatgacgttattatgccattctgcccctttcaatctttgttacagaaacacatcacttgaagccataccttctccgtgtccttaagctcctacgttaacatcacaatgtgaaacagtgcaacattaaaagtcccacagtctttaacaaattccactgactccaggatctaagtactctttaaaattccaaagtgtcttacctgtggactcttcacatattttttaaagttacatactttattattccatgtgggaagagccatattaaagtaaacacaaaattcaaaaatataaatatcttaatatacaacatgatcttctatgatgcaaagggtttcagttgtctcaaatcaattctatgcatctgtcatgagcagcatacagagcatgtctggtatgttgaggccacttttggtccaggcttgctgctgtccttgtcaactatcatatgctaggatatccagtataactaaggctgcaccttcactcatgtcatgctggatattttcagggactgcaactctatcttgttgtgccaagccttggtttctctccatgacctcttcaaacctggagtttccactgctactgaagctaagcctttatcagtagtctctcctggaattctcacactgccaaagttcaactgccttacatgatctttttaaatcttcaaaattagtatcatgttgatgactcttacaagttaactgcagccttggtcccccactggaccagggctctgtgtgctcacctgagggaacaaatcctagaagatgtcaccttgatgatcccagccctagctaaccaacattgatttttccagttacacagaggcttcacttcaaagttgcgggtcccctgttaatcacagctgattcttcagcctcatctcaccagaaactacattcttaatttaaatatcacacaaatggccctgatatagtttttttccattgtctgcttgtttttcaacatccctagcttcttaagctcccacagaatagaataccagtctctgaactaagctctgaacattcagtagtttttcagccctagattccataatgctccacaactctgctaaagcagaatggtcagaatcatcacggaaattagggcactcaaacaagaagagttctccttatgggctttctcaactcagtttcttacacatctcatgcttttctgtcaacgagtagtaccacccacagttgcataggcacttttgtatcaattagtaaccaagaaaattctctagaacaggaccacagccaaatagaatggaggcaattctgcagttaacattccctcttcctcagtgtgtcaagttgccaaaaagtaaataaactatgacattcagacatatattagtttctagaaccttcgtattatattgcaaggtttattatattattatctgtagctcaagatcaagaactgagatcctcttctcttaaaggtcatttgtcacatcatgcagtgactgagtttgcatattgagttcttatcatcattctaccatcaattatctgtgttttagttcagactcagaagtcaaatcttttaatttctttattttttcagtcacatttgtctggatctctctctctctctctctctctctctctctctctctctctctctctctctctctctctctctctcctgtgtgtagggtccaaaaattagaatctgatgctttcactattgatctcaccttagttttaatatagagtctattgctgaacctgatactcaccaaattatcaagattagttgatcatcaagcatcgggagtcctctggtctctacctgccccgtgccaggattgtactgatttttatgtgggtacttgaaatctaactcaggtcctctttcttatatggcaaaaactttaccatattagtcacttttaattaataagggtgcttaaaccctgagattccacctcacactagtcagaatggctaagatcaaaaattcaggtgacagcagatgctggcaaggatgtggagaaagaggaacactcctccattgttggtgggattgcaagcttgtacaaccactctggaaatcagtctggcggttcctcagaaaattggatatagtactaccggaggatccagcaatacctctcctgggcatatatccagaagatgtcccaaccgataagaaggacacatgctccactatgttcatagcagccttatttataatagccagaagctggaaagaacccagatgcccctcaacagaggaatggatacagaaaatgtggtacatctacacaatggagtactactcagctattaaaaagaaagaatttatgaaattcctaggcaaatggttggacctggagggcatcatcctgagtgaggtaacccaatcaccaaagaactcaaatgatatgtactcactgataagtggatattagcccagaaacttaggatacccaagatataagatacaatttgctaaacacatgaaattcaagaagaacgaagaccaaagtgtggacactttgccccttcttagaattgggaacaaaacacccatggaaggagttacagacacaaagtttggagctgtgatgaaagaatggaccatctagagactgccatatccggggatccatcccataatcagcttccaatcactgacaccattgcatacactagcaagattttgctgaaaggacccagatatagctctctcttgtgagactatgccagggcctagtaaacacagaagtggatgctcacagtcagctattggatggatcacagggcccccaatggaggagctagagaaagtacccaaggacctaaagggatctgcaatcctataggtggaacaacaatatgaactatccagtacccccctggagctcgtgtctctagctgcatgtgaatcagaaaatggcctagtaggccatcagtggaaagagaggcccattagtcatgcaaactttatatgcctcagtacagaggaacgctagggccaagaagtaggagtgggtgggtgggggagtgggtgggtgagcgtgtggggggcttttgggatagcattggaaatgtaaatggaataaatacccaataaaaaaagaaaaaagaagaagaagaaaaagatgagtggaaaacacacacacacacacacacacacacacacacacacacaaaggctgcttaaatctatattactgcactttgaaagaaaaggtactattaaacatgccattttaatttagtaatatgaagaagagaagaaagaatagaaggaggaaaaatgttaatcacagtgaatagcatatttgctcaaatcttgttacactaacccttgggattttaataaaatttcataaacaaagaaatgcctgatgttttaaatagtcatctgaaacatacttttttattaataaaatttgtgtacctttatattacatttagatgcccagattcatggtctgatctaacttggtagtctcaaagcccccaatggtgctattttaaagtgttaagaaaacatggcaagtgccttatgactagatattaactgtaacttcccttgcttttatggctttaagccagattctgaatttcttgcatgttccttttgtatcactcactaagtagacactacttaaaccgcttgagactcagactcagcctacccaacctaccatgtattacccaattcttcagactattatatctcttagcttgtcagattcatcacagtagataacaacaacaacaacaacacacacacacacacacacacatatgcacacacatctctagttactactttaagtttaatttttaatgattttgacatacatatctcccctagtattcagctttaatgttgccccacttatgaattctataaataaataattgacatgatatagaacacatcctaatttcagctatctctgggcttattttacagatcaacctcagggtggttatatgtttatgacaaaggggaagactactgataattacatatctactttgccaaattataaagttattttcttattatccaagttgaactgaatcctgctttcaatctagaagtaattacctaggcagtgcaaaactgaactgaggtagactacattttgcattctgcatccatgaactgtcattaactgatatcataaatattgatatacagtataatactccaccaagtttattaaaagaataatttaagagtccatagtggttttatcatccagggttctgccattctcaaaagtgtgatgagtgtttccgtggttttcctagattttgtatttatgagttctttatggcactgacattattttatgcccgaattcattaacctttaaagtttctgatatggtacagcactattgtcacctctggtttttagacccacagaatgcatcctaaaaagaagagatgtaatggatagcattcctattcactggaagctgctttctttgaccacttggtctctgaagatcaatgttcaatgtgctagagaggacaaaactgcccctgaggtgatgtttttctgatttctttgttagagccccaaattataagcttcattctctcatcactgtgattttaggaaaagtcagtaaccatagctttactgtaaagactagagaaataatgtcactatttaaagaatagttgtagtacataataaaaggtaatcatcacataatctggccatatcctaatcaagcttattctctgacaaaagcattccttaatggcagttccttgtagagatgaattcttctgtgtgattctgttcagaagagcatagaccattacatacacacacaccttttcaaaaaaaaacaaaccttttgctccttttgcagctcaaagtgtgatataaatagtgaggcttctggtgctaaccaatgactttggaacaaatgaagctgaaactagatctattataatattgattctggcctggaataaatgtttatgtccttgaaataatttgttggtggttgttcattcattattgtccttgtatattaaataaaaagtcctttagcctccttcaagttcgggatggactaattagccattttgtaaccactatactacagtattttatcaagagtaattaatttatagtcttacattgaaatgtaattaaaatgttgttgcaagtaggttttagtccctattcagcaattgctgttactctgtatatgaattggatggtaaatttcattagattgtttcctaggcaaaagatatcctccaaccacatagtcaaagaacaagtaaccaaatttacccctttcttatgtttgagaatataaagatgaatatgctccattttgatttgatattatgtttttatttccttaatgttgtatttatacttaagtacttctaccttaaacacttaaaaagcaataaggggaggattttgttataattgaaaccaacattctcttattttgtttttcatccatcaccgtcaaacacaatcacaatcaacccaccaatctgtatcccagtgctacttaaaagtaaatttcaggatttaaaatgtatcctttctctgtcacacaacacatgtttttctatgcctgcaatgctcaagttattgtgctaaatagaccttatggtgttatttgagatcacagcaagacacagacaatctgaaattagttggattaaaatatttaaatatcagcttttgagcagaaggaagccatattgataatgaaatatcagtaagcattgtgcatttccacaaatataacagtaaataatagtgaagagagaaaaatattttctgaaatagtggcttttttagaattttcaattgcttgactgacagccctttaaaaataccaacagacttttctggaaatgtttgcgtaatcatgtgattcatattgctagggttattctctttcccataggaagcatattacctcagaatcagaataagaaacactgaacggtgtttgtgatgcatacttcaattttaacgcacttagtaaattaagctgaaggaattaaaaattaaaaatcagtgatagttgttccatggaagttatctaaaatatttgataacaactttagctctttataattcatatgagatttcatctgttttgtgttggtttataaacctttttgaatttgtagaaatgaacttttgcatttatttatacatgtccaaatctccacattacacatgcatacatacttgcatacatgttgaaataaaatttagttgtacacacatatatgcattgaaaggcaggtggtttctattgaaatcttgtaggcataatgaacttcataaacacatgcatgtatctaactcaactattaattgttgattgcttaaagaatagcccagcaaatttctctagaatagttatctcacattttgaatggggaaaagaaagatcaaaacatacctgcttgtttgaacttgtttgtagaaaagcacagcaggcacttagaatcaagtcctactacacttagttcataagaatagatgaataatcctaatgcaaggataggtaagtcaataatagcgactttagaagctgacagaccaactaacatccctacattagaaagctaggtatctatccatttggttacattgtatctgagcatgtgcaagagtgccactctaatttcatttgcttacaaaactcttctttactcacttatgtgagcctgtgataggatttttaaaaaaatataactcaggctggattaaaattcatgacctctttgccttctctttagttctggaattgtaggaatgttcttccatgccagcctctctaactattttaccaaggtttaagatcattgaatagccacccagctgtatgacttttcctggcacaatgtgaactaatgtctgttcattcaaatgataaatcaaaaaaattatgctggaacaatctagcttcgtgatccacttaatttactgacgttcttcaccggagagtgggtgaagggttactgacaggaacatatgtggctcaaggatagtttaatggctaaatacatcccccagcatgctaaagctgcatgcctggagctctctgtccaactttcatgtagctcagctagtcagaaggtctcttgtatccagaaattttattacttataaattcttaggaagggaccttggaaatcatgtaaatttggaggactacctgatacttaagtgttgtgcactttctgagccttgtaagttttgtttacttcttgagtcttagcatcttttcagggtagaatggtccaattctcatatagttgctatacatagctttttcaagtgattgctcactagaggaatcatttatttccatttaattatcactatggtaattttctaatcaccaaaatattctgtcctaggtatgttgacaggaaattgggactaggtaactaagtattcattaagtctaggtaagcaagtgttacaaactttttaggttaaaggaaacctgattatgtaaggcagtatacatctgatgttttgatattgtctgttttttaaactaaatttcattttagagaactaattcacttcttttacatcagcacttgttcaatatttcttcaagggcatttgcttaaatgtcaggctccagtagcacactacaaaaagaagtgtttcagtgtctaatgtcaaataagtttgaaaagcaatcgttagcaaataggttctgagtattcctataaatatgaacctttataaattaaccttgagttttccctgactgatcaggttatgaaaattttatcccatatgtcaagtcttaaagtcctaattcacagaaatctcttcagtacattgttcaaaataatacatatttattaaagtaattcaaacccatattggatttttggaatcatatcaagctaatcttgactcccttagtcctattatttagggcaattgctattcatgtttttcttggcttggtttctgaaagttaactatcagtctttttcttctccttctcctctttcttctcctctttcttctcctctttcttcttcttcttcttcttcttcttcttcttcttcttcttcttcttcttcttcttcttcttcttcttcttcttcttcttcctcttcttcttcttcttcttcttcctcctcctcttcttcttcttcctcatcttcctcctcctcctttttctcctcctcctcctcttcttcttccttatttgtatttgatcttctggatctctcctactccaatttgaggttttgaatccgggtttgtcctattatgcattcatcatcaatttgggatgttgcattctaaatttgcataaattgctgaatagaaatgagaaacaagattaggcaagattggtatcatttatgaagcatcacactttgattcttactaataatctctttactcagaaacaaatagccaattctgctagtccatgtgatttgaaaatcttttatcaagagacagtttttcctctgtgtattttccatattttcctttactaaaattcacaacaatctagttttaaatatcctcctcaactttccataaaactgttgctttctcttttgcaaaaattaatattgctcaaaacatgctttatattttgcagaaaatattttgggatgttctatacccatagtgtctgcaatgacaataatatattttcatggtttcagtatatttgttttataattttttctctaaaatcatggccacatgaaattgtgtatagtaataaacatagtttgtaaaataacagatatatttaaatgtgtgagagtaaggcttgtaagtgaactgtttaagcatcatttcactttaaatatatgtgttaactaattttcctcaataaaaaattaaaagtagtctgttgttaattattgtctctacaaagaaagaacaactgcagtatattgttcacatttactttaaacaccatagtttaataagagtttgttcacatttatatacatgctaaggtttgaccccactctgcataccctctaacttcaatcttgaagaagaaattttgcttcatttgcaaatcattagggtactattattgacattttgaagctccttcttattatcagaactcctttaaattttcattgctaacactgacttagaaaagtagggtgtcggtagtgagagcttagctggaaactaaaaagactggaggtgatccttgaccccatgccacattctagcttagcgaccttgagtaacttgtttcttgtctctaaatcttgcttcatttgtaaaatggacatcaagatgatgaaggatgcctaattaatgggattttcttaaagctttcatgaagcgtattcaaatcaaacacttcccaagttaccttacatgcattaaaagttggatgagtaataatcacgcttttaaaatctataagtaaaacccctagaatttccacaaagtttgcatgttagatgtaaaaattttactcacacagagctctggagatcaaaaccatcatattttttaaacgtttctatttgtgaggactatgaattatattctgtttattcataaaaaaaatggcaggatatttaaattcacactatcccagaaaactatttcactttagttaccataccaataatgcccaaagcattttttccatcatagaatttaacgtaatgggctgaaatgcttaatataagtaggatgatagggcctactgcttttgtatgcccaagatgtggcctatatattttgcagaaaaaaaatgaataaaatgaaccagtggtgtgttcctactggacacataactattctgaattatcttacatagaattatatatatgtctgtataatttttaaagtttatagcatgattctgaatcttttcctttataaaacccagtttaaatcaacttttgtttgatcttttaatttttaagtataatcataattaaaaaaaacacaacatcttataacatagctcttaattgttagtagatatggtcctatttaaatattagaagaacaataagatttaatggtgaccaatactgtaaagatatagataaagagagcagactgcctcctatgtgttctaaagcaacagtctaggagaaaaattcagtagtgacactggatagtcattaggacctaagagctggatgaacaaattagttttactatcaggagaaggtaggacccttatattagttctgtagtttattaataatctacactcaatttactgtgggtcctttgtacttgaactattagacagtggcatcttatgtaaattcattcatccaaaggagctatcccattctattttgtgcaaaggtacctcatggagaatgaagagctgaccatcagcctctacctaacatttagttttactgtcatgtgtctttctactgtattgcaaaggaacaggcctcattaatagagagcttcttaacttagaaaagatggtcttgtctttctgtgaatactcttgtttccttaatatttctagaaaatttgaaaggattattaaagtagtggtgtaatggaaataacaagtactctatagttagaaaaaatagtgttttaattagaattctaccatttacaagctttctgatattgaatgcattaatggaaaatttagattgcataaataagtctcaaactttaatgaaatttactacatgaatagaaataaataaattgatgttcaaagcagtatagttatactacatataatattcacatgaggtaaaaatcatctctaatttgtatttactgacagaatttgtatatggtgatttgcaattgtgtgtagtcaagaagatagagaatcacttattatataatgactaccttttggccttagatgaagtgagcctcattatatgatctgtcctattaagtgcttaagcttcagagagaagatgccctgcactgcttcattttgaacactttaaggcatgagacaaatgagatcacacaaatcaattgatactatttccattttgaaaatacattttagaaactgattggtactctacaaggaaagtattagtattgacatttcatctaaaaaatggttcgtggagaagaacccattgtgtattgaatatacttatcaacattatcatttacacagagatggagagaacaaaaaacctctaagtagtttttctttccagactatgaagtacaccatagattatgcagtggttagtcttgcataaagtatgtggctaaaatcatgcaaaaatagctaaagactaagtaaaatcaaaatcacattccagaaatgctttcataattgaaaatgacacccggattatggcaaaaatctctctggacagtgcatccttttcattataagcaattttagtaaaataacatatattttataatttgctttgtaattcacatctttaatttcactctgtatctgttctttattattttctggtggaacttggatcaaaaccgatataagtatttgatttccctggttcacaaattcctactttgtagagcactttgctcccatattagaccatagaatgaaactttattcctacattgatttttcttgtatacatattctttgatatcacatctgctgtagaattttgattccctgaggagtactaattttcatttggcttcttctatgtctttggatttttgttattgtttccattgatgatatttttgggagtaatgttaaattagttctacaacaatttggctgctataaagtctgcaaagcattaactgcagagggaaatcaatataatagtaataatcttataaagcatgaacaccttatcgagtttactatggcctttccctttcttttacttgattgaatattttctctctcttgagatctttaaattgacaaattagttgagtatacatgtttttgctttgtagattattgaagattccccattctagaaagttttcccatgtgtttaaaaaaacatttatatgcatggaaaacataattcaacaattgattaaaatacgtggaattctttatgagatatctttctattaacagagtgatgtatgtttgtttattccaagaatgaaggaaagcaaaatacctttaaacatacactgttgaaataactacagttcatcatttttcccttagacgaagtttaaggtttaaattatagagctctatattagacactaaggagacattttcctcttttgttttatagaagaacattggtgattgtataaatccatattgcaaatgcacaataggctgaacctttgatctagaaagtgggttttttttgtttatttttgttttgtttttgtttttttagttttagggtgtgtgtgtgtgtgtgtgtgtgtgtgtgtgtgtgtgtgtgagagagagagagagagagagagagagagagagagagacagtgagagtgtgtgtgtgtgtgtgtgtgtgtgtgtgtgtgtaaatggagcaggttcctaactgactgtgtttggatgctccccagatcagttcttcttattctatggtattattaaataagcacatttaggctacaaatttttccattatttggttatattataattcaaggtgtccattgcatacactagcaagattttgcggaaaggacccagatatagctgtctcttgtgagactatgccggggcctagcaaacacagaagtggatgatcacagtcagctattggatgggtcacagggcccccaatggaggagctagagaaattacccaaggagctaatgggatctgcaaccctataggtggaacaacattatgaactaaccagttccccggagctcttgactctagctgcatatgtatcaaaagatggcctagtcagccatcactggaaagagaggcccattggtcttgcaaactttatatgccccagtacaggggaaccccagggccaaaaagggggaatgggtgggtaggggattggggggggatgggtatggcggacttttgggatagcattgaaaatgtaaacaaggaaaatacctaataaaaaaattaaaaaaataattcaaggtgtctaaatctaccttgggattaggcatttttttctattcctcgataattagtgtcttttgattttatacctaataaccgtctttgactgtgtcatcttccttcacagaaataaatagtcctcagcttgcattatctctgtgttcaaaatatgatcaaatgatcaagcatttttttttcatttccttctgttttggaatagcaagcctgtttggccaatatttctttctttacacattcttagtacagtcctcttgactcaggctgtcatcatctgtcatctgttaaccatcactgtcttcaggtttgcccttcagtctgccagtacattttccacagtatacccaaaccaatacactataagattatatcatccttttgttttcagttcattatttgtagattaaatctaaactacttaacacagtgagcaatggcttccaatttacacatgttatagtctcccttcctacaattctccttatggaaacattgttaccaggccacactgtcttctttcgtatcctgatgactcccctgcccagatggctgtctattcatttaacctagaatgttgtaacaacattctaattatagtgatctcctgtaatacctagttgaagcttctatttccatacatgcgtaactagcataaactcctgtaattttcctggctctctatgcatatttttgaacagcatttctacattatgtttcagatacctgtatttgcttctctctctactaccatagtcaatattctaatttcttcaatttcctttctcaagttattactgcaatgccatatacaaactggatattccacatatatcactacatgaataatgaaaaaatgagaaatgaatagtacaggtttcatttgatatagtcaagcatagcttgaagccacaaactttaaacatttgaaaacataaaacattacaaaatgcattcagagaaagattgcttggataatctcaagtaattactggatccctaaacccatgtagtacttgagactttggtttgctatgtgagaaagccatccacagaatgaaaagcaaaggatgacaataacacgattttctgtaccaacacacaaacatatatacatgcacacatccacattctagggtctcctgatgtaccttctactgtctaactcttccaataaggaattttcaggagggacttgctcagtatttaaatatatatgtcagtatctttcccagttctccttccatgggagatgcctaagaaagatgtccaaaggaaaatgccaaaactaaatttctcccactgctaacactccctctaatatcctcccatttgattttatcttttacagtgttaaaatattttcttgaattaaaataatattggttattttacttatttacaccttttactggttttttgagacagggtttctctgtatagtcctggctgtcctggaactcactttatagaccaggctggcctcgaactcagaaatctgcctgcctctgcctctgctgggattaaaggcatgcaccatgcctgacacttatttacatttcaaatgttatctaccttcccagtttccacttcacaagccctctatgacctcctccctcctccctatttccatgagggtgctccaccaccagtccacccactcctgcctcagcaacctagtgtttccctttccagggccattaagccttcacaggaccaacgacttcccttcccagtgatgccaggttaggcaatcctttgctacatattcagctggagtcattagtaccccttgtgtaatctttggctggtgctttggtccctggaagctctgggggttctggttggttgatattgttgttcgtcctataaggttgcaaaccccttcagctcctgcagtccttgccctaacttccccactggggaccccacactcagtttaatgtttgcctgtatcctaagcacttcttggcatcagcaaaagtgtctatgtttggtgtctgcataagccatggatccctagctggggcagtctctggatggcctttttttttttttttcgtctctgctccactctttgtcccatgaattctggattaatatttttgaggtggatgtgtggccccattcttcaaccaggggttgtgcctatctactagatattgtctctacaggttctctctcccctttgttgggtattttggctaatgtcctccatgttgggttctgggaacctcttgggtccctggcatctgggatttcctagtgaccatgaactccccgtcctgcactgctaaacatctgctttcagattcctgatcctctgtacttctcccccatctcctcccacatttgaattggctcaccttttcccctccttctcctctcgtttttccagataccattctccctctacttcccagagattattcttttccccatactgagtagtactgtagcattcacactttgctgtgatctagtttctttttgggtttcatatggtctgtgaattgtattgtgggtattctgagcctctttttggctaacatccatatcagtgagtatgtaccatatgtgttcttttgtgatggggttacctcactcaggatgatattttctagttccatccatttgcctgtgaatttcatgaagtcattgtttttaatagttgagtagtactccattgtgtcaatgtaccatattttctatattcattcctctgttgagagagaggttctttccagcttctggctttatgaagaagtctgctatgaacatagtggagcatgtgtcctacttacatgttggagaaattttggggtataggcccaggattggtatcggtgggtcctaaggtaatactatgcccaattttctgaggaaccatcagactgatttccctagtggttgtaccagcttgcaatcccaccaataatggagaagtgttcctcttcttccacatcttcaccagcatctgctgtcaccttactttttgatcttagccattctgactggtgtgaggaggaatctcagggttatttggatttgcattttcctgatgattaaggatattgaatatttctttaggtacttcacagttgaaaaattctttgtttagccctgtaccccatttttaatagggttatttggttctctggactctaatttcttgagttggttatatatattggatattagccctttatcagatataggattgataatgaccttttctcaatgtgttggttgccattttgacctattgacagtgtcttttgcctcacagaaactttccaattttgaggtcccatttatctactgctgatcttagaatataagccattcatgttctgttcaggaaattttctttcctctcagcccatgtgttcaaggctcttcttatctccttatacaaacttcaactcctagtgatcaaggacctccacataaaaccagatatggtgaatctaatagaagagaaattggaaagaacgttgaattctttttctttttcaaaagtttttaagtagacttagtggcaaaatgtgaaccatggcatatggtttaattatgagcttgtaaactaaatacagtataagattgcctacttaacgtttatttatttctttatgtgataattaaattatgattgctcaccatgtgccgaatcatatagcatacaaaaatatattcattatgccttcatagaataatatattccattattaaatttaacttcataccttctatattttcattttaaacaattacttgaagtaaatatggagaatagcaatgaggaatgttagttgttcctaaagttcctaaaacttttgtcttttgatgttagtttgtgtgtgtgtgcatgttatatgtgagtctatgtgttcctgtgtatgtgcaagagtactgggggtatgcattcatatatgtacctgcttgtgaatgtcagaagtcgttattggtatctttttcaatcactctctaccttattttgagacattatctctacactgaatctgagattcattgattatggattattcaggattaattgccaagaagctacataaggtcctcttatttccaccttctgagggacaagataccaggtatacctcacaattcaaagctttttatgggcaaggttggggcctaacttcagaccctcttatctataaaacaaacactctactgactgagcaaactatccattccaataatcaataatatgaaaggcaaaaatattaacataatatatgatcatagataccaccaagaaatttgagaaaatgtggttttacaaaataattggttgttctccaactaccaagtagggtaacttctgtatttgccaggcactggcatagcctcacatgagtcagctatatcagggtcctgtcagcaaaatctttttggcgtatgcaatagtaactgcgtttggtggttgattatgggatggattcccgggtggggcaatcttggatggtccatcctttagtcttagctccaaactttatctctgtaactctttctatgtgtattatgttccctattctaaggaggaatgaaatatacataaaatattttttagtaaattaaactctaaagtgattaggtatacttctttgaacagatttctttattattgggatctcatgtaagtatgatatactcatctcagttacttgatgtattcttgttttgttaattccatagtttaggaagtgttccatattcactatcatttttctatgttgtagcaccccctccaggatagcacattattgcttgttgtgatgtctccttaggcagtttttaaatataatgatgcgttcatgctaatgactttggaagtttaatcactttgaagtaataatagacagaactttggaagaatgatcctcagatttgtcttctgttgtcttatgattagaatgttcaatggctttatatattgtcctattaagactcaatattatcaacatgtcatcatcattaatattgttcttgcatcctaagactgaagtaggattttccttattttccacagtgaagttgttcaactccttcttccttttctatagaaaactcattagaaggaagttttatatgtactttatacataaagagcagagtgttccacctgatccccttaaagggattgtatttacatacattatttggactaatccatggaagatttgtatgttttccatttatatatttcttcctcgatctcttgtatcaatacggaccaatgagtaatttttttgataaaaagttttatttctatacatgcatatgagttttgaattttaagccaagtgttctctaataaaatattaaacagtaaataaaatctccataagtgtcctatagtccatgagttggaagagagatgcttgaatgtgcttcaggtctggaaggttaatcattagtggcagacaaggtatcacagctggactttcccaaagagcttctcagactaactgcaagatttcattagtgaatacacttaccaactgtgtcaaggtttaggtgtaatcagaggagagatgacagctttttgtttccaacattctaccttcttttgcatcccatttaaacattggaaacacatctcctgatgtatttgcttatttcattgagagctattctttttctttcccatgacaaagtaataatccccttgagatattttccatgagtcctttggaaaacgtggttgtagatatacccataaatattcacttgtgtactttctgcttctttttgcataatatttatttttattagatattttctaaatttacatttcaaatactatcccttttcctagtttctgctcagaaaatcccctctcccctccccgctccccctgctccccaatacacctactattgcttcctggccctggacttcccctatactggggcatataatcttcgcaagatgaagggcctctcctcccatttatggccgactaggctatcttctgctacatttccagctatagacacaagctctaggggtagtggttagttcatattgttgttcctcctatagggttgcagaccccttcagctccttgggtactttctctgactcctgcattggggaccctgtgttccatcctgtgagcatccacttctgtatttgcccagcactggcatagcctcacaggagacagctatatcagggtattgtcatcaaaatcttgttggcatgtgcaatagtgtctgggtttggtggttgcttatgggatggattcccgggtggggcagtctctgggtggtccttccttcagtcgctgttcagaattttgtctctgtaactctttccatgggtagtttgttccctattctaagaaggggcaaactgtccacactttggtcttcttttttttttttttttttttttttttgagtttcatgtgtttgacaaattgtatctttggtattctaagtttctgggctaatatccacttatcagtgagtacatatcatgggtgttcttttgtgattgggttacctcactcatgatgatatcctccagatccatcaatttgcctaagaatttcataaattcattgtctttattagctgagtaggactctattctgtaaatgcaccactttttttctttatccattcctctgttgaggggcatctgggttctttccagattctggctattataaataagtctgctataaacatagtagagcatgtatccttattaaacttgggacatcttcttggtatatgcccaagagtggtgttgctgcaccgtcggatagtactatgtccaattttctgaggaactaccagattgatttccagagtggttgtaccagcttgcaatccaaccagcgatggaggagtgttcatctttttccacctccttgccagcatctgatgtcacttgaatttttgatcttagccattctgactggtgtgaggtggaatctcaggattgttttaatttgcattttcctgatgattaaggatgttgaacatttgttaaggtgcttctcagccattcgatattcctcagttgagaattctttgtttagctctgtatcccatgatggatgatcatattattgtgttcttggatttggtttgtgagaattttattgagtacttttgcatcgatattcataagggaaattggtttgaagttgtgtttctttgttgagtctttgtgtggtttaggtatcagagtaattgtggcttcatagaacacattgggtaaagtaccttctgtttctattttgtggaatagtttgtggaaaattggagttaggtcttctttgaaggtctgatagaaccctgcactaaactcatctggtctttggcttttttttttttggggggggggttgggagactatttaaaaaattttattagattttttttcatttacttttagatgctatcctgaaagtcccctataccctccccctgcccttgctccccaacccaccctctcctgcttcctggccctggcattcccctctactggggcatatgatcttcccaagacaaagggcctctcataccattgatagctgactaggccatcccctgctacatatgcagctaaagacagaattctatggggtactggttagttcatattgttgttcctcctatagggttgccgagccctttagctccatgggtactttctctagctccttcttgagggggcctgtgttccaacctatagatgactgtgagcatccacttctgtgtttagatagttaatctgatcctgatttaactttgctacctggtatttgtctagaaatttgtccatttcatccaggttttccagttttgttgagtacaggctcacaagatacagctatatctgggtcctttcagcaaaatcttgctagtgtatgcaatggtgtcagcatttgaaggctgattatgggatggatccctggatatggcagtctctagatggtccatcctttcatctcagctccaaactgtgtctctgtaactccttccatgggtgttttgttcccaattctaagaaggggcaaagtgtccacactttggtctttgttcttcttgagtagttaattagaatactgtccctgtgccctctagttaatctgcataaaggtttatctatcttgttgattttctcaaagaatcagctcctggtttggttgattctttgtatggttctttttgtttccccttggttgatttcagccctgagtttgattattttctgccatctactcctcttgggtgaatttgcttccttttgttctagagattttaggtgtactgtcaagctgctagtgtatgccctctgcagtttctttttggaggcactcagagctatgagttttcctcttaggactgccttcattgtggcccataagtttgggtatgttgtggctttattttcattaaactctaaaaagtccttaatttctttatttatttcttcctttaccaaattatcatcgagtagaatattgttcagcttctatgtgtatgtgggctttctattatttatgttgttactaaagaaaatccttagtccattgtgaactaataagatgcctggaattatttcaatatatttttatctgttgcagcctgttttgtgaccaagtatatgttcaattttgaagaaggttccatgatgtgctgagaagaaggtatatccttttgttttaggatgaaatgttctatagatattcgttaaaaccatttggttcataacttctgttagtttcactgagtctttgtttagtttttgtttccaggatctgtccattgatgaaagtgtggtgttgaagtctcccactattattgtgtgaggtgcaatgtgtgctttgaactttaccaaaatttctttatgaatgtggatgcccttgcatttggagcatagatgttcagaattgagagttcatattggtagatttcacctttgatgagtatatttgatgagtatgcagtgtccctccttgtcttttgtgataactttggattggaagttgattttattcaatattacaatggctactccagcttgtttcttgggaccatttgcttggaaaattattttccagccttttactcttaggtagtgtctgtctttgtccctgaggtgggtttcctgtatccatcaaaatgttgggtcctctttatgtagccaatctacatctttttattggggaactgagtccattgatattaagagatattaattaaaagtaattgttacttcctgttattttgttgttagagttgggattttattcttgtggctatcttcttttaggtttgtggaagcattactttcttgctttttctagggcatagtttctgtccttgtattgtttgttgttttgttttttttttcccctccttgtgttgaaggtttccctttattatcctattaagggctggattcatggaaagatattgtgtgaatttggtttttttatgaaatactgtggtgtctttatctattgtaattgagagttttgctgggcatagtagcctgggctggcatttgtgttctcttagggtccgtataacatctttacaggatcttctggctttcattgtctctggtgagaagtctgatgtaattctaatatgtctgcctttatatgttacttgaccttttccccttactgtttttaatattttatctttatttagtgcatttgttcttctgattattatgtttcaggaagatttttttttctggtccagtctatttagagtcctgtaggcttcttgtatgttcatgggcatctctttctttacgttaaggaagttttcttctataattttgttgaaggtatttgctggccctttaagttgaaaatcttcattctcatctacacctattattccttagatttggtcttttcattgtgtcctggatttcttggatgttttgagttaggatgtttttgcattttgcattttctttgatttttgtgttcatcttttctatggaatcttctgcacctgagattatctcttccatctcttgtatcctgtttgtgatattccatttatggttcttgatttcttccctaggatttctatctccagagttgtctccctttgtgttttctttattgtttctacttccctttttaggtcttggatggttttgttcaattccatcacctgtttgggtgtgttttcctgtaattctttaagggattttttgtgtttcctctttaaggacttgtacctgtttaatagtgtcttcctgtatttctttaagtgagttattattgttgttcttaatgtcctctaccatcatcataagatatgattttatatctgaatattgctttttggtgtgctgggttatccaagactctgtgtagtggaagtactgggttctaatgatgcctggtggtctttatttctgttagtaagattcttacatttgccttttgccatctggtaatctctggtggtagatattctatctgtctctggctggagcttgttcctcctttgagtctgttagtctctgtcagcactcctggttgaccagctctctcctgagtcctgtgggtcagagcactccctggaagccaaatgtcctctggcattgaaggtgcacagaggactgaggatcagctctgcctcctggctgaggattaaggcccaaagggaccctatccaagaaactctgttgccgtgcagacccacctcagagagaccctgatagaaaatgatgatcacacctgagtcctgggtgtctgggcactctctgtaggcaagctctcctcaggcacagaaggtgctcagaggtctgaggatcagctctgcttcttgtctgaggatgaaggcctgaagggaccctgtcgaaaaagctctgttgctgtgcagacccacctcagataaaccccggatagaaaattaagtaattattttaaacattggcttttcatccaacatcaccatatttcttttgattctacattttgtcagtgggaactctttcacccagttcttgtcttccttggttctatctttatcagtgtaggactttcaggttttatttgagtatttacaaagaatgctccaggcttattttgtatttccacatctttattttaatctcctcgatcttcatagaaagtggtagaagattacaaatggccagaaaaacctgattaatggcttagaaaacttgtataacctcgtgttttgactagactctcatctataacttcacatcatacttaataaggattttctagtgtttcacactgttatctaaatgaaacttttctaggctacagaatttaaaattattgctgctggtgttgataaatttatagttttcaatggattttaatgaactgaatcaacatttttctatagatactaactggtatatagataacataaatataattattgaagaggtatgactatatcatcttattatccttattttgttttctgtttaagctattaaaatatcatttagataatacacattttatgtaaattatataatttatacaacctatgataaaggaaataatgggtattcagtttgataactaacagttatttttaataaaacacttatctgtttatagattctgcccgtgtataaccacattttgttattttacacataagtgacattagaagtgtttgtgatattataagttctcttctaagttcttgtcagcattttcattataaatgtatttttcaaggacatataatgtctcctctgaaatttcatttggggtttagacttgccaaacacaattgaagactgcaaattttcttttgaaaatttaatcagaatcattgttttgtccctgtgctttgacttgaatgatagctgctttctttcttcccgtgtcttgataaatggtttctctcttatcgggaaatgatgacttttgaatgagaacatggccttaaatttctccatgtttgataggttgtgtgtaatatcataactctttcattctatggcaggcaacttcagcatatatgttccatgacagtagatgtttcttcttgttgtttcattaaaaacctgctaatattgtccctctgggttatgcttcacttctacgttgacgtaccagcaataaccagctagaaaacataaatttgataaaatattcaacatagttgacaacatattagtaagagaaattttaacaagaaaatacacagtttatatattcttgaaaataccttaagtaccacaaatacaaaatttgaacagaaaggtacattatgatctttgtagactgcatgaaatttttaaatatttccctttttccagtttatttaatttataggcaaaggacattccaaattaattcatacattttatgtaaaatcaatcaaaattctcctttaaaggtgttataatgattttagaagaataaacagattatccatataaaatatatttcagaaacaccagtaacatatttaagatttttttgttgttttttgctttgttgttgttgttgttgttgttgttgttgttgttgttgttgttgttttcaagacagggtttctctgtatagccctggatgtcctggaactcactttgtagaccaggctggcctcgaactcaaaaatccgcctgcctctgcctcctgagtgctgggattaaaggtatgcaccaccatgtcaggctatatttaagattttaataattggaaaagtgtataagaatgaagaagtaaaattaattgaataaccatgaaaattaatttttgatgaatgaagtatgatgggcagccgaattaataaataatgtgtggaaaaattggtctgtaatgttggaatataccatagaatccaaatgggagtcctaatatcctctgaagctaaataaaatttttgacttaatttagaactaacagttgaaatgtttaaactaagatgagccaaacatttaaattgaattcaagttatgaaaatactttctattcacaagcatatcgaaaaacccacagaaacggaatgatgctgtaacaaaaagttttacataataagaaaggatcaggctgacatggtggaacacgccaccttttgctcctttagaaggagcaacattttcataatattgctgaagaataaataacaatatgcataaagatgcacaaatattattaaagtttacaaattagagacccaatcagattttgtgtaaacactttccattaccttgataagtgttaaaatttaagtgatggtcatttagaatctctgacaacattgtggtaaatgtattatgacacaacagtgtattcttatttacaatcatattgcatatatgatttcagctatttgagtagaactctatactcataatatttcattattcaatcttgtcaaagaaaaataaataatatattactcaatgagagttcacaaaacttctaaaattgcacagtcactattccttgtcttatgtcaggaattttagcctagaaaataaatagtgctgttaaaaacaggtatcaagtcacagttgccaagctcttagagaacttaatggtgcaaagaactcagaaagggcatccaacaaaacattcagcttccactcacatgtatgtatatcaaaagactgattcacatttcaaaaattctctccccttgaaaaatgtgtcacaatttgctccttcatgtttctaattacttctccgctgtcctgttaagtttacatgtaggtcggggaaaccattctctatcatttaaaatggtttccatttcaagttaagatagagaatctatcattaggaatgcagtgaacctacatcttgggggtcagacacacttttcgctaccagataactgtgcagttttaaccaaacagctttaccactctgagacttggttcttataaaggggcaaaacatatctaagttacttagttcattgcctagtatatagtgggctggaaatcatagctaatattattattattactattatgtataggaagcttgggagaacaaagaatttctaaagaaatactgttgctttcaataaaaaaggtactttaaaacttaatgctaccagaggggcagacagaatatagagtatcagctgagctggcagcctaagtacataagatacctaggaatgaattagttctcaggagacactgagcaagtcacacttaagaaccacgttttatgcactagtgtctagcacagctcaataaagaatttttgaattgacaagtcgacggctgaagcataagaagttaaagaacctggtagcctgagtataagcaattgagtgcatgtgtttccgaagaaaggatatgaatatgggcaaaaggaaaagtggatcagacaaaaagagaagacacagccttctacagtgattgaaactttggctttatatcccgccaaagcagctgtgaaaggaaatatgttgattcacagataggcttgataattttccctcttcacctctatccttctaataaagaaaattagtgacgagatgaaaaacaaaagataaccccagagagctatttctgaagtctgtgtaggaccagcatttaggctcacagagcaatagaacagtggcaataatgacctattttctgagacttaaaaagggacacatgatctgaccgatgttatttttttctagaacaaggatgaatcatgtgaatagtctgtctgtctgtctgtctgtctctctctctctctctctctctctctatatatatatatatatatatagatagatagatagatagatagatgtagatatagatatcatctttaaatgattcatcattatcagaaatgacatttttctgaattaggcatattctaaatatatttgaaatatatgagcaccatgacttggagaatcttatttaaatacaataatttttaaaattagtatatatgaaaaggctcttttcaagtacaaagaaaagaagaaagaacagaaaaattcacacaataaaaatttaactaatctcatgaattacagattgaaatatatgaagcatttatattcatagccacatacagcttttggacaagtcctgtcaggatataagattagtagtgttttttttccttcttttaaatagtcattaccagtgtacagaggctcaggtatagaaataaagtgacatgttctgcctcatatattgtaggaggatcagagtccagaagatgtaggcttaagaagacatgattaataagggtccaaaattaaatagagcttccagaaatttaggaataaaaacaggattagaaaggaggattataggcactctttgtacttaaagtatgacagttttttgtaatatataaatatgacctgatgcaattactaaatgtgagatcaatgtttgtggaaagattttagaatataatgggctttatgaatgagcaagggtccacatagtcgttggtttgaattagaatagaacaaaaaatttccaaaaatgaacgtgttgcccaccactattcattcacacaataaatatttttagtgtacttactacattttcgatcatgtgctacacttcagatatgtgatattgatgtagactactcatatttctgctgtattacagcttggagaattattgggaaaaaaaaaacaacacatgattaaaaacccaaatctatgggaggcagaggcaggcgaatttcttagttcaaggccagcctggtctacagagtgagttacaggacagccagggctacacagtaaaaccctgtctcgaaaaaaacaaaaacaaaaacaaaaacaaaaagataaaagctatcaataaaaatgaaccaagatcaagacaaggagttgtctatacagcaatatattatcaacgattttgaaataatttttttctccaataaggtaatagaaatataaagttcaggtatatactctatgaatgggtaacatttatgattgattaataaatggacattgcctggggtaatactaagcatggagtatcagaacagatagtgagctggtattctagcaaaatgaaagagacataagagccagtcccctccaggaaggaggggagtaatcataggtcaatgtaagatatttagaatgaaataaccaggtaaagggctcttgccaaagtctatatatctgatggtcttgtggaagcaggacacaattgtggatatgaaggtgagtgagaagattaagaatttatcttgaaaacagactccacagaacttcctagattgggagtatgtgacacagcagaatgagtaaatgaagtcaagatttgggtttcagtacttgagcaagtaatgatagcactttcatatattagagttgagacacctagggagaaaatgaagaaacaaatttttgatgtattcagtttcagacttctatgctagagaaaagtggaaagtaaaagtagctatggattcatgggtaggacattaaagacactgttagaactaaatttatagtctgaaaatatacttattatgtacctctcctgggcatatacccagaagaagttccaactggtaataagaacgcatgctcaactatgttcataacagccttatttatactagtcagaagttggaaagaaaccagatgtccctcaacagaaaaatggatacagaaaatgtgatacatttacacaatgcagtactactcagctattaaaaacaatggatttatgaaattcctggacaaatggatgtatctggaggatatcatccttagtgaggtaacccaaccacaaaagaagccacttgatatgtactcactgataagtggatattagcacagaaacatagagcacccaagatacaatttgcaaaacacaagacaatcaagaacagggaagaccaacgtgtggatacttcattcctccttagaatatggaacaaaatacccatgaaaggagttacagagacaaagtttggagctaagacgaaaggatggactatccagaaactaccccatgcggggatccatcccataatcagccaccaaacccagacactattgcatattccagaaagattttgctgaagggaacatggtatagctgtttcctatgaggctatgccagtgcctggcaaatactgaagtggatgctcacagtcagaagcttgagaaagtctgtaaccctataggaggaacaacaatatgaactaaccagtacccccagagctcatatctctagctgcatatgtagcagaagatggcctagttggccatcactgggaagagaggccccttggtattgcaaactctatatgccccagtacaggggaatgccagggccaagaagcggggggtgggggggtgggtaggggagttgggcagagggagggtataggaaactttcagtatatcatttgaaatgtatataaagaaaatatctaataataaataaataaataaataaataagattgggaatggaaaagaagtagacaatgtacagacagggattactactaggttaactgagaaacaaagcatgatgggaaaagcatctgtaaggggacttagggaagctgttgggatccacagagtttagagattatccacattttgcaagtttatggctttaatgtaaaaagaggagtggtggtggtgagatcagaaaggtgagaagagatggggatgagagggaagtataagggcatttgttggaagtagagggaacataatagcagactaggtggaaagcctacagagcaaccatacaccttgccaagcaaaataaaaactaaaataagctcagtaaaaagattttttttttgcaaatatgaaggtaaaaaaaaaatgaaagcaaaaattaaaagatagcaataacaacaacacaagacaaatcccattagtgttcaaacaaatcaacagggctggtaagagagctcaatggggagaggtgcttgaaactaagcctgctgacctgagtttgattcctgggccccacttggtagaaggtcccatttgacccccatatatgtgcattgccacctaaataaataattgcaataaaaaaagaagaagaacaaggtgtttgatgtgagagtgcagtgaataaaggagatcaggagagaatttgttaaaagtatattatattttgtaatgaaattatgaatatatttaaaaagatgtgataatccagacaataagtataaatgtagaagaaaccaaaaatccaaatatatcatcagagtcctaccaccaagattttttcctttcaaaaatattttgagtgtttatggtatacttgaattttcaaaagtccccagggaaaatggagaatcataccaataaagctcttgccttttaattacttgctgataagcaaatcaaaacaaagtgtatcaaagaaaaatagcttagaatgttggattctgtaaagaaaaagaataatacaaacccaatgactaataagcaagtcagtatgttcaacttcagccaaccaaatagaagaaataagcatgggtgtaagaaaataactagtgtagatcacaaaaccattgatgcatggaggaaatgagtaatagtcaccctaacttttgtagcaatatatttagtttcatagttttgtatattttgttaatttcactagtttcttgttcatggtcttgtggtgaaagtctttttttatatatccctatcagctggtcattctgtcattactaaaacaatgctttcccaaatttaatgagcaaagaaatcacaggggatcttgttatcattcagattctgattctctaggtctttggtaggattttagattctgcatttgcacatgctcctttccatggtttcaaatttgactagtatgtagctgaagaaccaatctggaaaacattagaaacagtagatctagggcattcacatatctgagttgtgaatatgtgaggtgggatagtgataatgacctttgcttttcatttcaaccacaggcagttgtcacaaattgcatcctgtttaaaaataatatttgacaataggtaggtggattttaaaagtagtaatataacaaacacatgattctttcaatgttgtcctgaaacagatgtgaatgcacagatgtctactacaaagagagcttgaggggaaagtctccaatgagcaatacatcccatttttatcattttctctttatgatgttttcttttctgcattccacgaaaatgacataatgggattttattgtagcctgcctggatggataatacaaaggagaaataatgtagcctagaaattattctcacaacaaaaaagtttatctgagaaatgttgatggcacaatataactaaccattagaagtgaaatttgagcaaggtaaaaaaataattcaatataaattgtgtattgtttatgaaagatacttgtaatatacagaaagattttcactatgagtcctgagataaaaatgtggccttcaaatatattgctttaatatgactagcatattacattgaagaaactgttctttctcaagatgttgataaatacacatgtaaacagtgtattcagatgatgctgggaatgttaataaattcatcttttcctcctttgcttttacactgtgatccccattttataaatgagacacagaatttaattttgttattttagatgatgaatttattatctattttagtgacactttttcatgataagctcatatagtattccattcacagcatgttaagcattttgtctgtacttgattgattgatggatgtatggatgtatgtatggatggatggatggatttgtatgagaagcagtatagcaatgtgtgttcagagtgtggattttagagacagatttcaatcctgatgctaacacttattaattgtgtaacactgaacattccatttaagatcatagtgttagtttattcatcatcaaaatgggaaaaataaagttcccttatattttgggtaataaatatgctaacatatataaaccagccaaaattattatatatagatagatacaaacacttactaagcatttagaacatgttggataacttattaccaacatctgctaaactatttcatgaactatttcactagctcatgatttatatccttaggaacaatactaatacattataatacattagacaaaaaacatttactttctgtgcatttcaatcatctattatttctgtaatatttgccatcatttcagaagatttcatgtacagcttaaactgccaagaggtatattatgtatttgaagaatgaaaactacagataagataaacttctacaaacaagcagtaaataaagaggtgtggtgaatggatgcacatactatcttgttcttttccttttgtttttctttttttctgtttcttttatttatttattttttagttagcattttttagcatttttactagataatttcttcatttacatttcaaatgctatccccaaagccccctgtatcctccccccaccctgctccccaacccacccactcctgcttccttggccctggcattcccctatactggggcatataaagtttgtgtgtccaatgggcctctctttccaatgatggccgactaggccatcttctgatacatatgcagctagagacaagagctccggggtactggttagttcatattgctgttcctcctatagggttgcagatccctttagctccttgggtactttctctagctccttcattgtgggccctgtgatccatccaataggtgactgtgagcatccacttctgtgtttgctaggccccggtgtagtctcgttagagacagctatatcagggtcctatcagcaaaatcttgctagtgtgtgcaatggtgtctgcgtttggtggttagtttttacactccctattttattcccctccccgatccagcctccaactgttccacatcccatacctcctctccacccccctgtctcttcatggatgtcctccctgccactccacctgacctttaaataccatggggccgccattctcttgagtgttaggtgcatcatctctgaatgaacacagacatggaagttctctattgtatgtgtggtgtgttgggggcctcatataagctggtacatgctgtctgtttggtgatccagtgtttgagagatcttgggggtccagattaattgagactgctggtcctcctacaggattgcccttttcttcagcttctttcagccttccataattcaacaacaggggtcagctgcttctgttcattggttgggtgcaaatatctgcatctgattctttaagctgcttgttgggtctttcagagagtagccatgatagatcccttttttgtgagccatctatagcctcaataatagtatcaggccttgggacctccccttgagctagatctcactttgggcctgtcactggacattctttttctcaggcttctctccatttccagccctataattctttcagacaggaacaattatgggtcagagttttgactgtgggatagcaaccccatccttcacttgatgtcctgtcttcctgctggaggtggactctgtaagttccctctctctctactgtcgtgcatttcatctatgatctttgagtcctgagagtctctcacctcctaggtctctggtacattctggagggtccccaccaccacctacctcctgaggttgtttgtttccttttctttctttcttttttcttattaggtatttatttcatttacatttctaatgctatcccaaaagtcccccacacgctcccccacccactcccccacccacccactaccatttcttgtccctggcgttcccctgtactgaggcatataaagtttgcacgaacaatgggcctctctttccactgatggcccactaggccatcttctgatacatatgcagctagaaacacgagctccgggggtactggttagttcatattgttgttccacctatagggttgcagatcaccccagctccttgggtactttctctagctcgtccattggggaccctgtgatccatccaatagctgactgtgagcatccacttctgtgtttgctaggccccggcatactctcacaagagacagctatatctgggtcctttcagcaaaatcttgctagtgtatgcaatggtgtcagcatttggaagctgattatgggatgggtccccggatatggcagtttctagatggtccatccttttgtctcagctccaaacatttttctgctggctgtcagggcttcagttcttttccctcacccaataccaaatcaggttctcctctccaaccaccacctcccccgactaccccatccactttccctcccagttcccttcctcctccccacttgtgattgctttcttctaaagtgggactgaagtaccctcacttgggcacttcatcttgttgaccttttcgagtcctgtggactgtatcttgggtattcgtactttaattatttgtttgtttgtttgtttgtttgtttattggctaatgtccccttattagtgagtacatgacatgcacatccttttgggtctgagttacctcactcaggatgatattttctatttccatctatttgcctgcaaaactcaaaatgtccttgttcttaattgttgagtagtattccattgtgcaaatgaaccacattttctgtacccattcttctgtcatggaatatctaggttgcttccagcttctggctattacaaataaggccactatgaacatagtggaacacgtgcccctgtggcatggtggggcatcttttgggtatattcccaagagtggtatagctgggtcttcatgtagatctatttccaatcttctgaggaaactccagactgatttccagagtggttgtaccagtttgcaatcccaccagcaatggagaagtattcctctttctccatattctctccaacatttgttgtcaccattttcttaagaagtaattaattttaattataataacccgtgtttattaagtatatattttaaagtgttaaacactctgtataatccccagaattttttccaataattatgaatcatgcaactgaaattcacagagacttattaatacatttcagggcattattataagattcaacccgatgactgatcaaaacattgccttggttttatctagtttacaaatgtccaagcacaattcctacttaaaacaactaaattaggttcacattacagttctgcctctttagagctatgtaaccactttgaattcagaaatttcgtttagacagatggatgctaagtgtacatcttaaacttctctgtaaaacactttctcttctggcatttccctgtcatactgcttcttctccctccagaatcacaagagttgatcatctgcttcaaatgccctagtcactgccaacatatctccatatgcatcctttgtcatcatgctccagattctcccctaattttcttcatttgtatgagttatgataatatgtttatggcattccttcagtgagagtaattcaatatgaaaacattgtctttctccatctgtttctacacttaggctagctatcacattttaattagtaagtactactctgaagcagtcgtccagaacacaaagaaaatgatcaatacttctggttcaagtccagatgtagtataatgagactcctggacacaaacactattagaaaatgtgatatatggtcacagaattggcagattattaaaccactaataatgcccttgttccatttgcccagggaaaataacttcaagggattcaccccatccttactcattaatacattttccagttactatggagcatttattaggtggattgttaatcatagaagtagagacagtatcagactgggtgatttgagaacatactttcttaatctcaacttttctcaccaataagaaaacattttgtctaatattgattcagtcacctgcatcatattctgtcttttaggttttaattgcagttccttcagcctttgctgttcttccaattcaagtgtcatttgcaactaggaaatgttttcaacattctcatccaaataattacattcatataaaaatctgttaatgaaacattagagctaagggcttaattgctgaaaaatcaatgcttgagctaaaatactcagttatggttccatggtaacaggatctattattaactgtataaatgttatctaattgaaatgaacatactactttaggtaatttaaagtctatatataagataatatgctatttaaaaataaaataattgttgaaatagacttctggttgaaaattatggagaaattcacatttttcaattattttctgcttatcaaatttcatgctcagtattttctatcaatttaaatatagataatccccaactgcttttgaaatatgatggtatttaatgtccacatgtcaaacttatataatgtttttctctaaagaaggaaatgttttgcagaaaatgaaagtatacactgaatgacataaaggagctgatgtagggtatatccaaagcacagaaaccaggtcagcaggttgttctatgaaggaaatttctacatataaagaatgttcatgaatttttcaagtatgatgagtatgacaaagacaataaaatattgtacacttgtatcaggttaataaaacatagccagaaatcggtgaaagtcttaagtaggtgtattactgccatccacacaaaatgactgaatattacatctaataattgcacaactgagtactcagagtaagcgcactaagaggatgattcaggagaaagaaacaatactgagattttcttgcctcaacactgtctatattgcaggaaagaagatataagcctgggatgtacagcagtatttccaaagatatataagacaatattagtagcttttgcccatagactaaaggcaaattcccctctcctagaaaaagaacacagctctgagaaagattttatggtacttcaaatactggaagaagtgttttatcaaaatgtacttattggttagtgtgttggtcagcagaatataaaataaaagcacacagtatttgcccataataagtagcttttaatcagtctggaaaaagtatagaaaaattccaagttcaaacacatatgaagattttaaaaattataacataaaattcagctcatgtttctggaacaattccagataaagaacaagttatgagtgatctgactgtatatcttgatggatcttcaatttctagtactttgttgatattaaaaaactaaacacaaaaccactatggatttttaaaaagtcataataaataactttacttaagaaacaattatgctccttctctacagtatatttatggactatatatatatatgtgtatatatatatatatatatatatatatatatatatatatatatatatataaattttcaaatgtttataacataaatgtaggacaaggacgcatacatacaaacagtgtttcatatattccaggctggctttaaattcatatatagaaaagcacaaccatgaacttcttaatgtagctctacctcccaagttttgagattacatgtgtgctaagcctggttatatatggctgaatatcatactcacacatgctccaatgtggagctatggcttttgcatgtatttatttttaaagaagaagatatagacaagaaaattaatggtcttatggaaaatggcaacttttaagaaaaatcaatttagaatcctatagtgatgtttcagaaataggactttaaggattagtaactgcacaggatgtggaaatgctgtaaactatggagtcaaggagatttggtttgattttaaactgacatttctgtggtatgttattttgatatgaaagaaagttcaacaaaaatgaattatgtgcaaaaataagctaatcaaatatttctaggtatatacataaaaggaacaaaagtatctttgtaacaaaacatgactatatttttataacaatattatgcctaatacctaaagtatctgtgtggatttttgctatcactaacatctaacataataacttaatagaataaagaagatttattttggttcatagtttctttttttctggggatttggtgttatagtacatcatgttagaggtgtgtagtgtaatggagccacataaaacatggtagacaggaagcaggaaggtcagacaaaagcaggatataacctccaaagacatgtaatctgcagaacacatttttataggatccatatcctgcaacccacattcttgcatttccccaaaattgaattataatgtataaaagagtccttcaacacatattcaaatattctgaagttgttttcccctaagcaagtaataattcttcaaaacattatgctaaatgaaaaacccctagatgcaaaagatattatatgatcatgttcataggaaatgttctagaaaaaaaaaacctataaatactgaaagcagatggatggttacctataatgcaaggcagggataagaagttaagcaaatgagcataacaggtattttgggaatgacataaaggttccaaaattgatttgtggtcaacatggaccaattcaatgaaacataattaattacagatttcatgtgagtgaattttatcttgtcagttataagccaagaactcctcaattggttgtccaataccaaatggtcaatcctgaaaacatacatacaggtgacattatattgaattgacagtttgcatctaggaatatatgtatataccaatgtatatatgaatgcaataacaattaataaaaacagcatcagtttgaaggagagcaggaagggatatatggaaatgtttacagggagaaaagggaagggagaatttttgaactttaaatacaatctcaaaacaaaagaaaaatacatgattctttcttagtttgcttttctcttgagaaaaatactctgacataagcaacttaagaaacaaagaacttgctatctctcacagttccaggttatagcccatcatagtggcaaagtcaaggcttcagggacttgaagcagttgttattattgctggtgttcaactgacttgtttgattccagtatagttttatcctatgaaatgaggctgtccacatacaggatggctcttcatatatcaactaacccaataagaaaatgctttacaagacaagcccacagccaatctaatttagacaatacttcattgatatcctattcttaagtgattctcggttttttcaaagttctaagtgaatgaaccatgatggaattaaaagtgccaaacgctgtatgatggtgatcttatagtactatattataagtggtatgtttgactatctttaaagcaatcagtaattgtcttctcaactcatgggacctttagtaggaaataatgggctgtgtttttcctagttggtgaggaaatatgacaaagaaccaggaagaatagggaaataatattaatgctgaagtgaagtgtgtaataagttggacaatttattttcttatagactttaatagtgtaaagtatctgtactattggaatgtgaatattagaatcttttgacttcagaactggcactggtaaaggacgggtagaatgtgtgtgacaagtatcatgcatcaatgatagagtagtgggctaccccatactggtgctaggaattaggctaatctggctgtagctgtctagtgctgtaacaagacattatgaagcttgatttcttttcctgtttgttaaaatactatcacaaaagaaactttaaaataatttactatggctcacatttcaaagctttaatgcatcatgccaggaagttaagaaagcagggatttgaaacagctggttaaatagtattcatgatcagggagcagagtgtgatggatgcttgtactcagcatacgttcttttttatgcaatccaggatcctggatgaggaaatggtgcttcacactcttagaatgatcttcccatcacaataaacataatgtaattatttaaaatcgtgacctgtggtgggtaacaactggaatgtaaaaaaaataataatttaaaaaaatcatgacaagaggttaaatagtcacccacaagtgtatctggagacttatcttgtaaataataccaaattctgtcaaatgggaaacaccacccatcacaaacacaaatttggggagagtttaggtcatagaatattgatgtggtatcttttatttgttatgatgtggcaggtgactaagcaagaatagtttttcatttaagataggatatagcaaagtgaccacactgggagtgagtagggtaaaggtagtgttgtgaaccatgtgtgtaaaatactttgtgataaagtatcatacaagcactaaccttcaaatcttgtgagttatttaagtaagcagctctgtcaacactatgccctttaactctgcaacagattcgatgatgttctgggacagggaggacctccaaatgtcttatccaagttgtctagagttgtaaagatttcctacccatcttgaaacaaatccttacagcgcttgatctaagtgatgtgataagatcatgaccttttcagaaatgcctttgatgtcaatcctaattccactaaattttacctgacagggaaagaatgaaacattataggctcgtttgtcaagcatcctagtaatctctcatggcaataatctgctccaactcagccctgcagtaatagggtgtgggagtgatttaccctgactgggaataaacttgttaagtgttcaaacattgattaatgaagtaaaaatgcactaggtagaccttgaagtgataaactggacaggaaccttggcagaaagtgcttcctgcccactagcatgctatgatttattttgaggatgattattttcttacccacatatctacaatgccatgggaaaaatcagtattgataggtaagatacagaagtgaaaattatcacatattactcctaatttaagttttcatcacctttataaagatgaagaaatattcatggtgaaatttgtaaaagcccattttttgctcagctgacctttctgttataaaattttaaagctgttctatcatcttttgataatataaacataaaagatcaaggaaattgaaattgcatttttattttgacaggtacattttatgattgaccatttcagcaaagtaagtatgtgttatttttagttgattatttattaagttttagaatgcttttaatctcttcttcctcaatttatcttatttctccaaacaccaccagtactccagctatcaaactaaaatggagatggggtggggggatatatttttttcttattgctattcttaatgttttcattaattgctaaatttctttctggtaaaaattacttctatagcaaacagaaattacttaatgcttagagtaatattagaatagggcatgtcttgtgactcaatgtgatacacaaagtttaacttaaaatacttggagctttttttttagactaatggcctatgacgcctcactgttgtgttcttaccatgagtttgattgtgtttggaggggagtctaaggtcaatgatacgccttattttttcaggtccttattttgatgttgctttttaatggcggtcttgtttcttttggatattttgaggcatgaattcattatttagcccaaggcatcctttaagctctcagtgatctacctgccttggcctctaatttctcaatgtaataaggcaaatgtctatccctatagccttaaccaataaaagttcatttatgtgacattattaatatgtgaacatgacatagcattaaaggaatttaaatgctaaatgagatctaaaatttgggagttgtgacaagttctgttagacctgaaaggttcacaatattgccttacagtttcttcctccaacttctgaatagttcctgttcattacatccttcaaaccatgcctgatgatagtccctgagtgagcaattaacttaccaagaattacccttcctttaaaattgagaagtttttagtttgataacacaaagaaaatcctgatgtctcggcccccaactagtacccttataaattactgacaaattactgtaaatggctcttcttgcaatgctgtcactgatagataaatctatgctttatagttctggcttttattgtctcttaaaacatcatcagattgattttagagtagcaatgatataaaataaatacacaagatatactcccaataaaacagaagaaaagcatccttctttgtttctgagaattatagtgtgaaaagaaaaaacatttctgagcaccttttggttccagcagaatcatgtttgtttcgaaataacttgtaaattgtggagccagttcattgtataaaaactacagaactcatggaaagtccaatattttcattgtacatttatcattaaaaatagtatttttgatgagctgtaagagaaaatctagttcttatggtttaataaagatatattcatataatacattcatcagttataattttgtatctcccttatattgttccaaaacaatatataaatacagaactaacaactctgagcatgaaaagtctagtctgctgcagcaggtttctgtattaatttattcatgttttataaacacctaggtaccttatcagtgatacttatagagataaagataaactattcattttttcttcacacataacagtgataaacaaacatttgtaacatggataagtcttaattaactatagtatgtagagaggcaaatgctaattaaggcactttaaaattaagtagcacatttatcttttatttcagtctttgtcattgaaatgtattataaaactgtagtccatttaattatcttggtaagtacagtttagagaagataattgtgttttactttagtatatgtaatatttccaggggctcatattctttattctgaaagcagctactattgttcagacaaagttggatagtggaatgactccttataacagcacatcatttcttgggagatgaaactttctcttttagtaaattcaagatacctgcttgcttagtcacaatgcttctttttttctcataaaagtctgagtatagaacatgaaattaaatgtttcattagttgagcttcatttaattaacgttttactgtacataaaatcctaattagtaatggagagatctggctgctttggggaagaagtagtttgttcagtttggaatatgagatttttgttcggaaaataggctgacaccatgatggtatccagaagggatcaaccacatgagtgaagagaaatcatatactatgccaaataatgagctaaagttaaaatgtttatggtgaagaaaaacactgaacacgagatacatctatttgatgagctttttttgaaggaccgatgagaaatccttgtttagaatggactcaaatgtttcacttctcaaaatgcacttcacttatagatactcatattgttttgtaatatctacagaaacattttattagacatgttttccactataccccaaatgtcatacttagatttaacttacacattttcattttattgttcaacagatctattcatctgttttctgaggtgatacctgattccttgcagaaacttgatgacttcttatttgttaaattcataactggatttgttaaagttctatacctttcttctcagacttttaccattctacgattaaaaaaaagagaacctaggttttttttttgtttgtttgtttttgttttgttttgttttgttttctgtttggttccttactatttcctaattagctttctaaactttttctatatcaaacaaagagggagtcattgagatgaataaatgtcttatggagactgatatagcagaattaatcacacatggaaagccctaaagttgtcacatcattccctctttttattttagctggcttctaccaagacagtttgtaattcgcagtgaatcataataacagttttgattatttccaagtcagtggcttgttatgactttgtatttctttctccaacaatgcaaatcagagtgttttatttaaaattctgtgtgcttcggtgtatggtgctagactcttagttattactctctctttttttaaaaaacatgtgtctttcaagacagtgcaggtcaattctaaatcaactttttgctgaaattttagaaaattgcaggctatttcaaagccaactttttattctcctgacaaaggatggaataaaaaagtagggtagtataaaggtttagatgggtacctcaagtaattttctctaggtaaaggtttgaaaatgtaaaaactctctgctgaaacaaacaaacaaaaatacaccttcccacaaaacaaagcaaagcaaaacaaaaaaaaaaaaaacaacaaacaaataaactacatcaacaaacaaaagtgagcaactatttaggcaaacttcaaacttaaatataatcatacaagctctaccattacagaactttttttttttaacctcaccagttgtctgtgaaagaacattacctttgatgaatgaacatgggtaactaaagaggtgaaaatgtgagacaatggagaaactgaaaatgttaaaatgataagtagaaagtaataccttttaaacagaaaggaataggcaaaaaatactacactctattaataacgcacccctttttgtgtcaacaaatttcacattctttcccttggattctctgacaaaatttgttccatgtcaaaggttgcaatcaatacaatagagtgaaatctatgaggacattaatatctttgggaataaatggtctaaaatagttggaaaccttccttcttgttagtaaatgttaggggagttggatttttaacccaagatgacttgacttagattctaagaaaagttcactctttttgggggggctacatatgataagaatatgtagttagtatttcttatataccctgaaaaactactgttcttctcatatggtgaaagggaaacattcatgatctcatctgtctcttctgtttctcaagaaaacacatctaaaaatacagtccttctgcctgaattcctccatctataaagaatatgtttgggccttttacttctttttatgccaagcattattaaattttaataaatggcacattttggcaaaaatatgtagataggaatgagaaagaaaagaggttactgtaatttgaagaaagcctgtctttaaaacattcaccccagagtcaagcaacaagctcttctatagtcaaaagtagaaatcaaaatattattccagccttcctggccttatctgaatctaatatgtagtttggcaatacttcattcagtttaatggactatgtgaaataatgttgattttcattgctttttttatttgccttgaaaaatacaattaaaaaaaaactcttcaaacgccactacaatattgatagaattacaatatatttttagtctgaaagtgacctctgacaatttaatttcctgttaccttttttttttttttttagccttctaatgctgcaagatgtccctaatgcagattcctctttggtgatagtaagaaggcaacaacaatgtaggaagtgtaaaagagctactaattctcagtgtctgctcattaacatgagtaactctactcagaatcatgcttcttgctgagagggactctgggctacaaaccagtaggaaatagaactgggaaatatgttgcagactaagatttttagatgaaacctaatgtaagcagaagatatctgtagatatattaactttatgacaatcctgaatttgttgcttcgaggtttttgttttgttttgttttgttttgttttgttttgttttgttttgttttaaaccagatctccgttatagctcttagcttcctgtcttagggttttactgctgtgaacagacaccatgaccaagacatccctcataaaggacaacatttaattagggctggcttacaggttcagaggtccagtccattatcatcaaggtggaagcatgacagcatccaggcaggcatggtacagggagagctgagagttctacatcttcatctgaagactgctagcagaatatgaattccaggcagatagggtgagggtcttaagcccacacccacagtgacacacctactccaacaaggccacccctcctaatagtgccactccctgggccaagcatatcacacttcctaacagtttgctcaatttataaatggaaattttggtttagaaaaatgtttggatgctccatccttttgtcttagctccaaactttgtctctgtaactccttccatgggtattttgttccctattctaaggagaaatgaagtatccacatgttgttcttccttcttctttattttcttgtgttttgcaaattgtattttgggtattctaagtttctgggctaatatccatctatcagtgagttcaaatcaagtgacttcttttgtgattgaattacctcactcaggatgatatcctccagatacatccatttgcccaagaatttcataaactcattgtttttaatagctgaatagtactccattgtgtaaatgtacattttctgtatccattcctctgttgaggtacatctgggttctttctagcttctggccattataagtaaggcttctatgaacatagtggagcgtgtgtccttattaccagtgggaacatcttctggatatatgcccaggagaggtattgctggatcctccggtagtactatgtccaattttctgaggaaccaacagactgatttccagagtggttgtacaagtttgcaatcccaccagcaatggaggagtgttcatctttttccacatcctcgccagcatctgctgtcacctgagtttttgatcttagccattctgactggtgtgaggtggaatatcagggttgttttgttttgcatttccctgattattaaggatgttgaacatattttcaagtgcttctcagccatttggtattcctcagttgagaattctttgtttacctctgtaccccattttaatggggttatttgaatttctggagtccagcttcttgagctctatgtatatattggatattagtcccctatcaaatttaggattggtaaaaatcctttcccaaactgttggtggcctttttgtcttaatgatagtgtcttttgtcttacagagcttttcaattttatgaggtcccatttgtcgattcttgatcttatagcacaagccattgctgatctgttcaggaattttttccccctgtgcccatatcttagaggcttttccccactttctcctctataaaattcagtctctctggttttatgtggaggtctttgttccacttagacttgagctttgtacaaggagataagaatggatcaatttgcattcttctacatgataactactagttgtaaccctaacccggggatccatcccatagtcagccaccaaacgcagacactattgcacatgccaccaaaattttgctccatagaccctgatatagctttctcatgtgaggctatgccagtacctggcaagtacagaagtggatgctcacagtcctctcttggatggaacacagggcaccaatggaggagctagaaaaagtatccaaggagctgaagtagtctgcaactctataggtggaacaacaatatgaactaaccagtaccaccagagctcatgtctctagctgcatatgtagccgaagatggcctagtcagtcatcattggaagagaggccccttggtcaagcaaactttatatgccccagtacatggaaaagccagggccaagaagtgggagtgtgtgggtacgggaggagggtgtgtggggggggaggatataggggactttcagatagcatttgaaatgtaaatgaagaaaatatctaacaaaaaaaaattggaagtcatctatttcagttacttgaattcctcacagcactttcatgacaaatggcatgaaatgcatacaagcatggcacatttaattatgccagtcactgtcttctgaatatatttgacctaatgaccttttgaagatgaggattgtaaaatcagacacaggcattaggtatttagggggaagctgtgatgaaactaggaatctgtctcttcattttccgaggtgacctttacagtcatctggatagggaccacctcatctgcatcatcctgctaactcaccagatatagatacaggtagaaattcattgtctctctgcgcgaaaacaatggttaaatctctttacttccttttgtattactgttcattcatttatatttcaatctaattatattaatattaatcttatgtgtgtgtctgagagattgagagagagagagagagagagattttgaaggactttataagatgccccactgatgtgaggtataactacccatttccgtctcctaccaacttgtttattctgttttaaaagaaaataaactaatccattgtcttgttctgagtatacttctactgatatttagtgccacaaactttctagtgtaaagatatgtcaatattcttagacgtctttgctaagggtcagaaaatattagctccttaatattcattcttcatgaatcttggccttcagtttattattggtgatgcctcatctattcttttagtctaaaagtaactttattttttactgaaaagacagatatttaataaaggttatctagttatttacccaaggattcatctgaaaattgttacatcactgactctaacagtattattatctatctctctttaatttttctctaaataaaatgcctctacctctgctgcacttttccagtctgtatcattaatacattgtataaggtttaggtagtcagggtcttgtctttggtatgacattatttttacctcttaacatccagcaacaagtgatttataaactagtaaattactttctatctccttccaatattactaacatgatgatgatagagaaggcaatgacaaatataagtgctaactttctaagtactttctatgcaccaaaaattagtcaaaatatttatcccataccaattttttcaatgagtttcactcttttcatatcaattctcttattatctttctcttacatatgaccacatggaggcataaagaggccaagtattattttttaatatcatggttagttagttttgaagctgaaattcatacattgtgacttcacagcctagaatcttaaatttcgctgtgttacttaaggacattggttagacaggaaaagagtgaattattagaacaaccgtactacagtctcataatatctcataggcaaacatggagaatatgcataatttatagctcttcttatctctatatctccatacttaactatcctctccagttttcattgtcaacttctgggtttcctctataagctcctattagctcttcagctaaaatgtaaagtttgctagaacatggtctgctatggatactcatttgtttcatgaatattctagccaagcacagtgctaagcaaagagaatctgtgaaatattaaacaagtgacagacttttcaattcattttcaaatgaaataatgagatatgtcctcctagaagaagtgtgtgtgtgtgtgtgtgtgtgtgtgtgtgtgtgtgtgtgtgttcatgtgatcaaatgcattttcaaattatctatgtgtagtgaagaaaagcatggtgctagccacagagcaagtgttctgtgactatatggcaaatgaataaatgaatgaggtagagagagagagcaagtttccaatgaatatgatcaaaatcaattgtccccatgacttattctacactaggcatactattttgtaccattaaggaattgccatgaggcattagtctgtttttagcttcaaggcatagttattgtacaagcaattttaagtactaatttcttgtaatatccattaaaagatgaatgtgtttgcgggtcctctatgtttttaagtatctaatatatacactaatgacatgaaagtagaagcaaaactgtctgaggagagagggggttgcataaaaggaaggggaagaagtcagaagagagtgggatatgggtgacttatctcatgaaatactatacatttgtatgaagagaccttatataaccctgtataatattcaaaataatttaggtaattggaaataagtatatatacttgtagttcacacacacacacacacacacacacacacacattctccctttcagatactgaaatacaaactccttatatatccaaaccacttatatgattttcatataacctgtatatatccacacattttgtctgtcatctctagaacactgatacaagcgatgtcagtgctcactcttcttatcttaaatactaatgtgctccaaattttatttctaatatagctatgagttttagagatattcttatgcactttctaagtttattcatgtgaatagtggtttttatatatatgcatatatgatttaatgtataaatgtatgtgatgtggtatatatgtatgtgtgtgtatgtgtgtttgtgtatgtccagagaaatgtatacatattttgcattattttcctttgggtaagtaaatttattcatataccttacacctgggtgaatatgctttattattttagtatcttggtaaatcttgaggttcaaagtgactcgtacctattcaaatttaatataagactttagacaaatcctttcataacaaaaaataattggagaacatatgatggcttaggtcttttatatataattatatggttcccagaggggagttataattgaattataagctgcctcatgagtattctagctggtgtttagagaaccgcaaagcagagctgagcaatttttttctccagctaggctgtgaataagacaccctataattcaattataactagcctccaggaaccatataattatactataaagtagtttagggaaactaggaaatgggatgtttttcaacacattgtatatgtttaaaataataattttataattctgctttacccttcaacttttccaagttcacagctctgggaaaacttttcatgaccatattctcttatgctttttatatattttaattgcaaattgtcatcctaaagaatccttagattgcccccttttcattatggtctgtgtgtatattcatacatatcatttaaattcttgtcaactttttcaactataaaatgattaaacttgacagaaatgacttgagaatcattttccagtaccaagagggactgatgcttttattagtcagggttcttcagataaacagaagtttgtttgttttttttgtttgtttgtttgttcttttttgattttcttgcactttcaccaaaagcctgataaggaatggtttgaatgtacagtagagcctagggagaaatggacattgcagaaccatgaggctaacaatggcattacatccaaagtcagaaaggagagagagagaaagagaaagagagagagagaagccactgcttactggcatcccctttttatcatttttattcattctagtacaacagtctatagtatgatgtgattctcatttggagttaaccatccctcgtcatataaacctccctggaaacactatcttacgtatggaaagcagtgtgtcatctagctgattacaaatctaataaaatttaaaatgaagatttctcatcacaaagaaccacgaataatatgataaagagacatagggatgttatagcagtggtgagactctcaagaaactcgcttatgccattgtggagctagcaatctacatggcagtcttgcaaggaaccatgaagaatgtgaatgttccagcatgagtctgaaggcagtctatcagcaaagattctttctttggaagacctgtctttttccttaaggctaccaactgcctggatgaggcttacccacattatagaggataatgagctttacttagtgtctactggcttaaattttaataccatttaaaatattccttcacagtactatctagactggtgtttgagctgaaagtgagcgctaaagtacagacaaaattccacatacagaaaccatcacgcattgatacagggagaatgtgctgcattattcaggttctagttcttcagatttcagataacctcactgggacatgaacgaaaaatagaaaggaaaaacttatctttgaaacattggaataatgtaacactattattgatattttacactgaaaaatagatagatggctttttgaggaaaagggaatatcttagttgcttttctcttgttataaagaaacaagataacttatgaaaagaagcatttaattggtggcttgcttcaaatggcagagggtaaagccctgatggtcatgttggggggaatggcaacaggagcagtagctgatagcttacacttggtccacaagcaagagacagagcaccaatcggaatgaaatagacttttgaaaccacaaaccctactgtcactcccatactttctccaataaaaccataactcctaatccttcctaaaacatctataccaactaaggaccaagcatataagagtgcatggtgtccattctcatccaaaccaccgcagagtatataaagaatgagaatgtaagtcagaagaggaagatgaattctgtgcaatgctgtattcaagaaatgccaaggctgttgcatggataaactaaaagcatctgtcacttatataatatctttgcaagatcaagccaatttatcccagcactgatgaggtttctaatgctccaccttttaatggagccctgttggcagttcatggttgctaaagaaaggacggtccttttctttgaagtggttgcttctatgcctcagtggtcaaccacacacccatgaagatatggtaaaattaactggattcagtgaatttagtcaaaagaaaagaacatgaaataatgagatgtggtgggagggctcaaaagagaattaggaagggacatattatcaagttaaagtcaaaagatgaaatctgcaaagaatgaataaaatatcagctaaagcaaaaaaaaaatgagaattgacatttttatttaacaatctgtatttaagttatgaaatctcactttcttctgttttatagaataaaatattaatttcataataaaaataaagtttaataactattttttttcaaaagaactgtgttcacactgaattccttaaaaatttctttgaaaatttccatattatgagtaactggtggtgctatgacttgctataatagaaacatattttttttattttttagctccattatacttatacataacatttgtcaagaaaatagtataattgtgctgattatattaatttttaacataaaagtctcacttaaaaagtaattcatgcatatgtgattagttgctcataacatcactatttctactaatgaaaaatggatgtgattaagtctagcaacttttaaatgggaaaacaaaataaaatatactattatttatataatatgtgtatacatgtgcctatgaattgtaaccataatgagaggctctaaggcatactacaacatgaaataaagttggaaacattattttcagtaacataatcgatttacaatgacaatatcttatatgctgccatttatgtaaagtatcaataacatacataagccagacacataacaatcaatgtgtgctagtctattttatacagaatgtgaaaagttgctcttatataagtatagagttagaattgttgctagtagttgaaacagttcagatagtttggaaatgtgttagacaaatggtggagaaaagttctcataaagtacaaatttaaagttctactactgtgtaatataatgtgatgactactttgaaagataaattgtgttttaaaaatatagtaagaaagtgagtcactgaagggtgggagaatacatggaggtcctccattctctcagaggaggaggggggatgaaggaaaggactttgtgtgtgtgtgggggggggtgttggggaattgggggagggcagcatgggatataaaatgagtgcataaataaattagcataaaaatatcataagagagtgaatttgaactgtactcatcacaagactatctatgagaatagcacatggcaattaacctaatatataattaattagcttaatataaaaattgcaatatataaaagcatcttgtatatcataactattgatgattttagctataaattttaaaaatagtaagtttgaaaacacagctatatccacagatgaaaaattattttgtaagttggagtagaattctgagatgaaagtaggaaatgagggatgcatgctgatgagaacatttcttttcctgagattgattatgttttactttaattttataatgatagctaaaatggtttactttaatttttatgatggttctatggatatatgaaaatgataggactatatatattaaatatactaatgataatgtaggaagtatatataaataagagtatggtaagagcaatatatgtgcaggaaaatattcatatagtttggaagaggctctattaaaactttagtccccttgtcttctcactgtagtctataatcacaccatcctttttgattgcctattagtagacaatgtcactatttcttgcctttccccaacactccacagtctcatgatgtatttttactaacagtgttttcagaatcttcctataacagcataaatccatttttgccattcttttgagtatattcctttatgtggatgcatcatgatctatttaaacatttccctcctgaggaatttgttctttcaagggcttgcaaaaatgctgcatggacattctttgatatctgcttacaagaaagtacaaaatatatctggaggatgaactcttactagtaaaaagaatgtgcattttaggatttgataaaggtgtagtagagggagcaatatattttcttgatgacaatacttgaaaatgtttgttaatattggatactatgaatctctcatctttgtcaccataacagataaaaaacaactccacatttcagtttctaactttgctgctgattatggatgcaaactatgctaattgactatgccctttcttcatatttctgttaagttttagtacttgcaacattccgattgccctttaaagttcctgctgttttacctttttactatattcaacctacattggggtagaatgcttcttgaaaatattcattttgctattttcaaatacattctgctctacaatgggaaatattatgtgtgctgaaatcacacactatgtgtgttgctctttccttgagtccataaagtttcttcttggagaaaccttcaagttaccactgataataagtcttcgactgttcagacctatatctgcatgaaaatcagatagacctaatttcaaatcttaggtttcctcttagataaaaggatctttatttatttttaattgttcacagattgaacaataaaacctgatatcattaaacagatttcgtatatttttcctttgccaaggcaatctcacttcacctaatgtaacagctgtcatagtgcttacattatttgctaatttaattccattacttttttcacatactatataaaaggacatttacaacacacagttttaacatggagacaaaatgacacattaaatgattcaatgtagaaaatatataaatagaggtacaaaaaaatactgactacaacattagctaccagcatcagtgtgctttttttctttttctaactttcttttctctttttttaaaaaatgatttatttatttatgtatatgagtccattgtcactgtcatcagacacaccaaaagagaacatcagatcccattacagatggttgtgagacaccatgtggtttctgggaattgaactcaggacctctgggtgaggagtcagtgctcttaactgttaagccatctcggcagcctcctttcttctgttcttaatatctgcatttctcccttgttattgtgaaagcaataaatattcatggctaaatatataatatattaatatccttatgtgtatgagtattaatattcaaattatattataataatcaagataaataaaatagctctattcacctcctcacttctcttccactcatttgcctcaaaatatatatcacttcttgcacattttatatcatcttcatggaaatatatatatatatatatatatatatatatatatatatatgtgtgtgtgtgtatacatatatatatgtatatatacatatgcatatatgtatatatatatatatatatatattaccttacaagaacatattcatgcaaataaatagatttcctttagtaacagttacctcaggctgtacactaatcccagtgcaatatttgctacagaattgttggatattttgggggttattttggtatttggtattttgggaccttggaaattattcaatacttacactgctgtgtttttaatttcactaaggataggtttgatttcagggaccaatcaaattttatttggggttaggtatgtgtgtgtatgttatgcattcaacctatctaaaatggtctttggtcaaaatcaccaggacaataatgattattctcacaagcagcttataagaaaaccctatagattattgtcaacaagtaatcacaacaacactgagaaatgacagtgtgtatacctggtaatcaaaggtgatatacagaatcaattaagaatgtggtgttcatttgagcatacagatttttttctgtgttggtttttagatgtcatacttctgttgttctccttacaaattcaccttagttttcatatctaactacttaagaagcatcattgtaaatcagcactgtggtgtatatacagcaagattatgcttctgttagccccaggggcataatgacagtcttagatgtgaggaagaacactgagattttttttctgtaccttttaaaatacccattacataatagctctttattcatctctttttttttaactcttcacctttctaacttccttcctatcttttctctttgttgctccttcccctcccctctctctttaattaaaaaaaaacacaaaaaacaaacaaataaaaatggtctgatgcatctgattctggaacaaatgcttcgatttcacttcattcttctcttcagagaagcagaatacatctcttaaggtattcagaatcaccattttctttatgtggaaatattttttcaaatctttccttaagatatttaattaaataattcttatgtactaattatccaagaatttctttcttaaaatctgcttttatttccactagctttgatgaccagtataagaatttggatttgaaattttaaaattactataatcagtgatatgcactgcctggttgcagtaaaaattgtatcaaatagtttctctttttaaaaattcatcagcataatatgaaaatactaaatggtagggacattgatgcacttcaatactcttttttttctcttttgttttattggatattttctattttatttattttttattttttggcctgtgactaatcttttataattattcctttttattggatattttctttatttacatttcaaacctttcccaggtgctcactccggaagccccctatcctatccccctccctctgcttctatgagggtgttcccccacccacccatctactcctgcttccccaccctggcattcccttatgctggggcatcaagcattcacaggaacaagggtctcttttcccacagatgtctgacaagtccatcctctgccatccacatatgcccctggagtcatgggtcgctccatgagtactctttggttggtggtttagtccctggaagctctggtggggggggtctggttggttgatagtgttattcttccaggtgtggtggtacaggcaggtaggatttgctgaaggagacagaggcagtggaatcaggagttcaaggccagcctgggctaagcacttcaatattcttaagacaatccatgattacgagacatgaaagatagaaattgtaaaagccattcatttctaagcatcagaatggtagagggagtctaacattttgaactgttaataactgttcaaaataattttgtctttaactttcaagattaaaaacagtgctctagaatatcttcttgtttccttcaacattgtttttccagatgagtcacgataggacaacctgattattgattaacttttaattcaaatccatactttgttgtaggcctctaatgaaagcctttgttagacagcctaagcttcatttattaggttgcctgtgattctttgcaccaatcacttcccttttggaattggcttatcattgtgaggaccaaagaaatgtgggtaggatgggcattttcaaatggttttattgaattcccattacaaaaatgccttttcttgctgagtgtgctcgttactgtctttaatctcaacactcagaaagcaaacaccgtagggttctatgaatttgaccccagcccgatctacatagagagctctaggctagtcaaggctagatgagaccctatctcaaagggaaaagaaaatgatttccttcattagcaaaacatgggttgaatatcttctgcatatgaatcaccatgaccactaccagcaatataggaacacagaaggtgcgcctttgagcatggaagttgaaaaaaaagggaatattataatcagggtaataaaatagaaaattcctgcacaaaagtatggcatattattaattggatgttctaaagcttttcagtgtcttctcctgttagaagaaaaagttaagtgcaaacataattaaatcgagaactctgctacttatgagttgcaaagtctccttcaagttgcccaaattctgtgggcttaactttactctttgtaaacttgggaatgataactattgtatagagtttgggtaggcatatttgtttatgaatataatgtgacctttttattgaatattcaatgcaaaacagaaggttgaatgttcatctatattaatacatatatgtttatatagatgtcatgaggcttgactattttttttctggaaatgagattttcacaattttaaaagtgacaggcacaggagaagaaaataactgtattttcctaaagtctcacaactacttgtagaaaccaccaaccatgcttttatggtgatgcattttgtatctttccagcatggcacgcatattatggttgccgtaaacacaataatttcacttgccacttaacttcggtctcacacattttcctttcagatttccctcgcaagggtcatgtcatgaaaggcagtgtacagaaaaatggtaccctcccctcctccatgtgtctcctttatattctctgatatcttccctgtcaatttgaagtcttaaaattggactcaatctaaggcatcaaaagccagaactgaataaagaaataaaaatatttgtggaagacactacattttgtgtttattttcccaattgttcttttagagtttttctctaaccaatatctaaatatccgattattttggaaaaaataaatcagttaaccattcatagacagtttttaaaaactaaatcatcgtctggaattttctgattttatgatattctggcacacagctaaatgtatcttgtcttgaggctaaagtttcaacttcatcacattttttgcttaactgaatattagctctgaattcactctatttatcactaattaaaggtcctgcaggtaattttacttgcttagcaacttgttataaagactgcttaggcagcatatgtgtattttaagaaacacatgactatcatgtgcaagctattgtgtatttactgagtcaactgataaaatattcttttttccaaattctgaaggaggattgttttgtatatagaagttcctatagtcatgggatgattgttagaaatataaacaaagagaatggaacacttaaatattattcattaaattaagaagcatttctacccagatagggagaaggatcagtcacgtgcttgctctataagcaacagaatctatattcagatccttagccaccagttaaaaactgtgcatggtaacagatgcctgaaattctagtgctgcagaggcagagatagaactctgggatctctttggccaactattcttgccaattggtgagctccaggttcactaagatgagagattctgtctcaaaatcaaaggcaaagaacaatacaagtggacaccagacttcaacctcagtcctccaaatacattatcattcacatataatcacatgattgtcaacaccctgtatatgcaccctgacacatggacctattcctaagtacttactatctatcagttagaatgtaaagcaataagaatgtaccaatgaaattgacagatcccatctcttcctttacagaattagaagaggcagaggaaagagagacataaaattaaaatagtagcatgctgaagcatatataacacatgttataagaaaatacaccagggactttaatttagtctgaagagcagaggatgctttctatagtaagtaaaatcacattgagaggtgcaaggagggcaagagtgacatatacaaagaaagctggacaagtccttgtggaactgcaatagtgattctcaacagaggacaattttgctctgatcagggaacactttagtgtctccagagaagagtctgaagtaagagcaaaatggacattagattatagtgaccagagtttctgtaaaaaatttaaccgctctagtgaagagtgcccttgccaaaactgtttctaatgaaagacatagaggtcattgtttcaaccattactgagtatttattatgtccttgataagtatggggaaaagaacattaccatcctatttagttccatctggtaaggaagacatatattagctccaagaataatcagtaatagaaatgagaacattgtgataaagagatattaagtgggatacctcatatagcatcatgggtatgatacttaactgggcttaaagttattggaaatcaaaagaaatattttctgaaacctctggaatcattagtcccaggaagtacagttatagaagattttaaaaagcagtagggatcaaagtcaaggctaaaagatgatgtgggagaaaaatcagacttatcccagtagatggatgcttctcttttgatattataggctacaaaatagatggggtagtggaaaagaagaggttgaatatgtagatgttgcttagactctgaaattctcatccagtgaacagaaaaaagagtgtccaggtgaaggtcaactatgtttccttgatcatagagaaacactgtcatcagcacaaaatgaaaaaatggagataaatagagattttaaagcagatgaaaacttaaaatgcagcctataaaacacaggtcatatttaggtgatggatatacactggattcaagataatttcatgtcaatgtatataagactttttttttttttttgcaccattcctggaggtacttcaataccaggtcaatacgtggcgtgggtggggcaagctcctattccaactcctacttccaaaaacccatttaatatattgtcctcagatagaggacatatcagatattaaactaataaaaacagatcttagcgtgatcttagccaaaaggctgagaaacgatgagacatttcttaaaagatgtcttcatggtaaggcctaatctttgaagacttgaatcaactcaatccctcttgtatttctgctactagccaaggcaccaatggaacaaaataagccaataagtgagcatgtcttcaatataattccaaattggggatatctaatacacttctttcttaaaaatgctttttatctttatatatgggattttaactactagttatataataattatttgtttattttttagtttggtcctacactgtaatagaactgaaatttatttagatatgtcatgtatattctataagcattttaaatccaaagaattcatatgtgttaatgtcattcacaactttacatttaaaatcaacaaaaacaaagagttgtagagttgcaattgcggctagctataatatatacttcactttgcaggcgttactacttgggctccattcctttttcttggcagcatgaatattgcaattttgtaactgcaatgtgggggaaggggaatcagattttttaaaaagaaatcattattctttaaacttttttttaatagtccagtggttacccccatcccagtctgccctttgactgatcctcatcccatacctcctcccctgtctccaagaggatttccgtatcccccaaccccactctaccagacctcaccatttcctggatcctcaagtctcttgagaggtgcatcttctttcactgaggcaagaccaagcaggcctctgctgtatatgagttggggacctcttatcagctgggttatgctgccttgttggtggctgagagatcccagggttccaggttagttgagactgctggtcttcctatggggttgccctcctcctcagcttcttccatcctttccctaactcaaccacaggggtctccagcttttgtccattgtttgggtgtaaatgcttacatctgcctctttcagctgcttgttggacctctctgaaggcatctatgctaggctcctgtatataaacacactatagcctcagtaatagtgtcaagccttggagcctccccttgagctggatcccaatttgagcctgtcactggacctcctttccctcaggctcttctccatttttgtctctgcagttcttttaaacaggaacaattgtggatcagagttttttactgtgggatggcaaccccatccctccacttgatgtcctgtctttctactggaagtggactcttcaagttgcctcttcccactatacagcatttcatctaaggtccctacctttgagtcctgagaatatctgacctcccaggtctctagtaaattctagagggtcccccacctcataccccccaaggttgcctgtttccattctttctacagttcctcggggcttcagtcctgttccccaccccaccccaatacctgatcatattccccctttttctccctgtcccctctaccacccaggtacctttctctctctgccctacccagcaccccagtggttgatttctgctccctaccaagtgggattgaggagtactcacttgggccctttggcttgttaaccttcttgagttctgtggattgtatcctgggtattctgtacatttttttgactaatatccacttattagggagtatgtaccatgtgtgtccttttgcatctgagttacctcactcaggatgatattttctacttctatctttttgcctgcaaaattcatgatgtcctcattattaatagctgagtagtattccattgtgtaaataaaccacattttctgtatccattcttccattatgggacatctgggttggttctagcttatgggtatcacaaataaggccactatgaatatagggaatcagttttgaatccaatcacttttccctacgagttcaaaattgctgccagtatattaaaccaatttagtcttcaaaatattcagccatttctttctggttaggttcaagaaattttcaaagatctgccaacaaagtgagaagaaaattgcaacaatgcatagaatctagtcaattgatacagaagtgtttcccaagtgcccttgcacatttatcaaaagcaaagaatgaaagaatgaggccagagtaaagattgaagcattattctctaaaattttcacactaacctagtgtcactttgccatgtagtctttaaaaacctgtaaaaatattggcttaaaatcagtggaaagagaggcccattggtcgtgcaaactttatctacctcagtacaggggaacgccagggccaataagtgggagtgcggggggggggagtgggtgagggagcggtgggggaattttgggataacattggaaatgtaaatgaaataaatacctaataaaaatataaaatttaaaaagtaagtaaataaaaattcaacttaacatagttaactaggtcaagtattagatatatgaattatgttgatattagttttcctctcatgcacatctatcaaagtatcatcattacacgtgcactttgaatatttgtcaaccaaatgtcagcaaatgtaaaaaaaattaactaaaaccattccgcttttagaatatttgcttgagggagcaaacatttctctgcttctgtttttgtttttggcaaagcctgaaacatttgttcttttaaaagtacttagaagctaggtgtggtgatgtatgcctatatacacagcattcaggaggatgagagaatttcaaattccaggataaccaagactacatagcaggactctgtctcaaagagtacttggagcttgtagacaaaggagctgaagttatattttgttatattatattgggttatatattttatttgagagatctgtccattatcatagagcaatttagaaaatattataatattgccaatcctcatatgattgacaagcaacaccttttttttttcatattgttaggaattgtttctctgtacaattgtatgaaattttaaaatctaaaaagctaaaaatattttaaaaaataaagtcatttcaactaattggctttttaattgtgtagcactatgtggggagttctgtcttctcctacaagagaatacacaggtttttgctgatttgagttggtctcctcccacaatgtttcttttcttttaaaatcaaatgcattaaatttctttattgcatccaattactttgttaattgaaaaggacggcattccactttcattatatgttctcgttttctacatttcttttaatttatggaacaataaaaagtaaagcattgcaaaacccaactatttaaagagccatttggtacagtcaccatttgaccttatttatttgaattttccagacttcctgtgatttcagttcatctccctaagcatggtttgttagcttcattggttattttcaacagcacattagaagtcccctgagatcttgctttgtagctgacatttggtgctgtttctgctgtcacttttaagattttgtacttctccagctgtcacattctagagtaatctgttgtgttgtctgcatttacagacgccaagaagcagctaggaaatatgaataagagtgtcattacactgatacttctaatgagaagtaggttttgctttctctaattaataataaatggataagggaaagcagtgagacaacacccagaaggtaatagcaactcatagaatgagagaaaatatttgcaagttttataagcgagtacatgaataatgattgcacatcaataatgaaaaaaataaataagataaaagggtccaaggttctctaaagaatgcacctaaatgaccagtgagcaaatgagatcaatatcattagctatcaaggaaatgcaaatcgaaactcagagatgctatgttacattcactaatatggctacaataaagaggaatagcaatgataggattagagatattgaaacacatgtagattgctgccaaaatgttcaatggtgtggtcattgaaaaaaaaaaaccagcttcttaattgttcacaaacaagaaaatagacatagttcttatatgacccattgatttctttcataattataatcaaaataaaaaacacacccatagatatgtattcagtgtgttcatgacaacattagtaataaactccacaacatatttatacaatagagaattatttatccctaaaagaagtagggtattttaaatgctacaacttgaaaatagagctttgcaacattatctaattgaaaactaccacagataaaagaccagatattgtataattctattccttaaaatgtctagaatagctaaattcctagaaataaaatgaacattagtagatgtaactggaggggaagaggaaatgactaatgagtagaattggaattaacaactagtgacacttacaaaattctggaaaataataaaaggctttgaattatatactttatagggtcaatttcatgatatgaaaattatatctcgataagatgggattagaataaatgaagaagagaaaataagctatatcatgtacttaagagtgcttccagatatacccatacaaatttcatgtctcatcatatttgatgtttacaacaactgcaactgcatgtatgctgcagtctttctacttcacatatgaataaactgaaagatagcaaagtggcataaaatattctccaaggtaccagggcctaaaattcaaaaatctgcatagtgatccaaaaccaatcttacttctttttctgtattttaatcacagttaattatcacagcatacaattcattaatgtaaattaaccattcattcagtagttttggttgtattcacagacaggagcacatctccatggtttcagagcatttaagtcatcatcaaaacaatctccactttctaatgaattgtatatgaattatagcttagtaaatttgtttttaaaaacacttagtgacatttagctatcaacaaactccccctcctcttccacatgccaatcataacttgaatcactgcattctctttttaatctcttagcatatatagaatcagggaattatagacttctttgtaagagatggcctcaaaatgtactgtttcctcatacacctaaaaggccaaggaggaacattctgggttttgattttgtctttggaatcccctgcactgttttaacgaggaactgagtagtctcaaaatgtaaaagggatgtttcgcttctgggaaagattgcaaaaactgtcaggaacacttctggggctttaaaattgacataatgccctctagctaaatggctttgctaagtggctttgccagaaacctttcctagcctcctgtcctgaagctacagctttcctcctgaccctcttgacttcagttgagtgtacgtcttccagttaacaagtaatttgggggagtgtcaaaaggtaactagtgtcccctgggttacaattaacctaaaattaagaggtggagtttaaaatcctcattaagtataaggaaaacataaaagctagcttcggaattggacttggatttagaaagtcacctttaaattaatgaaactgactgtacttcaccatagagcaagcaagttatttgagagaggactgaggaggagggagaagagaagagagagaggagagtgtgtatgtgatttcatgtattttactggctaattaaaaattagtagaggaaaggatctttctaggagctgttttctatgataccactcattcactatgcacataatgtccttcagttttaattagcactaatttttgaaatatgcctgtgagtgttacattatttgaattatgaattagtgctttctcgttaaacatggtccgatattgggaagcatcctatttccataaaaaatttgatgatttatttttaaatgtggaataataaaagcagttgaggtctttaaaaatgatttacagtgaacacttacagtctgacaataaattctaactaatatgtacttcttataatggatgcctgcagattatcaattctgagctaaaaatgagaaacaatatagatacggttattgctatataaaccttaaacacctgtgttttgctgcatggttacagcagctaaatgtttaaaatatttaattattcagatttgctaatgcttcttttaaaatgtctttagaaactatctctataagcttcttcctgtaacatacacttttaaaccccattttatcaaagtcattttgtggaccccctacaagcagaattatataaatacaataaataattttcaagtaaaaaatttggagagagattcaaaatcattaccactttaaacaacattcatacctgaattgttcccatacatttcccagaatacgtatgccaattataggaagcgatatgcgtgtttacttacttcattagcttttctttattaaatcccatgaatgcatgtgcacacatgcgcccatacacacatacacttgtataagagctcactcatttatctttacctttctgtatgtctggctattatggatggtagttcattggtttaggtgtgaaatagttatgaccagactgacccacagtcagcaaagtatgtctcttgagttatcgagaaatggagttgatggtgacagttcctttgtgacttgaggtatatgtttctatatatagtacttggagttaagctttcctcgtttttcatgggtcagacaaaagattattgaatttagagactatattgctgatcactacaccctggggccaagagatcaggcaaaagataactggtctatttgaggattgattcccccaagtttggttgtcatgagctctaggcttagccaaaatgtaacaaaggacaactgagatttatatggctattgacagatatagactaggtatcaattaatagcatatttttcttctccttggaaatgcatgtgaagaggcaaatttatcagttctcatcaagatatctaagctatctggcagtttcaattaactgagaagagagccatgtggaagcaaatctgttagcttttttaaagaaaagtattgaaaaatgtatccaaatggatttgtttgtgggacacttaatttttttttgttgtttacgtatttactttatatcccactccctgtacccttcctggtccatcccctcctacaatccttccatcgtctccctccctttcacctctgagtggctatgagccccctggctccgccctaccttggcacatcatgtctctatgaggctaggcacatcctgtctctctgaggccagaccaggcaacccagatagaagaatctatccaacatacaggcaacatcttttgggatagccccttctccagttgttcaggacatacatgaagaccaggctgaacatctgcttcatatgagggcagaggtctaggtccatgctctttggttggtggttcagactctgagagccctaagggtccaggttagttaactcttttcatcttcctgtggagttcctttctccttcaagacctcctgttctttcctaagagtccctaagctccatctactgtttaacttgggtatctgcatctgtctgagttagctcctgtgtggagcctctcaaaggacaacatgctcctgtctgcatgcaaacataacagaatatccttaataatgtcaggaattggtcagtgcttgcccatggaactggtctctagttgagtaagttattggttggccattctttaagtcttttctctatcctctgtgcctgcatttcttgtagataggatacatttggggttgaaagttttgtgggtgggttgttatctctgtcgttccagtggggttcctgcatggcttcaggagtaaggtagaaggggttattagtaggtgagccacctatatcattttcttgatccatgcatatgagtaaaaatgaacagcataagaatattaaggttttatgcccattattttcattcttcaatgcatttatgaaatgagaaaatatctttttctatttggtggaccttttctcagattagtttatatgactggaaactgataagaaatttttgaatgtcttttagattttaatgttgctttttcaatattttggtttgtttccaaaatacctcctactatacagggtgcaagggagggaaatgataggtctgcttcatgtggattaaaaactggaagcatatgttttagtgtttggtaaatgagaaatagtttactaatacatatgtagggggtccttttaattacaattaattaatgaaaaattttggcttaatctgaatgagtcattggtgtgctttaaactcacgaaatacatgaatgatttgatggtgcccccccaggaggatttgaagtttagtggtgataaatcactgtcttgatcactgagaacagattactttccaccttcactggtcacaatgatgctctgaatatccatgagaaaaaatatgcatgctctgaaagctaatatgtagcttttctatatcatgaaggcagaatttctaatttccatgccatttgatacaaataagctataggtacagttgtaaggcatatagtagaaacaaaatgtaagagcatatatgcatgctgccatcttcctcatagattaatacagagaaacatggtttaattaaaacaaaacaaaacaccatagccatactgtagctgtgggattttgtaggatattattagttagctaatgttgataaagtaaataaataattgttaagaagtgaatcactagttagacattaacataatgttaaaactataagacagtcatgtctttcaatgaatatcaaccaacaagatccccccaaagcttccagggactaaaccaccaaccaaagattacacatagagggacccatggcttcagctggatatgtagcagagaatggccttatctggcatcactgggagaggaggtcctcgttcttgtggagacttgatgacccactagggcgctgaggcaggagtgggtggatgggtgggtgggtcagggagtgccctcatagaggcagagggagggaggatgggatatggggcttgtggaggggaaacttggaagggggtataacatttgaaatgtaaataacaaataaaaatgaaaaatagtgttgtgctcatgtacagttgatttacaacacttagaagaacaaattcgaatagcacttgaatataatagatagatatgaatgttttctagcttgactatctcacaaccaggaacttatatagtcattgatgagtaatacttttgttaaatagatgcatctctatttttattatattttattaaaagagagttcatagaatgtcatgattttataagtttttaaaacatttgtactttcaaagatacctacaccatatttaattgtcaaaatccaacaaatgtaaattttctagtcagatataacttttttacaggcaaattctgtcatttaaagtattctgaccaaccagttgttcaattctaagattgaatctgacatttgatatatactaatatctaacacatttatttcagtatctaataaggtttttgaaccttattagctaatattgtctgtcctttcccaaacattaagctctactagatgatcaatcatgtttcttttatcagacttatttaacatctactgtattctaagattttcacgacaatgcccttgctctaaactggtagctacataaaatcttgttttctttttcttcctgaaatagcttctaccttaccaagtacagtgcctaatttattcctttagacctaagaggttattgcagcatcattcagatataaatttacttccactgacacatttttctagtatttatcaagagtattttcaggtgtgttttttttttctttaaaacaagttttaaaatagaagataagtatggatttcactcaagaattagagagagcgccagacatgaagaacatatgaagggtagtactgctattcacctgctaagataaacaacagatgggataaggaatttaagaaggaagacatagaaaggaaaattagagtagcaagtgtctaagttatcttcttaactgttcttcatccacccaataaaaccagtaagaatcatccccactaatttctggcattcacttcaaggtatattgctgcttttaaatttaaattccaagtatttgatgaaaagaaattaatgatcagtcgcagctctcaagttgtttcttgcttttaagatcagtgaagacatacttaaagctattgaagtttaaaaagtgcccattaatttaagtatagggtgtatctagagttgagaggttttattatgtagcaaaaaagtaaaacaatgatagaatctttaaaactaattaaaaactagatgttctgcttgagtagatatatttacataattcgtgtgacattcacccttttggttaaatcctctttgggtatattctcctagtttctctctatttcttcctccttactgtttattcatgctttattcacttctcttcaacattagaatgcaaagagaatatgtaatctcatgaataatacaattcaaaaggtatccttaacctatttgttgaagagtacttagtcctccaatcttacattgcattgttggttatagtttatgcattagactaaaacgaaataggaaaaaaataatgttggcatctaacacaactatactcacatttactgctcagaatgtacagagaatgtaaagtgttccattttaaaatatttatatggcataaagtataagaattagaaaggatctttgaggtcatctctactttttaattaaatttagattgttttcttttaaagttctttcttccaatgacatctgacatgaaagttcagtgtgaatgggagaacattagggctcatagtctctgctcattattggttctgtgaaagcccagaggttccatagactttgaaatgaactgatagtttcagagatattgtgcaatgaacatgtgaacataagcccaaatttatgattcccaatagctacatttgtgtgttttttaaaatttagcagaatttcttctgttctagaagtagtcagtttaaggtgtctatatgataatactgcagcagtgcctaatagtgagctgatgaccataggaaaaaagagagaaagggatggtgggagaacaattcagaaacagaaacctttttgcacattgtacatcttctaagagaatatcagaaatatggccaagtattaagaatgggtaggggtgttttattattgataattcgtgcttaccaattccctgaatgacattaaaacaatatcaaagtaaagtgcctttaaatagaaataagaatgatttggaggtcagattgtctcaacaacagaagattactttctgaaaacatagagcaatatctggggaaaaaaagcttactgaggtcatgagcctaaattttattgcaaaactccaaatgatgaatagtatcaattttccttcagatcatattttaaagatccttgggaaggatattgcatatggcaaaatagatgtactttgtgaatacaaacagaattatgaacagagaagtactggatctaaagagaaacttattcaccaggatgtattatattaattaggagaagaactaataggatgacatatatttactgatgtttcaaaagatgataactaacaagaaatgcctatcccaggcttataaatgtgtttttgcaatagatatgctttttcagtttgcatgaactatgcacaaatgttagaaaggggctgaaaataaaatagaagtaaacaggagagcatagttgacttctagtgtgtgtgtgtgtgtgtgtgtgtgtgtgtgtgtgtgtgtgtgtgtataaccacatataatatttaggaatatatataatgtttagaaatatataatatataaatattacaatataatatataatatatgatatataatatgcaatattatatatatttctaaacagctaaatgcaacctgttcagtttctatagcttttcctttagaagaaattccctctctgaaatttacagaaataagtaaatatccaggtttatacattgtagaaactcctatttatgaaaaacctgtacaattgtatatgtaaagttaggtatggaaatgcttatgtagaaggagacaatgaaagtgagaagtcctgacgtttaaactttaaaattaaaccactattgcataaaaaaaaaactcattgggaaataatttactagttgagggggactgtttttttttttttcaaaaaccaaaaccctttgatattgaaatggtttgatacgctattaacacatataaaaacaagtgacaagattgctatcatctggtcaaaggaaaacagacttagaatgcacagtttgataagatgaggtctaaattagatcaattaaactttgttagtgctgtgacaatctggtatgtcattatgtgttgcatcctgagaaatatacttacaattattttaaatcactgatagtacatttaaaaccaattaaataggaattatcaagaaatatattaaactgagcaaggttaataagaaaaggctcaacatttttacaaatgccctctaaacagatggtgttctgtggcatggaagatgaaagctaggatcaaagtaagtatgttctataaactgcattacattctggaattactctacttttaggcagtaggaattttcttttgtcttaattgatcattaaatagtggcatctgactaccttcatcattattaagactttttgtatacaagcataatttcccaaaatttagtcaatgacttttttctttattggatgctcatgacctactcatataaatgctagcaagtaattagaacatatagtaatagtttaccagtgataggcaaatgcagttgaatctttctaaaattattttgtagcagccctgggggtggagtgtgtgtatgtgtgtgtgtgtgtgtgtgtgtgtgtgtgtgtgttgctagctcaaaacagactatgttatgtgtctatagggctgttataaagagtcattacttcataacaattacaactcataaaaataagacagtgtgataatcattttaatactaatgatatattggtggcattttggggctattattatccaccttttatggataatgaaagtaagtcacagactctaccttttcaaatatacaaagtttaaaatgggatgtgggggagtgggtctagctacacaacactaatggataacagtttaatatggaaaatagagagatacaaaaaaactagcaaacagcattgaaacatctcagtgagtagccaagagaaatattttacacaaagaaagattaagctaatgactagaactccttaacgtaataacttactagagtgtcttttgtaagctaaaaagtaaatatgaaacaaatataaatgagccaatgtttaaaaaaacataaaaatgcatcacattttctcattcatggtgacatgaatagaatttgagaacataagttgagtgatataaatcaggtacagaaaagcactagatatgaagaatctaaaatatattttcataaaagaaaacaaattagtgatcagcagaggataggaattataagggagagggaagttctgaaagttactgcacagtagagtgactacagttctaagtttttatgggttttaaaaatcaactaccagggaggaatttgttaggtttctaaaacaaacaaatgattgttaattttatgtatcttctatatgtaccaaataattgcgttttacacttgatcgtagccaaaaggccgagaagtgataaattattgcattttttctcataaataaatgcaattattaaatgtcaaaaagaatacagtttagcctaggaataagggtaggtggcagaacactagcctagcatgtgtgacaacttgtatcatatccttagcactaccatataaaataaacttgaaagacttaattatagacaacaaaagtacaaccaggaggccccactattttactgactagatgtcttagaaaaatgattacagttcttacagaagtacacctgtgaatatagagttccatatgtcaatgcaaataatacaaggtcctttctcacttgattcaattaggacactgtgcagaatattgggcacctaatcactaaagtctggaacaaaactatggaaatgtagtacacaggactcagatcgtgccaagagtctagagatactaatttataagattaaaaggaggaattatattcaactacactaagtaatgactaatgaggaacatgagaactttctgcaagtgactgaagaacaaatgttccaaacagagaagggactctgggaatggccacatatgaaagcagacactttgactaaaattgaaaggattcttttacataccagcatatgaaactacttgggtggtaatacatagtaaactgaaaagtatcagagcataaaacaaaacaaaaataggagtctagtatgggctttagactataagcagggcttacagaaggtatgtttaatatatttatagcttagattaaatactgtgtttctagatttctatatcccttccaaatgtcaaggcatctgtacactgcaccccatattagtgtcacagtgcaagttagagacattgtatttggtttcttattgtctaatgatatggaatacttattgaggttcctggactcccttttcagagacgagtcatcagggataaacaaaactaattttctgaggtggaaaacatttcaacaaggagttaaaaatgctaattgggtgcttttctaaatctatttgatgttcatttatggaataattaaattattgaacattgttactaactcaaaacatgttcatgtgtaggatcaatagaatcaaaccccacccctaaactaaaagctatcccaaaatgataaccacttaaaaatgaaagattaattcttgacaatggagtttcactggtgacacaaactatacttaaggacagacgccatgcccagcagtagatgaccaacataaaatgaactcaatgacatatttggagttctttgtcttataatgttttgttggaacatttttttaacttcttgggtatttatgtatatattatggcttccttttttgtgttttcattagattcttgtgtgcacaaatgtgtgtatatctgtctatatgcatttcttatgtgttttctttggttaatttaattttcttctgtttttcttgccctattccagtgtttatttttattttatgttattttatttttattattcttagactcttacctgttttcaatgagaaagggtgtggatttggataggagaggggatggggaggatctcagaggagttgagggagggaaatccatatgtagtcttactgtatgaaaaaaagtttattttcaagaaaaggaaaatatgttcatctgtaaaatatggtatgtaaagcctgactgccataactaaatatcttattcaatgaatggaggtgaaggaaagcaaacacatgtgttaatgatgacttcttgctacctacacaagtatagaatagtgaaactttccctttgactcctcctttgtgccaaagcaccagctagtctttagaataaactcattggtgttccatgtttttcaggaagttgtagtatatcagaatgtaaatgtactatgtctcaactattttctccaccatgtattatggttgaacaccatatagtctttgtctttgtcgttaccctttgaaatcctttatatatcgtggctcactataatcaatacagagtaacacacaaacatctccaacttaaatatttttaattctcagctgtcaaaagtcaacacaaatattttaacacacattgacactgttttgagtgaaaacaatttttttaaggtacagtgctttagcctgctacaaatgtaatctaaaatgactctaacaatagttagatatattaatatgtatctggtaaaattagaaaattttgactagtgccaactagtgcatagtattacaataaagtaaaaaatatgtttatattcattaaattaagattaaaggcatctctgtttgtaaactgccaaataataacaaccctaagttttgtggaagataacatgcatttcaattgttttgaggaattttaataatgatttgattgtttgtaaacagattactaacctgcattccctggagtagcatgagagatagcacatagaccagctccgtaatattttattatgatgttatgcactaagagcaatgggctattgtttctgacatactattgtttctaaaagagaaccataatgcgatgagagtccaccttatgcattcacaagagaaaggtcctgtgaccttcttggctcctcacatacttaaacattattctagcatataatttccctcataaagttcaagtataaccgaaaaatttaacagacctttttcatgcccttaacgattctataaatacaagacaaaagtcatttacaaagccattttctggctaaaaatgtagcacttttttcactgccaacattagcactagtggatactttacttgccagaaccattttcacataaaaataaagttaattgttaacaacttagtagaattgcagaaaatatcccaataagtgcaaaagggtgtagatatttgatgaagccaagacttctctacaaatttgggtaactataacactatgtcaacttcttcactgataatcccaaggcctctcaacatcaaatattcaaattcagcagtcagtatcattataagtcaggacaggccacagactcatgaagtcactttcagaacagtcaaaatggtactattaaatccatacatcccaatggaagttgtttctcaatggtttttataatgtagtagcaaaagcaggtgatgctgactgtagtcttgttactctaatcatttctacaaagagatctgggaaattgaatttgagttagaattaaaaactcgagaaagacttacagtttctgtattcactttctatacccccaaatgcatgtctaaggatatcttgtaaattttatttttttcttttaattttaggaatttaaatgtcctactctgaaatcatattttaaatagtagtatatgaaagcaatcaccacatgctagatagaacacttggctttcactataatggatgaaaatattaatatagaagcatccatttgttgttaatttgtcatatgtcaggcacttggtaatcattttacatccattatctcattattcctaatgatgggcccatgaggaattcttgtcactgaaagcctttggtctatttaaagtgacaagtcatggagggttgaattggatgcttatttaggatgaccgaaaaatcacttaatgttttacttacaaaatgtagtaggcatttttcaaagtaactatgtttccctttttcttagaataaaaaccaaacaaacaaacaaacagaaagattaatttagaatatctgctaagtcagctagatagcgcttgaattccgatagatatctccgaagttaacctctgtatatctaaattttaaggttttacaaataatgtcaatagtaagatgtgagtgaaattttcatcattagatcaatttgctctcgtgcttttatattaaaagcttttatgtttcaggtagcaggatctttattgtttattaaagaaaatcccaccgccctgttgaagtgacactcatttgtgagtctgctgttatcctagcagtaatctttgatcaaatttttcattatttcccctgggagctgcagaattgcagtggtgtcaaacttgcttctttatggcaaactcaactcactgagaaagaattcgttgcacagtgcagattgatgccaacttttgcaaatgacaatttttgctctctcgcctcctctggtgtatagttaacttagagcatgtaacatagaaaaattgtgcaaaaccaaacagattgcagaagtctagcatctcggatggtatatgcagatttgttgcttttcctgaagcagtcttcttttctgtgaagcaatcaaggcagtcttctgagtaatgtattgtctaggtaagcaagagctttggtgcctcgtccaggcacacaagctatgacactttttggcaagcaactttacctttgggggctatgatttttacaggtataaaagaaaggatggtgtctcttacagaccagttgtaaggaaaaaacaaacaaacaaaaaggttatcttctcttcagaagtgcacactatgcatccaaagtagtattttgcgatgcacatggatgttttctcattagtggcatatataatgacaaatatttttatcatttaattgttacagcccaataagaagtacaaatgaataaatattgtttacaaatcagcaaaatgttgtgtatatgagctgagccacttttaattctataacatatgcaatttatgacttttataacctggaagaggatatggaaaaaaacaaacattttacaactccaatcattgcaagacaaaatggtccatcactaactcatggttaaagaaaagggttgctacttgctgctaatgtgttagcaagcatgacattatccctttcccctcttctatgttttcagaaatgccatgctatcttgtcccagaatttgacagttacctagccaaatattttaactacccctataggcatagcttgatcttctttgatttctaatatagtgcatatatcatgattatctctaagagcatgctcgactgtatgacatattatacaactatattgatacaatcattgatggtctcatctgttatgttttaattagtgtatttttgcatagtatatactctgcttccagaaaaatggtaaatttaatgataaaatgaaagagaacaactatttctactacaaattggggcatgaccaatattaccctgctgagtagaaggatattgtccttaattctgatcagaagcttgtcctggttaactgattttgatcatcagcattaagtataccttttgcctggtgcatgtgtataatgtatagtacagtgaagctggtcatatcaaactaaaaatcagaaagaaaagcaccatgaatacatgctgtcattcagctctcatttccatatgtacagttgaggatcctagtctgagaatggtactgcccacagtggtcaggacttggcatctctattaattcattcaagataatctctcacaggcaatgacaggaacccatcatctaaattctgtcaaagttttcagttaacaataaccatcactgtataacagtttatcccaaggcattttggacaacagttgaatcagtgactcaaaatgacaacaatcaccacaccacacaaccccaccaaacaaacaaacaaataaaaagctaaaagagttgagatttttttctgtttcctggaaaaagttgatctaatataatctttttccaagaaagggtgatttgttcctcctcttgagatttgcctaagggtagaatagaactcttcttaacaattgtcttaacaaatagtcacaaggaaaagaacatagaggtaagagtcaaacttcaacagtgcaaaactaaggagtccttcagaaggactgaaccacacctaaacagtcagcatcaagcaatctacgggccaatctgagggaagcaaatgacatcattattcaaatactaggataagtcgtttttattttaatgaagagatatctcaaatgtataaatgtatggagatcccataaaacaaaacctcaaatacttgtcactattttcactctgctcttttaaaatctaccatgttatagctctttaagatttacttacagaaataaaacataacaaataaaatggaaatcttttatgttcctcctcacactgctctcaattttctctagacataaaccgtcttaaagaaaaacataacattataaatattacagcacatatactatatgaatatgtatatatgttacagcatgcataaagtttttcattaaatgcaaatccatcttcattttgtctattatagtttctgtcatagaactttgatgtgtaagattctgttccacagtttatgttgggcaaaagtactaatcttccattattgagggatatttaggccacttccaaaatttaattcttcaaacaatgattgagtaaacagacttgtaggaatttgttgtgtatgctaatagacatttgttttgttaggataggtcatctttattagatattttcttcatttacatttcaaatgctatccccaaagtcccttatatcctcccccagccctgctccccaacccacccactcccacttcctggccctggtgttcctctgtactgaggcatataaagtttgcaagaccaatgggcctctcctcccactgatggccgactaggccatcctctgctacatatgcaactagagacacagctctggggggtactggttagctcatattgctgttcctcctatagagttgcagatccctttagctccttgggtactttatctagcttcttcattaggggcactgtgttccatccaatagctgactgtgagcatccacttctgtatggcaaaaagacatttttaaagtacatctctagaagaagaacttatgggttggacagcacattttccccaaattggtaagacgttgctaaattaattgttttgtagagagtacaatacttactcgtacaatatgaaattcctaattctccttactaaaatttggtaaaattttgtcaatctgtacatctataggtcttgagtatttatttaatttatattccatcgattgattgtaaatccaagtgctttctcatagttctgttatgttaaaatagaaaattacctcttcagagaatttgttcattttctgacattctgttaaattttatttttaataataaattttcacagcaaagtccttgtactacatgtgcttttagtttgcatttcatctctttgttatagcatcagattaaattgagtacaagtcatactttcttgatagtgtgtcttttagttcatgaacatattgtacctttccttacatgcaaacctggtatgctctacaatgtttgcttattctataaatgtttgcctagctctggcaagaactatttctaggttcttttcaactttttagtactatagatataatcttggggctcttttcctattgagttatttttgttattgattctagtacattgattttatttcatgaaatcttttaaaagttcattttaaatcataatagtttgtatgaattctgggatttctctgtatatataaatgtggcatttgaaattggcaaaaattctatctaatcttcttcattttatacctgatttgttttccatgttctactgtattatctagaatgttcattaaacattttaataaaaagatttattgaaatttatcagtgataaccagacttacaacttaaaagttggcacttccccaaggtgagggaaaaatatgttgcagatgttcttttgtgcagttgaaacacaggttaggaaacagcatgtcacttctaaagtccagaagaggaatgctgaaagtagacagtgtgcactaggaggaacagaagtcacatcagagtcccactaggtaagaaaatacaattttgcgttccttttccatgctccaacattcagaagaagcagggaaaatgaacaaaaagaaatccagacaagtcccttccgctcgactcgagactcgagccccgggctaccttgccagcagagtcttgcccaacacccgcaagggtccacacgggactccccacgggaccctaagacctctggtgagtggatcacagtgcctgccccaatccaatcgcgcggaacttgagactgcggtacatagggaagcaggctacccgggcctgatctggggcacaagtcccttccgctcaactcgagactcgagccccgggctaccttgacagcagagtcttgcccaacacccgcaagggcccacacgggactccccacgggaccctaagacctctggtgagtggaacacagcgcctaccccaatccaatcgcgtggaacttgagactgcagtacatagggaagcaggctacccgggcttgatctggggcacaaaccccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtaccggccttgcaagaagagagcttgcctgcagagaatactctgcccactgaaactaaggagagtgctaccctccaggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcaaaagtcacttaaagatttacaggagagcactgctaaagagttacaggctcttaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcatacagaactccaaatagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggacagatgttatacagacactaagagaacacaaatgccagcccaggctactatacccggccaaactctcaattaccatagatggagaaaccaaagtattccacgacaaaaccaagttcacacaatatctttccacgaatccagcccttcaaaggataataacagaaaagaagcaatacaaggacggaaatcacgccctagaacaaccaagaaagtaatcattcaacaaaccaaaaagaagacagccacaagaacagaatgccaactctaacaacaaaaataaaagggagcaacaattacttttccttaatatctcttaatatcaatggactcaattccccaataaaaagacatagactaacagactggctacacaaacaggacccaacattctgctgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatactcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcttcaaaggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagactttttagagtttaatgaaaatgaagccacaacgtacccaaacctatgggacacaatgaaagcatttctaagagggaaactcatagcgctgagtgcctccaagaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagattcttctacaaaaggctatactcaacaaaactggaaaacctggacgaaatggacaaatttctggacagataccaggtaccaaagttgaatcaggatcaagttgaccatctaaacagtcccatatcacctaaagaaatagaagcagttattaatagtctcccaaccaaaaaaagcccaggaccagatgggtttagtgcagagttctatcagaccttcaaagaagatctaattccaattctgcacaaactatttcacaaaatagaagtagaaggtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaggtgaaagatctgtatgataaaaacttcaaatctctgaagaaagaaattaaagaagatctcagaagatggaaagatctcccattctcatggattggcaggatcaacattgtaaaaatggctatcttgccaaaagcaatctacagattcaatgcaatccccatcaaaattccaactcaattcttcaacgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaatcgacaaatgggacctaatgaaactccaaagtttctgcaaggcaaaagacaccgtcaataagacaaaaagaccaccaacagattgggaaaggatctttacctatcctaaatcagataggagactaatatccaacatatataaagaactcaagaaggtggacttcagaaaatcaaataaccccattaaaaaatggggctcagaactgaacaaagaattctcacctgaggaataccgaatggcagagaagcacttgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggagtgcaggcttgtacaaccactctggaaatcagtctggcggttcctcagaaaactggacatagtactaccggaggatccagcaatacctctcctgggcatatatccagaagatgccccaacaggtaagaaggacacatgctccactatgttcatagcagccttatttataatagccagaagctggaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtattcactgataagtggatattagccccaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaaaaaaaaagaaatccagcagacatgcggtgagcctccagcacttaaatttgtaaaaatgttccaatctggagtatgagagatgagtcctcctgtcatatctgctgaaaaaattgctctaatattttgcagaacaagataggacaggctattttctgaaggtgtcattattattattattactactactactattattattactactactacgtagtccacttcatttgtatctcctaagcctgtcatttttgtctcagcctcacagctccagaggcaaaaggtttctttgcaaaagcaaagcccactattatctgtgaagaggggaagggggaagaaaggttgggaatatccccaaaccagtgccaaagtaaacttgaaggttactatttacaaaccagggtaacaaatgactctagccaagaccatgagaccatattgatcagaactagagtttttgaagacaagtggggttcaatgcttccagggctgtgaataaactgatgggagccaaccatatcctcctgaccaactctgggaatgagggacaagcctgaaataagaacaaatgcttgcctggtatgtactaacattgtattgacaaagacattccaggtgccaagaaaagggaaaggaaataaagagtggcagtaaaaacagtattttattccttccccactccctttcctcctcctcctcctcagaatctccagtaatcctttctttccctacattcagaagaaatataaatgcaggaaatggggggcggggcacaaatagttagaaacaatcaaatcgcaataggaatttcacaaattggttaatgttccttagtcatcctcttcatcctcatcttctgactctttaactagcatacttttcatcttgctcatcatccaaaactccatccttgtaaccttcatcctcctcctctccactcacgtcatgttcttccctatcctcctctgcatgctccctcttcttcttccactagctgcatatattcatcgtattcctcatcctcatttttcttcctgtaaacctccaggtagcattcctcgacttcagaaccagagtaagaatcaggggcctctttggagctagagcatgtgtgtgtgtgtgtgtgtgtgtgtgtgtgtgtgtgtgtatgtatatatatgtatgtatatgtatatatgtatatacacatacatacatatatatacatatacatgtatatgtatgtatatatatatatatatatatatatatatatcctgctctgtctgtgtaattttacttgtatgtatatgtttttaaggttaggcatttggtattggatagccaattggtgcactcttccttggagaagactatttctcgcagccttcaacattctctagttgcctgtaactctttctgtaagggtgaggccttgtgggattagcatgtctttcttttatcctgttcagctcgtgttcaggtagtcatgttggtaaactttcacacatgtagcttctgacacaagtaggagacagaatcttacaacacaatacctgatgctctggttcttatgacctttctgctccttctacaatgatccctgtactttagctgaagaagtttggtataggtttattagttgagactgagctcaacaactctgcattttgattgcttgtgattttctgtaattgtctccattttttgcatagtaaagtttccttggagaggggcttacttatctgtgcctatgcagaaaaatatttagaatatattagtggattatgtgagtttatattatccccagccctgagtagtttctaggtttaggtttccagtacttgatatgatttctcgtgtgtgtgtgtgtgtgtgtgtgttttaagttcaattaaagacccgttagttaccaacaaaatattcatgtcactactacccccttaagacctattgctctctgctgatcattgtagtttgtgagcattgtgaataagactgtaagaatctttcatgaaaccttctgatatattgaaagctaaacctctgggaggaggctttcaattcaaatccagcttatgggcatttgggctctgtgaccaaagtgcatgtttttccccctcaggaatagggactaatcctccacctcttagaaacaatcaaggttattagcaatagcctataaagttttgaaagtctcttaggcaacactgatcttcaatttaaaggaaggcttcttctcatgtctggtactgggattactgttagatggtctaaaatgaaaatttcccatctgggcttacaatgctccctcccataggttcactgatctttttaaaaagaactattgcatgaacttaatgtgcaatttttctttttcaaattggtcttgtcaaatttttatatcctgattacaagtctcactaaataagcagatggctttcattcttattttaatatagaagtgtgttccttcagagaaatgtattgaaagcctgatcaattttacacagtatgggttatatatgttatatataatatataatattcatatattatagtggatatgtgtctaccatgtttgaatatctgttcatatacatatatacacaaatgtgttatatcatcttaatcatttctacgtattgaaatggaaagttgaatcactttgaattttggtgtctttcctaattcaactcctctttaaaactaaagaggtcaatccaaaacaaactaataatactatatgtactttcctaatctctaactttctttgtgacactacatttatacttatgctatactaaaaatcccaatttactgtataaacaagatactttcatgaatatttacctttgtccacaatttccagaaattttatttgatcattgtcaaataaaattgtaacctttgtttttgattgactaattctcacataaaatatttagattaactttcaatataaatctgaaggtaacactaattattaacaagtagcttgcaaaaggaagtaaaaagaacaaatagaattgattggggagtgatcgcccatactgcattgtctggacttatccaaagaaatttaatacttttacagtgaaagtaatggaaatataaataattgttctgtgtttttgtaaacatagtgataatttttatttttttagtaaaaaagctaacttgctttattctatacattttaatgggtagtgagagtctatgttttgattgataggaagctccatgactgagaatagtggacgctgatctatcccataacatagtctataccactgactaaatgacacaggttttcagactatcatgcccttactcatgaaagcacatggaactcttgaaaattttgtacatgttatatcttattgtctaatgtcaacttttctaggactgttttccctttttgtctctagtatcttaacttcctgatggaggatgagacagaaaatattctctggttataaattaaagttatcctggacatagtactactggtacatccagcaatacctctcctgggaatatacccagaagatgttccaactggtaataaggacacatactccactatgctcatagcagacctatttataatagctagaagctggaaagaacccagatgttcctcaacagtggaatggttacagaaaatgtggtacatttacacaatggagtactaatcggctattaaaaacaatgaatttgtgaaattcttggacaaatggatgtatctggaggatataatcctgagtgaggtaacccaatcacaaaagaagtcacttgatatgcactgataagtggatattagcccagaaacttagaatacccaagatataacttccaaaacagaagaaaatcaagaagaaggaagaccaacgtgtggatatgaataaaatatccatggaaggagttgcagagacaaagtttggagctaagacgaaaggatagaccatccagagactgccccacctggggatccatcccataatcagccaccaaacgcagacactattgcatatgccagcaagattttgctgaaaggaccctgatatagctgtcttctgtgaggctttgccagtgcctggcaaatatagaagtggatgttcacagtcatctataggatggaacacagtgcccccaatgtaggagctagagaaagtacccaagagctgaagggaaaaacaatatgaactaatcagtactcctaaaactcctgtctctagctgcatatgtagcagaagatggcctagttggccatcattgggaagagaagccccttgctctagcaaacttaatatgcctgagtacaggggaaagccagggccaagaagtaggagtgagtgggtaggggagcagggcagggggagggtataggggacttttgggatagcatttgaaatgtaaaagaagaaaatatctaataaaaaataaaaataaataaaaataaaaataaattaatgttttcacatgtcattgatgagactctaccaaatggtatgctccatggtttgcatttgtagagctggtatgaacacttctttcttttttcttttttttaaatttattagatatttgctttatttacattcaaaatggttatccgctttcctagtttcccctccaaaaatctcctattcccttccccctccccctgctccctaacccacccactcctacttcctggccctgacattcccctacaccggggcataaagccttcacaggactaagagcttctccttccattgatgactaattaggccaacctgtgctatatatgccgctagagccacgagtccctccatgtgttttctttgattggtggtttagtcccaggaagctctgagtgtattggttagttcatattgttgttcctcctatagggctgcaaaccacttctgctacttaggttctttttctagctccttcattggggaccctgggcatatgagcacttcttaatgttctaacttatattgagcatatgttttcatatctcgaaatgtaagatatttgataatcataagcctgcatcttaaaaagattattactgagcacaagaaaaatgaaattaaaataaataattacaaaataaattgcattaataaaatgattcatgcacaaatacagtaaccctaagtttctcaaatatagtttgtaactcagagtcataaatgttctcctttcatgaaaaatgatttactctaaatgaattagactccttgatgcttaggatgtcatagacaaattttaaaagaaatgttgtacaaatggtttaaaatagttcactatgtatactatttgaggatagagttttgaagttctaggttttaaaattcccaaatcagggatagatatagacatatatagatatagatatagatataatgatagtaatttttttactttgcctccatttcataataccaccttagactttcaggaacaaacctgaaactgcagctgatatttcataacatattccctggatacttttctgttgcttccagcctcattttccgaaacactaagcaattattctcattactgcttagcacccacgttgcacagtgacaggatgcaagatatccaagtatgatggagctttctgagtttccagctgtatttcaactataatttgagtctcatcaaagaagccatgtatataaaacttttagccagtgagtagtgtctgtaaggtttaagacaaagttatctttcctgaggaacgcttattgtttcacctgctggaatgagaaacacactaatatatggatgatcagtaaggcctttggtgtaatatgcaaagagttagcatcagatatttctggtcaatttaatattcaacaagtattttctggattggcagatagccataatttcttccagatattggtaccgtttcctcaatttattcaggacttatttggcatccattatcagtaggaacaatgatgtttttctttacctttaagtgattaaggcaacttagagcaggggttgtcaggccatgaccccagttaatgtggctcagccttcatttctgaatgggttcataacatggttgcttttgaaacttattaaaataaaaaaaaaagaaagatgtttgtgaaatgtaaaagttatatagtttttgtgccaatgaaaaccaaatgaaaatcaacatggtcacattcattcacttaaatgagttttttttttttaatttttcaacaaagacataaagcgtttagtagctggctttttacagaaaaataaataaataaataaataaataaataaataaaagaatgttttcaggccactgactaatgagattgatgaaatggttttcataaagaaatctgctagaggaaattgtgactacttcattctaaatgtgctattctatcggagcaactggccttatagtattagcaggtacgaatgcacaagaagagaacagtaactcctgatgtaattgcccacattcagagaaaactgtatgtgcagctgaagccagatgttgaaggaatgggaacagcaatgaaacttcagaagtcgttatgaaaaaaactggagaactgctaggtgagctgcaccaaggatttgacaggaagctctaacaaaagaactattattttttaatttagtgtgtattccctgggatggatttttaacagacaccttcacaaaaagccagttcccataaaaacagttttaaatgctaaagcaaaagactcacttccttgaaatttacataaaaccaaccagtgtgagggaagttttcattttattttatcaacagtgaatcttatagaaaatgttgacaattaatttacaatttatattatgaagttgtatggtgatatttgcatccagatgagatacgtaaatcaggagtagaggagaataaattcagatttttgaatcaaagaaaaaatagagattgcagtattacacgtatttttaggcttaaaagcttctaatgtggtgtgtgttaaaataatacaaatggaagtaaagtttaactaatagagttcatttaactaacaaagacaatgaaaccagatatttcactccctgaatgggattacatttggtggttatctagttaatttgattcattgggatttgtaaattggatcattcagagtccaaagtgaaatggtgatttaaatgcagcccaatggcctctagagaaataatcaattccttagaattcatctgaagaattaagttttatcctaattactcacctggagaattagctagaattttgaagcagttgactgggggaaaaataaacctggtccttccatttagacaaaacctccagggaaaacctttggggacatttgagcccattaacaacaggcctgaagcctattttcatgataaaaaatttattcaattatgtggctaggtagagttagcaaatctattcacttgtaacttagtatttaggaaagtctactatgcaccaaatactccccaaatcattaagcacaccaatgtaatgtgtaaacagcaaaacagtttggaagcattcctagagtttacattatttattgcagtgtgtgtgtatgtgtgtgtgtgtgtgtgtgtgtgtgtgtgtgtgtgtgtgttgcctgcacatgtgatatgaattattgcatgtgtgtagtatatgttggtaaggagtatgtatatatacacttgtacctatgaaagtccaaaattcatttcagatgtcttcctccattaagctatactttatgtatttatgtatgtatttatttatttccttttttacttatgagtcagggccaatctctgaaaaagaagctcatgaacactgggtaattccttgggaattccctatttctgcttctggagtactggcattataggcagacactctgcccattccacttttgtttaagtcctccaaactttgatgtccatactttctggcaagtgctttatctactgagcagtattcaaacctggactgtgaaatatttttatagattagcatggtggacatatatttaatcccagcactcaggaggtagaagcagttggacatttatgagttcaataagtccagtatacattgtgaaataattgtattatgttatttttattattatgtaataatttgaaattttatgaatataattatgaaatattgtttaaaatatattatgaaacaatactgtttcatatcattatgaaataactccattgctttatttttattatcttactttaaattattttaaactgatatataaaaaaaaacataaaattcagtgaggtaccatgctatatttcaatagatatatacataatatgatgacataatttataaaccatattatatattataacctcatacattccttacttatttattgttaaaaatatgggcatcattttcattagtctttaaaaatatacaattgttttctatagttaccctgttttataacacaaagttccaatgtcttactcgtataggagtataacttagtacctactcatcagcctttcttgtactccctctccttcccccactattccttctttatacaacttctaggacatcaatgtcatattctgcatatcatagaaacttgtctttcatgggtggcttattttatttaacataaaaaatctctagtttctaccattgctgtcacaaatgacaagatttcatctcttttagctaaatagtaatctgctccgcaacagctgatagacacaggttgttatagttcccatttttatgaggtagacacaaacagtaattaccataaaaagcaatttccggcagaggcgcacctgtataacaaaacagagtagatagaaacaaactaagatgagtggcattactttgtgtaatacagagacatcagagcttcataaggtgaaagctaaatgcctagaaaagactggcatgggaatgtttgatgtgtatattcacatatgtaaaatcaaccctgatatacaagcagatttccttcacaagactatggtgtcatgctctccattcaagctcaagttttgtcttgcaagcaatagtttgaacaaacttgtgaaagataactatgttgtctattattataactattttatcataagcaatattctaataaactatggaagctaagagatttttttataaaaatcatgccatttcaaggtttgctagataaaagaaacaaaacaaacaatattcttatttaaattttaacttcagatgagcaacccttttcaggacaaatatactcaaatatggtaaatgcttactaaattggacagtgcaaaattatttttcaatatcctgtggaaatggctcattagataaagtgttcattgcacagtcatgaggactggagttgagaccccctaaacacatattaatgttgagtaagcatgtcagatgcacctgtaattccagtactaagaatgttgtaaataaaggattcctgaagcaaacagaatatccagaccaactgtatctgcaatgtcttagttcaagtaaaggacctacttcagtaactcgataaagaagatggatagcccaagatctttagagacatgtgcaaatgcacacaaacagacacacacacacacacacacacatcacaaataaaatttaaataaaataaaaagatgaaaaaagataatttgtcatataaaaacactaagagatatcccaatttttttctcaagaatttgctctttactgttttcttttagttatgtttagagagtgttagcaaatcttcaacacattattttggcaacttgttaatgctggcaatatacatgacctgttagaagattagtgttccaaaaataacaggaacccttccccagagcttttcaagagctgggctgaaacttccgcactacttttcagcctattcaaatgcatctcttcttttgatacatatataaaaaacatatataaaaacttatgtccctgaactccattgagagggttattttctgtagcttctttatgaaaatattttatctttaacatttttcaaatataaaactacattgtgatagtaatcatgcatttccaagttccatgccatataatactaccatagggattttttttaaatcacccttcagaaccagtggatgttgttgggaatcagatactggtccataccatgccaaaacaaatcagtgaaaattaaaataatcaattcattatttaattaaaaacatctttttttttccattttttattaggtatttagctcatttacatttccaatgctataccaaaagtcccccttacccacccacccccactcccctacccacccactccccccctttggccctggcattcccctgtaccggggcacacaaagtctgcgtgtccaatgggcctctctttccagtgatggccgactaggccatcttttgatacatatgcagctagggtcaagagctcaggggtactggttagttcataatgtttttccacctatagggttgaagatccctttagctccttggatactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatggggtggatccctggatatggcagtctctacatggtccatcctttcatctcagctccaaactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctaccattcggtattcctcaggtgagaattctttgttcagttctgagccccattttttaatggggttatttgattttctgaagtccaccttcttgagttctttatatatgttggatatcagtcccctatctgatttaggataggtaaagatcctttcccaatctgttggtggtctttttgtcttattgacggtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggaaatctttccatcttctgagatcttctttaatttctttcttcagggacttgaagtttttatcatacagatctttcacttccttcgttagagtcacgccgagatattttatattatttgtggctattgagaagggtgttgtttccctaatttttttctcagcctgtttattctgtgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccatctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcgtcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaactgagagttcctcttggaggattttacctttgatgagaatgaagtgtccctccttgtcttttttgatgactttgggttggaagtcaatcttatcagatattaggatggctactcctgcttgtttcttcagtccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctgggtttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactcggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctcccctgccgggtgggcacctgtcctccggtcaggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggcgaccgctgctgctgtggcttaggccgcctccccagccggacgggcacctgtcctccggtccggacggtggctggctgtccccggcccacaaagggtgctgcctcagcgcctctgtacttctgcctgttccagaagctgtcaggttctctggcgcaccctctcacctgttcagactaattccctaagttcggcgggtcccggaccaagatggcgaccgctgctgctgtggcttaggccgcctccccagccgggcgggcacctgtcctctggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctccccagccgggcgggcacctgtcctccggtccagatggtggctggctgtccccggcccacaaagggtgctgcctcagtgcctctgtgcttccgcctgttccagaagctgtcaggttctctggcgcaccctctcacctgttcagactaatttcctaagttcggcgggtctcggaccaagatggcgaccgctgctgctgtcaattaaaaacatctttgtgggcactacaaacacatggtgcacatgtgcagtcaaagtagccatacccataaaattaaataaataataaaaccttaacatttggctaaatcagtgtttctcaaataaatattaaataataattatatgattttttattaaataagactagcattctattctgttgtaataatgaaatgtttctgtttgtcaaaactaagttttggttttatagaaatgaaaacaattttcctcttcatgtgcaaaggagaaaaaagtcaaactcagtatgtccaaaccttctcccctaaactggcctgctgtttgtcttttgtaactaaacagactgctctccttatgaccagctacaaatctgaaaagactttggttacagttgataattgtactattatattattttgcattcattatttataccttcaacatgaaaatgagatgttagtattcccattgtgctgataaatattctgaaacagtgaagacagctttggtttggctattgaggatgagattataaactttgttgtaaatcacaacacgttttaatttttattgaattattcttaaaacccacattgctgcccaattctgtgccctgtgtgtctattgacagatgaattattagatgtaaagggataaggctttgtgtgaagaggaatagcaaggcaattatagccccaggaaagaagtgttgatgcacaggcttattcttatagatacgcgttccattttcaaacaaataaaaggcttagcttcatgcaaagaaatatttaacaaaaatgttttgtattatcctcttctggtttaagtttcctgaactgtaggagatagccaaggttcacccatttaatctagttacagtgtgtactgcacattaactaggatatattgattttttttgaagttggagaatacagtggctcagaatctttagcctctgatttaatcaacctcaaataaataccaaactaaaatgatttctcagtttatcaaataatatcgcttaagtgcagactatccttcatcccggagccaaatccaggcctctaaatgagggaaagtccaaattatttagtgaaagttttgggtgcaaatgtataaaaacaccattttgacattcaagcaaacacccagtattagtactaactggtaataaaaagaagaaatggttaagcaggacctttcttggaaattatattatgaattacgtttatggttgttgccagttaaagtattaagtggcaattactattaaaattaaatagtaagatatttatcaggatcatttttaaatgtataatgttttaaaacaaaatttccgcagcaataaaatctagagaaaatgtcaaaatcttcaccaaaaaatactcattttgcagttagtcttctcatttgagcacccatcaccatttacctcaaggtctcaatgttcaagacaatgagattattagtgtctagttttcctcacagaacagctagctactgagtgtacaagctactttagggatgagaccattgtaatgcagaaagtataagaaatgttataaggtgcacttatgaagcctcttaatcaatccctcttgctataactgggaatgctgaatgttttgcctgtttgtggtgcactcctttaatcacaagagttgtgatctcaaccattatatctgaggtggtttaagcatgtttgcaatcattcttggtcttgaattatcaagacccgttttcttcatttggactttgtgtaaattgatcttgacgctaagaaaggataattcacattaaatgtagtgtttacttcatatagagtggttttctggaaacacagttatactattccataaatgttacttccaattatataaataattttgtggagattgattaaaaatattttaattaagttatttcaacctgcagaactgtctctaggaatggtaatacaattaaatcatttctgccacaagctgttttgtattatgtaacattgataaatatattatattgactctcttttttattttgtttttttattaggtatttatttcatttacatttccaaaaagtcccccacgcgctcccacacctgctcacccacccacccactcccacttcttggccctggtgttcccctgtactggggcatataaagtttgcaagtccaatgggcctctctttccagtgatggccgactaggccatctttggatacataggcagctagagacaagagctctggggtactggttagttcatattgttgttccacctatagggttgcagattcctttaggtccttggttactttctctagctcctccattgggggccctgtgatccatccaatagctgactgtgagcatccacttctgtgtttgctaggccccggaatactctcacaagagacagctatatctgggtcctttcagcaaaatcttactagtgtatgcaatgatatcagcgtttggaggctgattatgggatggatccccggatatggcagtctctagatggtccatcctttcgtctcagctccaaactgtgtctctgtaactccttccatgggtgttttgttcccaattctaagaaggggcaaagtgcccacactttggtcttcgttcttcttgagtttcatgtgtttagcaaattgtatcttatatcttgggtattctaagtttctgggctaatatccacttatcagtgagtacatattgtgtgagttcttttgtgattgggttacctcactcaggatgatgccctccaagtctatccatttgcctaggaatttcataaattcattctttttaatagctgagcagtactccattgtgtaaatgtaccacattatctgtatccattccactgttgaggggcatctgggttctttccagcttctggctattataaataaggctgctatgaacatagtggagcatgtgtccttaccggttggaatatcttctggatatatgcccaggagaggtattgtgggatcctctggtagtactacgtccaattttctgaggaaccaccagactgatttccagagtggttgtacaagcttgaaatcccagcaacaatggaggagtgactctcgagaatatcactgttattaaggagctcgttcatttataaatgtatagtgtatatctgaatgtgggcagggatatttttctcactttgctatacttcattgctctttctgaaagcttttactactctatattaattaatcaatttagaggagatgataattatttctatgaaagcacaaattgatgcaaaaataaaaacttagaaaactttttgtacctgaatacttagtattgtacatgtatcctaaatcaaaattatataaccctttgttaatacactttaaatgacaaggccatttgttgatgatttggcatgtctattactaccacatggcaagatttcctaatattcacagaaacacattttcattcttagcatcacaggtactttccttacctgcttttcctattattatttttttaacgataaaaaagactgtgtctaatcctgacaactaatgtgtgaaatttgctggcactatcttcctggcaaatagaggatatattctcagcgttgccaactgtggtaggttttaccatttccaatgtttacactagtgtttgccttgaatttccctaattccagagtgattaagaactaaaaatttcccaaggccactgaaaagttctttttagatgattaggattaaggaaattgaatttgtgacgatataacatattctacaatttttagctggaatttgtaccagtagatattagtgaggaaacaagacttagggaagtggagcattttattcctttgctttatttttgcctaaacttctatgcagcattttaactgaagcccaccggtgaaggcctggatgtgtcaaatatatagcaataaaatgtttcaactattttgattctgagactctgagtggaaaacttagctgtcaatgtggggacaggttgaaagcaagtttgtgatcatgataaggttcaagaaattcagaggtgccctgatcttgttgagctttagatgaagaatcgagtaaccccagataactcaggagaagagagagtgattttgaagacagggaaaattgagcactttaatatgtacaatcccaggacttttctctttgcccctgatactaactacttagaactttaaaacttttctaaattcagacgttttgattagacagatacttatgaagtattttgttcactagaaaagacaggcgttatagtaattataatcgaaagtgatagacatagattctgtttgcattgatttgctttgttctctctctctctctctctctctctctctctctctctctgtgtgtgtgtgtgtgtgtgtgtgtgtgtgtatgaatgatgatgcatgcttgtttatgcacaggtgcgcacatgtatggttgtctttctccaatcactcttcaccctggtttttaagctaaggtctcttgaagaacctggaagttgttcacttttctgaactggctggccagcaacccacctctctaccctagcttcccgaatattgaaacagttcaggtttctgtcggtgctcttggttatgaatagataaaaggttctataggaactgaggcaagatgcactatacaactaaagcctatgcttgctcattaaacaaccatttgttgtatacatcctatttctctggcattgagtatagatggtacacaatgaacaagtaactcgggctttctgaaaatttatagtctgaaggatgaagggaataaagtgtgcatgtatatagttgtgtgtatgcatttgtgaatatagggcaggtattacaaactactacaaaaaaagcacaaatcaaagtgaaatctcattgtgcaaagtgacagctgagtgtacaggacagattctgtaatcttcttctatgccttccattgtggtaagtacccttgtcctacaatgcattgttatatgtcattttaagggttatattttatctccataaaaatgtttctatgacccttaagatattaaacttctttgttaccttaccacctatcataatgtccattcaatataattttctacgtttaaaaattattaaataatggagcacattcaaagtgagctgaatcatagattttccaaaatgtgtcctattcattttttaaaatacctaaagtggcataatgttaaaagggaaagaggtttatttacctcacaggtctagagcttgaaggtcatgtttccaagatcaggttagctcttctcaggacttcattggaattgtatcccagtggcaagaggtcttgaaaaatggagagatcacagcagcacgggtgagcgtggatgaggtgcttttgtgtcctccctctgaaccctgactcttaatgggacagtagtagtacatttcaatacaaaacaaacaaacaaacaaacaaacaaacaaaaacaccctggagaatactctcaagatatgctctttgattgtcatgctgaaaatattccaaagcacagaaagggagaagaaactcaatagcatgcacccttagctacctcattgctcagatgagaaaactgacaaaacagttttgagcactaacatctgtctcgaagaatttcatctgatttagtgagacaccaaggagcactgtcatatgcaaaggacattgctacattcaaagagatgacaggcaactatggtgtgtattgatttctaaggtacaattgggggacattttccttaattcactttttctgctaattcgctggctccctagaacctctcacctcatcagcttatctataaaatgatcccttcaaataaatagcataatttaaaaagtgaacacagacagaaatacataaaactcaaagtaaaattacacattcactaatgggatgtctgtagccagacccttactatacaggataagtccttgacaggcttattattagcacggttgcctttagaatttaatcaagacactaatttcaaactgaaacaagtagggggaaaaagagcacataaactacagtaaattgaattctagaagactaagcctctggaggcctcaaaagtgggaaacaggaagctcagcctcatgcagtcagctgctcacagtatatttggtaaatgtcgtattccaaaagatagcttgcaagagtctgggctcacgggccagggataaagcatttggttgcaacaagtctaacatatgcgtgatcatttttcattttaagtgaaaaaccagactggcacagagcttcgaattttcaaaacaatttagcactctgcacaggggggaaaaaaagagtaaaataactagtttgctgttaaaaggagcatctactgtgcatgccagaatctggctcatattacatgaatatgtcatctctcatacttgtaatgcacccgttttggaaatatgatgcttttaaaggaattctggaaagataaatcttatcaagcaacctaccctttcttcatttactactttttcctgttgatgtcaatgaaaagatgtttccagtgttctcagtggtgagctgcaggcgaacttttacgtttcaacaattttccttgcttgacgtcaagatcgtattttcaattattaaatccataatcttgaagacaagcctaatttttgtagcttatgtgtgaatttgcaatttcagtgacttagtttatgcggcgcatgagtaataaaccatcacatattaaatttggaaagtaccaaaagtgaggaataagatttacaatgtgctgcaaaaatgatattcattattatcttgaattttacaaattcgtggtaaaatagtgcaaaccgctgtttaattttaattaataaaatcagggaattttggggggatgtattttatgtaagaaataagtctctactagctagtaagtgcctactttgtagaaagaactctcagcatttcctgacttgaactagcaaacctgttcatccgtttgaaagacaataaggcattgctaaaagcttatctacacactgctgatggcccttttctgttcttgcccatgtgccctgtatttaaagcaagttcagggggagggcctttaacccaagggagagagcacttgaagtatccatgttcctttccttttcttttcttaaattgcctgtgtagagcaagacatttattagtgagccttgacagatccttgagacttacaaaatcacccgtggagggataataggctaactttggatcatgtttgaacttctcagctggtagtcatgcagcaatacccgcccctggaatctggacccaccagcctgtctacactcccgtcgaccttctctattttattaacaactgtttctggttgatgcttagtttaacaactggggtgtaggagggctattgttacattcaaattagtgtattttttttaagttgactctatccttcatagtaagtgtttgactttaatttgttctttgagctcacttctcccctcttgttattcacattgatctctacacatatgaatagccatagtatttaacacttatttgtactcgaatatctcatatgcacgagtattattctctaattgtcttacataaaacatgtaatttaaaatttgtagccttttggcttttgtataagcatttacattggaacataaatatactgttataaacatatactggaagccaagttaatagaaattagatatcttcttacagccaggctattattaaactgaatgatcttgacattactttagaacttgttgcatggtaggaggtgctttcaaaagaaactttccatctcagttcttcatatcacattatgcttttaatctcaaatgacatatttcagcatgagtactaactaactccagttgaccaactcaactgaagctttgtgtttgccattacaaaatttaaattcagcctagaggaaacatttcctacagttgaataggataaagatgtgtttctcttttaaaaaagcaattacttaagggtttttgaaatatcttcatcagtgtaataaatttgtggttgtctatgggggctactttaaaaggtatttctgagtatgcagatgcatgtgtctctgtatgtgtttctgggccttttctttggttctttgttgggggcatgttggctcttttggcttattcaggtttgtttgttcattttagatgcctgtttggtttctggagagagagagagagagagagagagagagagagagagagagagagagagagagagagagaggacaaatgcagatttggatggtcagaagatggggagaatctgctgtttcacttaattgaacccattattattatagtaacaggatgaatatgctgagctgaatgtgcaagtcttactgtttcaaccagaatgtaaactcgtgcttcagtaaagcatctatgcacaatacataaattacctttcaatgctttctttatgcttcacttttctcataaatcaaatgattataatctatctcaaggatgctatgcaaactaatatatatatatatatatatatatatacacagtagctagtttacttatggctttttcatatatgcttagctttcgttgatatgcaccctgcatgattgttcttactgctttctatagttccttggtgatatcttttttcaactcttatgctgaatctcttgttttagatcccagccttataattgagtgactacagatacatttttgctaaatcaactttatccatttctaagtataattcttattttataatttaattttattttttattgaaaagttttttcatgcgatgtattctgctcatagtgctcatagtttttttttaatctcacaactcctcccagattctcccaatctcctgaccatccaaatcctctctctctctctctctctctctctctcactctctctctctctcatcagaaaacaaacaggcatctaaaatgaacaaacaaacctgaataagccaaaacaaagaacaacacaccaaaaaaggagaaccaaataaaaggcagaagaaacacatacagacagagacacatacaactgcatactcagaaattaccctaagaaacacaaaatcgaaaataataacatataagcataagacctgaaaggtaaaaaaataaaatccagacaaaccatcactgaattcattttgctctggccatctaccactagtcatagggcctgcacttaagagtgatttcaatatccaatgagactccattggagaaaactaattttttccatccaagaagattttcatgggatatagcttctgagttaggaatggggtattaagagatccacttctcctctcaatgctgagtctccatttggcttagaccagtgtagatcttgtgcatgctgccacagtctctgagtgcattaaaacatcagtcatgctatatttagaaggccctgtttccattgtgttccccatactctggctctttctgactctttcagtctccttttgttcagggttcctgagcccttggggagggggggttgacataaacatcccatttagaactgtatatttgaaggattcactctctctgtgcatattgtctgactttgggtctctgtatctgtcctatctgcttcagtaggaagaatctctgatgatggccaagcaaggtactgatatatgagtatagcacaattatattaggaatcatttgattgctactttaaaaaaaattagatcagtttggttttaccaaactctgagctatctagtctgtattcctgtttacctggtgttgggtatctgtgttgaaaacgggacaaggcagcaatcagatgtaaagtagaaaattacagccccatatgttttctcctgagtcttcctttggtggccagagccattgcttcacagaagcacagaatatatccaggaatgagaatccttggcacttgagatagacagaatactaaacgtgttcttatcatttgcttgacctaaattaatggcaacattgatgaagaacaatccagtaggactaaagcacattaaaattagagttttgtttctccaaaataatgttctgctttgagatttttttcgttacacaaaagtaatgaaacaaacaaaaagtgaagtacatccatatttgttgatacctgacattttattataacataagatttaggcaaaatcttatttaacctgggtttcagtgttctgtggtttatcttgtcaccattgggtttcatttctgtaattgaacatcgaattgtcacagcctaaaattaaaaggccatcttcctttaattaagtatgcttaccggttttgatcctttattcagctccttcattttgtagggttgaaattagaggttcctgtgggagatcatagacaaatggcagtctcaattgaagttgtatttttgatgagttccagaacagtttcaatcatcagtggcttaaattccatcagttttctaccattaatgccttttataaactatcccaaatttgccttatcatttcataaaatccagagcagattttctatatatgacactggcttcataaatcaaatttattcttctttctcatcaaccttatttcttgtactttagtaaagctcaactctacctattttttaaaaccttccttaattctggtgcaagtttgccaatacttaccttggctagatcatttcaacaagattttcatgattaaaatggacaaaaactacatcttattatatatagaaatacatcctgtgtggtgctcagcatagtgctttaagcttataaaaagaagttattgatctttaatgaaaggatcgtttagcctgctgtaactttgatattgtttcctcagtgataacttattgcctatcttagttaatatagatgacatattaatttgaatttctgttaaaactagaattatattattctgagagggaaaaaaagtatgtgttgacttatttgccttttggctgtactaaaatcagtaaatccctttgtgatttgatataaaatcagtttgtaaatggttgttggatttctaatcctgaaattcaggaaataaaattggactttcaactctagtatctattttgggagtgttgtattagacacatgctttccggtgatttacttggaactcaacaatgtctgtgtggtcgtttctagcacacaacaacttcaagaaatagtagttttatgccatgagaatatgtttagggacttaagattattttgacaaaagctaggtcagaaagttaatatgaagaaggattaaagactttgaaagatgccagcaactatttgatgattatagcacttcaggattataacttgcattttctaaatactatgcacaattctcagatttcaccattaaaattccacttactagtttaaaagaaaaacctctagaagtagctcttccagaaaaagcattccatatttcttagtattacacttagcttctaaagtataaaaatgaacacatctaatcttaagtttattcaaggaaggaaaaggccctttatggttatttcattcatcaaaaataagtaacaattttgtctgtagataaatatttctgataggtctctagaaacattaagtattttttaaatgaaatcctgaaattcaactcagcaaactaaaacgtttttttttttcctaaaggactttaaaaatgcctgcaacaatatgatttattttctctttcatattaatgttccaatatacttcttgaaattgacatgcatactactgcgatgatgccaaccctttatgtgtggcttctttaacgcatgtatttattgtcctaatagtgtaactggggtactgatgcattcatacattttctttgatgaaaatgtcttgtgcatatatagcaactggcagacggtagaaggttcatttgtaagtcccaaactgctccgaaactgctaaatgatccaatcttgtgctgtttgcctaaatagaagcagcattgtgccatgaagagttctgtactaggctcaggaaacatgaatgctggctatgtgagcctctgaaaatccatctattcatttattaaatcattatattatggcatataggtaaggcataagactgagaataggaagcagtataaaatcaaatgtatgggtacctgacctaatggaatgtacagtcttgtgacaaagagggatggatacataatgacagtattgcactgtgatgagtatgaacagggagagacatggtgttatatgtaaatatgtcatagcagaatttgttcaatactgagaagtcagaatacatttctccgagaagatagaatttactagctctgtagccacaactaagaaaagagggatcacaacattccagagataggaaaagcatacagaatgcctatggtattaaaacaagcaaacaaaaaacaaacaaacaaaaaacatgctaaacttcttaaagacaaaacgcaggtcaaagtggtaaaaaaaaaaaaaaaagtgatggatcagatagcaccactctgtttcctgagtgctgctgtgatatgaacatgtgtctaaagtatctacctcagtaacttcccactttcaaactatgacccaaaatatactgtgttgtccttcatttgttttgttaggtgtttttcacaccaaaaaaaaaaagtgacttacgcagtagtatatgattttaggtcatattagagatttttttatggtgacctaaaaatctaataggatgcctttgaaaagatttggtcagggagataaaattgtgaaaatttgcatccaggaaagatccctctaacaacattgtaaagagtcaatcagaaagtgcctggagaaaaaaaggtaggaatcagatagaagaaaaagaagtgggccaggaggatgacagtgtcagagaggtataagtaggtggcaatgaagaaatggaagattcaagaggaaagatgtaaattggaagagcttagattagatctaggcacggtaatgaaggctggaactatcagtactaactcatatatttaaggcttaaataggtggataatatgtcataacttgaaatatagaagaccagaggaaaacgatgatttgttttggtgggttcaggaggcaagaggataatttagatgtgatcattttgttgtatttgtttggttgctactgttatgaaatttttgactcattattttctaaaactttcaaataagggtgaatcataaaagtatcttctattgagaaattgagaactttatgtgtgaaaaaaaaaaagccatagcgaatatttcctttggggcatgtggaatctcagctgtaaatactaccttcagatattatagctgtattaaaccattgaacctcagttatcaagtatgacaatctttaaaccatatcaatacaaacctgccaaataatttggtcaataacatgaaacgatcagttacataaataattgagtatattatgagttattaaattaaaccactaagattaactggcacagtagtctaaaaatctgtatgtgtatatatagatatagatataattatatataactctccatatatcaatgctgaacggctgcagaaggcacttgctctctgcatagaagttcctttaggggaattttctctcctgtttccaccatggttattgccactcatgttgtcttgaggtatcaaccatgagtagtgaacatacagaaacaaaactatataataaaatattataatacagtctactctgtttactctaagtttttaatttttgaccatatttagtcccaactttgtaggctcactatacttcatttgtatttgtctctggcctcgctagccagtatttttcaaaaggagctttctcttgtctttaattagcacatgttttgtctacgttcccttcttaaataaatgcatatgtgtaagtaaggtttcaatcattccatagtatactctcatagctaacctttttaggttttaaatagcatgttttgaataaaatgattttcaggatttcaatattaagaaggatgataaagggttagtagaatctgaatattacttatgtaagaagcatgaaaaatgagccttctcagtacatggactatggcaactgagtgaattattgacaaccttaagaaaaaaaggtaaaaatttcaaccaaatcatacccataattaatcttaatgaaatactagttcattctttttctttacagcttgttatgcatgaatatataaaagcaaggcctaaagccaaatatatttttcatgaaattctttcaaattgaggtagatgaattggcatttccatgatttatgtaataagagattctttcctatgcaatatgattattattgggtattaaacattacagcatatgtgggcataaacctaagattagtcaaatattgtttgttctattaacgagaaaaacttctatttgtatcactggcgaaacttcctagccctacacaataggactagaacatagctagaagaaaaggctatgttagtcaccttcccattactttgacaaaatctccaagaaagtcatttggaaaagagggaagatttaatttgattcatactttcagtattactctgtctccattgcttgctgacaaggcagaaagaaacagaatgtaaaagccacgtgataggaaacaaaacagaacaaaacaaaataaaacaaaacaaaacaaaagtcaacctagccagaaaccatagagactgggtacaaaataaacttttcaaaattattcttccttggtggtgaccttccattaattaagcgataaaccttttggctattaattatttagtaaatgaggttaacctctcaatagatctactagctggggctaacgttttgatatggtatgagaaacattttatatccaaaccatgactaagctcacaggagaagtggccaaaatttagaagccatgaaaatgaaaggtcttggcagaacaaaataaaggataaaattcttcttaggaaagtaaacagtaagctaaaaacctgatatccaggttaaacatgaataaaaccaagtcaaaagcagtatttattctgggattcaatatcaaacctagctctataataaattttgttataaagcaatgtaggactcgttacatgcatgtttatgtttaatgtttatgaattccatgaagaaggtatactcatattttttttcaattttatagctaggaaatatgagttatgtgattctgagctctctctgtctctctctctgtctctctctctgtctctctgtctatctgtctctctctctctgtgtgtgtgtgtgtgtgtgtgtgtgcattatctatatttctctatgtctataacaaaagttaaaacttcatttgtttcccttaattcttcatgactaacatagtgcctgccctataaaagacactcagatagatactcaggaggtttgctgctggatgaaggagtaaaggctgctgcaagcccccagtcacagtgtgtcatctagtcacggatgtgtgagttcatccctagccactgccaccataaattgtattttgctatattagacaccctgcaggccttatttctactggacaattgataaattaatcctgatataggatgatagcagtaaataattactgtatgttaatgtgtcatcacacctacataacttatttgcattttaatggagcaattgtagatgtaattccttcaggcaaaagaaaatgaatcttgagggtaggaaagtgctaatctgggatgtggtatggagaaaggtgctaatatggaaatcccaggagactccctgtatgtgttatatcagttgtgatctttccttagctttgtattagatttgttgattctttggagcaaaacttcaagccctcttgggcaaaggcaaatggttaaacctaataagatgcatgctactgtgaaattagattaattagctagaatttgaattagcgttgttttgcagataaaatgtatccaaaaatctacgtatataaaattttatttgatatgcctacaatgtactatattaaatataatttttctcttgtggctgacaaatggggaaaaatgaggcatctcatgaaatgattggaaatatttcattttatacctgtgtatcatgcagaactaaatttaacttaccccagtgaaatccatttttggtcaattctttctttagacagctacaataaatatattattgagttttttaaatgtttcagtaagctcgcctttctgagacatgttcacgggttacataaatgatatactttttaggtcaatgaaacaatttgaagttattacatgatgtgatttgtcacaaaatatagagagagctaacaaatgattgacggacatagtgggaatacttaagatggtcatttactcagcgagtatttggtgagcacagtctatgcatcagaagctgtgaaagaaagcttaggaacaggaaacattaacacataaatgtttcatgtatcatcaagttagtttgtggagcttacacatttttcctgtgaaagatcttagaaactgtttcaatttgaattgagaaccttattgattatcacattaatttcatatttcttcagctgctatcatcttgtaataagtttcaaaatcagtattattgctttagcattgcttcttttaaataatgtttggctgatccggattttttggtttcctttaaaaaacattagatcaggataaaattgaagagagatttgacattacttgagaatttaaaacgtaagtactgtatttacatccgtcccccctcgctctccttccttcaactcctcctgtgaccatgtacccacctgttcttaaattcacagcctctttaattactattggtgtgtgtgtgcacatttataaataataacctgatgagctcatgtagcgttgctcatacgtgtttgaatttagaattgaccacatggattggatcacctaacagaaactcattcttcaagcagactgattatccctctcagaagatggtaattgcatgtagcacttcttttatgggtgataccttatgctgtttacctcatctatactggcatgtgaactgctgttgtccttgtctgagcctctttaggcaaccatgttgagatttcatgagtatatcttctctgtcctttataaaaaaaaaaaaaaaaacaaaaaacaaaaacaaaaacaaaccaaaaaaaaacagaatcttgcagtagacatcttagtcttctggctcttataatctttctgacccctcttcagcagtgttctttgagtcttagacttatggttgtgttgtagatctccaactcatttttatctttgctgacaggcaacaaaattctttatcctgtgctggttccactccctattaacagctttcctcagcagatagcccagggctctggcatctcgaatatcttggagtctccaaagtaacttcagcttcttgttctaatgtctgggatccacatatgatcttctggtctcctcatgatcttctggtctccaaagggctagaatcacttctcctgttcttccctctatagcactctaagctcagattgatccactccactgacactgctgttcttgctgattatcccatggttctagtgtctccaatacactggggtcttccacttcaactatgcctcaccaatagcctctcataggctttcatcatagtgcccagcctcaaatcctttgcatgacctcttgggccatcaaatgcaactgaggctgcaccttcaccaatggccttccatagcatctcagtgacaagcctcagctgatctccatgaccccttcatgccttcaaagccagtaccaatgtacctatttcttctatcttgtctttaccgtctgatagtctctcttgtatttctttggtcaatcttacatctgatattcttgacaaatttctaagttcttaatttccagttttccttcagttttgtctttattcattctatttacatttccctgtctttatcagttttatttattccactgtttttgctgttgttattgttttcacatatttcattgatagaatttttcaaattctctttaagatccttgagtatattcattatagctatttggaattcttgccttatgcttcagcaatattgcattttttttcagggcagttttactcattttcatttttgcagggttgctagactctagtggagccagagtgccctggctgtcattaatcatgattttatgttgtcatctatttggatataatttgtcattctaggtactgttatctggtcttatctttgttgggtggattttctggtccttggtttttgtaaccctctctggattttaggagcatttgttgagtgtgagttgcttgcaaggagtagtacatctgagttcctgccaactgtggtcactgaggttccctggtagaatttggtttaaggtattggaagctgacaatggagatgagctaggacaaggtattgagaggttacacaggaaggaagaaaggttgtctgttaagatgtgtccacggggaaaggaggaagagagggaagacagatctgtgaaagtcatctcctactggccttgggctagggatgagactggagaattgcaatctgagatcgtgaaggaagggaaatgtatcatcacaaatgaatgataatgtcagataatgactatgacagacataatcaaataagctctcagcctagattttaaagcacattaggaaattctggggtaggtgtcctttatcttactccatttctaaggacattgcattacctggaaatgggggatgaaatctgttaccagtggtgatgtctggaaattgctgtccttgcttcaagttaggtgactgggcactttctagtttctgactatatgcctgaagcctgggattttataactgacttacctggacttcccaagttcttaggcctagtctcatagactgccaatttgaaaccagtcagcaagtcttcctgtctcaatgctattttctttgtccctaatttatgtcatagcttgatatttaattaagtgacatcaataacctttaacttttactttattttgacccaatgtatttttctatttttcaattctttcaatgatgagatgagaattttaatacatttagtctttctccttatttcgtattacttaattaaattaattcataaaaaatctaattataatctatcattaaagtggaaagccacatgatttatttttaatttgattaacctaagagattttgtcatctgcaaacagtaccagaattcctcaagctgattattagtagttttcttataggattattaagttttgcatactgaaaaagttctatgctaaaggtgaagcaaactgtagaagaaatgaaaaaaatgttaagcctctcaaaactctgatgttttctaaggaatctagagctagcaaaaggattcactgaaagagttttagagcactgctgtgtactaagcccacaccaggccatatgctgtgacaagtaacttgtacaaaatgaaaagcagtaataccagctcaaaaatgtctaattttgttatattggatacaccaccaataaaggcgtatgtgaatgctctagttaaaaaaaaacaaataacaagcaaacaaacaaaaaacccactacactaaattaaaccatcaaagctgaaactaatttttctaaggttgttgagcaccttgttttcttattataatcataggaagttgctccctatgactataataagagagtttagtatgaccaggtaagtcatttcaatttttaacataaattttaggtgttatatgtgagtaacaattccattttacttgtttactaagaggagaaatatcaccctgatcatgattctcagaaagatttgtgtgaacagttcagatatattcaccatgatagcattgtgtcaggcctggccaaagcagttgcataccttaatatttcattttcacatactgaaaggtcatgggtaaaagaaattcaagaaaaagaaaaccaaatacttcatttttaagggtatatcttattttgagtagagctattgttattattatcattccaaaaaatcacagtgaatatttttccttatgttctctcatattttagcttctacaccattttttgcaacttatgttctggctatcagttacttattacaatttttagcaatcagattctctcttactgttctttctacagacacacacacacacacacacacacacacacacacacacacaatacaactgataccacatcatgatatacttgacatatcacatttaatttttattttgttttaaaataatacggaagtggtaattttgaatagccatgtcaatgctattgacttgtcaacctcattattctttgcttcagtgatttctttccagatattgattactttgcaaggaaataatgtctgatgtctttaggattttccctttaactctgacctttatattgcttcaaatatcaaatacacctaattagtgtttatattattcattgttcagtgccctagctacatattatttaaaatactgaaaatgttgttaaaatttattccatacacacttcatttcctgtgataagtagtctgtgaattattatatgttatactacatttgtcactaaataaatagatagataggtatagatatagttatagacatagatagatattttgatgttaaaatgcctcagacatttaaatgactacctagcgctaaggacagtaaatgtcacccatgtgttagtaagacttttacatgagtaactgccttgaaataacagtgcctcaaaggaagttaaagctgccttagtgggtgatttgaagctttaggtcttgatggtggtagcttattaataagtaagtgtagtattattcatagttgtattccttacttaactgaataacaccctttgtaccagttctagagaatgaaaattaagtaagtcatgtttacactcattacatgtctgcaatgactcaatgtgtcctttcttgaaatatttacaagttctagctagtttacgctatgctttgggatcatcattacaagtatctcttatgaacaaaaagaaatgaaagaaaaatctattatgataatgacttaattacaaataatacaaattccctgaagagagaacaccatagcatgaaatgtcatctgtttttatctgttttatcaaggaagaaggaataagagccagttactttgggaatctttaccttagcatttgaaaaaaagcaccaaataagacttcaagaaaatgaaaatcccagaaataccaattccctttcagcaacatgaagcctgaagcttttctgggacttctaaggacatgtagaggcataaagagccttagacttgtatcactgaatcacatgagaagaattttatttgaagatattaacaatcatcttcagagaagagtctaaattctttaactgtgtggcaatattaatccagttggccaaaatacaaattatgtcatacttattctttctaaggctgtggaagcaagaaaagtatcattgttagcttccaaatgggaagagaggcccttggtcttgggaagatcatatgccccagtacaagggaatgccagggtcaggaagtaggagtgagtgggttggggagcagggtgggggagggtatagggggctttggggatagcatttgaaatgtaaatgaagaaaatatctaagaaaaaaagacaaatcgagtcagaaaaattgaatggagttgtgtcacagtaggggatgggaattgggtgtagcccaagataccaagaaagcaagaggctcacaggacccaacagggatgacattagtagaaatacccaaggaaggggagagagaacctgtagagaccatatccaatggataaatatggtccctggttgagggatggggccacccactgatctcaaaaataacacagaattgttcttgtctaaaggaaatgcaggaaaaaagggttgaacagagtgaaggaaaagccatccaaagactgccccacctagggatgcatcttgtctgctgacaccaaacccagacactattgctgatgccaagaagtgcttgctgacaggaacctcgtatggctgtccccgagaggcctgccagaaccttgccaatacagttacagatgcatgcaaccaaccatcagactgaacactaagacccaatagaggtgttagaagaaggactgaagtaggggtttgcaaccatgtaggaagaacaacaatatcaaccaaccagattcccccagagctcccaggcactaaaccagcaaccaaagaatatacatggtgtttccatggctccatatacatatgtagcagagaactgctttatctagcatcaatgggagcggaggtgcttggacctgtgaaggctcgatgccctggtgtaggggaatgccaaggccaggaaggaggagaaggtggctggatggaagaacaccctcatagaagcagggggagggggaataggaaagggagtttgcagaggggaaaccaggaagggggataacgtttgacatgtaaataaattaaataactaataaaaaaaaaacccaacctacccccaaagacaaattgctgtcctcactgaatattatatccaaaaatgttggtctatactttctcagattatttttacttcaggaactaaaagcattctccagtcgcaagatatctcccttaaatagtcaaatatggggcctacaatttcaagccaatgacagtatctttagtcaactactgaatttccagattacttctacagcaattttgttcttatcagagaggtaacacatttaataccaattagttgttaatcacttcgagtaagttgttgagagtcatctgggaatcctgagaaaaaggaacaaatataggcaaatcaagtaacctgtgaagagagagaaatgaatatggaagaaggtagaaggcaatgtactagaatcttcagaagcagttacagtagaatcttacactgttgcttggcatccataggaaaccactaggattctgaagaatttaaaagaatgagtatgtctgtgtgcataaacaaacacaaaagcatgtatgtgcatgtttgtgaaaacgaatttcaatgaaagaaaagcaagtaaaaaagaaagaaaatatgtgcctgggtatgtatggtggaggagaaagttttcttgtagaaaaactggagagcatagacagaggcagactatctgggatagttcctagagtaatgcagagagagggggaaggaagaggggagaggtgagacaagggagacaggtgctaaagtcctgaggcctagggtacaaaggtaatcaaaacagctgggttagataaggaagagcctctgggggaagggccgcccagtctagggcctagagacttcagggtagggggctggttatgagagccacaccctgtaagaggaagtgactgagggatactgggagaagatggcagccaggcccactttgatatgttaaataggttcatctgcagttgtgcctggtttgcaatttagcaatagtgagttctaaaagcttgccacacacagtgtcgtggtaatattttatgacaaatttccaattttttttgaggttgttatttaactttttaaaactactctttttcttcttttgagattataatcaaattttttgattccagtacttctctccaaaccctccaaacctaccttctaggctgctttcatatcaatggccttaagttttattactgaatatttcttttcttgagatgattatatgtatctccttcaaatatgtgcctatcacttcttgaattcatttgattttggtcaaagaggtttttgtttgtttccattgataacagacctatgtatgtgttgatcaagtttggcttatttacttgatcaaacaaatcattttgctcttcattcatgaacgttatcttaatgttggtattaatgacaaccatagaatcctacaatgagtcagtgagtaattattcgataaatcacattagtctaggagctttgtgtaaattgttttatatactatgcattgtatatttttcattatactcttaagttttcattcttaaaaatacaataagataaattagcaaaatttcattagtactgtaacttattattccacttaatcttccatctatccattgttaacatctttatggtatacatattttgttagaaataaaatatgtatgaattatgttttagtcaattgtcacataaacactgtgattaagctcctgttttaattttataaatatggaaacagtaactggggaaatagctcagtgggtaagttatacaagcatgctaacctgagttcatattcccagaacacgtgtcttacagtagcatgactatgtgactccactgtttctataccaagattagaaggagagagaatcataggacagctagcatggtaaatgcagttgctaatgaatagagacccggtctccaacatgatgtaacaatcacagaccaacacctaagtttgtctcctgactgctatatgccaaggcatacatgtacctatatgctcacttgcacacatacagagagaaggagagagaggggggagagggagagggagaggggagaatgtggaacagttacatttttagttaatagttattagtagaatacacctctttctcccatacaaaaggtttctggtatgcactagttcttctttagtagtagaacaatttaatggctcatacacttcctttagatgtctaggttagggtgaattttgagaaggaatattggcacctaagataagatttactgaataaaaagaaaattgaccatagcatctggacagaccaagtcattcaaaatgacagatagatttctgggaaatatttagtcagcattacccttccttaaatatgagtccctttattcctcgttgatagtttgatcctgagagtttctgttaagggattgcagtaataatattaaactgatgttttcttaaaaattctatgaaaataatttcttcaaaaattccttcattccccgttcaccagaaaccactttctctgtcccctaagtggtagactcagttgcaaagacttaattctttggcttaaaccaggagcgtttggacagtttacctccctggaggcaatgatactattgtacaaaaagagtcaaagtgctgcttcttggtgcttttagtacacgtgattgcttctttttttatcttttctcccccccccccggttattttaatttgatgagttcctttttaaaaagcataatttattgacatgggtaaatctaagactgagatagaaactcagatgacaattcagtccttcagtacagtggataatatggatactttgtacccacaaatgggtcaaacacattgcatccaatgttccatcaagtcatgccaagtccatcctctcatgggtttaggctacaaaaggaaaggctatgaggttgcccgttccttggcatggggtatacctcttagtgaaataaaagacactttgcagacaaaaagctggcatgaaacatacctttgatttcaccagcaagcatgccatatgtcacaaaattctactgcttcctcctgttatttcatctgaatgcctctttcctgcacatggcttttgggtacagttaagtaaataaaatggatattacatttaattgagggaaggactttaaattcatgtgagtttaaataggttggatgataaagaaatagtacaaccagtttcctttgtggtaggatgcacgtagtaaaaatagcatccagtaagaaataaggacacctgtcctctgccacgttcttacaccatcttgctatgtgacctttggcaaatatgtgaacctctgtattttcttttgaacatgggggtgaaaataaattattatgtcagagagatgtcaggtgtttaatttataatacaatatgtgattgtagatagtttgaaaaaaggctagcattccttggaaaaaatgtttttaatatatagcagttggaacacttatacatctatatggatatgatataaatatgaaaaggaatgtgaaaataagaaagtgaaataagaaaaatttcacttaaaacttataattgacattttaataaaaatgaaatatgactttaatatacagaatggataaataaaatcattgaaaaataattcataatcacaaaacacaaaggtaatattgtgtgtttccattaaatattttattttttcaagaaataatcttctctgtatgttaatggatactgtttttcactgtgacactttaacagacattgattgtagaaaattaggtaaatagaaagttattcttctctttgcatgaaattagtattaataactttaattcttgttttctattctgagtttccacttgatattgtattctgttatcttcccacaacattaaaacactttctgctgtgataaagtaccatgaccaaagcaacttatgaagcagagcatttaatttggggtttatggttttagaaccctaaagcacatgatggctaccaaaagcatgggggaaacaacagctgagagctcccatttgatctgtaagttgtaggcagaaacacacacacacacacacacactgcaaatgacccaagtcttttgaaacatgaaaggccactcccagtgacacaccttctctaacaaggccattcctctagtaatccttcccaaacaattgcaccaaccgggacccaagtgtccgttcacatattcaaactgccacaataaatgcaatgaattttgaaacaatctcaatataaacagcaaaaatagtcagcctaactatatttaaatatctcaaacattgcaattaacaaaaaaggattcaaaatgattagtatgtaatcaatggaaaaatgacaaaatgaacatgttttgcagaagaatgtaaaaactattataagaagtagctgaaacttctgactgaaaggcaagtaattgcaataaagaattcaccaaataggttcaaaaatcattgaagatggtgaaagaaataatcagtcaaatacacatatagatatatagaaattatctaatctagaaagaagaaaaataaatcaaagaaaactagacagagtcccattagctcaggcaaaatgtagactgcataatacatattaatatatacttaaaatgaatagcagaagtcaaaacagaaagggaaagaaaaaaacagtttcaaaggattataccaatcaaaaaaagaacattatttactgatatgcattacaacataaacaaaccataagagtattgtgtaagaagccagttataaaagatcacaattaggtctcaagaagcagctcttatgctacagtacttgtaataaagcttaaagaactgagttcaagtcctaaagcatgtataaacactagtgatcagaggtagctctggccgtacacgcctttaagctcagcactcaggaggcagaggcagatgggtctctttaagttcaaggccaggctggtctacacagagttccaggacagccatggctacatgataaactctgtcttgaaaataaaaattttaaaaaaaaatagtaataaggggttagggatataattaattatgggtaaaaggaaaatgttaatagattattgttagagattttgctaatttagtaaattagtaattgtagattcttctccaataaacatggctacagagttgttagctaggttttccatacctagtagagtacacctcttatagagctcccatgaaggaaactcacaaagatgaaaactacatttctgtctgtagggtgtcttcattgtgtaactgttgttaaaaataatgtagcacatttctttcttttagtctgacatagaacacaagtatatatcaaattgatgattcactgacagtgctttgttctctgacatgtgcatatgtgcaagtgcactcatgtacatgcatacgcatgcacaaatgcatatgcacatataagcacatgcaactgccacatattatatggtactatttatagagagtactcaaattaaactagcccatagaagaatgcagttctagccttcatttaattgggtatgtagtctaagtgcaaaattttgtaatctagaggtggtatggtagacttacacctgataactttacataacctgaatattttttttggctttctgattttgttcacatcatcatcaagtttagagtgttcctttatgattactgttatgccattttgttcaaaaagtttaatatcattgtttcattagtaaggccaaaaacctttcacctttaagagtttgcagaagataattgctcaccttttaagcctaggatgaaaatcttgctggaatttcattgcttaactagtgtcttcctttgaaactcccaaaactctgttaccctattcagcaatgagaataagaatactctagagttgaaccagtcagagttgaattctgactttactagctgtatcttcttgaaaacctttgttaaaaattctatgcttctggatatatgcccaggagaggtattgctggatcctccggtagtactatgtccaattttctgaggaaccgccagactgatttccagagtggttgtacaagcctgcaatcccaccaacaatagagcagtgttcctctttctccacatccacgccagcatctgctgtcacctgaatttttgaacttagccattctgactggtgtgaggtggaatcttagggttgttttgatttgcatttccctgatgattaaggatgctgaacattttttcaggtgctttgcagccattcggtattcctcaggtgagaattctttgttcagctctgagccccatttattaatggggttatttgattttctggagtccaccctcttgagttctttatatatattgcatattagtcccctatccgatttgggataggtaaagatcctttcccaatctgttggtggctttttttttttttgtcttattgacggtgtcttttgctttgcaaaacctttgcaattttatgaggtcccatttatcgattctcgatgttacagcacaagccattgctgttctattcaggaatttttcccctgtacccatatcttcgaggcttttctctactttctcctctataactttcagtgtctctggttttatgtggagttccttaatccacttagatttgaccttagtacaaggagaaagaaatggatcaattcacatttttctacatgataaccgccagttgtgccagcaccatttgttgaaaatgctgtctttcttccactggatggttttagctcccttgtcaaagatcaagtgaccataggtgtgtgggttcatctctgggtcttcaattcttttccattggtctacttgtctgtcactataccagtaccatgcagtttttatcacaattgctctgtagtacagctttagttcgagcatggtgattgcaccagaggttcttttatccttgagaagagtttttgctatcctaggttttttgttattccagatgaatctgctgattgccctttctaattcgttgaagaactgagttggaattttgatggggattgcattgaatctgtagattgtttttggcaagatagccatttttacaatgttgatcctgccaatccatgagaatgggagatctttccatcttctgagatcttctttaatttctttcttcagagacttgaagttcttatcatacaaatcttttacttccttagttagagtcatgccaaggtattttatattatttgtgactattgagaagggtgttgtttccctaatttctttctcagcctgtttatcctttgtgtacagaaaggccattgacttgtttgagttaattttatatccagctacttcattgaagctgtttatcaggcttaggagttctctggtggaatttttagggtcacttatatatactatcatatcatctgcaaaaagtgatattttgacttcttcctttccaatttgtatccccttgatctccttttgttgtcgaattgctctggctaatacttcaagtacaatgttgaataggtatggcgagagtggacagccttgtctagtccctgattttagtgggattgcttccagcttctcaccatttactttgatgttggctactggtttgctgtagattgcttttatcatgattaggtatgggccttgaattcctgatctttccaagacttttatcatgaatgggtgttggattttgtcaaatgctttctcagcatctaatgagatgatcatgtggtttttgtctttgagtttgtttatatactggattacattgatggatttctgtatattgaaccatccctgcatccctgggaggaaacctacttggtcaggatggatgattgttttgatgtgttcttaaattcggttaacaagaactttattgaggatttttgcatcgatattcataagggaaattggtctgaagttctctatgtttgttgggtctttttgtggtttaggtatcagagtaattgtggcttcatagaatgagttgggtagagtaccttccgtttctattttgtggaatagtttgtgaagaactggaattaggtcttctttgaaggtctgatagaactctgcactaaacccatctggtcctgggcttttttttggttgggagactattaatgactgcttctatttctttaggggatataggactgtttagatcattaacctgatcttgatttagctttagtacatggtatctgtctagaaacttgtccatttcatccaggttttccagttttgttgagtatagccttttgtagaaggatctgatggtgttttggatttcttcaggatcagttgttatgtttcccttttcatttctgattttgttaattaggatgctttccctgtgccctctagtgagtctggctaagagtttatctatcttggtgattttctcaaagaaccagctccttgattggttgattctttgaatagttcttcttgtttccacttggttgatttcacccctgagtttgattatttcctgccttctactcctcttgggtgaatttgcttccttttgttctagagccattaggtgtgctgtcaagctgctaatgtgtgctctctctagtttctttttggaggcactcagagctatgagttttcctcttaggaatgctttccttgtgtcccatccagaagatgtcccaaccggtaagaaggacacatgctccactatgttcatagcagccttatttataatagccatatgctggaaagaacccagatgcccctcaacagaggaatggatacagaaaatgtggtacatttacagagtggagtactactcagctattaaaaaatgaatttatgaaattcctaggcaaatggatggacctggaaggcatcatcctgagtgaggtaacccaatcacaaaggaactcacacaatatgtactcactgataagtggatattagcccagaaacttaggataaccaagatataagatacaatttgctaaactcatgaaattcaagaagaactaagaccaaactgtggacactttgccccttcttagaaatgggaataaaacacccatggaaggagttacagagacaaaatttggagctttgacgaaaggatggaccatctagtgattgccatatgcagggatccatcccataatcagcttccaaacgctgacaccattgcatacactagcaagattttgctgaaaggacccagatatagctgtctcttgtgagactatgccagggcctagcaaacacataagtggatgctcacagtcagctattggatggatcacagggcccccaatgtaggagctagagaaattacccaaggagctaaagggaactgcaaccctataggtggaacaacaatatgaactaaccagtaccccggagctcttgtctctagctgcatatgtatcaaaagatggcctagtcggccatcactgcaaagagaggcccactggacttgcaaactttatatgccccagtacaggggaaccccagggccaaaaagggggagtgggtgggtaggggattgggggtgtgggtatgggggacttttgggatagcattgaaaatgtaaatgaggaaaatacctaataaaaaaataaattaaaaaaaattctatgcttttgtttcttcacctgtaaaattgaggaaaatgatctcatgaaatatttgcggattaaatgtgattatggatgttaatttttaaaaaactgtctacttttctgacttttattttgaaaaaccaatgatttactagctattagtattaactgtttacaaaattataccatattaacaagtacatgcaataatatacaagaaaccagacaatatgaactgatactaatgtgttttaccttgtcctttttaaagaaaatgactaatttaccatttttgtgttagatatgaaatagaggcagactactttatcctaaagctttacctaaaagttagactggaagactattttatggggattttcctaataataactaccagctatgacttagttgtcatttgcccacaacagtaaactccttagtataaatcccagagatcagaattaccctccgttatccacctctgcaatcaaatcgctaaagggtctatattttggagcatatgttatgttaatttgattagatcttttacagtctaatgtttagcataattgcaaatgagattctagtagcaagcagtgaacatgtgactgcttccaattgttacacatgaaatttgagagggttactaataaagtgccaattttgctaaactaatgctgaagattgacagcaataagagagtgttgattaatacttgttattcgtaaactatggacggaaatggtatctccaattacataacaccacatttaaaacctattacttttgaagatacgatattaagtttgatgctacattttgggtaagtatgttaatgctaaaattactatgaaatttaccaaaccccaatggatttcattgtaagaaaatgaattgaatatgattgtttacttggggaaacaagcagctattgtttttctccaaagagtacaaagaagcttttatatattgagttaccttcaattttattgaagattgctctgcctattaagtggttagatgatctgcataatccaacacagaggatgtaagaaagtaataagaagcagataatttggaattactttagggcattgttaaagtttcaaaagacgtgaagagatagagatagatgtcactgcaactcaaagatgaattattacttgcaaattactaagaaatagaaatgtgcaagttatttacacaattactgaaaaagttcttccttagtgatattttgggaactcatttttccttccctctaacagtgtattatgaactagaaaattttcaaaatcacaatatagtgtcaattcatagatattttattcaaaattctggtgtgtgtgtgtgtgtgtgtgtgtgtgtgtaaattcaaggtcaagattatcttaactacaactgagaacactaaattgtattaagccttctgtttctgaaatagttgttatagaatttctttgtggagcccttcctatctcctttctttcatttctccacattttttatgtgaagcatgttaacccaaatagtggaggttttaacaaaagcaaacagaaaataaataaaatacacacagcagtaaagagcaagaatatctggcaagaggtgtaatatcactatttagttgtaaaattgcaaactttggaatgttctccttcaaaatggcctgaagaactagcctggcaaggcaccgtgacaatatctattgcaactgtttcaacaaatgattcagatcatatttgaagaagttttccaggtgttactgaacattcttctattgtaagattttaaaaattctaatgtaataattaagtagatccatatgaagtaatatagtaagtagaattcatatcaaagctggaatttcaagccttggtattataaaatgctgaacaaaaacatttttgttcagaatacatcaccttctaggtaaaatgatcatgctatatcctaaaacctgggaaattatttcccttttatttgctaaaacaatttggtgtgtccattagatgggaaaaactggcaaatactatgacaaaatcaaattaatttggttgctttctgtatttcttttggccatcaccacatagaaaatggtcatttttatgatagagttcagccaaaacgccattcattttctgaataactgaatatagtcaattaagcagccacttagcaatcatatattaacaaattgcttttggaaaggttcttgcttttatcaagtttgacctatttttttcaaaagtaattatatctactcattgctcatgttttcctcctctcctgcttaccaaccccccctcaaaaaaaaagaaaaacaaaacataaagttaaaatggcaaagaattcactgtgaaagttagctgcagcaaatattcaggatggaaggttatgctatttgttgcatagcccgagtaaaggttaatgtcttttcttgtgtgggaaaagttcccaatagataaatgtacaaaaactacaaagagctcaaagaagaggaaacagaattagaatgtgtgcagaaagtaaagtattatcaacaagcaaatacaaactaaaatatggcactcgtaatttactcatttaaacagacatttaaaacaatatgcaaaattggccagggtacaatgaaaggaatgtctcacacattgctaatgactgtgtatattataattttccaagcaacaatatattcaagacttttggctcattgattcatggtcttggaatctatcctaacaaaacaataaagataataaaagatgtttatggtgtcttcataatgttccaggctatgcgacaaatagcatgaccttctgtcctgaatatttgctgcagctaactttcacagtgaattctttgccattttaactttatgttttgtttttcagggtttttttttgggggggggggttggtaagcaggagaggagatataatattcataaattaggggcgatgtaaatatccaacaataagagaatgaacaagcaaattgtggcacacccactttgcagtgatatttaaagttattatcatagaaattgtataaaaaatgtgtcacaagggaagggagaaacatgaaacttaagaaaataaatcagaatgatggtagtcatctttctagatagtaaaatgatgagttttcctctaggtctttaaagactgggtgactatgttactgttatagacagcttccacaactctttcccatttcaattttttttaagaaaaagaaaattagagaaaaaaatcagtcagaatttcacaatctaaatttgtcaagctaaaataatctaggaggattttattgtgaaaaaagtattgctacatttacagcgttcaccctttaagtgctgtgctatgaaaggcttgctaaccttaagctgcattctatgtatcctttacttgttttctcaattagagtgtgacttctttgttaaggcttcaactcataaataggcactataggtagaatgagttgatattcatcgtgaataaactagaacaagtgtccatcttgagtggccaatgtatacaaaagcatatataaaattaacattaaacagactgagcagagcatatttatttatctatgaacatatatgtacacatgtatatacatatatatgaatgtaaacaatgtgaaaagaggctatccatttcaaaaagagctagatgggtttatgagaatgttgggtgggagggagaaaagggaaggggaaaatgatgtaatggtatatcaaaaattaaaaaataataatttaaaataaatgagatttagaaacaaaataaatagagaggaaggaaagtgattattaattcatacatatgcacaaggattcatggattcaaaagcagtatttttgttttattccaatatcctatagcatattggagtgtataatatccatttggggagaggaaagaagcagaaaagaaatgagagagcatgattaacaatgcaaacatagaattgattatacttcttcttttatgtctaatcaacctcagcttttctgtcatttgaaagccaataaggaattttagaactagaagagatttctgagataactcagtctcttcactttatatttagagaaactagcctctcagagagagcacgctgtttactgagcatcgcagccagttgttccattgaaagcaaatactgactagtgattggaatttagcatttcttcctcatgtctaaagaagactgacatagcattggacttaatgaaaaaaaaagagcagtgaagtaattagtatttactatcttttgtccatgacagttttgtaacaatgtctttttgaaattactgtgcttttaaagtttgttgcatttcaaatcttgttagtatttttccaaatgttaaattcagagcttgtaaatttttcataaagtcattatttgccaatcatatttgaggtataatttttgagctttgataagtatcacaattacatattttcaaagccccagcccacacaattgtgtgaatcaatcttattttcaaaaaaacaaaacaaatgaaagaaaaacaaatagaaaaaaaaactagactgtttctctcatatctcctggattaactgacaaattttaggacaaaaatgttatgatagtccagtcaaagagcttttactggtattctactttaaagagagaaaaaaaaaaaacattgaataggtgtgacattccttattcctagctgatttgtaggtgggaattgctgtgacttgaactttgaaaatgactcataacagctatataaaatctgtctttctgcattactttttgtctctttctcatttcatatatgtactatctcattgtatgtttcaaatagacacattgaaagtaaagagaatgtcaagatctgtgtacataaaagtaaataaaattatagcatgataaatcatagttgccataatgtattagacattagaaatgaggtatttttagtttttgatttcatgtattatatttgaatgtcattatgatatatgtaaattcctaatgaatggatgattaatagaaagcattctctaagttctttttgtctataagtccttgatagttttctacaatcagtgatactatgtggaaaatagtggtccacctccaaattgttaaagtcccattctataatgaacagcaacaaaaaattgtatataagagtttatgttcgtaggcatcaatttaaatgaattttattgatatggagtttttgcagtgtgtgtgtgtgtgtgtgtgtgtgtgtgtgtgtgtgaaaaaatctctcttccttttaaaaacgtctttgtgcggtaaagtttctaagactcatctattgatcaatggtttgctatgtaccattattcaaaggtatagagcaacaaatacaacagacaatgcctattgatataaggcagacaatgaaataataaacatttatcatgtcatttgttgatgaattttttgaaaggacagaagaggagaatgagtagtctcatgagaggtagttttttatggaaggttaccctgaggtgggaaaggatttagtgttttcagaaacagaacactagtataactacagtacatgaacagaaggaaaagaaaagtagatgagttggaaaattttaagctaaggcccttgtaggttactgtaggcttttgtcttttattttagagtatggcacaccattactgcttcagaaaataggagaacatgaaaaatcatcttagtaaatgttctattgctctgaagatatactgtgaccatagcaacttttataaaagaaaacatttaattggggctggctcatactttcagaggtttagttcattattgtcatggtgggaacatggcagtgtgcaagcagacatgatgatgaagaagaatctgagagctctacattcagatccgcaggtagagctagagacactgagactagcttaggtctttgaaacaccaaaacccatccccagtgacacacttcctctaacaaggccacacccactacaaaaaggtcacactttctaatagtgccatgaactggtgaccaaacaatcaagtctataatcctataggcggtcatttttacttttcttttcttttcttttcttttctgggggggaggggggttagagacagggtttctctgtatagcccgggctgtcctggaactcactctgtagaccaggctggcctcgaactttgaaatccacttgcctctgcctcccaactgctgggattaaaggcatgtgttaccactccccggatggccatttttttcaaaccatcatatttatatgttaaaaattatactctgactacagtgatgataaattgctgtcaggctgcaatggtataaacaggacactcattaggagaaaagtcacaatacttggaaatcctttgatccaaagtagtattgaagaagtggatacatatgtttggattctatatttttttcaaagatgccacaaatgtactaactaatggaatgcatgtaagatgtgaaagatgatagtaagcaaggatggctttaactttttgggtacctctagagaaatgacaaagtccagtctcaaacataccacatttcagaggacttcatagataactatatggaaatcctcagcagccagttagatactcaaacctgtagggcaggagaaagatctatgctggtactaaaagtgaaaaaaaaatacaactgctagacaatgcattagaaaattatagagagaatagattcataaaatgaccttataatcaagcactgctgaatgaacagcatatacgggcatgcagcaacaattaatgaaatagagaccaggaatttgaaagggaatgaggcttttatgggaagacgtgaagggaagaaagggaaaggagacatgatgtaattatattcatctcaaagcataaaataagtaataaaaacaccatatctctttttttttcatgatggtcatttctgatattaacccaaagaaaccttggaatattcctagaatgtttgtagtatttatgtatttgaataataaacagtctctaagacgtattttactagattagtactatatagtactgcaactatgaagtttgaaggttcaggttttaccttcctgaacattaacattaggtttaataagtcttcaacatataatgctttgttcatataataaagtagaatgaactatttagcatcagccaaccatgaacattactgaaggatttctggtttctatatgcttactattaatccaatagagattctaagctctatgctactatatatggtataggacgcatagtttatatgtcagtaggtttcactgaaaatatatatgatagattcctggggttcgggagaagtaatattagcctttctggtgctaaggcaagaggctaataaatttgagatgagttggggcttcatagtaaggcctttcctcaaacatgcctatggagaccaagcatggcagctcacatcagaaatcttagtacttgagagcctaggacacagagtcagtacaaaggaagccaacctagtgagttgcaggccatattggaatgcaaagtgaaaccctgtctgaaactacaaataaacaaactgcgtaaagtgctgaaaaaaatgaaggaatcaatacttgatttcaaactacatatttaagcattataggaaagaaacaggttgcagacttactgcagcacaaaaatgatggaaaaataaatgtaaggaaataagcttgaaaacagcaacaacaacaacaacaaaaacaggacttttaatgttccagaagactttgacatcttaaatggcacttgttctcagtctgtgataagtagggcagctaatgtctttactagccctaagagcttcagcagctcctagctcagcattgggggtgagggggagattcaatgatttatcatgaagctctatattgctgcttacaaacccaatttagatcctactgttcctatagcagtatagtcactagagatgttgtttacatcctctcaatattatgacaaacaaaaatttaccaccaccgaagtcattaaaaatgttctgcaggcctgagactcaaaagccacaagataaatacaagaagtccagtcccctcaagcacactttatttcatgagctttgctagctgtctctccacattcagagcccttcacatcctcagagtcccagtcttaaatgtaatattaaaccagaggcaaggaacgattctttctgaatgtatttttcttactagattcatttcaagtgtgagctagctatgctaggttaatatttatactcctggccatttccaaatcccataatgttttctaatctaaccacagtctttaacattaaaaacacactctcataccaaagaaatagtgccctttgtttgcattccaatgcaaatacttttgtaagctatccttcttttaatttgagctttttctgatactacaacctctagcttcatcctaaatgcttgagaatatatgcatgtagagcacagtgttattattgcctccggctagcttcatgtcatccactttgtcttttgcttcactcctttgatagtattagcaggccaattgtgaatctgccagatgtgtttccttgcaaaaggacaaatctaaaaaggctcatgtttttcactctcttccaggactgttttcattaaagaacttccttatccttttttcatgaaactcagcttgcttaatcagagatggagcaaacagactgcaaaccttatcagcctctgtccaaagtcaagcatgaaatggatctagcttataccagttcttctgatgagagtgaagatgggagaaaaccaagacagtcattcaactccagggaaactctgcatgagtataaccaagagctgaggaggaattacaatagccagagtagaaagaggaaagatgtggagaaatctactcaaggtaggtttttattcaatttctataactaatattattttcattaatgagtatttacatactttaacctatgtatcaaaaacaaatttgtcagtgctaactggttaataattcctactgcttacatatgctcagttaatctgttccacatgtgcacccagctgaggttgtaggttccatgtgctttttacggattatgcatgaatttggatgcaacaatcctcttattggagctttcagaatttgtctaatcctacaaatagccatttacagactaaaggattaaataatttatagtaagacgtaaagtaaacagctaagtgcttttcaagccattgcccatatgggacagaagtctcaaagaaatattcagctgctgaaaacgtgacacaggctagtagagactacccaaaaaggggctaggatgtctgtgtaaagaatgtggaaaggctttgcagcatagcttacaaggtaatgaagaatgttgagagtttcttaaagaaacacacagatgtattttgtaatctattttttgactactgaagtctctcacttatggaaggcataatggtttctaacaaaattagggagatagaaatacaatttctattttttcaggtaatgaaatagaaaaatatattgacattagcatagattatttgttagggataagtcatagtgacattttaaaacaatattattcctctgggacagtgatcttcaggttgtatacccctgactcagtagtatcagcattaactgagaatttactaaaaattcaaactctcacaacccatcttagaaaacctgggtttagaacttgtctatcaatttaaagttttaaaaggcccactggagatttctgatgcttgaatgattcctccaaaatcttttgttcaaatgaattcattggtcacacttgtttggggaaatttccaaattacattttaattcagctttaacctcactcataaattacagttttaaacattcaattatctgatggacatttccaaattgatactatatcagttactctaaattctgtataactaaaaggaagggaatcattctaacaccctcaattataagcctgtttacattgttaggcactggctccttcatgcttgccctctttcagtgagccaccagaatttctctgtgtaacacattgtttcatccagcaaagttgatctctacatctgaaatgtactattagcatatctcactgagattttaaaaaaagaaatctaactaatctgcttgtatttcctttcattcccctttacccttttactgtgctgttgcctacttcctgacagcaaaaagaaaaatatcggagggaggtagaaaagatgcaaaagatagagctgggtgtcttatgtatatggaataaacactctaccacccagctatatctccagatacaaactcttggactctgggaatgccatcctcactgtctctctttatctctgttcaactattattcacatcttaactcaaaagtatctttaactctcaactctcactgtgactctatcaccaaacttttgctttgtgaagatgattgatctcttcttccataaagcataagtatattttatttacgtgactcacttttgctgtagatcttctttccatattctatacctaacaaggatgaggatcatggtttctttcctgctctctgtttttctgtaaaatttacatatatgttctatgacttccctatttgatagtatatgtgatagtatacatattagaagttgcttgttaaatattactatgtcagattcattattataaattaaacttattgcattctaaactattattacagttctacatttacaaaagtctaaatttagtcaatagttcaatatatactaccatgtaaatatccattcacatttataatatcaactgtatgatcatttacatttcaatataactggaaaggttttgtacccatcttttcaaagtattcactttaatctgtcatgtcttcagctgaacatatcttacatttgttcaaactaaaaccacctcccttttggcaacattgtttttctaaatgtttggagtgtctatttctctttaaaaactgtatggatccattaaatatttctcagtaaatttgtctttacagaagacaaattcataattataagttttgtgttgtggaataggctcatagagtgattaaggttttaaaagtacgaataatgttacactaagtctgaactgagaaagtcagcctcacattttgtttctgtgcaaggtgaccaaaagaaatatatgatgagtgcagtttgtcttttctaatgtcatgctaacttcctttcaatagagtatttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggcatccaaacgctgacaccattgcatacactagcaagattttattgaaaggacacagatgtagctgtctcttgtgagactatgccggggcccagcaaacacagaagtggatgctcacagtcagctaatggatggatcatagggctctcaatagagtattttaagcaactagcttttgtttagcatttaatgttaaccataccttgagtccaatgttggaggtgaaaatttaatgcctcttggaaactcataggtggtggataaaattgctatacaaactaatcagtacaattttgtgataagtgcttttgaaatagcttccgcaagcatggtgttactttccaatagattttagttacataaccaaggtacacacacacacacacacacacacacacacacacacaaagaaaagaaaagaaaagaaaagaaaagaaaagaaaagaaaagaaaagaaaaaatttcagaaataaaccctttttaagtttttggttacaaatcatgctgactagcataatgatgttttccaactagcatctctgtcccactccatgtaagaatcatcactttgttcaatatgattgtattatatatgatatcatccctttacttattatagaactctagttaatatatgaagtagatggcattacagggcttgtattcaagtaatctacttaataagcactccaaagcttgagagtagaatgctgtcaaatataaatgctacattaaacaatcaatgaaaacaatcctgaaaatgagaaagtgagaggtcttgatttaaaaaggaagaaaaaattatatgctgaggttactagaattacaatacaaacaaatctatgaaattaaggagaaaggaaaagaaattcactccagttttgaagttacacaaaaaatcatttaagttaaagtcaagatgcatgatatgtgctaggtaaagagagaaaatgtatcaaacttgtgagtaaaagatatgaacagaaatatttatactgactcctggaacatgttgtagcagaaagcattgaacctacaggaagacttacattaacaaatggtgctggttcaactggcagtcagcatgtagaagaatgtgaattgatccattcttatctccttgtatgaagctcaagaccaagtggatcaaggacctccatataaaaccagatacactgaaacttatagaaaacaaaatagggaagagcctcgagcccgtgggcacaggggaaattttcctgaacagaagaccagtggcttatgctttaagatcaccagtagacgaatgggacctcataaaattgcaaagcttctgtaaggcaaaggacgctgtcaataggacaaaatggcaaccaacagattgggaaaagaactttaccaatcctacatctgatagagggctagtattcaatatataaaacaaacttcataagttagcctccaaagaatcaaataatcctattaaaaatgtagtacagagttaaacaaagaatttctcaaatgcagacactattgtgggtgtcaagaagtgcatgctgacaggagcctgttatagctatctcctgagaggctctgagagaaactgacatatacagagatagatgttcgcacccaacctttgaactgatcacaggatctgtgatggaggagtcagagaaaggagtaaaggagtgaaggaatttgtaaccccataggaagaacaacaatatcaaccaaccagactctgcagagctccaagggactaaagcaccaaccaaggaatacacatggagggacccatgtcagggaatgtgagggcagggaggcaggacagggttgatgggtggggggtacaccctcatagaagcaggaggagggaggatgggacagggggcttcggggagggattgtgaaaggggataacattagaaatgtaaataaataaaatattcaataaaaagataatggaaaagaaaaggaaaggaaagaaaagaaaagaaaaagttcaacatccttagtcatcagggaaatgcaaatcaaaacaacactgagattccacctcacatcagtcagaatggctaagatcaaaaactcaggtcacagcagatgctggcaaggatgtggagaaagacgaacactcctccattgctgataggactgcaagcttgtacaactactctggaaatctgtctggcagtttctcagaaaattggacatagtactatctgaggacccagcagctataccactcctgggcatatacccagaagatgctccaacatgtagtaaggacacatgctccactatgttcatagcagccttatttataatagccagaagctggaaagaatccagatgtccctcaacagaggaatggattcaaaaaatatggtacatttacacagtggagtactactccactattaaaacagtgacttcatgacattcttagacaaatagatggaactagaaaatattatcttgtgtcacaaaagaacacacatggtatgaactcactgaaaagtggatattagcccaaaagctcagaatacaaaaagataaaattccgagaccacatgaagctcaagaagaaggaagaccaaaagaccaaagtgtgaatgcttcaatccctcttagaaggggtagcgaaatactcacatgatcaaataatgagacaaaatgtggagcagagactgaaggaaaggccatccagagactgcctgcctgccctacccccccaccccctgctgggtatccattccatatacagacatcaaatccaaacactattgtggatgccaagaagtgcttgctgacacgagcctagtgtagccgtctcctgagagctctgccaaaacctgacaaatacagaggtgaatgcttacagcatatcattggactaagcatgggatatccaatggcggagctataggaaggacccaaggagctgaaggggtttgcagccccatagaaggaacaacaatccgaaccaactagtaccttcagagctctcagggactaatctaccaaccaaaaagtacacatggagggacttatggctccagccacaaaatgttgcagaggatggcattgttgggcatcaatgggaggagaggcccttgtttctgttaagtctcaatgctccatggtaggggtatgccagggcggggagttcagagtcagtaggtggtagaataccctcatagaagcaagagggcagggatagggggtttctggaggggaaacctgggaaagaggataacatttgaaatgtaaataaagaaaatatccaataaaagaaaaccaacaaaacaataagcaatacaaagtcatttgttaaaagttaggaatgaggatccagattcaggagtaggcttggactgaaaagtacaaaaatgttggacaggttgtttctggtgataagaattaccactgtgtgtacagcagatgggaggagactaatgaaagaagactcaccctcagcaggttttgtgtacaacaaaactaagctttctctaaaaagatgctcaatggaaattgttcattaaagagctggtgaagcactaaaccataaagtcagaagaacacattaacaaagtactatatcattatactacagagggcatggtaaagccaggtgtagaatgcatagcaaagaactcttactctttctctaaaacaaaaaccaaattaatcttccaaggatgcggcaacataatcaaaaattgggggtggcagtcaccttgtttctgatgtttttataaatgttttatcccagaagtgaaaacacgatttggaagagaaaggattgaaagttaaagccctattaacaatgtaacagcaacttggccgtcttaaccctgataattataaaaattaatatttcaaggttgtagttttaccttgtctcttggctagaatattagttagtccatcaaggctataaatactaacctagtactagtcttcttggttcagctttttaaaaagaattctttatttcatgctgctagaaccctatacaaggggtaggcatgtccacaaccagtgagctttgttcctacccttggatcagttagaatggtaagcttaatctggacataatacaatgttgaaagttattgactatgtctggcacactagcattctttaagttccatttaaaaattaaaagcagaataccccatgcagatttggagggaaagagtgggggtaaatataatcaggatacattgtatgtatatatgaaattttcaaagaacaaaaattaaaatgagaaatcaaacttaagaagattgaagtataagaacctgcattttcctcagtagggctacagagagagaaaagcaagataaaatgacagtttgctattgtctaaactgctaaacctttgaaatgtattataatttaataaattctgactttcagaaagacaaaaatatcaatgaaattcattctgaatacaataatcaaaaggataatttataattaaactattcttctaagagtgttctacggggaaacccaaacaaattaacttttctctaccaagtattccaagccatgaatgttgtctagtgccttatcttaagtcattgactttatcattgcttagtttctcaagaccacacaaagaagatgatcctcctcctgactgaacaccacacatatagtccttatttagcatttattacagtgtcattcacttcatttcatttcatcattcagagcatcactgagaaatttttagtcaaagaaaccccattgatacatcttctattgtactattgtttcagtttagacttagttattgttgttggtctcttattacttacaaatcaaactctattataggtctgtgtgcacacaaatttatatatggttgtagtatgatgcagcatcattgaaagttccaggcattcactcgtggtcttaagatatcactgtgaataatggtgaatttttagacaatggactcatagatttcaagttttgtaatgtaaagtccacaagagaattgtaaaggtttaacagaagagtaggtgtaattgaaaataactgaatatgtgactgtgtggaatctatgaggtcccaaagttaccacaaagcaaagaatggcatgaagagaaaaaaacatagctaaaaaagagaagagaaacactcaagaaatgtttatgtgatataagggaaatgatttgggtaacttactgctagttgcatttacaaaataaagcagagttgaaatcagtctgcagtttcaaggtttggaaatggtgaggatgctgatcaatttgataaaaaatggatgttaagtttaagatgctggtgtgacagcagatggatcgtccaaaaggttgtggaagatgcatcttttgagttcaagatagattgaggccaaggataaaagcaggcttgatcacattagttcctaaaatatgcccagagaaagatgagattattcagggcaagtgtataaggtaagactagaaaggcaagggacaaaaacctgaatctatcatctgtgaactgacataaacacagtttaaatatacttacattgtcagccagtaccattctttagtgaactgatttatctaagctaaaatataaaggtatagaaagccaaaagcctgaaaacttgagatcttatatgctactgtctttcttactgatctatagaggcactgtagggaaatatctgccccctttgaagagaaacgcattatcctatattaagcaagaaaagttcaattttcttttctgtaaagtctagaatctacattattattttatttcagcaccacctgtaaatcagagaaaacattattagctgtcaaaattgcatgccagtatttgtaacttgcattaatctaggtaaagctgagcccaacttattttttagagtgacagataaaattgtatgtatttatcacatataatatgttttagagagtgcatagattgtagattctcagaaagtcatttggttttagatctgcaatgaagaaaataaacaccattctttatatactgtactacctattcacacctacaccaggaggtcatgataaggatcaactgctttcacaagtctgaaaatactgccaaactaaaactgtttagattcccttcatttctgtctacaattttggcagcttctttatgttccaatggccagtggttgacaagaaatttaaaccccccccccttttttttttttttactctgagtagcattagtaaaagataaatgctatgctgtataatttattatgaatggtttctttgtttttatctgtctgagaaatcaatgggttgttgttgtggttgttgttgttagtgtgtttctagttgaggactaacttttgataaatactgaaaaaatactttacttcaggtttgtcacctcagcaactctcctgtccatgtgcatgtagattgccgaattctaatgttgtttcttgttgttgctgtgttgttttagtcttccaaaagtctatgaaaagatagacaatcatattctatcgtttgttctttattaacaggatgaatataaggaggcttagtgtgtgatttgtggtagatttaataggaggtatagatttttctggaagtagaatggctggatattgttcccaagtatgcccacatccaaaggcagcttcgagtatccaataaacctaagaatcaaaatatggaaaagtaaatgtgctaatttttctatggttttaatatggctaaggttagtctggagtatagccattttacttcaaaataataatgaaggaacatggcctgtacaggaaagtaggaggtatggcaaaattcagctgtagctcatacagttctaaacactctcaaaacagtaaagatgaaattctctctttatatcctgttcttttatggtttattcttcttctaatatgatggttggttgcttggttgctttgtagttttgtggattacagttttatctggtggaaaacattcaagctgccgatttttatgtattgtgattacaaagcaaatagtctatcatctactgctggcctttaatttattcacttatatatgaacactaatttagtattgagtatgccccagggctatagttctaagtagatgacattctccttggaataaatgtaccctaatgactgttatgttcccattccttgacccaggttaatgagctacttcataccactgcagaagctgttcaagccatgttggcacatattatgttcaaaggggtagatagaattccaaaattgcaaagcacacttttttctgttcttatttcaagcagttatccatagtttgaactatagtttttgtatatgtagatggcatggattatagttcctacaaaatttttgtaagaactcttaatctcaggatccatatttatagggaagagatcacagatggcaggagtaatataatggtaacaagacctataaaatgagattttcaacagcatttgatcacacataatgatttttctgccgtgaacatgttatacttatagttgtccagaatttctaccataaagagttataatgactgctgtgaaagagtttagagtctaaaagagaattagtccaattatttaagaacattttcaattggctctcgtcttttaggtggtaacattgcttatgaaaatgtattcacttttttcaaatggagcatctaaaattgtaacagaatgtccttgacaattgttccgtgccaccctctacctgttccatggcagggcagaatcataataaaccactacgtccttacctatcaagaccagctgtgatatcgcacattctaccatatatcatatgccaatcaactagaattgtaaacaaagaaacatatttctagactgtgatatgactctagcaaaccctctatgaaattctaaaagttcattgatgagcaaccgatagtccttgcagtgaaccatcaaacaaacaaaacaaagaatcagagtccacctggaaatggagaaaagtaaagtataccctatagggggatttagaagctagaaatgtggacttctttgattatgggagaaatatgtagcataaatgtcataagtttcagagaggaagtttaagagagtgtcaatgattgtttgtttgtaggtatttgtatatgtgtgtttattttatattgtcaagctatctgtgctacccaatgtgacttgtggactcaacttctattactacaccaacattctactggtgctcagacacacacacgcacacacacacacacacacacacacacacacaacctgtgaagttgtagtagtgcaggaaaatgtatacaaccagaatgagagcctagcatgaaagcttgatgatacattcatataagataatgagcagaaaaatagtgatcttgagatatcaaagaagaatataaatactgaacattacataaacttactgatgtgatttcccaataaaaaggggtgactaatttttttaaacttcagaattaacaatgtaggatgaaaaattgacaaagaatgattgagcagatgaatgctaactttagactagagagtttccagtttgactagatattaaaaacactcatgtggaacctaggtacttgaaaagagtctcctcagtggttgggggttccaataacatttgagattcggatccattgctaaccatatccaatgatcttagagaagtcctatatcaggaagagtaggaaaataaaagaaactgaatgcctgttataaatactgtagaagacaaaatgacaggaacgctggtagaaggaattttaattttttctttttaaaattctatacatgcatacaatgagttttggttaaattcactctctattccctgtgttctaattctatcccttccctcttcccattcttgactcccaattatattacttcttttgttttgttcttgctgaatccactcagcaatattattatgcgtatgtgtgtagggccatcttctcaaggatgggcaacctctgaagaaagaaccatatacctaacaaaaattaatatcctctaagggaacattctttgcatcttctgtaatagaaagtaggttccacacttgaatgtcaaacattaaagaagatcctattttagtgttcccatttcattggataaaaaacaatcaaggtcatctgttgaatgtgtaaatgtaagcaagtactgcaggaatagggaaaggattttcagactaagcaaattgcatacatatataaaccctaaatgagatctggtcaaaaatgaatgtatgataatgagaatgttcactctgctatgtggatttgtatatagtttagatttcagtgctatggtgtggaaatagccatagtggcttttatttttattttgaatttctattgatttcttttttattagatattttctttatttacatttcaaatgttatcccctttcctaatttcccttctgaaaataccctatcccctccccactcctcctgctccccaacccacccacttctgcttcctgggcctggcattcccctatactagggcatagaaccttcactggaccaagagccaccaaacccagacactattgcagatgccaacaagatgtgctgacaggagactgatatagctgacttctgagaggctctgccagtgcctgaaaaatacagaagtggatgctcacagtcatccattggacagagcacagggtccccaatgaaggagctagagaaagtaaccaagtagctgaaggggtctgcagccccataggagaaataacaatatgaactaaccagtacccccagagctctcagggactaaaccaccaaccaaagagtacacatggtgggagactcatggctccagctgcatatgtagtggagtggcttttttgatttcaatagaggtttgagttttataaatgttgagggttagttttacaaatatctaagatttaatttttatcaatagaacctatttttatagtcacacagattatgaacctatcagagctgaggcacacaacagggctcactgaccatcatatacattttttaatacttctagattcatctataagataatatgtccacactgtgataaaaggtttaagcagagtttttcattttaaaaacatgttttccaaagagaatatagtgccaaaacaagattggaaatcccataattattttttggagtgcctttctgtgaaactgatttaagagattataaactacatatttttgtgtgttaaattttattctaagtactggggaacccaacttctcttccttgttgttaccaatggccttttgagaattcagatttgataataacattatttttgtaagatctttcattgtttctcaaagcctggagtcatatttcttcagtgtggtaggtgttggggtattaaaactgccttcagaatctcattaaatccctgagactatttggaaaatcatgcatacagacacaatatttgcctaaaattctataggattcaggaagcccttgatgactttctttatctatggtcttccatactttagtattagaagatacatgtctgcagagctacaaagctaccaacaaggaagtctgtctctgaagctctcaccttccactgatattatgacatcctgatatactactgttatcctcaactggaaagttttccaccagtgccaaatctaaaataaagatgggttggtaaattgttttaaaaaaacaaactagtatctccttccataactaattattcatatttatattgatggatacagattttaacatattgtacaagtatatttaaaacttagtttcaaaaaagaacatgtaagtagaaaatgaatgccgtatgtttgtaatgctacagcctagataataatataatataatagtataaaccttcagacagcgttttgaaggacattatctctgtaacactctcattttcctttataagatttatgtaggagtacgactcatgaccttctagatgtcaatttagcagctaatgacataggttatttaattgggttgagtttgactgaaatacttccgtatataaagaatttaattcactttagaaaacaacaaaagcatatagcttgttggagatatattttagagttgcaaatataactttgaaaatcaaaacaaagaagaatcaagtcagtttcttaattctggcttgctctttactctcagcctaaagataactcttatattgcattctctagccatcagccaactttgctcaatgctgtgtcctaacttttaatgtttcttatttaatctagatgaaaacctacacaccagtatgggagataatgctggtgtttgcttcttaaataattttgttcaggggaattgtgtatttcctttaaggatacacataatttgagaagataaaaacaggttccctggctaagtgtcacataaatgactgtcccctgggcagcaaaactactctcttttggggcatgtaatttggtttctgctgaattgctttagctacagggaaggaacaaaatgcatgtttgtctcagactgtgaagattgagaggaaaatatttgtttccaccttcgcaccccctttggggcctgttcatgatgtattttggacaaagacccagagaccagggtaagacgaataatttgaatgaaaaacagaataggtagtatggttgaaacagagacactgcagaagataaaaagtaaaagttagtgggatatcgagggaagccattaccaaacctaaaaagccaaacagcaaggcaaggatttggttctatagataacagggacctccatagtgccatgagttttagttcatgatgtgtattgaaattacacccctgtttcatgctgcttcttttttatttataaaggtttgaggaggcttcggagttggcattttgaaatctagcctgatattcattcaaacagtcaaaaatggttttagatatctgtggtaggataagtatgaagtattgtagcatgtcctgtcaggaaatcaccctgtgagaaaactgttcttagccttttttctttttcttttcttttcttttcttttctttcttttttttttttttttttttttttttttttttttttttttgtcacctgtgaggcagaactggcacgaatacaaataatttctatttatttttagtacttttcattctcattataattctgcatgggaaagaggtgacagaagataaatcttgggtcccctgaaacattggaaatattctcatttgaagcctttataaccaaatctgaggcttctgcatgccgtcagtacaagcccaagcatatgcagtgctattttggcaccattccttcctgtaccacatgaaatatttaattttattactcttgagtctgtttgagcagatgattctttgtgtcttttatgtaatggaataaaaggcagttagaaatgagctcaaagacaaaaaaaattaataaggatacactcgagccttaagactcgttttccaagctgcagctgagacatttacaaagattcactactagagtccaattatgtcttctcatgagtggctcaagttcaatgtctcatgaacacttaaaaaattatcacattgacatctaaccaagctaaatgctaatggtgtctcagataatcaataaatatgatctaaaatcaccttcactaattggaaaaatacaatctgtgactttgattaagagaatggccacaagaagttcataactgtgttgtacattttatatgtatggatacatgtatttctatcaaatattcactaattgtgtatggatgtatgaagcaacaagggtaatcaatttataatacaattacactctaatttattctattgattgcattttcttaagcaagacatacttgtatatcataataaaagacaaaacaaaacagaccctttatagaacagcatgttaaattcagacaggaatactaatgcctcctattagtgttgtagatttccatctaaagttctctaagctctggctctgcttgccaaacactagtggctggcaaagtctgtttctctatggtttccttcacaccaccttttggaaagaaggcaataaatctgcttcctggagcattgtgaatgtaacagacagccaagatacccagtctgtgtattctttccaagcctcacgtgggatttgcagagccagcacatgactccaatggatggtagcacatatttgatcaattttctttaaaaaatacaagtacacgggtggtgctacgttcctcctatcatgcttttacaacttatattagagactggaacactatttgacacataatacacattcagtatatatttattggaaaaaatggatttattaaaatttaaaactatttacagaatttcaaaagaaaagactgaggtatcatcacttttgctttcactcttcataaaaggatggcagcacattgattattttctctacatggcctaaaaagaatatttgattatcttattacatggtctgttctcatataaatgtagtaattgtattcccaaaatgtatattcataaattcacaataagatttagtttaaatctcactgacaaagccattctatgtgtcctatttctcacatgcctttagcatatgaagatgtatctggacatgaaattaatttcaggctaaatttgtgtgtatgaaagttgttttagtctttacttctgttttacaagactgaaactctaaatagtattaaataatcaagtcagtacacatagcctgaaagctcacaagtagctttctattctgttttagtcttattcattctagctgctgaggtaaatggaaggaaaatatcacaactaaatgactctctctgatatttggggtcctgtggattacagatatattatatactaacatgattatcttttatgtacaagtaaatctcttgttccatgtgtttaggagttgtgcagttgctatttgattttaaatataaattttgaagctaccttgttttgttttgttgtttgtttgtttttttctttttgttttggggtgtttgtttgtttgtttatttgtttcttttttgtttttttcgagacaggtcttctctgtatagtcctggctgtcctggaactcactttgtagaccagactgtcctcaaactcagaaatctgcctgcctctgcctcccgagtgctgggattaaaggcgtgtaccaccacgcccggcgaagctaccttgttataagtgtactttgataagagcattagaaggcaatcacaaagactctggattcaatttgatccagaaattaatggcatttagacatggtaacaagaccattagaaaagtacttcaacaaactaaacaattttatcataatcttaagcaaaaatcaattgagcctttgctaaaataaatattaaaaacacaaaagctataaaaagaatcatggataaatattttttaaatatcatttatttaatatatatatgagtacactgtagctgtcctcagacacaacagaagagggcatcagatctcattatggatggttgtgagccaccatgtggttgctgggaattgaactcaggacctctggaagagcacagtaagagcttttaacctctgagccatctctccaggctggataattttatcatgcatgttcagaaccaatgttcaaagcacttaaaagttaatgatggtaaggtcaaggatctttgtaaaacttactatgtctgctcccttaaaaagatatggagaatttgattctagttcaatggcctcaccaatcttttgtcataacacatattctgttttcactccctaccatatcagaacaattttatttccttatacaatttttgcccaagttcaatttgacaattactgctttgaggagcttcaggtgaggacattgtttgatttttgaggcagccaaaagatttcttggtattgacagatgactcattgcataggcatacttaccaggcaagcctggtgaacaattttacaaaattgtcctctaaattccatatacatctcatggtccatgcatacctgcactcatatacacacattttgcatatccacataacttacacagagggaaaaaattgtcttccattttctagaatgttttccaggcttccaggggtaacaagcatttcagtttcttttctcttgccatgccctaaaatgacatggaatataacaagcaaacattatggagtaactagacactttaatataggtcgataatacccaagttggagattttttaaaatatttggtaatttggatcagaaagttaaaactttggctttcctgtatttcatggtgaattattcagtgttgtataatataaggaatattgaactagcaggaatttgcgtggaaattgctcttttccttgttagcttagcacagtgtcagcacagaatcaacacttagtaagatttcttgaataaattgaatttaattggaattgaaattgaattgaattgaattgaattgagtaatgtcttatatagtccttcagttacaatcttcttccttggttcctcttactctccaaccttcttcaggtgtggttcgttgagaccacagtatctctaacaatcattccttaggaactaatttttctttggaactgaaattcctttggaacttaaatttctgctacagcactgaaacctacctttgtgttaaaattaatatacctcaattaaaatagtatgcatacttccacatccccatagggtgtatgccatgcaaccacatacttattaaccttatagccataatcatccatggctctttaatatttctagaatggatagcatttccaaactgcttccagtttattataaaacaatgtgcatttcatcactggctaaagcactgcttgtagactaactcgaggatgagttaagagaagtggataaagaggtaaatgtaatcagaatatatatatgtgtgtgtgtgtgtgtgtgtgtgtgtatacatatatatatatatacatatatatagttcatatttagatgggtcagttgatattttcagggataaagaactgatcaaagtaatataaacaccagtttttccccattggttcacaacagcacactctttttatgtagctttaatacatgcagaatattttagcatatgatcctgatggcattcctaactatacttccactggattatttcacaagtctattcagagtaagaatgagagtttctaatcttccagggcatatcttctcttccttcgaaggttatgataactagaattggtgggtcatgaaatgcccaaatcaatattgtcattgacttaatccacataagaggattaacttcataggtgacttctgagtatctgagacaaaaggaaacaaaaatgaatcagtctctagcaatgtcccaaggtttgtttgtttgtttgtttaatagctgtaacaggaacagaattctagactcacacagaaagccaagtaggacattgtaaacaactatcttttaataaatacctcctcatcattcccggttgggtgaatacaaatcaatcacgtggaacacattaaggatgtcctaatagaacattttatatagccctgactcaggcacactattgctcctcatttgacaggtcacgaagttgaaccttggagaaggttaactttcacaatatgacaaacctaatttgtggcacaattaagactttaacatgtgctctgaaaactaaatgtcatgattttctttctctagaggttcagagacaatttcgttgagtgatatgcttacatatggcagggtgcaccaaaaatacctaccatttgcatataattttttgtttattatttagagttagtgtctcatgtctttccgtttttaaaatttcttatttctaatccattcagattgccagttcaacttttttgcttttacttacttacttacttatttgtctatttattttaaactccagattttattaccctctcagtccactctcccactgtttcacatcccataccttctccccgaccccctgtctccatgaggatggccccaccccacacccaacctgacctctaaacttcctggggcctccaatctcttgagggttaggtgtatcttctctgactaaacccatacccagcagtcctctgctgtatatgcgttggggacctcatatcagatggtctatgctgcctgtttggtggtccagtgtttgagagatctcagggtccagattaattgagactgctggtcctcctacagtatcgcccttctcctcagcttctttccgccttccctaattcaacaacagggatctgcagcttctgtccattggttgggtgcaaatatctgcatctgactctttcagttgcttgttggttctttcagagggcagtcatgataggtccctttttgtggatgctctatagtctcagtaatagtaccaggccttagaatctccccttgagctggatcccactttgggcctgttgctggaccttcttttctccatttctatccctgaaattcttttagacagggacaattatgggtcagagatgtaactgtgggatggcaaccccatccttcacttgatgccctgtcttcctgctggaggtggactctgtaagctccctccctttgagtcctgggaatctctcacctcccagggctctggtatattctggagggtccttctaacctcctatctcctgaggttgacagtttacattctttcttctggccctcagggatttcagtccatttcccccattcaatagcagatcatgttaccctctttgatccccatccctttccctgccagtcccctcttcccctttgtggttgttttgttctcccttccaagtggaactgggtcatcctcacttgggaacttaagcttgttgacctttgtgagttctgtgggctgtatcttgggtgttcgacacttttttttttggagtggggggtaatatccacttattagtgagtacataccatgcatgtccttttggatctgagttacctcactcaggatgatattttctcgttatatacatttgcctgcagagctcaggatgtcctcgttcttaataattgaggagtattccattgtgtaaatgaataacattttctgtatccattcttctgttttgggacatctggattgcttccagcttgggtatcacaaacaaggacactatgaacatagtaaaacacatgcccctctggcatggtgggcatcttttgggtatatttccaacagtggcatagctgggtcttcaggtagatctatttccaatattctgaggaacctccagattcatttccagagtggttgtttttgagaatttcatataagcatactgtacatcatttccatttttcttttaccatgtttcatctgtgcctccatatccctctaaattttatagcctcttctgtagttagtgttacacacacacatacacacacacacacacacacacacacacacacacacacacacacaaacatataccacctactcagttcatttagtgttacttctgtgtttctgtgtacatgtgcttagggcgaactacccatcaggatagcccatagtgattctttcaacctctatgaaattgtttttacatcttcatctatgagtctgctccatgttgaaatgtccctagtatagtcattgtacaggtctggcttaagcaaccatattgttgaaatttcatgaatgcaacatctcagttatgtctagaaaatactatctcatcattcgccctgttcttctgtaacactacttgggccttgggtgtaaacgttgatccgtatgtgtatcagctgagactgggtacactgtgatcatttgatatttgtattttgaccagttgtgactttctgtaatggtctatatctgctcaaaaagaaaaaaatatgttgttttgattacagtgacaactacttttttctgggcataaaaataggtatttaaactacagatacaaacgaaaatcgtactaataagttttcctcaaggctccatgacctccccagccacaggtcgttggcttagtttacaataatagccatcaattcccttatattgagtggaactttaagtgcaattagacagctgttagtaactcccagatctcaatgccactatattacccttcaggttattttgccatgctgatgtttgttgttgcacacagacttcatatctccataggaatatttattgcttttctcccttggcagcttgcatagcccttcagattctatgagagagttagtcctagagtgccagctcaattcccatcctgtattcaatatctgtgttgtcttcagggtctttcacattttgggattcaagcaagttcaagagcatgtgtttatattattttgcatcaaatcaatatactatgtatgtagaatgtattcttggcatatactggttaatgtacaaatggacctataaatgatattttagttgagttataaaataataaatttgcatttgctttctcatatacccctttttatggttaaccctcactcctatatccaaatcttctctgccccctcttccttgtcctacatagaactttctttttttcttttttttttttgcttttcttttctttttttattaaatattttattttttttattttttttattttattttaattttattttaatttttttattaggtattttcttcgtttacattttcaatgctatcccaaaggtcccccatacccacccccccaatcccctacccacccactccccctttttggccctggcgttcccctgtactagggcatctaaagttggcaagtccaatgggcctctctttgcagtgatggccgactaggccatcttttgatgcatatgcagctagagacaagagctccggggtactggttagttcatattgttgttccacctatagggttgcacttccctttagctccttgggtaatatctctagctcctgcattgggggccgtgtgacccatccaatagctgactgtgatcatccacttctgtatttgctaggccccggcatagtctcacaagagatagctctatctgggtcctttcagcaaaattttgctagtgtgtgcaatggtgtcagcgtttggaagctgattatgggatggatccctgcatatggcaatcactagatggtccatctttttgtcacagctccaaattttgtctctgtaactccttccatgggtgttttgttcccatttctaggaaggggtaaagtgtccacactttggtcttccttcttcttgaatttcatgcgtttagcaagttgtatcttatatcttgagtatcctaagtttctgggctaatatccacttatcagtgagtacatattgtgggagttcctttgtgattgggttacctcactcaggatgatggcctccaagtccatccatttgcctaggaatttcataaattcatttttttaataactgagtagtattccattgtgtaaatgtaccacaatttctgtatccattcctctgttgaggggcatctgggttctttccagcttctggctattataaataaggctgctatgaacatagtggaacatgtgtccttcttaccggttgggacatcttctggatatatgcccaggagaggtattgctggatcctccggtagtactatgtccaattttctgaggaaccgccagactgatttccagagtggttgtacaagcttgcaatcccaccaacaatggaagattgttcccctttctccacatcctggccagcatctgctgtcacctgagtttttgatcttagccattctgactggagtgaagtggaatctcagggttgttttgatttgcatttccttgatgattaaggatgttgaacattttttcaggtgcttctcagccattcggtattcctcaggtgagaattctttgttcagctctgagccccattttttaatggggttatttgattttctggagtccaccttcttgagttctttatatatattggatattagtcccctatccgatttgggataggtaaagatcctttcccaatctgttggtggcctttttgtcttattgatggtgtcttttgctttgcagaagctttgcaattttatgaggtcccatttatcgattctcgatcttacagcacaagccattgctgttctattcaggaatttttcccctgtacccatgtcttcgaggcttttccctactttctcctctatacgtttcagtgtctctggttttatgtggagttccttaatccacttagatttgaccttagtacaaggagatagaaatggatcaatttgcattcttctacatgataaccgccagttgtgccagcaccatttgttgaaaatgctgtctttaaaaattattttgtttgccttccaaatgtcgacccacttcctggctccccatcccatagttcttcctcccattccccttccccatttgcttctgagagaacactcccccacccttccccaccagcatctccccttccctgaatcatcaagtctctacagaattagttccattctctctcactgagtccagacaagacagtactctgttatatatgtgccaggaacacagaccagccatgtatgctttctggttggtggcttagtctctgggagctctgagggttctgggttagttgatgatgtttttcttcctatagggttgccatccccttcagctccttcaattcttcccctaactcttccatagggttccccaacctcagtccaatggatggctgtaagtatctgcatctgtctcagtcagctgctgggagagtctctcagaggacagtcaagctaggggccatttttgcccctgcatttcctttagacaggaacaattctgagtcaaaaaaattgaagatgagtgggtgacccatgactcaactggatgcctgtctatctactggaggtggtctgttcaagttctttctccctactgttggacatttcagctaaagttatcccacattgggtcctagatggctctcacatcccaggtctctaggtctttctaaactttcccacttctcccgcaccttacacagctgtatatttccgttcattctcctggccctctgggcttttctgctgtctccccaccatacctaatcctgccctctttcttctctccctctcctctcccactcaagtccctccatttttctgcctcctgtgattattttgttcccccttctaagtgggattgaagtacccacccttgggccttccttcttgtaaagcttcatacaatctgtgaattgtatcaggggtgttctgaacttttgggctaatatcgacttttgaaggagtaccattatctatcctctctactttcatcttaactacattctgtgatccacttcctctagggtatcctaaatgactgctttctaatttcctgtcttccacaggtacacccaattaaacacacacccaacaattaaaatttagtattcacatatcaaagaaaatatgtggcatttgtcattctgggtctaggttacctcatacagtgtgatcttttccaggtattcccatttacatgaaaaattcattatttcatttttctttgcagctaagtaacattttgttgtctatatgcatattttctgtatctatatttaattttatattattttgcaaatattatgaatataatacacaggaatgtgcagcattttctgttccttacttggtcagagtttcatatttattttgtgacttcatataggagcaattatccatttccacttccctttgttagttttctcacatcttaccagtgtaggagcacctgaggactcagtcttctcttaccatacatactcttattccctcagaggacttgtttcataccagtatcaactatgtgcaataagaatatatccactgaggctccaaggcctaacattattattgatgctatagtgtgctcacaaaaagggacctagcatgaccatactctggaagacccaacaggcagctgaaagagtcaagatgcagatatttgcacccaatcaatggacagacctctgtggttgaattagggaaaaactggaagaagctgaggaggagtgtgaccctatatgaggacaagcagtctcaattaacctggactcctgagagctctcaaacactggaccaccaaccaggcagcatacaccaggtgatatgaggccccaacacatatacatcagaagactgctgggtctgggttcaattaggaatgatgtcccttgagagacttgagccccagagagtggtgagtcctggtggtgtggggacattcttttggagatgggagggatgaagtatgggatgtggaacagtcagagggtggaccaggagggggataaagtctggaatgtaaaaaaaaaaaaaaaaagattacagaattaaaaaaaaaccagaatatatcccccaaattaacctccctcttcatattcatatttatgtccatatttctctttttcatattcccttagttgcatagtaacatattacacaactgttctgtgtctcatactcttcaatgctactttgtcattttagctgttattgtagctaccagttgtgccgaagcatacattagcaattcctcttcacatctgaagcaaatgaactcttatgtgttgcctattctgttatgtgtttgaggaatgtctatagcagccaactcagccaatttttggtgtgtgaaaacatgtgtgtaagaaagttgatatatctttgaatagcatttgacctataagagaatgaaatactttcatcaatatttcttctatgtttgatcatgttttcttctgggtattttataatagcagcatcaacaacatctatctcctgtttcccatatctgtggccacctcaaaaacacacagtggagtaactgactttacttctctatttggttttccttgttcttcattcttgttttgttcattattgtccaaaataaattctgtgtatacaatgctatctctctggtattgatttcgggatacccaggcttaaatctattcaagactcttgactcagaacctcagaacctcctcctccaacctcattgacctcaaattcttgtaactctttctcccagtccttataccttgacaggacccctaatcatacctatcagcatgtcttttcatatcctctttgaaagcagactcagaatgtgactaattctcatcacctcctctgccattgcccttgtctaaagcaccatcatttctcatattgatttttcagggaacttctaactaatcttcctgcttctgttctacattataaccctaacattttactcaaagcacaatagccaggctagtaatttaaaaatgattcatagataatgtcacttccctgatgataacctgtagccacagaataaaagatactatacaagggtagtttccctttccattggtgactctgcttcatttattctgctatacctttcgaataatgtttctccaaaatgcaagtgtatttctgccttcaaagttactgattcttatacctaaactatgtttcctcttcacatttaccctttacctgatgaagatcgttatgcatatatttccctcttagtgagacataactgaccatgctacttcaatttatcatctgtgcacactactctcctttttctttctttctgtacagtatatattgcttagctaaccatctatattatttattctttaaagtaggagtttttgtgcattctctgtgtgtgtttgtgtgcattagtgttagtatgttatgttgtagacacaacacaggaactcagaagacaggaaatataacagtgacctatatcaaagcactacactgaaagtgttttggaagtaaacagctgcactaagaataacactaggatcatagatatgaaccaaggccatatgggaaagttgaggcattatcagtcctacttttcaccatttgacatagtattttacttttcttcatttatgcattatatattggctaatgcttaatgtgtgtatgtgtgtggtatatgtactaacttactatactgcacagggaactctttcaacagtatactatacatttttttaatatgttcatttggttgctgttttttccaataatattaagtgctgtattttccaataatattaataatattaataatattaatatatatacatatacacatatatacatacatatgtatatatgtgtgtgtatcataaattactagaatgcaaaaatattatctagcacatcatcatctattattaacaggaagtattaacattatttgtcatccaataaaagggatatttttcttgactcggattaattattgagatgtttgggtgacattgttctattttacttgctctttcataatgtcttttttgaatatatctgtgaaggtgcttgagatcatcaagtcatttttcctttgcttttctagtgctgtttattattattattattgttcttgttgttgttgtttttgctattttgccttgtaggtaggtgtttacaaatctttgacattgttgaggtcactttcttatccatcggtttctataacaaattagataagaacatagtatggttttgaattttaaattgcactgggttaatttatttgaagtcaagttgtgagtattttgtaaaaatccttagaattcttgttatgataataagaaacacatctcttatatgctttatccagctggaaactgtggataaaaatatctaagaagagggactttgagttctttcagtagaattctagaaatgcaaattcatataattgtaatgatcaatcatttactggtatgttaatttcttaatgctttcaatttatcagcagcaggtttttcctaattctaaagaagcaatgcttaattctctttttactgattaattgtggagaattatacttctggcagttgacaaagggacttacatggtttgcttcaataccattcaagacataggtaaataataaaagtaaacaattcatgagaaggggaaacataattaacagcattctatgaacgtttgtctcctcttgcaaaatcctagtaagctatggcacaggcttccagttttcttttgatgagagcacttgttagctaatcaatttataatcccaagtgatccttaaacattaaaaaaaatgacatcagccaattagctaattcaattggacaagcatttatggaacatttactattcaagcaattgtcttttggtcacagacacagaatgaatatagcaatacccttgtataaagcttacattagaacgcatagctgatagattcaattctttttttttcttttgcttttgatttactgagcctttatatttcaagacacaggattttctttatagcacatctgtggtcttataatcacaggctgtattataatacaattgtgctttattgagacagaatggatgaatagaaagttcactttgcaagtcctttcatttaatgttgaatttcatgctgaggagccttgtcttctaacagtttgtatagatagtgtctcttattcccatttgctcccttttggcttgcctctaccatatggtcttctagaaagatcacatcactgggtcaagactcatgctttcaattttgcttcgttcactcactggatgaccttaggtcttcttttaactgcctttactagtatattaatagtcacctggggtctggtggcacagttaatcaaagtcctaaaaataatttgaaatgtatagctttctttctgcccctggagagaatctttgaaccagggaacaaggtaggaaggaaagggacatttgctcagataatcaacaaggtctctgtgtgatgattcccccttcagcactgtctcctgtatattcctacttagtctccaaaaaatgaaataaacattttaatattctcctgtataattctttatttgaagattggagattataaaatgacaaagctgacatctatttgaaataaacgtaataaaattggcagtttttcttcatgatgcttgtttgctatttaataaaaagagctgaaatatttatatattttgcatctctctatatatactatatatacatatatatcttttatagtatataatataatagaaaagacaacataaatttgtgaagtgaggaaacatggagggtgttaggggatgaaaataaaggggaaagtaatttacattttaattaaaatatattcaaagaaaaaaacaaagaacaaaatgacatctaaattaattatattctaaccatataatatcagacatgaatggtagtaacatagaaagtgtagctaggcatctagtaaaacttatgttctcctccatataacatttttgtctctctgcagtgtttgtttccacctctctgataatgaatgttacaaatggtattctgtagctccctgttgctgttaatagactgttcttttacttaattatggttttatccaaataactgtgaaaatattcaaaggtattttaattaaaagtatttgtttattattgtgtgcttgcatgatgtgtaggcgtacataccacagcatgcctgtagaagccagaacaaacatttgcctagttggttctcattttccatcttcacatgggtcccaggaattgaacgcatgttgccagcctttaatatcaaatatctttacctacagagccactttggcctccctcaaaggtagtttttagttcttcatattgagcctcatggaaaactatgttcaaggtggacttctggatacgctaagcatattcctttatagcaaggaaggtttcaagatttttgaggtttttttaggcaataaagatcacaaacagtaggaataaaaatgatttgcaacatgaccatttctaatgataatacactaatctagcaaaaatatcaggagaagattagcttttgcattaaatggtcaataaataagaggagacatcataaggtaaatattagaattggcaggacttagcagctgacagtgtgtgagaactagaagagagaggatcaacattttaatctttgtttaatcaataacataagaaaaatgaagtcatcaagataggggaataataaagtatttgtgaaaaatctattctctttagaacatgagttttaaggaattatatattgtcaatgtctaagtatatagtttgaattaaaatatatttgaattggacttgtcatctcataaatgactgacataaagtaaagcacatggaaattactgagatatgaatagagacaatgcagtattatagaagtaaagagaaaaacacaatatcataaaagaagaataaggggatctcatacaaataaatttcaatacccttaccagatctggaatttttgttaaatttttgagctaaaatataattacatcccctcttcctattatccctcctatgtcccttccatttaaaacaccccctcttgcccccattgtttgcctttcaaattgataacctccttttattgtattgttatcgtttcctatatttaaatgcttaaatatgaacatataacctgctgagtccatttattgtggtgcgtgcgcatgatttcagggctgaccactttgctgtggacaataagttacagtgctcatccctgagagaaactaagtttccctctttcagcagtaactatttgtatgtatgactttatcaaaggatgtgacccccccatgaaattttcccttttcacattaacatgtctgttggtgttgtctttcttcgggtatggtttagagagacctattattcaggtatcatgtgtatagtttccctgtcttttctagagacagaccacacaatgattttcctagttccctggtcctctagttgtcatgattttttcatcctctcttccaccatgttccccaaaattgatgtacatgaagtgtgttgtagatatatctacgggggctattatcccccacaattcttaaactctgcattatgggcagttgtagttttctgcaatgttctccagttgatgtaaagtgaactttccttagaaacaatgcaatttagacacagatcccaaaagctgtaactgacctgaattcctactctctaagaattacttttcatggtaatataaagtagcatgcaaggttccaaaggggagaagaaaccaacagtttttcacagctatgatgccttgtcctacaacaacgtacagtatgacaatagtaatacttatttcttagatttgaccaagagttcttatctccttgtactaaggtcaaatctaagtggatcaaggaactccacataaaaccagagacactgaaacttatagaagagaaagtggagaaaagcctcaaagatatgggcaaagggggaaaattcctgaacagaacagcaatagcttgtgctgtaagatcaagaattgacaaatggaacctcataaaattgcaaagcttctgtaaggcaaaagacactgtcaatcagacaaaaaggccaccaacagattgggaaaggaactttaccaatcctaaatcagataggggactaatatccaatatataaagaccttagggagatggactccagaaaatcaaataaccctattaaaacatgtggtacagagctaaaaaaagaattctcacctgaggaatactgactgaatggctgagaagtacctgaaaaaaatgttcaacaacttaatcatcaaagaaatgaaaatcaaaacaaccctgagattccacctcataccagtcagaatggctaagattaaaaattcaggtgacagcagatggtggcaaggatatggagaaagaaggacactcctccattgttggtgggatagcaatctggtacaaccaatctggaaatcagtctggtggttcctcagaaaattagacatagtactactggaagatccagcaatttctcttctgggcatatacgtagaagatgttcaaacttgtaataaggacacatgagccactatgttcatagtagccttatttataatagtcagaagctggaaagaatccagatgtctcttaacagaggaatgaatacagaaaatgtggtacatttacacaatggagtactagacagctattaaaaacaatgaattcatgaaattcttagacaaatggatggaactggaggttatcatcctgtgtgagataacccaatcacaaaagaacacacatgatatgcactcactgataagtgatactagcccagaaacaaaatattcaagattcaatttgtaaaacgcatgaaactcaagaaggaaatccaaagtgtggatacttagctccttcttagaatggaacaaaatacccatggaatgagttacagagacaaagtttggagctgagatggaaggaaagaccattcagagactgcccaacctggtgatccatcccataaacaactaccaaacccaaacactattgcatattccagaaagattttgctgacaggaccctgacataactctcttgtgaggctatgccaatccctggcaaatagagaagtggatgctcacagtcatctattggatagaacacagggcccctaatgaaggaggtaaagaaagtacccaaggagctaaaggggtctgcaaccctctaggaggaacaacaatatgaactaaccagtacccctagagctgtgtctctagttgcatatgtagcagaggatggcctagttgaccatcaatgggaggagaggcccttggtcttgcaaggatcatatgccccagtacagggaaatgccaggaagtgggagtgggtgggttggggagcatggtggggagagggtatagggggctttggggatagaatttgacatgtaaatgaagaaaatatctaataaaatgcctttaaaaaagagtgacaatatgactggtactggaaagatagccaactactcaggactactaaatgcatagatcttgaaggaaaacctacaagcaccaatttagtaaatcagcatagtccctaactatattcaatagatctgttcttataggcatagataagtatagtcctcatcacccagcaatggaatatctttttgcagcagacagattattacagaataaaacaatagatcaaaattcggagttgtagagcctagtcccaagtgacacattttgtaaactgaaggctgagagatcattgtaggagagagcagaatgagtgtaaaaatcacagaaacaaagaggctgctataactgtatgtatactaataatattagaagctacttctataaaatatcaataacatggctgcttaaacattatttgaacaaggttaaccaaataaacatagcaactaccagcaactgaggattgccaaaattggggggggggaagaatcttcctcaaggaagaaccacactaaatggttttccaatacaggattatcatccctgaaaatatatacacaaataatatacagagcaagcatgcatcaggtagtatttgtgtgtgtgtgtgtgtgtgtgtgtgtgtgtgtgtgtgtgtgtgtgtgtggttgtgtgtgtcttaataacaagtaataagaagccatggatttgaaagaaagtgatggagtacatgggaaagtttagagagaagagaggaaagggaagaggaaaatatgtaattataggtttttaaaagtactatgtaaacagagaagcactttgatgaggagcaagagctacactcatctatgaggataatgatgctttagaatttcctcagtaattatgctggtctgataaagtgatggtaacaagtttggtttttgttgttgatgtcttttaaaatagaatccatgacctatctagccatgggtaattttctaggtttctagtaccagacatgacttttcttcttttagtggcccttaagtctcattaaacagttgatacttaccaagaacatgggactgatacttattgaacatttagagatatctttctatgctgtttattattgtaattcataggcatcgcagctggataaggctattgattactatcctcctttgatattttacatagtacttacaggtactatggaaactatattgcagagccaaggttttctgataaaaatcagattgaatcatttgaatcttgtgtcttaagtgtgtagtgtcttcagcactaggcacttatcttcaagttatgagaggtaaccaagggcaacagcgatagccagtattgttttggcagttattagactatactgacaatctgtatggtgattagttggcacatggaaagtgctactattaggaggtatgcccttgttggagaaagtctatcacaatataggtggactttgagaactcctaatgttctagttccattcagtgcagaaagtcagtctcctggctgcctttcaatcaaaatgtagaaatctcagctcttcctgcaccatgactggcctgatactgccatgcttcctgccattatgataatggacttgacctctgaaactgtaagccacaccaattaaatgtcctttataagaattgccttggtcatggtgtctcttctcagcaattgaaaccctaactaaaacaacttgcatacaagttgcacatatcaagtactgggagttcggttagggagtttacatggagcataataatcagaaggcaaaagttaattatattcataattttaggtaaatacaatttgtcccttctccccctttttctttttgtactgataatagtcaatacagatttggcatttacaaatttgttgccccctttaaaatggattggtgtaacagtgaacgtatacatcagagtttgatagattgaggaatgaatgggaaggaaagaagtaagcatagatttttgagatgtttaagtgaaaagaaattaaatggtttaggatagatgtaataaataaatagtttcaacagaatatttttataatcacatgagtttctatacaaaaagtataacttcagcatgtatgctttcctacttttttaacttgtcaaattgataacaagtaaatatttgagggatgaataaatgaatacatataaaatttcagaaaagaagtaatatatacaaaccaaaggatgggggaaatagtggtatctaattttacaaactctcaaaaagcccaaagtgatgaaatatggatgtgagtctctcaaactcatggaaagtatagtaggagttactatattcatagcatctattttattatgtcaagtagaatacagtgatatctgacatgcttcagaaccacaaggtcatgagtagattaacaaacattggaggattgaaaatgtgatagactaaactaggtacaaagaaagtaagagaaaataggattaaaaaagattaacatacaagttaggatcttggttacagtgttggaaaaaaaatcttcaaactagcttaagaaaagtagagaggtttggggtaagagaactttagaaaaactgaatatcaatatcagtaatgatcacgtaagtcaaaggctatcaacatagttcttaagtcattttagaattaaagtttccttttagtttagatacaacacagtaaaaagtatgactggggaaaagctctcaagatttttctcttgcagttgtgcattctctaatagaggattctgttctatttgttccaaatattaaaaatcgtgagcagggacattgactctccttgttatgctcacttgtcactcctggttcaatcagtcatgaccaatagtgcacacatgtgaagtaaacattaataaataaagctcatgtcaggcttcctatttgaattgatctgtgatgacagtttctttcatcatgcaataagtattcatttggtctttacagattcccaaatcctaatgtaggtaatgagaaaagaatggcatgaaaatagttatcgttcctacttttgagtgtttgccctcttataaaacaagattaataattaataaactctttcacatattatcagaataaattatacttactataaagaaaaggtagtgaaggtgaacttcaggatggatagtcatgtatgtctatatggagtgatcacaagaaagatgcagctatttgaagatttgagtaaaggtcattgatgcagagaaaaaagcaattgcaagatcatagggtaggaaatgatcttggcataattaataattaataattaacagagagatggttgttgggaaaagaatttatggagtgaatgggtgaatgctgtgacatagaatgaggaaactgagcagaagctagatctcatatgctcctgtatctactaagtacttaatattggatgaaggaaagcagactggtataggttttcattccagtccctataaagaaaaagcaaaccaagctaagtcttataagaagattcacaggttgagtagaattcacagggaatgcagagataatgttcattgactacttacaagaagttgatccaggattcaagatcatgatagtaaacagctaaacttaggagagagtctgatagactaagagaaaagaaagttcattgatcttgtggtatttgtcaaggatggaaagtacactataagtccaggagagagtcagtagtaaaagaatgacactggcagaaagattttttaattacagattttggactgccctattgttcagatgaatacttgtttttatgtttattacatcctaccagactatgaatatcttgttagtgtacctagtttccaggaacgtgcttatttgggttcaaaatactctctcctccccattcccttttaaaattgtgatcttttccattattaaacattggctattttcccagagatggcactgaagaagaaaatcaatgacatatctagccagccggcttggactgaatgggcattcaaatatactccaagggccaagtacagatggtgatttattgtgcatacaacttctacagaatgccttcatttgagcattgatgtatatacaattactcaccagaatgctgcagttttacaattcagccaggaatctgtggagagagatcatgttctccaagaaatccacaaatatattttctacattttcagcatttctaaaaacactcagtcatcttctgtatgaagaagcaatttcaaaaaccacttctttcatttttaccatatttgtcattattgtcatgttttcacaattaccatttgatgacaaattcagatttgttaaacattatttctctcccaacatgtgagtagaaggagttgcttgaggcaaatcatttactgtggctattgtgaaggctaaatgtgcagtggtgatctatttataccagagacttgctcagtggaaaaatcattttatgcattgttcatatcataaggaaacaacccattgaatgttaagcaatttatagaaaccaactacttaacattgcatgggcaaaaaaaaaatagtgaagatacatctaaattcttttcttattgaaaagtctttgagtgaccattttgtccttatattctgaatggcaattgaaatgatgtggaaacttccacctttagcagaataactttaaaaagtaatactctttatctcttgccacatattacttaattgctatgctactagtggaatgaaagtatggccaggaatttatatgcttatattttagttctattttctactattgataatgtgctgttctggtttataactggaattaaatgatatttttctttgcactgccatatttagaattacaacaaaaatgtattgtctaatattttggctacaattcaataataatatttacagaatcatttcagacttctctataaggaacacagtacacagtcaagattaatagtagctataaataaaaagaagctgtaatggtattgataaaaatcagctcagcaaatgaaaatgaggaagttcaataacaaataatatactgcaatgacatagtccatcgagttgctagatgaggcagcatgaaaaataatccttcatgttatttctattctataatcagcatcctggagagtgagctactggtggaaggaatgggcaaacattgtgtatggtgctaagcttagtaccaccctcacattaaattgaatatatgcatttgatgttgcaaaagaaattcttctcactattaacacattccccagctttcattagcatttgctcatctgaactttattcctatgtctaggaatttttctgtactagtctctgttttgttattataacacacaaagtcaactgatttatgaagaaagcaagcttactttggcttaagtttctggaggtgtgtatacaacatctgcagtcctaatttggagatgactttcttgttgacatagtacctaagcagtgcatatcctccagtcaatagctgggaacatacatatgtttctcttttctttttatctctttatcttccatcttttataaaactacaattcaattgcatggatcccaggcctttgtcttgttctaaccatattccaaaggatccacttctaaacactatggttaaaaaaatttcagaatataaatgccattaagttatcatttgagatattcaatttctgaatgaattggagcaaggatggacaaattatagccatttactcttagatcttagtatatgattttcatatctgataaaaatcaaagtcagggttgataaaggaagacataattttaaaggagttacttcaattaattaagcacgaaaataggtgctattcaagtaataaagtatactttatggacatttcccttcatgtagatacatgagtcaggaataaatgtgtgtgtgtgcgtgtgtgtgtgtgtgtgtgtgtgtgtgtgtgtgtacgtgtatgcatgtatgcatgtatgtgtgtatatatatgtgtgtgtgtgtgtgtttatgtgtggtatggtgtgtgtgcatgtgtatgtgtggggtcacttgtgtatttgtgtgattttgtgtgtaagtgttcagatattttaatataaataaaattaggagaaattggtggatagtttcattttattttatgattttatgagaccattctagctttgtagcccaaattgtccttaaatttgtgcagccaggcctggcctcaaattcaacatgcttctaccttagttccctaagtgctgagattataatcttgtaaaagcatatccaattgcatcccaattataataagataaattcttttatgagaacattgttacagattttctgtgtgttatcaagctcgttgatcattctgtagtaatcatcagtcattgaatggatggatggatggatggatggatggatggatggatagatgaatgaatatcttctgtgttttttgccaatacatatggatggtcgttagtgttttatggaggagaaaatgaatatgaagaatcaagtctcagggttctaagtttaggagattgatatgaggaagattgaaaaggaatatttttcaggctagacttgaagagttcaattttaaacatgtttattttgaggaaccattagatgactgaaaatataaatcattgtatttaccatccaatgaaagaaagttcaaaagtttctacatgaaaacaattgacagaagaggtttagcggtcatgctttaattaattcaacaaatgtttgtttactttctgctgtgtggcagctattgtgctaagtagtaagaatacaaaggcacaaagtcaatgaaaggtttattacaattgagtttgaaagggaaagcagttagtttgtaatacattttgaagagaagaataaagagcatctaaattgaatagctgagtagatgagtcatgagaggagggttcctgtaacgtgcacatatgaattaggttccaaacttccagacaaagagaagaaaggaataccaaatttaaagttgttcaaaaaaagttgtgccaatcatagctatgtgacaacattttaatcattgtgaacataggatattttgaattattaaatatggctatgatatttacagaaataactattaaaactaaggtagccaggggttttaaagtgaccaattggattcaaagagaagtttcatgtactgaccctcaattatataagtttgtttctacttcattttcaaacattatatatagtaaattactacatggccttccaaagcaattatttaatcttccacattacccacctctttcaagtttttcttattcccagaaaaatgtcattatctctaatactcctcagttactctataccttgttgagcagtgaacaatgtgcagtgaccctttatcaactagtattggcatttggaatttagcagccttatgccatgtgtaaggagagacttaaaagtgatcaacagaatgattgtagtcacattctttttacttctttaacaatttctctctctattcttttccattggatatgccaatgttttgagataaacacgaaaatattcacaattcaaaattcaattttatttggttttctcctagcccttttgtttctacggttgttatccattgattgactgaatttgatcttccacagtacggatgtcctaactattctgtccctatcatttctagtactacccaaagtcatatttatactagccatcaaaactagcaccaaaatgaaaaacaaactgcttcttttccttctcttctttgtcaaacatcagacaactgaaactttaccaaatgtcacaaattatgtcctgccaatgacaacagaacttttagaagaatagggcaagattgtaaagtaggaactaatttagaccagttaaaaagagtctcttctgaatgtcagaatacatttgtaaaactcgcaaatttatttcattaaaatctatattgtcaggcatttacatgtgcttcaagaccacacagtctctttggaggacaatttatggatactggacaaaagcacactggtaatgctttaaatctctgttagtatggactgcttgaaaatgatggagagggtacaaatccaaattattcatttgtccaataaataaaagatatataacagttaatagcataaaattccaagtgtcattgaaaatgttacctatatatacatatgcatatatatgaacaccttacacttaaaacatgcacacaaagacatatgcaatcatataaaaagatatgttttgggatatgtacacagaatgaatatactgatattttaagtattataacttccagaatggaagtacttcaaggcagacataaaagggaaagtcactttgtatgtattatctatgtgtgtgtatatcattatatatatatatatatatatatatatatatataattttgaaatgcttgccatatgcaaatattcctttttaatagtcaaattgtttgggatagtataaaattgtttatgtggaaaataaactgtgcaaaataatgtattgctcttgcatagctataaaaattataaaataaaataagtaaaatcagttctaaaatacacttgaattttaactgggtaaataaaatgataagcaatcattggaatgcaaatgtcttcctttaaagtaatttttaaagcttcttttaaattgcttaagcactttctttccaaatttcaatttaaaaattaattatgtttgttcatctttttttaccaatactatatttataaaagaaagactgtcagtgtatttataagaaagactagaaaaatttaacaaattctgggcttttaatatctcaattaggattctaaacagtctctttatactaaaaataaataatgtctgatttttaaaagtaccttttgaaagaatgaaatattgtctataagttaaaaatcactcaaattgttcttcacattctcagtgaacctttacatttctttttctctttaaacttttcaatatgttttctctatattgaagaatcaactttgatgtatgtatgtgcttgtaactgtctgctcatatctctctccctctctgtctgtctgtcttggagggtgtgtgtgtgtgtgtgtgtgtgtgtgtgtgtgtgtgtgtgtgtgtgtgaaagtatgtgtacacatgtgcaggtgtcctaagaggccagaagacgatattgtttcaagaaattgtgagtcatcatgtggttttctagaaactgaactagagatccttaaaaacgatcaggaagttcctataagcactgagccatctattcagtggcaacatgttctaattcttggtaagaaaccagatgctcgccatattgagttgttaaaacggctgttctgattgtgttgtgtctgatttttcttgtctttaggctaaactttttggcttttacacttctccataacaccttcatggggatatgaggagtagaaaagaaaaacaaaatgctgattagtcttgctgctccagggcagcatcaaactagaagggtgtgtgtgtgtgtgtgtgtgtgtgtgtgtgtgtgtgtgtgtgttttcttaattcatctaccagaatattaggacaaggaactgcagaattaggcagttttctttaaaaattactcctgggattatttttaataagaatttacgactagtttgaatgtaatttcaccatatgtagtttgactaaatgtagcgacatgggatttattcagaatcatctcttgagatttttaaaaattgtagtattgactgtgatctcaagcctctttctgaaatttaattacagtaaatgtttaaaattaattttttccatgtgttcgataggtgtactttgaaagcccctttgtgaattgaggtatttcacttctttttaatcccttcagactttattttctgtatcaggagttcactcaggagtaaacatagtgaggtgacccaggccaatggtcatgtttggtatcccatatttcccttaagtcttatttacaatttttttctgcaattcattctagcatttacagatctcatctacctctaaggcctatttcaagtctttccccttggatcaatttttccttcacagtttctggtttctacacatattcatatattgctcacagcttctgtgagctattgcagttttcattgtctgacagtcagtcctgtagttcactatattactatcttaagcattggttgtaaaatatgtctcctaacaaaatggaaagttcctttaaaaatgactggagatacttttaattgtactgaaatagatgtctcttgactgccttacaatacctaacacctagcatttagttgctgctcaaaatgtttggacttgtaaactccagttttctggccaatatacaagtcacattttaaaatcccactattgccacagcctcaattagttccctcctttagtatatcatttttttacaaggcaggacaaaatattaccactgatattgaactctagtttcgcttatcggctggtggcaggctttcctgtagggcattatgagcttttacaaagctagtatacctaatctgttacagagctatcttgcccttttggtctgatttattttctcacaactgcagtattctctgggctactgtggaagccgagatttcaactttttaatgaccagcaaagttgtagaacagcaaataaaggcacattcataagtgaccatctattcttaaaagccaagtaattcctgtgggaaggaccttctgacaatcatgcccaagttctccaaacctttatctacccgaccagtcacagaaaatttcatgctttttgagatccaagacctttaatattttaatttagaacatgataatttctcaacttaatttgaggtagaccttagaaactgtttgcttcccttcttttcaagcctttaaggaattttgttttatctgccagaaaattgacttgaggagagactctgaaatttgaatatctcaagctgaaacttacatggctactgagcattcttctgtacacagaaaatagctgaagatgagtcagggacaatagctaaggattagaagaggtatcctatcctcctcttgggcattttctgctgcttcagcctcatggttcctctccctgcaaagaacaggtgtgcctgacagcaggtgtgtttgttctacttttcctatggcagctgtcactccccaggtaactccattttccaggtggcaaattcttactacccatcatcttctttcctggctaccattacttctggaaaaaaaaaaaaagaaggtttggctgttaaccctccctgtttggactgtagattccgttgaaataaatattatagatggtattgttgacttcccttcctcctcctcctcctcctccccctcccctcctccttctccttctcctctttggtttcatgtatttagaaagatgtattttagggtaaaaatgtatcttcagtaagcttttatttacaactaagatgaatgatgttttcctattgaattcctttgtgaaagtcagcagcctttgatttggactgcacttcagagctttcttcctgggcagctatgggtttcaccattttcatattttctagtagtttgaggtccacccttaatcaagacaccactgctgggactgccagtcactacaggcttggctttgatccgcctttgtttctattcatagcatgcatttctcataactctaaaagaccatttgatgccccatgttgtttaatatctatgtgattaaagcagctgagcaaattagctcatgccctaagtctaaggaaaaatccagtctagaggaaattgtattgcaagcctagatcatttttaataagctctgctactcactctttccagttcctctttgggaatcacttgggcatattggaagtatttgagagacattgaaaaagattctttcaggcatgcgtttgactattagaacaatgtttactgaaatccaacattgtacagctccttgacaatggtcctacaatcaagtacaaaacaagcaagtgtgcctttctaacatataggaaaatcaagcgctctggatgcagtagttgataaaaattgcacatatttaaaattattgagtgtatactgaagtcctcaaatgaacaggcattgtagaaccatgaacctggtaagtaagtaatggggaagaaaacaaaaaattgataaacaatattgttaactgcataacatactctctctctctctctctgtgtgtgtgtgtgtgtgagagagagagagagagagagagagagagagagagagagcaagcgagcaagcaggatctaggaatttgagtttgtgaattagcttcagtataatataagtgaataagagaacacaagaagaaaatctgattttaaaaaaatagagattgagaccaataaataaataaataaataaaaacttgaatcatttaccttacaaaaatattttaacttaaactttgggctcactttacttactcataatacaagaaactttttaacattgaaagtaagagttttcacaggcaagagttgtttctctaaactgccgattgtgttcccagaattctgtagactaaaacctacactgagatgatatacaaaatggcttatccctatagtaaggtgtttggagggttagagtagaaggaaaaaaaatatgatatttcgaggctatgtagtgaattcaaagccatcctgagatgcctaataagaccccacctcaaaacctgattactggcaaaatggctatgtggtgaagtacttatctactatgtaccaggccttggtttaaacctctagcccccaaaacaaaacctttcatgttaaagtttaattaacattgcaattataaagaagatgaaatcattaaaaggttatactgacatgatagcttagccttcatgagtgggctaatgaagttatcagggaagtgtggtcttcaaccttctaccatgggctgaagccacacaaacactctcccttccaccatgaggtgaagacacagagacacactccccgaaatctagtgcaatgccttcatatttccttgcctcaaaaaacaatctgtgtattagacttgtattcttcaattgatttaagacacagagtattatgaatttccacatatttgtaatctgtgatgattctgatatatggttttgtaagttaacctgccaaaaacatgttggaaaacatagtaggtaggaaaagatgaaaactaaatctcagagagactcgagtaatcatgttagcatggcttagctgaattgtggtgttggaaaatgtgaccggagagcctcctagagcccaagtaatttgcctgaggtctctttcctgcaggtgaattctctagtggcagttatcgcaatcatgccagaggcttattttcatgcagacatactctctggtattttcaaagcatctattgacacaactgccagtgtatgcagacccaggtctactagggaacaccagcaatcacttaacagtcagcatattttagtgtgcttttactatatggctagcatatagttagacatcaagaggatgtaaatacaatatatcatccattgggatactttgtgggactataatatttacaggaatgcaatagcgaaaaggccatttgtttttttattgaaaatagtttttcttttcacataatatttcctgattatggtttcccctccctctacttctcctagttgcttgccaactcccatccatttctgatctatcccctttcttcctttcattagaaaaccagcaggcttctttttttttttttaagatttatttatttatatgtaagtatactgtagctgtcttcagacactccagaagagggagtcagatctccttaggatggttgtgagccaccatgtggttgctgggatttgaactccagaccttcggaagagcagtcgggtgctcttacccactgagccatctcaccagccccatccagcaggcttctaatggataattcttttaaaaatataatataatataataatataaaacatatactaacgtatcaaaatagtacaaagtaaacaaacaggaaaagagctcaagaaaagacacaggaacaagatgcttactcatttatacactcaggaacatttaaaaacactaaactggaagccataatatataccaaacatacttaaagggtaaaaacatagaaaaatataaattaaattaaataaaaataagaaatgcaatttaaatgtgtgacaagacacaagacattataagtcaaggaatctctggatcaacaactggttttgtattctgttcaatgccattttaaaaatcaaactgcattttgacagtaaagtaagattttagaatgctaggaaaggaagagatcaattaaaacaatatattgagaatgccttcataaaggaattataacttgccctataactcaaaaaaaaaaaggcataaatttcaaagagtcagaatgagaagagaaatactctcaaagcaattctgaggaagacacaacaataacaaccaacaaatcaaataacaaaaacctagtatttaattatttacttgtctagttggttagttttgacagctacaaagtgagtgtgttacataggaactcataaactgttgctcattttaaaatttttattgaaattagattcttctttcatacagtacatcctgactgcaggttcccccttcacttttcccagtcccctccaacttcccctctcagccagattcattctgtccctccatttcactttagaaaagagcaagcctccaaaaggctacaatcaaacagaacaaagcaagatacaacttaagacaaggcaaaattctgaatatcaaggctggacaaggcaagccaacaggagcaagagtctcaagagcaggcaaaagaatcaataacacacctgttcctactgttagagtcccacaagaccctcaagctaacagccatagcacatatgcagatgacctggtgcagacccatgcaggatccttgattgcaactccagtctctgtgagccctagttagttgattcagtgtttcatgttcttctggtgcattccatccattctgactcctacaatcctcactctctctcttctgtaatgttccctgatctcctaggggaatgacccaatggaaacctccagtttagcctctctttgcatttaatgtctgacttgggtctctgctcccatctgttgccaaaggaagcctctcttgatgactgggcaagcctctggtctatgattatagcagcataccattaggaatcctacatactaatctctttggtacaggaaggtacactgcaggctactgaaatagaaatgtggacaccaacctagccacaaaacttggacctacaatctgtcctgcctgcaggatgttttgtggatggccaggaactgaagaatggatagcatggagacctagggtagagttaaacactattggcgaaaagataaaaaagcacctagtattttaaatggaaaaaaattatagttgcagactctctcaaagaactcaaaagcaggtcaaatacttcgaaacacgttttaaaaaattggttgccattgttacatgcaatataaaagtatgtcataatcattaaggggtattttaagacaaggaaaatgataaaacattccatacaggtgaagaagagggaggaagatacacaggtagagagagtgataagtacgtaactgactttatccttactttcccaattcataacggccaatgcccctgaacttctagatctatattactgttagagtgaagtataaggccgtaagtaacatacacttgctttattggaaaacatgtctgtctttcaaatttgatttaacctgtacaaatgttccttaagaaattggaattcctttttattacatttcttatatttgctacttccaggattgataacatcttaagatcttttactttcagatggaatgaagtgcataaataaaatggcaaagtaataatttacacagatgatccaaaacccattaggtatctgatactataacaaaaatatgtacctttgagagttaagacaaactggacaagaaaggcagtgcagagaactcagagcatgagtttcatgtgtagcagcaattcagtactttcacatttgcttcatcaaaggaattatttctctatcaaatttgtaagtataaatttgatcacgatatcaaaggaaatgaatggcttgctttaaggagaggaaacagttttaataaattagaaagtaaaacacaaggaagatatttctttcaggaaaactccttttataattgatgactctgtaaaggaaaagaacaatataggatcctttcatttatttgtcttttgtcttttataatcatgtttctctatcataacttctttgtagagcagtgtttcaaacctggttctatgaatgtatatcactatgggaattttcctgagagcacaatgcaatgtaagtgttctattttcagcatggtccaataaacaaacaaaagcactgtcaattgaccactttaaatccacactttgccattttcaggagactgtcagatatacagaattgagaattttttcttcatgggattatcaacagtatcttttatgccaccccatcattaaggcataagaatttgtaaagagatatgccttttgcatattgttaacaatgatgactgaagttttggtttatttttgactacctaagttttgacaagtaataattgcacacttaatagtaaacaagaaggtaagcaataaccaggaacagaaaaattatctaggacctgtgagaagtaaagggagtgatactactcagactgtgggatatactagttgttgcttcagcaacaaattattagatgggtgtgtgattataaaagagtaacctagaactgcagtgtgttgctggttattcatgacgactcctgcagatgatttgatgatcatttagtatccctatttctccgtaagttagagaaagacagccacatctaacttcataatccagagttcagacttacttaataatccgtaaataaggattatattagacaatgtttcaagttaaatattataaatataagttatcattttcaaaagtaataggtatttttgtcaagatataaaacctagaataaacaaaagaatgttgcaagtgcttttgacattccaattccattctgcagaagtgtgaatagcagatgtatttcttctgaggaggctaccaggcaaatcttacaattacagtttttataaacataataggtgtttatattaaagtaaaaactgtatacttcaataatgtgataaaatgaccatttagaaggtatttggtatgattccaactttaaggtacaaaaatactttgttttatgaatgttgaaacaatttagagatagatgtaaacagagaagataaatagatggatagatagataaatagatagatagatagatagatagatagatagatagatagttttatttgcccttttgttaaaatagattggaggtattatcatttgttaaattcattagtctatatagtacatatttattagaatgtgtatttgttcagatgactatgtctagaactgggaatataccaataaaaattatagacacattttataccatcatgaaatttaaattccagtagaaactgggttataagatgggtccaggcaaggagaactcctattgaataagtgtaattaagctaagtagggacaaaaaactcaatgggacaaacttaacatattcctattgccagactgctctgaagacacatctgatatataactctatttttttattggatattttctttatttacatttcaaatgttatccccctttctgttctgccccccaggaaccccctatattgtcccccatccccctgctcctatgagtgcgttcctctacccactcatccactcctgcctccccgccctggcattccctacactagggcatcaagccttcataggatcaagggcctcccttcccactgatgtccaacaaggccatcctctgctacatatgtgtttggagccattggtccctccatgtgtactctttggttggtggtttagtccctgggagttctgagggtctagttggttgatattgttgttcttcctacggagttgcaaacttcttagctccctcagtcctttctctaactcctccattagggaccccatgctcagtctaatggttggctgtaagcatccgcctctgtatttgtcaggctctggcaaatcctctcaggagacagctatatcaggcttctgtcagcaagcacttgtttgcatccacaatagtctctgcatttggtaactgtatactggatggatccccagatggggcactctctagatggcctttccttcagtttctcctccacacggtatctccatatttgctcccgcattttgttccctcttctaagaaggaccaaaagacccatattttggtcttccttcttcttgagcttcatgtggtctgtgaattttatcttgagtattctgagcttttggtataatatccacttatcagtgaatgcatacttgtgtgttcttttgtgattgagagacaagcaggaagatcaattgaaaagaattaaagacccagaaatgagcccacacacttaggatcacttgatctttgacaaaggagctaaagccatccaatgggaaaaaaatatacagcattttaaacaaatggtgcttgctcaatcagcagtcagcatatagacgaatgcaaatcgatccgttcttatttcctgtacaaagcttaattccaattggatcaagacttccacatagaaccagatacactgaaactaatagaagagaaagtagggaaaagccttggacacatgggcacaggggaaaatttcctgaacagaacaccaatgacttatgctcttagatcaacaatcgacaagtatgcatatgaagcatattggtaagaagcttcacgtataatacctaaaaactaaaaaaatagagtcatgtccatcactggaaatgtgaataaacaaactgaaatattcatatagtaggattctattcaatattaaaggggagcaaattcctgaaagatttgaaaacctggataaattttacaaagctttacactgagtgagaaacaagtaatccataatagcaatttaactttttcaatatggagacatgcaatctactttaaaagtctatacttttaagtctgtaattcactatagcctctaaaatctaactaatttattaatttaatatagcttaggaaagaaaaactagtcacagtactgaggaggtatagaaaaaaattctttcatgaaaatcattcaaagaataattattctttagcacattattaaaatgtattttcataatataaaagtttttattagtattttgtgatataagatgttttagcgagcactgtgttaaattctttctttttccatatttatatgttttatagggtttaaaaaaaacaataaacactggaatttctcctagactcacagagaattagagttgtttaacagcacagatacaagttgttttgtcagctcacaggaccaattatctgttcatgtggctgccctagagcttccctcgggcagtatagccactatagctagggtatctagtttgtttggtggctcctcttttccttttccttttttgatttcacacagaaacagtaagatcctacttacatagtgtgaagtgaagaatgacatcggccaccaatgcttccctatgtagtctgccgcaaggcagactatgagtcccataagtgatattgcgttctactggaaaggaagaccacttaaaaaggttgaatccatttccaacatataaatgttattgaatttattttactacgaatttgtgcattgattcccatatcaaaatctcatggatcttggaggcagaacacaaaagagacaggtaccttcaaaggaggaatggaacattataacagaattgtctgttagattaggaaccattatcaactacatatcccactgaattttcaagtggcagaggcaaaatagatggagaaaaggacaattcaaaatctaagaaaatgaaaataaggataaataacaagagagtatcaatttcttctcttgaattgagaattaattttaccctggaataaatacatgcatcttagaagaccataatcaaagtttcagaaagattgccttcctctctaccagcttctatagtcattgttgttcctcagatcattacttctttatctacaaatctagtcattgtgtatctgtttaactcttcctccaaattcaaatcttctaaaccttttattctgccccacttatctacttaaaaggacccttgtggttagtagtagggatatccaaatgatctaacatagtctcaaggccatctggttattaaccataatacaatctgaaaccttgatttgcctctatcatgcacactaacaggtaaacatgtgggaattagggcatggacattttgcagactatattatgcctactataaatatatttaatatataactttgcactgtgataaagagaatgtgtttatcacaaccaagaaaatggatatcatttttatccccagataaaagcacccaaatttacaaagtttagttgagtacacatattagatacaaacatcaaacaaaatgatgtaaatgttttaaaacaatagaaggagagagaagtatgccaggaaattttcattcaatagaggtttggataaggagatcaaatttagataaaatagcactcaatgttaaaagcaacataataatccctaaagcaatttctcaattaagcatatatgctatttgaagtgctgtataatatatatgataaaactatggtgatatttagagaatacaattattttaaattttgaaacatacacaaaccaaaatgtaacaatacaaatattttcatattgtaatatgaaacttgaagtattatttttatttttgagattgtattttgattacatttatcccttctctttcttgcctccaaattctgacacacctaacacacccttcttcaaatcataacttatttttacactgattttttgcatatacatatatatatgtaaatgcttatattgtccccaaatataatcttttgagttcataggatgtttattgtaggcatgtattcagtactgcagtttaacacaggaaaggcaatgggtgagctcttccacggggagggctacctctcacagctgtagttctttgtgaaggatgcggctgtctccataaggtttgctgtgactcttggtgtcctctttgttcaactcacatttgggcagtcatgtgggtgagactttttgtgtttgagttttcaactaattgtttattttttgagataattatgtcgtttccctcttccctttcctcttatgaaaccctctcacatacctctccttgctagcattcaaatttgcagtctttaaaaaacacacacacacacacataaaaattacattagtatataacaatacatatttctgttttataaatcatgaatgaataaaactatataatgaaaataaataaaattataaaacttatgaagttatacataaatttcttttttctttcattaaaaattgattttctcggccgggcagtgctggcacatgcctttaatcccaggacttgggaggcagaggcaggcggatttctgaatttgaggccagcctggtctacaaagtgagttccaggacagccagggctatacagagaaaccctgtctcgaagaaccaaaaaagaaaaagattttctcatgttacaccccgattatacattcctgtcctttcattacaaattgatttttccacgttatatcctgattatattttccccacttttcattaaaaattgtggagaaaaataaatatttatctgcaagtggttatcaattggagattggttctgggttccaaatgaaggcaagttcaacttctcctttcaatcagaaacccagtctggtgtatatcagtgcgtgactggtgcatgttgccttagtctctgtgtgttcatagagctttgttcatcttgatttagatggtcttgttttcttggtgtcctcaattccctcggttttacactctttctgtctcctgtttctcagggtcccctgtcctctcagggaaaggatttgaggaagacctttcatttagggctcagtgttccaagatctctcactctctacatatctggctgtgggcctctgtatttctactgttcggctttgggaggaagctttcctgatggtggctgagaaagacactgatctgcttccctggctagagtagcctgtgggtgtgcagggaatcaatatttctgggttttgactcagagtcatttttaaaagctgaatatatgctttgccacagtgaaagcttaaatacgctctcatgtaaaggactgacacaatattttctgacacaattctatgaagctagaagtcaacaaatagaagatgagaaaagtgcccaagcataatggtacacatcattgatcttagtactcagaaggcagtgacaagcagacctcaaagacatcaaggcaagcatgaaccacagagctacaaatgaacacatttagacaatttaacaaaattgtatctatgggatagaccaaacttatgtctagtatatgtgagaggaatgatttttatacactgaaacacacaatgaaaacctattgacatgcaaggataaaggggaaaatcttacaggctttttacaaagaaataaaatcaaaattagtagttttagtgtctatatcctggaatgtataaaaaagaaaaaatagaacaacaatccaggggagaaaataaaaagcaggtatcctacttcctagtgaacatatcattcacatgatcagagaaacatttatgaagatttggaaaaattcaaaaagcatgatgctctcatgtaccaatgaaaacaaaatttgatttaaaaagtcataaatggcttagaatacagaacctaagatgataaatgaaaaataaagtaataatattggctttctcaaaaggcaattaaatttaaatggaaatccacttggcagtggataaaatgcaaagctagaaatttttgaacaggacagatatttcataatattctagaagaatgtcatcatttacaaacagttaacaacttatatgaatgcttagctaaggtttatatagattcttttgacatataaccaaccatggtccactaatattgttccagaaatagagaataataagttccaatatctggagagtgtgatgaaatctcattccattcctcttcatcttttcatgacatgaattatcattttttagtaatggctatgatgtgtatactagcagcttattggtcatgtagcaccaatcttacttacagatcagctttcatgttattgtaatatttgtattcatataatccacagtttacttaataatgacaagacaagatcagtaagtgatgctttcactttaaatatgctgaagagaaactgtaagaattttcctctaagcaaaaatgaaggattttttcttattataagatatcattacatggtttctatttaattattaataaactttccattatgcttaatatgcacatttaactctcttataagtatatatatatgtatatatatgacatatatgtgtatgtatgtatgtatatatatatatatatatgattgtattatctgtgcatttagatatgaattgcagctcttcaaacatgtagtctacagataagaaagagctgctattctgtctgattttagattttttgagtaatcacactataaaaagtaataatgaatgaaactaattaaaagccttatttatttaattatatacactatcattccaatatgaaataaatatatttgttataaattagacaattatacatcatctttctctgttaaaaattagaaatccattacatatatgtacatgcatcacaactcagttcacactgaatacctttcatatatgctcatgtgactttaataactaccatactggatagaacaggtctatgtgtaaatgtatcaaacttctcaaaaaagacatagtactgggggtaagaagaagaattgtaaacaacagtattcagaaggtctcaaggataaaaaagaaaagtgagaattattttgagcataacattatagagttgacaatgatgggaaaagaaaccatctgaaagtctagaaataggacattacttaaattatgatgtgtttatagtgtacaatgtccccacataatgtaataatatagagtcagaccatcctgtagtagcaccatcctgtagaggcttcctttttttaagggtgtgcaatgtaaacagaaaatattaagcttaaaattagaaaaataagaatctctttatatgtgtttatttttataacttttatgagtctacataaatgtatcaaaatattctaaaatgcatattaatatcttaatgtgaagactgaaggaagcaaagagggagtcattcatgatatttgcccttataaacaccttattgcttgaatttgtttaatgaggacttttcggtaatttccacaatagcttatctaagataaagtgagtaataaataactgtacattttaatgttcaaaaaagacttgatctttcttgataaggtcatacaaagtctcagtttatagcattatttgaacattaataaaggagaacaggactaaggaatattaaaagtgcagcacttctttttttttaattacatattttcctcaattacattaccaatgctatcccaaaagtcccccataccctcctccccacttccctacccacccattcccatttttttggccctggcgttcccctgtactggagcatatacagtttgcgtgtccaacgggcctctctttccagtgatggccgactaggccgttttttgatacatatgcagctagagtcaagagctccggggtactggttagttcataatgttgttccacctatagggttgcaaatccctttagctccttgggtactttctctagctcctccattgggagccctgtgatccatccaatagctgactgtgagcatccacttctgtgtttgctaggccccggcatagtctcacaagagacagctacatctgggtcctttcgataaaatcttgctagtgtatgcaatggtgtcagcgtttggaagctgattatggggtggatccctggatatggcagtctctagatggtccctcctttcgtctcagctccaaactttgtctctgtaactccttccatgggtgttttgtttccaattctaaggaggggcatagtatccacacttcagtcttcattcttcttgagtttcatgcgtttagcaaattgtatcttatatcttgggtatcctaggttttgggctaatatccacttatcagtgagtacatattgtgtgagttcctttgtgaatgtgttacctcactcagcatgatgccctccaggtccatctatttggctaggaatttcataaattcatcctttttaatagctgagtagtactccattgtgtaaatgtaccacattttctgtatccattcctctgttgaggggcatctgggttacaaaaagaccaccagcacttctttttttaaattaatttattttttacactccatattccattccctgcctccatccactctgtgactgctccacatcctacaccttttccccactctccctgtctccatgtggatgccctcagcccctaccccacctgacctctaagctccctggggcctccagtctcttgagggttaggtgcatcatctctgaatgaacacagacctggaactcctctactatatatatgttgggggcctcatatcagctggtatatgctgtctgtttggtggtccagtgtttgaaagatctcggggtctagattaattgagactgctggttctcctccaggatcgcccttctcctcagcttcttccagcctcccctaattcaacaacaggggtcagctgcttctgtccattggttgggcacaaatatctacatctgactttttcagctgcttgttgggtctttccaagggcactcatgctaggtccctttttgtgagtgtcccatagcctcagtaataatgtcaggccttgggtcctccccttgagctagatcccactttgtgcctgttgctggaccttcttttcctcaggctcctctccatttccatccctgaaattcatttggacaggaacaattatgggtcagagatgtgacagtgagatggcaaccccatccctctcttgatgtcctgtcttcctgttggaggtgggctctgtatgttacctctacctactatcaggcatttcatctaaggtccctccctttgattcctgagagtctctcacctcccaggtctctggtggaattctggagggttctcccaacctcctatttcctgaggttgcctgtttccattctttctacttgccctcatggcttcagtaccaataccagatcaggttcccctctcctcccccacttcctctcatgtccactttccctaaacataatgtgaagcatgaaactcaaaacacataaaagagaaaatatatgaaacacttgatcacattaaaattaaacagccattaataatagtaagagaatgcaactagttggcagacaatatttggttcataaaaatactgtgcatgcatgtaacacatttagtgtaagaattaaatacatattagtaataaaatgagcatatacaaaagtgttacaacaaaaagctataaatgcatataaatgaaatacaaagtaaaaatgtaattgataacatttacaattttaaaagtcttgagatgaggtgaattgatatattagtttgaactaaatctttttccttttaaagaatatacagtttgacccagcactcagaccttgagggatttatattacagaaaagataacaagagtacagaaagatatatgtgtatatcattaagcaccgtatttcttgaaatagtaaaaattttgaaaaaagcaaaatatgacatgtttcaatgccttaagcaatggaattccttacaaatattgaaaagaacaatatagatttatggatgtcaacatgaaacaatgttcgtagcaggatgtatgaaaatacaaaatgtatttattataatacatatacaatatatatatgacatagtgtcaaataattatgcatttattatataatatacacatgttatatataatatatgtatatttattttagtgtagccaagttatgtaggcatagattcacttgaatactaaaatactggatcataccttgacactgattatcatagatatggctagaatagaattctcagtaaaatttaagccaatcccctctcaataaagacaaatctgatcaaatcccagatgtacttgctttcgtcaattttatatgaattgacagtttgcttgagcatgttcagttatttataaattgaatagtactcaacttcctgaatccattatgataattttattttacaattggaaatagatgtaaaagatctaacacaaattagatgttaactgacttccttctgtttttaaattgtgattttaataaattcttttacagttttatttcttagggaaccttgtaggtaatgaacagtatatttttcttagatttttattttaagtcctaatccctaccacaatgcttttcctctcttgtcttagaacacagagatctctctttcacttttcagcatcatcatttcatcatcagcccccttcctaattcctacatatacatatacctatcaattcttacactacatagaaaattcaagcttagagattaatcttatctttgctagtctgtacagaatgagtaaagaatgcatgcatggactctgattaaattggtatatgaaatcagaatcaataataaggcctggacctgagtccacatgttatgcatcccttactccctttcttttattcctaaagacagagccaatgtcaaaatacagaaatatctgccaccatattacctgcctaccatggaaggccatgagcaaatcttggcaatgtgattctatttcagttaataattgtgagacagttagatgactcaatgaataagttataatgaacagagaaattcacctgtgtttttatacaggctgagaagaagcctgttgtatcatgttgttaaaggcttatcatggtaaataaaaatgtataaaaatggcagaaagagaaatagaaactaaaggagagagggagtagagaaaaggggcccaagctgacattttataaatttctttttggtggtagttgtggttgttgttgttgttgtttggctttctttctttcttatttattaatttatgtcctaaatgctatccctccgtggtacccccatcacagaatttcaacccccatctccccttgccaggaggattaggttccatttcccccactgctatgagtctcacggtaactcacaagataatggcactaaccagtttatgaggcccaagtaagctcttgaaaatcacacctccaaatattgttacaaatcaattgcatattagcatgagttttccaggtaatcatatgagccatagaatgtatgctagtaagattgacccaaacacaattaggtagccatctcttggacaagcactgtggctaagatttcagcatcagtttagtagcttctttgtaaaatacaaaatgatttgtggaaaatcattgggagcatgttattcccacatgggattatgtaaagataattaaaatagaaacaaatatttggaagtacaagcctcaactggagaaatacaaaggcagttggaaaatctgtaggtgttcatagcagttcttaattatgtttagccttaagttgtactctgttgcagtttactaaattctgaaacattcatcgcaatattttaagactggcacgatcttcgtttctaatactatcttcatttttgtcctttgtatgaaccctctaaaccagccagcctagcatatttactgagcaaaaagatctgtgctatagctatattcacactgtaatcagtcctccagatatggcatcttcattcctgtatgtgaactatgatttgatctttacttgaaatgatttttcaaagcactcctttatacaccaaatattgatttgtttttcaatgtatcaaacattgttttgtggactatatatacacaaggacagtgcataattatataagtgattctcatgttataattgtgtatagtgatttggacaaaaaatagcttaatctaatctagacaataaagaaagtgaattaaaatctgaaagataagattatccaaataaattgatggaaaggacagaacagagaaggggaaacaccagacacaaagagagtaaaatgaaaaggaggttgtcccaattaaaaatctggaaaaaacatccagaattggatagctttacagcaaaattataagacaaattaatgtgaggctggagagatacctcaatggagaaagctattgctgcatgatcctgaagactggagttgttttgttttgttttgttttgttttgttttgttttgttttgttttgttttgtttgtttgtttgtttgagacagggtttctctgtatagccctggctgacctggaactcactttgtagaccaggctggcctcaaactcagaaatctgcctgcccctgcctccagagtgctgggattaaaggcgtgcgccaccacgcccagctaagactggcgttctgatccctagcagccacataaatatcaggatttattgccttgcaatcctaatacttgggaagcttagcaagtgatccctggagaaagctgtctagcttgactagcctagtcattgagcttcaggttcagcaagaaaaatggaaagcagtccatgaagatactcactgtcaatccctgtccttcagaagacatatgaacacacacatgcttgtatatgtattcatttatgtgagactcacacacatgtacagacacctgcaaaaaacaaaagatatgatttagtgttgtgtcaaatgtgaaactgataatgcctaaattgctaacctcaaccagtgaacgtatagtaactattcactgaacatcaataccaagaggagaatcagatttggaataaattattatattagctttatagcttttaaacaatacataaaacacataaaagctcaaagcatgctaacaggacttagaatattctctatgcctattccaacttttccattcatccactagttacttaatctaccacatctacaagatgccaccttcctgatcatcctcttccagatgttcattgtcttgatcgtgtaccctactcttcgtattaaatgtctcatatatccataactataaattatgttctccgaatgtagggattcccattggatcaaggtaaccttgacttctaccacaaaactatgtatgtagaaagacgacatttttgatgtttttctattttctgagattgtaatataatttcccctcttcttttctccatcaaaatcctcccatttaaaccctctttcaaactctctttcaaacatatggcctcttactctttattgttacatatgtatgtgcatgctttcaaggctgaccatttggtattagataaacaattggtgaggaagactatgtatccccctcacaacattccacagttgtctgtattttttttttatgactgatgccctatgagcttttgtgctgtccactgtagcatattgattactgtcatccacgctgagatcctttttcctgttataaagtgaaaacatacatccctcctgctaaattggtataagaacatggccatatattctgatctgtccagaatcagttcttcacctgctaaaatatcagcccaatcttgaaatgtcatttcagaaatccattataataaacaatatgcaaggaatataaactacatcctgtatataaaacactagacaactgatagttggctctgttgtcattgttattcattttgtaataatctggaagtaccataatttcatatgacagctaattctttgcattatgtcacatgtaggaaaattatgtcctcttttctgcactttttactaccataaaatgcacttctttctctacttctgagaataggtgttaacatgtttgttttacccctggctggagcatagcatctagttttagacaacattacattgtagttagactcctgtgtttcacaaattacaaattaaactatagtcaaagttcacaatgtgtattgatttacacatgtttatatatgtgtgtatgtgcgcatgtgtgcatggataagtgtttattaatcatgtttacaaagaacactcacttctgttgctatataccatatattggtcattatgagaatggaacaattacaggaaattatctactttgggtcatgaagcacaaactttttagtagtaggggtacttttagtaaaaaaaaaaaattcttcctgttgcttcatggtgttctactcatctatcactaatgcatcaatgaactctacgtggttttctgccacttcatcaaaagaacaagaatatttattttgtttgcattaaaaaatacagagggaggtgagtgaagaagtggctagatggataaaaacacttgctactattggagataatccaagtgtaggtcattacacactcttcttatctttggccctggggcatctgatatctctggacttttaaggcccttaagcatgtgtgcaaacacacacacagagatataaacacagatacgaagattataaactactaaaaaaaacaatggaacatatatgaagctttattatttatttacatttatgaaatatttgctaacaaaatcaagctgataatgtctgtaagcatatggtaggtataagtggccactttttaaatctttttatttattttttatttgttagttagttagttagttagtttgtatttatttactttacatccagctcactgcctccctcctggtcacaccctcccacaatcctttcccccccatcctccctccccttttctcctgagcaggtatgacccctctggatatctcccctaccatggcccttgaagtctatgtgaggataggctcttcctttcccactgaggccagaaaagacaagccagctaaaagaatatagcccacgtacagtcaacaacttttggggtagcccctgctccatttgtttaggacaattacatatatgaaaagtcgaattcaaaatggctgttctagttaattttccttctttgtctctcttaacatccacttgaaccttatgtaggctaagaaaaaaattgacttccttgatgaattaagttaatcttctattattttacccttatgctaaaactataatatcaacaagagcactgttttagacaatgcagatcagatttcttattttgatagcaaatattcaacatttatataggacaatataactccttttatcttttatttatttattatgcactgtaaagtgaaattgtgatacactgatttttttaaaaaatttttttattacgtattttcctcaattacatttccaatgctatcccaaaagtccccccctccccccccacactcccctacccacccattcccattgtttggccctggcgttcctctgtactggggcatataaagtttgcctgaccaatgggcctctctttccagtgatggccaactaggccatcttttgatacatatgcagctagagtcaagagctctggggtactggttagttcataatgttgttccaccgatagggttgcagatctctttagctccttggatactttctctagctcctccattgggggccctgtgatccatccaatagttgactgtgagcatccacttctgtgtttgctaggccccggcctagtctcacaagggacagctatatctgtgtccttgcaacaaaggcttgctagtgtatgcaatggtgtcatcgtttggaggctaattatgggatggatccctggatatggcatcttaagtctctagatggtccatccttttgtctcagctccaaactttgtctctgtaactccttccatgggtgattgtttccaattctaagaaggagcaaagtgtccacactttggtcttcgttcttcagtttcatgtgtttttcaggtaagctgtggtgacctgtctctgtttacttcccctttatactctctccttcaacctcctccaggaaccagtctctaaatctattatttgagatgatatctagtttgggaagaaggggtttccctttcatctccatcactgtatccctgtatccttcaagatatcagatcccaaaatatttatccaaagaaatatttcaggatataaagtaaatgtgacatgcagggataaatacagccggtctcaggacaacctctcaaggtcttcaattcctcttcatggagaatacacagaagttatggatgtggctttttacccagtaatattcatttgtgtagaagaaaccaaattcttgtgtattactgcttatatatatagtatgtttattctgaatttcagaaagaattctgaattaatatccatgtgataatttagagatgaagaagaagatgaaggtgtatttgattctgagaataaatctattcccattagaggatgagttctgtgatggtttgaatatttgtctaattttctttagtttctgcggggggggagtaccattatattagagtttgaataaagattttctgatttaatggatttttcttacattctagattagaactcatggcctcagaattccaagattgctgagtatattttcagtaaattctttagaaaaacacatggtgggactcatggctctagctgcatatgtagcagaggatggcctagtcggccatcattgggaggagagggcctaggtcctgtgaacgttctatgccctagtatatatagggaagtgccagggccagtaagctgtagtgggtgggttggtgaacagtgggagggtgaggggatggggagttttcagagggggaaccaaaaaggggataacagttaaagtgtaaatataaagaaaatacctaatacaaaaagaaagaaagaaagaaagaaagaaagaaagaaagaaagaaagaaagaaagaaagaaagaaagaaattttataggaattttaggcagtaaactcaagatcttgtgtacactatacaaatattataactttgagctatatcctaatactaaacttccatagattttgttgttgttgttttgatttgcttttgagattttcaaatgtattctcactatgttacctgggctagcttcagtctcttaagtatctgagatttaaagtacctaccattttttccagctcttgaaagacaccttcacagttcaggcatttctgttagatttataattccagactccttgtagataggaacagtaaacatcatgaacaaagcttaggaccagtgacatagccaaggaactgttaaaaatgaaaatctagccaagcaggtgtcatctgaatatagcatcaaatctgttatgattttttttctcctaaggtgttaactgagaactaaacaaatatagtcaactattcaggctttgcacagactcaagttctaactcatatacagtcttgaacaactacagtcttgaacaaacttcataaactatttgacctgttcatatttcctgtctggaaaatgagtatgcaatcatgtattcattgtccattcctaagtgtttaaaatgccaatttgtttgtttggattaagtttttggactatgttaataagacttttgggctctataagtttcctactccaaagtataatgttattgtttctgtctgtatttgatttctagcaatgggaggtttagaagattcattttgttaaaggattgactgtagagttactatcaaggtttgcatatgagctaaagagaaacataactttattcaatgtcacacttctttcataaattccaaataaataaatatggttctaaacacacaatagagaagtagagaatattttccagaaaaaaaatcacttttcttaatgctgtgaaatgtgcaaaactcataaagaagatcacaaacttaggtctagtctattttagcctatgattataatcctgtcttgtaaacaagacttgctcccaagttttgatctggttatctcctgtggctgggtaatgatgtgctaaagttatccccctaccaccacagagttcccagtgaataatattcccctcataattgttaatgttgttaaataattccaaaactctcctcaaggcagctgctttgtgcttgggagctaaacacaggaaaggccaacattttcttttatttgtctgcctgcagacacagatgttgtttgtgtcgtctaggagcataaaatatggtctaaaatatcactgctgttttcaatgagtcaaagggacatggtagtagtgatgggaatccataagaattagtacaaagtggaattatatttcaggcggaggtataaaaatacattacacttgcagaacaatgatgagctaatatatgcagagtttaagggtcccttttcaggctgtcaatgacggagcaagtgcccattgtcttctggctgccatatccctcgaagtattttggcaactagctgtaaaaatccagatggaaacagcagcaaactcaatgaatcctgggaagcaagaagtaggaagttctcgcctcagccacatacatataggacaaataggagctaggctgtgaatttgaatgggctacttataactttatatgctctgtgaggtgattagggctcggtgttaaaattgttctgaattagctttgccatttaccatctatgcaaccttagacaagtcattttatttctttgtgagcctcagttgctctttggaaaaacaagaataataacagcttttctctgagagtgtactgtgaggattaaatgagataatatacgtttcaaggcctggtacatgaaaaccctgaatatacatttggatttattttcttcttaccctcatatgtgacactgtgtgttcttttgtagcttgacctccaattacttgtggccaaggactgtggaatcagtatttaacttggagacactacaccagctgattagagtaaaatattgtgtttcatttacttatgattttttggggggtaaccaaggtaaactagtttctcattttccacagctattagtgacctttctatataaacatgttttaatggtaagcatatactgtagagaactactaataaaaactttttttctgttcgtatctactatactctaaaaaaaaaaacaagcattaattataaaaatgtttgagtgctatggcagtctgctatatattatttccccttggttaatatagaatgatataataactaagtcattctatagacttgagttcaactctctgccatttaatagatacacatatgtatacaattaagaagcttgcagaaattaataatgtacaaaggaaacattactaaatgtggtatagtggcacacaattttaatccctacacgtgagaggcagaggcaggcatatttctatgagttcaaagccagcctggttcatgtagtaaataccagaacaaccagaggtacacagtgaaaccctgtctcaaaacaaagttagtaaaattattaactctctgttgtggaaaggtatattttcagggctgttttaagcatggtctgcattttgactgatttaacactaacttttcttttattcttcaatgaaaaagatatgcatataaccatggtgaataaccaggattgtgagaaaaatctctatttacacaatgaaaccaaagcttctaacacgttaaagtggatggagtcactgatattaaatctacatggtctgtcatggtactttatcaccgagactccataaatcctctttgtcatggataggatcaaactgaatttgttagtcattgtagcattcattagtctaacatttcagcatacagcatttaagctgtcctgattcccctggtgtggcttaaagcaaatgacagaaactttgaaaagaatctgtcatttctctcattcaaagcagtttgtgaaacacaatcaattatcctgtcctataaacttggctactttattttgtagctctcagtgtttcactagaatatttgaattaggtaagcagaaaatattttaatgatccccttgtgttttccaaaccattttgttaagaaacaattaacatgaaataaattatgtatattaaatatgaaatttcatgaatttgatatatgtacataatcctgaaaatatgaaatcatcatagtgagcctagatatccccccaaatgtattcttgtctttctgtattgtctttttaccctttgatttctatttacccaccagcaacctacaactaatctactttctgtccctgtgggttagtttgcatcttctataatttctcataagcaaaatcctgaagcatttaaaatttttgcctgacttttttactttgtttttgctatggttttgatatggctctaatatattgataaggatggcctcatgtttattacccttctatgtattactttcttgatgtagcaacaaaatacctgaccaaattctgtgagttgtaagctatgttcctgagaacatacacccattggagaaatagtggaatagtagcataaatgttatgaacataaccaaccactttttgactggctatgaagcccacactattgagaagaagcccattcctgacacctttcatggagacaagaacctcatatggttaggtaggtcattagccttagaggaaagctactactagtatactcctaaatagacatagcattaaaattactcctagtgacttattacagtgcatctctcaaccaagaagcttctttttttttaaaagattattttattttatgttttagtacactgccacttcttcggacaccccaaaagagggcattacatctcataacggatggttgtgagccaccatgggtcaccattggtcacattccttcccccaaagctcaaggaacttcatgaagagggaactcaaaggttagatgagtcagaggtaggggataacaacaaggaagcagatgctaacagaaataacacgcacatgtgaactcacagaagtgatgcagcatgcagaatatatgcagttaccaaccagacaaaaattcaagcatagaaaaggagagcttggcacggatttctattcatggttgaagagctattgacatttgatggctacttggagaaggaatgtctgtttctttcaatggtttaacattttgtatatccattatactccatggcaggtccaatgactggttgtagtcagctatcacaaactatactcattacattataaaacatgagggagtaggagggtaggtaggggagcaccctcagagaagcagggtgatagtgatgggataaggagtttttggaggggaaacagagaaaggagataacatttgaaatgtaaatttaaaaatccaataagtaaatgttgtgtcttgtgtggggagtgctctagggaaaagatctgggagaaatttgaagaaggtaatgagtatgcccaaaatatattgtttgaaattctcagaaaatagtataaagtaattactttaaaaaacaatccaagatggtccattcaatagctgactgtgagcatccacttctgtgtttgctaggccccggcatagtctcacaagggacagctatatctgggtcctttcagcaaaatcttgctagtgtatgcaatggtgtcagcgtttggaagctgatcatgggatggatctctggatatggcaatcactagatggtccatcctttcgtcacacttccaaattttgtctctgtaactccttccatgggtgttttgtttcctattctaagaaggggcaaagtgtccacactttggtcttcattctcttgagtttaatgtgtttagcaagttgtaccttatatcttgggtatcctaagtttctgggctaatatccacttatcagtgagtacatattgtgagagttcctttgtgattgggttacctcactcaggatgatgccctcaataagtggatgctcacagtcagctattgaatggaccacaggacccccaatgaaggagccagagaaagcacccaaagaactaaagggaactgcaaccctataggtggaacaacaatatgaactaaccagtaccccggagctcttgtctctagctgcatatgtatcaaaagatggcctaataggccatcacttgaaagagaggcccgttggacttgcaaactttatatgccccagtacaggggaacgccagggccaaaaagggggagtgggtgggtaggggagtgggggtgggggtgggtatgggggacttttggtatagcattggaaatgtaaatgagctaaatacctaataaaaaatggaaaaaaaataatccaagaatcttaaggaaagccttattttgtgtaaaatccaaggatacactccatcatagcaggcaagccttggcagcttgagtgtcaggaggtagctggcacattatatgcatagccaagaattagtgggagataaatgctctcacttagtgggccacttttccatttcactctgaacaagacacaggccagggtaggtcttctcatttccattaacctactataggcaatgccttagaggcatgcccagatcctatcctaacctaaatagttcctcacaaatgtacctggaactttgcctcttggtcattctaaattctatcagactgacagactatgttagccgtcacagataatggcctcattttgtagcttagtttggcatcaaatttatgatcccttgcttccacagacacagtgtgcaaactgtcgtcatgcaccatgtcaggctttgtttgcttctttaactcaggataattattttcatatttatccactataaatatttaatattatttgctgttgtacgtgtaaataattttgctcccattttatgtctcagtactattcaactatgtggatccatatagttggaatttcttctgttgatggccttttgagttgtttccatatttcacctctcccaaacaagcctgcaacaagcattgaaatatacattattatattcatatgcaatttcttttctctctggtaaatattgatgagtagaacatcctattatattccaagtaaacatttaactagatataaagatctaactaatcctaaaaccaaatttgctctcaacctactttaaaaaccatggtaatgagactgaaatgtaatcatctgcagcgccccaacctggtgtcacactctgtgctccaagaagctataactgcctacgtgtcctctataagccaattggaactgtgaaattaataaggaaaaaggtagaaaacctttgaggtttaatcaatgtgccatcataaggaattgggacaaagatacactcactgactctctcacatccttcatctgtatccagtagtgagggcaaagtatatagagcagacttggtatgttaacatcttagcagtctaggtcaggtgtgtcccataaaccattgacttactcttgtcttgataccactgtaaagcttctagagagaagaatttccattctggatacctactaggcttctcttcccaggacataagattttctgaaaaagtccaatttcttatgtccattggtttagaagtctggtagataagatgacttttaaaaaatatgatcagttaactaggccaattacactattaccacgttttttttgtgttcgcttgtttgtgctagaacaaacctaagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctctggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaactctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggcttttttttggctgggagactattaataactgcttctatttctttaggggatatgggactgtttagaaggtcaacttgatcctgattcaactttggtacctggtatctgtccagaaatttgtccatttcatccaggttttccagttttgttgagtatagccttttgtagaaggatctgatggtgttttggatttcttcaggatctgttgttatgtctcccttttcatttctgattttgttaattaggattttgtccctgtgccctttagtaagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttccttttattctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacgtgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgtatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggacggtggctggctgtccctggcccacacagggtgctgcctcagcgcctctgtgcttccgcctgttccagaagctgtcaggttctctggcgcaccctctcacctgttcagactaatttcctaagttcggcgggtcccggaccaagatggctacctagagtgagattgttacaagtaagcaaattaaaacatctctaagtctatatagttactattttcgtgtttgtaatattgatgcctcaacccctggccataaagcccagttgtaattccaaaaactcacgttaactaagagaaaatgacatgatatatgtgtgtgtgtgtgtgtgtgtgtgtgtgtgtgtgtgtgtgtatcatatatataatcaaattatttacttacacttggatctaaaactagggaaataaacacttcatctgtgttcaccttgcctacagctgttataatttatcaaaaagatgtaataaagccaggaaatctgaatgtatagatttccctatgaagcctaacttcatgagctaggagataggcttattgtctaatgtctgaactttggcagataaacacctttcagtctcaacaatgtcatttattgaaagagtcctcattcccagggtccttattgtagtatgagtacctaaaatatactttattttttaattcatttttattagatattttctttatatacatttcaaatggatgtactttatttttgatgatccaacagcacacggcttttttgttaatcattttacttatgtgccagatgttgcccaccctccaagttgacccttacagagtcattatccccccattacccttccattttcctctgagagggtgcactcccatttccccctaacctgctgcatcacttccctgcaggattagtcacatcctcttccactgaggcaagataagacagcactttgctacataagtgctggaggcctcagaccagcccttggatgctctttggttgatgactctgagagctcccaggtatccagattagttgacactgtccttcttcctatggggttaccattcccttcaattccttcaatccttcacgtaactcttccacggaggtccccaacctcaatccgatgcttggttgtaaatatctgcatcggtctcagtcagctgctggtagagcctctcagaggacaccaatgctagccccctgtctgcaagcataccataacatcaataatagtgtcagggatggattcccgtccaggttggggtggtcactggctggacattccttctgtctctgctccatttttgtccccacatttcttttagacaagagaaaattggggtagaaagttttataggtggtttgatgggagtcctgtctgataactggaggtagtctcttcataatccatatccccactgtttcgcattttgggtaaagtctcccatattgagtcctgggtgcctctcccatcccaggtctctgagactttcttgaggttcctccaacccccactccaggcagctgcatatttctattcattctcctggcctctgggcctttacctgtctcccccatccccatacctgatcctgccccctttcccctcccctttccctctcccacccaggtttctgctccccctatctctcatgattattttgttcccccttctaagtgggatttaagtatcctcactcaggccttccttcttgtttaagttcttagggtctgtggtattcagtacttttggctaatatccacttatcagtgagtatataccatgcatgtcctttggggtctgtgttacctcacccagggtgattgagagacatcaaaaatttagaagataatatactgaataggaggcaacagtctaattcaagagaaaatatatgatataaataatgaggaaaaaaactaaccatgtgtaagagtatatagtaaggttcgaagtgctaccatgagaggtaaaattcctgggattgaggaaattttgagaagacttcatgagaacgctgagacagaatgaatatgcatatgtgtatcaaataccttagagatcaaaacagaagtatcttagatgcttggcaccacagaggcaaacataaagtgtctttgaaaggtgttagtaataatccctcaatagagtgggatgtagtttattcagcagctcctcatgggcattgactcaggttctatcttgacatcttcctcattcatcataaaacaaatgctattggagagctgtggaacatttcagaattcacattgtttgtccttatgagtatgtgtgtgaagctctcacaattatcattaacagtgtcactcctctacatggaattgtacagtagattaatgtagtttaaaatttcagacacacaccaacagaacacaatgtgcaaacttcttcacatgcttagtgagcataatggaaatacacaacgatacctggaagaccacagggaacaataaggatgcaggcaccaaagtgttatgagtagccagaaaattggaccaacacacgtaagaaatgagaaatttttagggccattgaacaccacgtatttgcagtgttcagtagccctgaaaatttctcatttaagccaggaagtccctgtcttgttgaaaatgttgaaataaaggcagcgtgtgtaagttctcattgatcacatctctgctgtagtctaggacctcccactatcttttagggtccccaattctgtttccaggctcttgtcacaaggctatactgcaggcacccctccttttcactctctcaggagctgttactgtaacttctaagcaagttctggtatatgaatacattctaaaaggagatgatccctaaggttaaaattagtgaggaaatagttatcatttgcttagtcccagatcaaatctctttcctgtctttggaatgatgactattttggtctatttacaagtgtgatcagtttgtttaaatttcctctgaacttctatctaatccctctttcatttgacttgatggaattatttgctgggcttctttgatatgggctgttattttacagactactgtttcactgtacttccgagaacatcctttttggcctcagcctgatttttttttttaaactatgttctgggatatttccaggtaggcaatagcagttggctccaagggataagtgtttgtatttcttggtttaaaccctacagggattcactagtatcctttccagtataacgaacagatggagagatcttgaaagggaaataaggcataatcagtacttggaaatgcaaagagaagattaggctgcaggaagcttggttatgttatttatattctctgataaccacatactccaaacctacacttttggaatagtccctctctccctcctataccagaaaaaggccgatgcgccctcagcctgaaactaaaggtcaggtttggatgatgtgtgtttattactttcctatcactagggcctttaaaaagactctctgtggaactttgcaaaggacatgacacagagttgcaaactcactctgctcactgccttgtgtagcagcaaacaattgataaaggtttttcataaagagaaaaggaaattaaaaattggactaatcctttaagaccaggaaaaaccaaggaaggctgcttggttttattttcttgacttgaaattgagtgggtgttcagtgacgctgtgtaggagcacagacacatgaactgatttatttgaaaatgtgatatcattttctcctgaaagcccccaagctgagaaacaaaaaatggtttccagtagtgaaaattatttgtctcatattgaggattgctaattactttctttgtatttcttactagagcctcaaataaaccattgcatgttccctagaaccagtaatggattattaagtggtcaataatagtttttcaattgtgtgaattcattataatggagtcctgtttgtgatagcctgattgtagactgctaattttatgtttactgagtaagcatttacatgattgcctttttacaattaatattttagataatatatgtattaataattttgagattctcactgattacccaggcaacatcaattcttttaaggccctgagacttctaatgataacacaagaacttatttagcttctatgtgtgcttattcatctcaaaacagtttctgtttgaatgttgaccagtaacattttgtcctaagagtctcagaatataattacagaagcatagaacaagttgccttttagatatttatttttaaaattgaattacctgaattttctcaagtgatttattttttaaaactatataaataattaacttttattttatataattcaaaaaggttgtcatgacacaggaattaaaatcagtaatttcattatcatccattattttggaaataatctcttttctttacatgttaagtctccaaatttcaagtcatagctaaaataaccatagttcttgacctcccagtacttgtctagatcatgctgccttgaagattcttggagagttgatgggtagacttttaaagataataaattcttgaacctttcaaaattttagaaatggtaaatctctaaaaatgatgatggagatatcattactgtactgttctagttctgataaatgacttttccagacttgccacctaaaaatcaacatcttcattcagacaaaaagtactgtacatcaatttattcaggacctcaatatttaagtaattaatttcttttcatcaaaacaaatagcctagggtgatcgaatgtatctgaatgtttcaaattagtctgatgatcctcagatagtggatgctcatgtagctgtggaaggctaagcattggtcagcttcatcctattttctatcaaaatttgagtcatttaatgttcctatgaaaacattgagccctagaggatcactaaaatatcatgcatccattaaccttgacggcctcttggcttagatataagtaaaagaatatttcttttcatgttcaactgcttccagatctgagattcttggctccatctgtgaagatggattgacttaaaatcccataagtatcttcattacttttgatatacaattcattacttttgatacacaattccatcagaaaaactatataaaagtgtagtgaaaatataatatatcaactgggcccaaagtatactttattatttctcaaattgttatctcccctggttaatttttaattatcagcatgaaacaaccaaaagtcatcagagaagaaggaatttcaattaagggattactaaaatcagattcttctgtagccctgcctatagggaattatcttgattgctgattgatgtgggagggcactgctcactgttggaagcaccattcctaggcaggtcagcctaggatctataagaaagctacctaagcacaatcctcagactaagtgacccagcaagctccatccttccccccagttcctgcttcaaatgcttatcctgtcttctctgaataatggattgtgaattggaggtgtaatttgagataaaccctttctttctgaagttgttttaggccatggtgtttatcacaatagcagaaaaaaaatcagtatatattcatttacatacttttagacatttagtaattggaaacacgggatgtagattatgatctgcttggtagattgtttactttgtttggattgttaatcctgttgttatacaacaaaattcccttcctttattagaagggattaatattacagttggtttattcacttacctttttagagacagttgcatcatttttacttttcagctattgtgaaaatgaagctccaacacacacacacacataatttgaatgtaaactgaagttataatttctctgtgattggtgtccaggtgtacaacttctctcttggaaagtacaaatctaatcaatggaaaactactagactatttttcaaagtggcatacaattttatttttgacatcagtgtattagacttgtagttactttccacaattattagcacttgatgagtgtgattcttttttaaaaatggctcttgtagtctcatatatttgaatgcttaggcaccagagtgtggaacagtttgcaaggattaaaaagattatggggtgtggacttcttgagtgggagtggccttgttggaacctactgggagtgcattctgagcttgcttttctttctttctttctttctttctttctttctttctttctttctttctttcttatatttattttatttacatttcaaatggtgtcatctttcctagtttcccctccgaaaaccccctacccccactcactaacccccccacatggccctggcattcccctacactagggcatagagccttcacaggaccaagggcttctcctctcattgataatcaactaggccatcctctgctacatatgcagcttgagccatgagttccattatgtgtactttttggttggtgatttagtccctgggagctctggggttactggttagttagttcctcctatgggactgctaatgctttcatctctttggatcctttctctagctccttcattggggaccccatgctcagttagctgagagcatccacccctgtatttgtcaggcactggtagagcctctcggagacagctataacaggcttctgtccgtaagcacttatcccgcaatacctctcctgggcatatatccagaagatgttccaactggtaagaaggacacatgctccactatgttcatagcagccttatttataatagccagaagctggaaagaacccagatgcccctcaacagaggaatggatatagaaaatgtggtacatttacacaatgaagtactactcagctattaaaaagaatgaatttatgaaattcctaggcaaatggatggacctggagggcatcatcctgagtgaggtaacacattcacaaaggaactcacacaatatgtactcactgataagtggatattagcccagaaacttaggatacccaagatataagatacaatttgctaaacgcatgaaactcaagaagaatgaagaccaaagtgtggacactttgccccttctgagaattgggaacaaaacacccatggaaggagttacagagacaaaggttggagctgtgatgaaagaatggaccatctagaaactgccatatccggggttccctcccataatcagcttccaaaagctgacaccattgcatacactagcaagattttgctgaaagggcccagatagagctgtctcttgtgagactatgccggggcctagcaaacacagaagtggatgctcacagtcagctattggatggatcacagggcccccaatggaggagctagaaaaagtaaccaaggagctaaagggaactgcaatcctataggtggaacaacaatatgaactaaccagtatcccccagagctcgtgtctctagctgcatatgaatcagaagagtggaaagagaggcccattgttcgtgcaaacattatatgcctcagtacaggggaatgacagggccaagaagtgggagtgggtgggtgggggagcatgtgggggacttttgggatagcattggaaacgtaaatgaaataaatacccaatttttaaaaagtgtctgggtttggtgattgtatatgggatggatccccaggtggtacagtctctggatggtcattccttcagtctctgctccatactttttgtctataactcctttcatcttgcgcgcgctcaactggccaggaagaacgacgctgcaacaggatccttctgcacacgtttattcagtcctgtttcttcttgtttatatctcccttgtttatatctccctcgaataatcattctccctctgacccgggcctctcactctcatgtactctcagttcccatccacgcacagcaggccacgccacctcaccaggcatgcagcttcagctaatcagggcagcaggggctatctccatcaaatggattcaccagtatcctggtacacctgtgcagctctcaagatgtttgtggcttatatgaggaagtcaggtgcaaatcatacgacttagctacagtccctggcgcctttgggactgccgccacacccgttcctcacacttccatgagtattttgttccccctacttagaaggattgaagtatccacactttggtcttccttcttcttgagttccatgtggtttgtgaattgtatcttgggtattctgatcttctgggctaatatccacttatcagtgagtgcattccatgtgtgttcttttgtgattgtgtacctcactcaagatgatattttctaattccatccatttgcctaagaatttcataaatttattgtttttacgccattgtgtaaatgtaccacattttctgtatctattcctctgttgagggtcatatggtatcacttggagtgagttctgaggtttcctacgcccatgtcagccttaatgtctctctccttttcattgcttgtggatcaaggttatctctctatgaccaaagcctgcctgtcaccatgctccttgacataatgatgatcatctaatcttttgaaagtgaaagcaatttctcaaagaaatgtgttctttgataaaagtatcttggtcatgatgtctcttcacagcaatagaacaccaagtcactaaggggtttcttgtgctgttttagttttggttggttgtttgtgtgtttgtaatcaataccagacaatgtggttgtaccacattgtagttttagtttgtattttcctgataactaagtagtaataatcttttattcctttattagccattcttacatcatttattgtgaaatgtctcctcaaacttattatctgttttaaaaattacacttttactcttctacactcttgaaagagcataaaatatgttttcttgagaataaaaattagaaacatattcatgagactgcagatacccttacttgaccttctctacactatttcattcttgaaatttagtttctcatgttaccagtgtatccatgtaaaccataggtgttctaagagtatacatttatttctcttgcagatagctctttgttaagaacagatctataataaacccagtttaactttatctcctctagggaatgtgcagcattttaggtaacaaggttatatgtgtaaggctaaaaacaaccactaagggtacactgaagtgcttgttaaataatgtatcttatgggaattttaagcagaatgcagacttttgtgtgtttaagaaaatattctgtaatgataacattgacttcaagaaaggaaagtaagacagttcaatgaacatcacttatggtgacaagtaaaatatatcgatctttctctgatccttcatacactctttaactttcctttaacacttcataaaaagaaagctcatgtcttgcttggatctttctgaaagttaggttgtctaacttccttaattgcaatatttatgatttagtttttgctttcaaaatgacataattccaacaaaaaaaaagaaattggttaacctgtgcaagttttgataatcttaagtgatacttactttgaagagaacaaatcaatactcaaatttccttttgagttggaaaatctcttcaacaaaaaatggagtctggctatacatgtcagtgccccccaagggggggaaaaacacgtcttattccagtgtttcattaatctagaatggcaaatggtcctctatttatttgtattttctcatcccttttcaataaatgccatgactctgatattcatatttaaaaatctgtggaaagtcacatctcaagtgctatcacctgagtgaaactaaacatacgctaattttggtgtgagggagaactaagtttcctaattagttcactaaatctatgaaaaaaatatggaggtacttcacagccattcagaacagatattttatttctttgtctccagaattcaagcaggcactacaaaaatctgtggtagtggcatggttgtaaattcactgccctccttcacccatttcagagaaaactctagggcagaaattttcaaactatgtttcctatgatgactataagcctcaccttaaaggccttttaattgcaaactgtaatccaactacataccagctgttttagacattaagccaaagggtaaggtgggagtgaaggtaagcaatctatgttttaacaagcctttcaggtgattctggggcaggcaagtttgagaactggtattcttggggaaggtacaaaatcatgtttaaataactacgtaatgttcttttcttacagctataggctgatgtgtttattagcacatgggtggaggcaccaccattgtaattttcaataaagaatcatactgaaattagcatataactattccaaagtttctaagatttgctttgagtagaatgaacttttaaactttatttcagaaaaaaagcataattcaataagatttagtgtttgataaatgaaaccctacatacatatctttaaaataacatttcttttgacttgacatagattctagtagaaaactgcaattatttttaaaagaaactaatcattgaaatcataaaatagtattctgtgaagtaatctctaactcttcaagggttaattgttattgactttcctcatatgttatagcagacttatttgtctgcaataccagttttgcaaagcacagtcctaggaatataacaaccactaaacaagcattaccattggcttctaaaacctgtatttagtaagctttgtttgcatccaagaaatagttactatgacaaataaattggaattctgaattttctctagtacatggtatacgatcaaacattttctgtattcaaagaattgaattcatgttagagtttgcattttattgatatgtgctatggattagatgcagtcagttaagccctttccgggccaattgacataccctgtctctgatgtcagtctgagaaaatcctatatagtgtactacatcctcagattaacttatcttagaattacatggacatttcagatgatatgtcttggcatatggtcatttttcattaaattattagggattgttaaagcatctttccccttttttgacaccttgccataattgaatataaattgactttaagacagaatgccagatattcatgcagtaggttactggggcttcactggtgtctagcagaaataatgctcacctagggtattgaagccaaataaataaataaataaataaacccagaggtttttgctttttgatgtaggctcgtggaaaaatggcatcagtattctagattttattttctcaactatttatatcttttttggaagatgaacatttaatattcagtatatacttttcctttttcttttcttttaaactccagattttattcccttcctggttcaccctccaactgctccacatcccatatctccttcctactcccccttccccaccccccaaccccaccagacctctaaattccctggggcctccagtctcttgaggcttaggtgcaaaatgacatgattactaagattctgtttaaatttctaaaatttggaaggatagggagaaaatggaaaccatgaagcactgccatggtgcaatacttaaactgtatgattttcttctctggttatgtaaagagcaaaaaataaataaataaaataaataaataaatatcccttaactaagataatgtgctttctctccttatccaccttctcagtctgttctagaactacagccaaccagtttcctaagtcaaccttcttttctgaattatccaaaaagccataacttttttttttctatctctgttctgttgaccctaacactttgagcttcattattctttctctaaagttttcctgctcgccttgtggcagtccctgtaggtttaagtcaaagggcatggcttttttcttcctcctcctcttcttcctcttcctcttctttcttctcctccaggctgtttggtgttatagcttgtgcaccctggaatttgtcatttaagctataatacaagcctcctccagcttcaaaacgaaacaaaataattggcaaaagtatgccttaaactcatttggaaatagtgaaaataacattagttgcttgtaattttagagtttagcatatttgaaaaatctatttgaatgtattgtttttctcagttttatattacttattagattacatataatatatatgacatactcagaaaaacaaatcattttgttattttaagcataggtgtgctgtgtagatcacatatttgttctagaaaagaaattgctttagaggacatctctctacactttatacttattgtattcgcttatttcattatattttgtgcaaccaaaaattgtagctataagctattttgagaatgcatttttcccctagaaccttgtaaggatcaacaggagcataattttaagtatcaggagtgcaaaataagcacagactcctaactacgataaataaaaggccagaattttaactttgcaaaaactcataattactagcaatggggaaggggaaacatgaggatagaaaagtgaaagttaatgggttttttgaatatacttatatatatatatatatttggtctgaacttttttcctttccagagatagaattctgtgaaacacctcctactttgtgctccggctaccacacagacatgcacagtgtttctcgacatggctaccagctggagatgggatctgatgtagatacagagacagaaggagctgcatcacctgaccatgcactcagaatgtggataagaggcatgaaatcagaacacagttcctgtctgtccagtagggccaactctgcactgtccttgaccgacactgatcatgaacggaagtctgatggggaaaatggtaagaaaactacatctgcagttttgctttgctatcacttctggtattggcccatctttcatttagtatgcagagtacaaatacaagatagcagggtcccaggaacaaggagggtacttaagtatctagcaaatagacacatttatttataacgacacaaaatagtcttcatttctggggaaccctcaagagaaattatctcatgtagtcagcaatattgtgaatgtcttattcattactcaccttttattttcatttttattttccagagctaccccagtgggatttattataggaagtactcatttcatgtattttagctttacatcggtgtatgaacaaggagatgaacaattatatagcatgcatattctctgtagggactctctattttgatccaaattaacttgctgagtttataaacagattcacattaaccacattagaatgaaattatttcacaaacacaattattttaaagacaccagtcatttgcctgacaataagtactaacagcaatatcattacgttgtaattatacattatttccttatacattttagaaaatgaaatgttttctctttttgagttttgaggaaagggttggcttattgaatatatgttcttctgcctctaaccaaaaaagtaatttcataatagacacattaaatgaatattaatcaaattaatctagtctatccatcagtttctttgtcaaattttgatatgagttctttatcatccacactcatgctagaatatgtgaattcaactcatttcaaaatgacaaatactgtgttttctctcctttgagcttcctagattttatacaatcacataaaattatgtatgtacatattaaatgaaaatggaaatacatttttttaggggaacaaagggacatagagagctgcattgagggaaaaatggatagtagaaaatatactccatattcaatatatacctgtctgaatagaatttaaatgtaaagatcatattctccgctattggccgatcctccgaactgtttgaaatcactttctgggagacaaaagttcagactctggtcggtgcctgttcctttttccagcatgagtttccattgtttcagtagttgagagtcagattgaaagacacaatatcctctttgtaatatcttcatctctgccaggctgcttataaaccctcacataaagaattacagttaagtacattcagttgaaacatccaccattaaagaattttccattctagactttatcatttttctatctctatatgattgtcaatgggaggtttcttttaggagtgttgaaaattgtagaattaagtaaaattgatttttttaatgactcaatactaccaaatcttggttttaatggaggaatattagggtacatagagtttttttcattaatgctgttaaatatttttaaatactttataaagagttcatgttgaaattttaagaatctcaggcaccatgggcaaagattaattaataaaacatttaatattacaggttttaaattctctcctgtttgttgtgacatggaggctccagctgattcggctcaaggcaagtgtttccaaatattagaaggacaagttgtttttacctcaatcaatcatgacaggtgccccatccacaaatagaccctgacagactgacaaataactcataaggccgaacaatggaattgtcagagattattctagtggtcacatactgccttacttgtctcttttttcacttatgaagagaagcagaggggcaacactcatttgtcttgtcgttgttgttgttttgctgttattttgttttgaatttagaatggctttcgctttaacatggtatctagctgatgctttcataacttcctagtgttctctggcagatgactccaccctttctccagatgcttctaccttggctttgcaatcacattttattcatgtcgtcaattgcaaataactcaaaaaggtcaaaggggaaaaatcatatgattgttcatcattttatgaagtttttctttttgtcactcttcagtaagggggcattgctcattattgatactaactaggaatcacctgtatttaatacttttttggagaaaacttgaggatgtgaatgcttttcttttttcccacaaatgcatgttaattcaaagaaaaaaatcattttcaactcatttaacattgtgtttgcatgcaaatgggagctatttatttcccactgatatcatccattcatgaaagcatgcctagcagggtatctagctcattaactcattaacttgaatttatacattctatatttgaaacataaaaatgcttaaaatattttttatttataggtttcagattccatgccatcttatccctgtgatacaactagtgttggtgacattttattttgtttctgccttcctatactttctgtttttttttcaattattgatgatgctatggacataatattatgtgaaagtttaggataagataagcctcactgctgtgaatgagaaatacaagcttaagtaagggaagttgttaatctgggtgagttatacaaccataaaagaatctaagaagtggcatcaaagatgcttacaattctgtccatcccacaagtagacagtatgacttagtggcactttgtttttctacttggatttcctgaattttgcctaagaagactgatttctttcatttcatccatagaccaagcattaaaaaatattttagtactgctaaccccgttttattgttctaaatctaatttaattctataacatgttacaaaatcttgaatttttgctaaactcaacttcactactggaatatttgaagcaggaagggaaactaacaggtaataaaaataagtatattttataggtttgcacagaactatcagaatatcatttgtttttaaatccttcccacttgtcctaagacaatcctttaacatttattactacttaattttctattaagcaaaaaggcagatttaatttttagcttactcctggtacctgaatgacaatttggtatcatgcttccttcagtatagccttctcactgtccatttcaaacatttgtcatgtgtctaagtcatagagtcctagattttcatacctaccaaaaggggtaggtaagcaccagattagatagaagtgtggtctgtcttattctccattatagcttcaatacctagccacaggatctagagtataattacagagtcaataaatgagaatcacgtcatgttttgagtgaggggattaaagtaagagataaatattttcatgaattatttatgatcttgtgccactctttgaaggatagaaatgctgcattgagtgaggcctatggtcacctaatgtgcaactttgcctctaacaaatgatatcttcatcaatttgtataatatgacaatactattttgtattagtcaatgttctctaaaggaactgagcttatataatgaatatccatctgttatacatgggatttagaattgtatattggctgttatatggctattccaacaaagattatctcttgactcaaaggccagaaatctggtagttagttgttaaccctgtctcagcagtctcaatctggtactggagtcctagagtcctagagagctgtgactcttcagtctatgttggagtcctgaagaagtaggcattaataccagtgaaggaatgcctcagctacagtattagtgaatttaccagtgagacttaaggcaagaagaccaaaatcaaaagcttctttcttccatgtttttttatgtgccctgtcactagaagacatggcctagatttaaggttggtcttcccaactcagatgatccaatcaggaaagcccttcacagttgtgctgaactgtttggattttagttgattctagatgtagtcgagtagaaaactaagattacatgtctcttgtgcaccccttgctaagtttcataccagcacatctccttaattatgcttaatttccaaatggaaacaaaaacactcaggtatttctacaactggtcacatgacatgagctggtatttataacttcttttttctactactctttctgtatttttttcaacctcatcaaccaactcagctaatcttagttcttttctaggaagagtgacccatagttttattcctgaaggatctgtgccctttgtcatcttgcttgaactgagttgttgtagtttcacattaactttaaccacaggacatggtaacaacatgagagaccccactggatctcttgcattccaggtataatctgtctaacctcctttatggagaagtgtagcaatttgtccctggtattctggaccaatcacctcttaacatactgttactcctatcttaacctgttggctaatggtcatcataagtccaaaggagccagttggtaatctgagctctcatcttaatggaatgattgttgtcttctagcaactttgcctctaacaagcacagagcattctccatctggaaccaaaagttctatgtcaggagaaattgtgtttgtgcgaacaggaagcaaaaattttcctactgggtcactaggggtgatagtgaatggaaccatttccatttatactacttcattcctggaccagtgaatcctgggtatgggagaatattactatagattcaaatcatataatatgttttacagaacctgccttcagccttctgagttactgccatctaattaaaactgtctttaaatgtcatctccctttctatgacgtcagctggtttcaggatggtggaaaacataatactagtgatttccattgagagtagatccattataacattactctgcatattaagtgggttttttagtcagaggaaattttgtatagactaccataacagtgactaagacattctgtgagtttgtatatggtaggttttttttttttttcagaaacatcaggtataaaaaaggcaaatctgtaaacaagataagtatcaatttcagtaaggacaaaacattgtcctttccacataggaagtaggccagtgtagttaacctgctacttgataactggctggtcacccttgggaattgtatcatattaggagctcagtgttagtctctgctgttggcagatctggcacttaacagcatctgtaaccagtttacctaggttagtataagtgcatttgttgagcctgtgcacaaattctatttctgctataatagccactctggtaatgggcttagtagaaaataacagtgaatgactgtgaaagactctgcctatcaacaagatgggccatcctatcagtagttttttacctctactgaagtcactttctgacgaacatttacatgaatagacaagcatcttcacattctttgcccatttgaaaagacctagttaagtgcttattcccagggtatttttcctcaccaattttctaatcatgctctttctaaatccctgaccatccaaccaatccattgggtaaaactcatgaatcaaacaacaagacatatggtcatttctccatccaagaaaaatgcattaccttgtataatgcccaaagttctacctacttatgaagatttcccttcactggtgtctttcagggttgtatcagaaggtttgtaaataatgcagctttccgtttctcagtagttctcgcatagcatgcagaaagagaaccatcagttcaaaagtccataattgctaaagagatgattccgtgactaaaagcactacttgctctttcagaggaacctaattcaatgctcaccacccacatggcaacacactactgtctgtaactccagttccagaggactcgacactctcacacagacatacatgcagtcaaaacaccactgcacatgaaataatatttattttaaaaaggccctcattcttcctcagtaaaatgtccataaggaatacttcaagaggccatgggcgcatgattgggagtagaaagaattttaatgggagtaaaaaccataagtatttaggcaacttctttgtataatttgcttgtgccctcaggaactactctggccagatcacatatattccacttccatttgataatagattgctgctgtgtacgtcctaatttataacttatggggttaaataatatctagattactataggcagccccagttgcctgacaccttggtgtctcattatcaaatattcactttacactaaggcccaatagcaggccaaaagctgtctttcaaaagaatagttgtctatagataatggtagagttttgatgctaaatttctagggtttactttgtgattcatctatatagaagtgcaaatgactccaggcaaccttccttgcagccactgataccatcaggtctctggaatcatattgtctcagtagaagtgcagcctatgtctcttgtgagactatgccagggcctaccaaacacagaagtggatgctcacagtcagctattggatggatcacagggcccccaatggaggagctagagaaagtacccaaggagctaaagggatctgcaaccttataggtggaacaacattatgaattaacaagtaccccagagctcttgactctagctgcatatgtatcaaaagatggcctagtcagccatcactggaaagagaggtccattggacttgcaaactttatatgccccagtacaggggccagggccaaaaaatgggagtgagtgggtaggggtgtgggggggggagggtatgggggacttttgggatagcattggaaatgtaaatgaggaaaatacctaataaaaatattttttaaaaagtgcagcctacacagaagtcttggtatactgaagactcttctcctattccagactccatttaaagctggtggctttccaactcactttatatataggatgacataacatattctagtaaggaatatgatgcttctgcagtccaaataagccttccttttgaaggtgggaatggtcagatacaataatgtatactttagttttatatggcatatctatgccccacacagtgggctcctgggaatttccctgaagttctacccttgaaatttgtttggatttatttcccaccctcagaatccatgtgtgttgccaacaagtccaatgtggtgtgtatgtcctgctcttatggtccactcagactaatttatcaatatagtggatcagtgtgatatttttcaggagagacagatgatcaagatcctttcaaactaagttatgacacagtgctggagtgttaatatgcccttgagataaacttgtaaaagagtactgttggccttgccagctgaagggaaattgcttcttgtggtccttatggacaggtatcaagaaaaagacatttgttaaagtagtagctgcataccatgtaccaggagatgtgttaatctgctcaagtaaagatactacatctggtacatcagctgcaattggtgtcgctacttgattaatttttcaatagtcaactgccattctccatgatccatctgtcttctgtgcaatccaaataggagttttaaggggagatgggatacaaactacaacctctgcatctttcaattccttgatagtagtactaacttctgcaagccctcttggaatgtgatattgtcttttgttcactattttccctagtagcaaggacttcagtgacttgcactggctttcatcaaccataataatcctcacaaaaccagtataggaattctgtcaacttctaagtacatataccccaattatacattttagaagtaggtaaacaaccacacaatgcatttttgggattaactgggcctgctgtgagtaagactttagccaaaactctgtcatctgatctccataaacccctacttcaactgattagccacatttgctgttggacctctcccataatcagtgccaattattttcctagaaccagtatcccatagaccctggaaagtctgatcatttcctttcccagtgtggagtggcccatgtaaaagaacatgtgtccctctccagaaggactgaagaaagctaaccttaaagaattgaagaaaactaaccataaatctcttaggtatttaatcaaggcccttcctcagaggacatttgacatcccctcattcaaggtacctaaggtttgcaaataggttcaagtctagaaattgtttcaggagccaagatttcctattgccactatccaatgtagcctttcttggatttgttcaataatgtatctgcttatactaatcatgtaaaacagtaggcttcttcatgattacatttctaaaaacacaatccattattagtcagtgtcagagttccatatgagatttgtgaccataaaaagtactttgcttctgctgcccattatgggtcagaccacttttgacatcgctctacctgggcttccattgccttaacagtgcttattattgcccttggttattcattgttgccacatgaaccctgctactccagtgcccaattataacccattgcgtttaattcaaacaactgagctgtggtatttacaaccccaaaggtctggcacaagaaaggaattaccatagagttctttaagtgtgctggtgcccctttcagcagttttcatgttagaggattagtgaagggctcttctgggccctcccactgtggaggattaggttttgcccagcaaaccttctgtagcttcacagtctcccagaaccttaaaatccctttgtcaagacttaggcaagctgtgtcaaacatcttcatcttcttttcaataggccatcttatgacaaattttggctgtgcaaacttccatactaaacctagaatgtgtagtcagggctctcacatcagaaaactcagtctggtccagttttatatcccaactacaactatcacacagccttaaaacccatttctacatatattacccagaattttgcttcaatgaattagcaaactcactaagttctttagtggtatattacacattttcatggactgtatttcttacctctcttctaagagcatctttatccatgaatgtggttgtaggtctagaagcactattggcagacactgaatgacatcagggttgtcttgcctgccacctccttcacagaaggacatcactgttagttcagcagatagtgaaggattaatttacacaggcaaatatggagaggggaacactgcagtagatgaaagtgaagaagtattctattgtaagggtgaagaattgatcaagtgagctaaatccttcagaataagaaagttcaatgccttcatgttgagataggttgtcccacacctctacatcctcagttttaggatccttacccgtcagtgtacttatttcaccactatcaataacattttatgaggctgggacttgaattttcattgtatgcaaatattcatatactggggacttaggattgattttctataacttgaactctatggttgctgaggacaagattctcttccacagcccacttataaacttttagactatatgtatggatctggagtcaaccaattaattgtgtcactgcattcattcatttgttactgtaccctgagatattagaagttggttaattttatcaaggagttcattttatcctttgccaatttatccagagatgttagaagcaagcaggtagcaccattcttttccttatttttctaccaattgtcaaaagtgttgagtatagagtcactaaatttgctgtttcttgcaatggataggtcaggataatcaaatgaatctatcttgataagtttaataccatggatatttaatgctttccatgctactgagtaaccttcagtaaatataggtattagtggattagaaaattagttccatgaccaagttattattgaagagagcatttttcagcttccatgtgtatgtgtgatttctgttgtttttgttggtatttaagaccagccttagtccatggtgatctgatagggtgcatgggattatttcaatcttcttgtaactgttgacgcctgttttgtggccaattatattttcagttttggacatgaggttctaagaagaatgtatattctttgctttagggtgaaatgttttataaatatctgttagaaccacttggttcataacttgtgttagtttcactgtgtctctgtttagtttatgtttccatgatctgtccattgctgagagtggtgtgttgaagtctcccccactattattgtgtgggatgtgatgtgtcctttgagctttagtaaagtttcttttatgaatgtgggtgcccttgcatttggagcatagatgctcagaattgagaattcatcttggtagattttttttttcctttggtgactatggagtgtccttccttatcttttttgataacttttggctgaaagttgattttgtttaatattataatatctattccagcttgttttttgggaccatttgcttggaaaatatttttccaaacttttactctgaggtagtgtctgcctttgaaactaaactgtatttcctggatgcaacaaaatgctgagtcctgtatgttatgtatgtatatgggcccatatccagtatgttagtctgtcttttggggaaaattgagtccattgatgttaagagatattaagaaaaatggttgttacttcttgttatttttgttgttggaggtggagttatgtttgtgtggctatcttcttttgggtttgttaaaagattactttctggctttttctagggtgtgttttccctccttgtgttggggttttccatctattatcctttgtagggctagatttatggaaagatattgtgtaaatttgattttgtcatggaatatcttcgtttctccatctatggtaattgagagttttgctgggtatagtagcctgggctggcatttgtgttctcttagggtctgtatgacatctgcccaggatcttctagctttcatagtctctggtgagaagtctggtgtaattctgataggtctgcttttatatattacttgacctttttctcttactgattttaatattccttctttttttagtgcatttggtgttctgattattatttgatcagaggaatttattttctggtccagtctactcaatgataacttggtcaaggaagaaataaagaaattacaggcttttgtagaatttaatgaaaatgaagacatatcttaccaaaacttactggacacaatgaaagctgtggcaagaggaaaacacaaagctctaagtgcatccataaagaaactgaagagagcttacagtagcagcttgacagcacacctgaaagctctagatcaaaaagaagcaaatacacccaagaggagtagacgggaggaaataatcaaactcagggctgaaacaaatagaaacaaaaagaactatacaaagtatcaacaaaaccaggagctagttctctgataaaatcaagaagatagatttaacccctagtcaggctaaccagagggcacagagacagtaaccaaaataataaaaccagaagtgaaaatgaggagataacaacgaaatatatctttaaatgttgtttgttcaatattaacagttgaaaatatcaaagtcatgttctacaaaaaaagaaaaaaagaaagattggtattataaaaaaaaagaaaagaaaaaagcaacccagatacttaaaaaatgaggctgatggatttctataaattcaaggccaacctggattattgagtcaactccaagacagccaagacagcatagtaagatcctgcctcaaaaactaacaaacatatttaaccaacccctctcccccccaaaaaaaattcttataattatgttctgtagaatccattctgatattactatctgtactagtcaaggttctataaatggtaaagaactgatagaataagcacccatatattaaaagggatttattagagaagtatgcaggctatggtctctctagtccaacaattgttgctgtctaccaagtgaaggaccaagagcctggtagtaattcggtccatgcagctagtttttttagcaatcccaatctggtgcggagtcccagagaacttctagagagctggcagtcttcagttcacattgaaacccaaataaataggttctaacaccagtaaaggaaggcctctccaaaagggtacatgaatttgcctttgagagggagagcaagcaggctttatactgtcattagtagacccactgaggtatacgtgctgacttgatatttactgctttgaagttgggggctgctttaaatatcaagtgggtaggcttcccaaaagcaatatttgtattactgatcttatcctctggttgtagctaatgagtgttagatacttgaatcaagtagagaaaatgattctatttccatggaatgtagcaatgacactaaaacattcatgattcattttagctgcttttctggacagaaattaagagctggactatatacagagttggttttgttttgttttgttttgttttgttttttcactccagattttattcccctcctggtctgtcctcaaactgttacacatcctgtacctcctctgccctgctgtctcctcaaggatgtccatctaccccctcagacctctaaactccctcgggcctccagtctcttgagggttaggtgcatcctctatgactgaactcagtcagacccagcagtcccctactgtatgtgtgttgaggggcctcatattagctggtgtatgctgtctgtttggtggtccagtgtttgaaagatctcaaaaggtcaggttagttgagactgctggtcttccctcagggtcgtcctcctcctcagcttcttccagcttttccctaattcaaccacaggggttaacaccttctgtctgttggttgggtacaaatatatgcatgtgactctttaagctgcttcttgggtctttcagagtacagtcatgctaggtccctttttttgagtgctttatagcctcattaatagtgttgcgcgggcccaactggccaggaagaacgacactacaacaggatccttctgcacacgtttattcagtcctgtttcttcttgtttatatctccctcgtttatatctcccttgtttatatctcccccgaaccctgggcctctcactcttttatactctcagttcccatccacgcacagcaggccacgccacctcaccaggcatgcatcttaagctaatcagggcagcaggggcatatctccatcaaaatggatttaccggtatcctggtacacctgcgcagctctcaagatgtttgtggcttatatgaggaagtcaggtgcaaatcatacgacttagctgcagtccctggcgcctttgggactgccaccacacctgctcctcacataatagtgtcaggccttagggcctccccttcagctgaatcccactttgggcctgtagctagacttcttttccacaggctcctctccatttccatccctgcaattctttcagaggtaagaattatgggttagaatactgactgtgggatggcaaccccctccctcacttgatgtcctatctttctttttttttttttccatttttttattaggtatttagctcatttacatttccaatgctataccaaaagtcccccatacccacccaaccccactcccctacccacccactcgccctttttggccctggcgttcccctgtactggggcatataaagtttgcgtgtccaatgggcctctctttccagtgatggccgactaggccatcttttgatacatatgcagctagagtcaagagctcccgggtactggttagttcataatgttgttccacctatagggttgcagatccctttagctccttgggttctttctctagctcctccattgggagccctgtgatccatccattagctgactgtgagcatccacttctgtgtttgctagaccctggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgtaactcctgttaaaggtgcactatacaaattccctctcctcaatgtagggcattttatctagggtccctccctttgagtcctgagtctctctcacctcccagatctctggtacattctagaaggtccccccatcctcctacctcctgaggttgcctgtttccattatgtactattagtgagtaccacggatgtcctttgaggtctgacttacctcactcaggataatattttccagttccatccatttgcctgcaaaactcaggatgtcctcattcttaataactgagtagtattccattgtgtaaatcaaccacattttctgtatccattcttctgtcatgggacatctaggttgtttccagcttctggctatcacaaataaggccactatgaacttagtggaacatgtgcccctatggcatcgtgggacatcttttgggtatatgcccaagagtggtatagcttcaggaagatctatttccaatttctaaggaacctccagatttatttccagagtggatgtaccagtttgcaatcccaccagcaatggaggagtgttcctctttctacacatccttgcaaacatgtgttgtcacctgaggttttgatcttagctattctgatgtatggtggaatctctgggccattttgatttgcatttctctgatcactaagctctttgaacatttctttaggtgcttgtcagccatttgagattcctttgttgtgaattctagatttagttttatatcccacttcttgattgggttgtttgtttttttggtggttagcttcttgagttccttatatattttggatattagccctctatcggatgtggggttagtgaagttttttttttccccaatctataggttgccgatttgtcagtttgattgtttcctttgcttactgggtcttattcctttcttttggataaatatttagacactagtcaatctgtacagatatggataaataacatggattcatgttcaaaaataaatgacttaacagttttcctatttagtccctttttgtgattattttctgtttaatatagctcaaattggttttgtcacgtataataaatcctcttaattaattggacattaatatttcccaccagtctagaaatgccttgaggttggggattatacataatattcatttttcaagcatctcttgtagttaatacaaagtttggcagcaagtaattgttcattgggcattttttaatagaagcatcattatcattaaaactataggtaagtataaattctttgtaattcatactttattaaaattaacaaataagatttcttactatttctttctgtttggcttattaacaagcaggtttatttttatatcttatactccatctttggtacttacatttcaaattcctgagtactagccattgaataaataattaacactgcccaaaccccagtttgttgttctatgaaacagatacattaccaatttcatttttgtgtgtgtacagaataaaactttatagtgtgacttctgtaattatatattcagtgcatgttaggtgtgaatagagtttattactattcatttactatgcctaagttgtgggatagaggctatgggtgacatttttattatcaggagttatacaagtagccaatgtggagtatctggcatcctcaagaaattctctatccttgtagagtccatcctaatttctgctcctttcaaaaaaggtaaaaattcttgtgtttctcttactttaactaatatatcattttaatagttgaaaaatatttttctactaagcacagtataactttagaggaaatacagtgatgtgattttaactaaacaaggccattgttatttcccattgacataaagtagacctttaagatagagctggaaacttgtttccttagaagccataatgattttcatcattgttgaacacttaaattctttctatgctatttaacaactttagacaaaggaagatctgactaaattccatcagagccacgaaatttctaacagctccctgttacttctaaacttcacacccagaaactgacgacatagcatgtgcagccaataaatacagtactagcgtagccttgctcatgccattttgagagcctaaattgcttcactggaacatctggagttgtgagacaaaaatgcctaaatgaacacctggaggtctttaaatggtatgtaatacttatgcccaaatgaggagttacccttctgatatctgaccatgtgggatcattcatgcacacttactagaagggatttgtttcttttacatttcttgcctgtgctttccatgttttcccctggtgatataagttatacaggacacttctatagcagtgaaaacagttccttaggaaccatctaaaagttaaaggaagtgtgtgaaacaatacaatgatttggtaatagctttggcaggaaccctaccatataactggcaccctaatggctctgttggaaccattatgcatgtatgaggcagtgcggttgacttttgtaacagctattttagagagttccatggtcggaggaagggtataagtcatttggatgactttatgtgtgagtcagacatttctgtgacaactgagatactcttacaattgaaaaccagtctaacgatattgaacattaagctattgtcaaggtaaatagataaatgcatattttcaaatagaaaaacctttattaatgtatttttttgctaaagtagtatcagctgatggtttaaaattgatactgtaaaacaggattaagtttttttttaaataaactattctcacctttgccctgtagatgccactcgagtgattgccatttccacattatcagtataaaaacagacagaattctgtgaaatgaaaagtcttgtagccttttctagtttagccatcttgcatattatcttctttgttggtcctcagtgataggtgcatgagacctggacacataggtaacacttttctatttagctaggtcattgatacaaatgtaggtgtccatcagtttgtttttccaaaaaaaaactttctgttacttgtttcttacatacacttctttttacatagctgttggataatttcttataattggaaatgattgataggttgtggtaatagccatttaatgtttactaatagctatcaccacatttttccctcaaaaaagaaaagtcagtgtatctttctactaatgcttatgaagagtatctattttctcatattctcatcaaggctggcaatgatgaaaaaaacatttctaatacatattctcctaagatatataaaatgttattatactattatttttcatttatgagtgagcttaggaaacattttatatgctaatgacagattttgcatctcttattctcagttgtttgttaatatgtctgctcatatttctacttataattagtaaggacttaggtaatctaacaacaaagtaaaaagatgcagatatgtaaagataatgtaaatgcttttttttctaattctaaatgtgccattgattttgtattttttatgattgtagtatataagtgtataaaatgttttctaataaaagagcttaaaatttaatgttaagtttcataatttccatatttaacctaaattctttctttttattttattgtgtatttatttcatttacatttccaatgctatcccaaaagtcccccacacgctcccccacccacccactcccacttcttggccctgtcattcccctgtactgaggcatataaagtttgcacgaccaatgggcctctctttccactgatggctgactaggccatcttctgatacatgtgcagctagagacaggagctccagggggtactggttagttcatattgttgttccacctataggattgcagatccctttagctccttggttactttctctagctcctccattgggggccctgtgatccatccaatagctgactgtgagcatccacttctgtgtttgctaggccccggcttagactcacaagagacagctataatagggtcctttcagcaaagtcttgctagtgtatgcaatggtgtcagcatttggaagctgattatgggatggatccccggatatggcagtctctagatggtccatcctttcgtctcagctccaaactttgtctctgtaactccttccatgggtgttttgttcccaattctcagaaggggcaaagtgtccacacttaggtcttcgttcttcttgagtttcatgtgtttagcaaattgtatcctatatcttgggtatcctaagtctctgggctaatatccagttatcagtgagtacatattgtgtgagttcctttgtgattgggttacctcactcaggatgatgccctccaggtccatccatttgcctaggaatttcataaattcattctttttaatagataagtagtactccattgtgtaaatgtcactgatagatcacaatctgcaatttaaaaatcataatacatagtattctatattttatgtggttttaatggaagtatacacacatatatgcatagattaatttgcaaatattaagattaaatgaagaaacaaaattaggcacattcaaaattgtatggctagagcccagtcatcatcagaaagacttcatccgctactcatcaaagaaaattcagacactcacaagtcaaacaataggcagaggtcccagaacccttcagaagttgggaaggaaggattgcaggagcacagcccatagaatcaactaagcaccactcataggagcttacagagactgtcaaggtagtctacatttgtctgtgctagatcctttgtatatgttatggttgtatagcttagtgttcttgtgggattcctaacaggggctgtccatgagatttttgcctacttgtgggaccctttcccccctacttgattgctttgtccagccttgatatgagggtatgtccctagtcttattggaacttttaatgctaagttcagttaatatccccaggaggcatgctgttttctgaagggaaaatgaagggaagtggatctgggagaaagggcaggtgagtagagggaccaggaagagttggcggggggggggtggtaaactgcactcaggatataatatatgagaggaaaatataaaaacaattaattaataattattattacatttgcagagagctaattacttggctaggaggtagaatctggagacagtgggtttttcctctgtacttctgtcccctttaagcttcatattataggctgataatttttagcttatgttattttaaatttatgaaattaatatggtatcacagagaaattaatccaaattacctgttctctggactactttagagcatattcaataatggctgttttcaggggtgttttgaatgtcttaaagtagtatacaaaaattcttttgggtgggaaaatgtataaaaccctccttttgtttagttctcccatctctcactccctttcttatgtgtgtacatgttcgtgtgtgtgtgtgtgtgtaaacaaatgtattaaataatatctttatgtaataatctcttctttggtttaatgttaagctacctgcttgttttgattttgttcataaaatgcaacccacgttcatttgtttccttgaaaaagctgtttttgcagataagtttctacctctcataggaagcagggcatggcagcattataatctagtggacaagcaatgctgctttcctaaattgtctgccaaaattagcagtttcagtacaacaacaaaaaaagacagttgtaaatttcaatgcctccatgtaatatataccatactattttcctttgagaccaacagcatgtatttgtcattttacaattctagcaacatacacataatcatgtttccatgaacaaacacctattatgctaagtggcatattttaagtataatttctgtcattcacacagttgacaccttcaatttttgtggttctattttatggccactatcaactagaaatttgtgcttaaatacttttcatttattttgatgtttgtaaatgcaaaaccagtttttctgaggcaatttaccgtttattttcattgtttctgggaaatgcagtgtatactgaaataaatttatcctctccatgtttatgtggatttggaagatcaaactctgcttatctgtcttgcctggcaatcaccttcacagaatgagccatctttctggccttcacatgagcagagcttaaagttcacaaacatggaatacaaattgattgttcataaataaggcatttttgtgagtaaattatgaaacaagcaagtcaatcaaaattatcaaaaagtttattcatttaagatactttctaaattgatgtgtgactgaattgtctgataatccctttggaaactattgaatattttgtttatgaatatgtaatcatatttttaagaaatagcacatccattgattggttaaaataagattcagttagaattgatcaatctagtcaaagttgtcaagaaatattcctttgcaagacaaactcttggataataaagactaaaactgagttgttatgagatttgatagtcccaaatcatagcaaaatttgagaaaatttccatgaaagttgaaaagtatagaaaatgaaacccaaacattcagccttacaggaattataaacctatgaaatcatgacatcttacatagttataggaagtcaaaaataatgacacttaactatctcaaagtggaaataaataaaaacaataaaataaaacaaccacacaatagtaaaagtcaagggaagggaagattcagacaacagtagttccctggattaagtatttgatataagtatttacttccctcagcaaatatacataaattattttaacatttcactgcttcccttgaagttttgatctctaggctactatatgttcatttgaatactttatttaaggaacaggaagaatttagaaaatgttttcccttttgattctggtgtagtcttagtcctaagttttgacacttgtgtagccagctggattttgtcattttaacggcctcaaccacaataaggtttattaagatgtttctgcttttcaacacatttccaaacagctgtctagatgtacagtcacaaatctgctatattgggcaggcatttggaacactttttatcatgttgtccctaatatatatatatatatatatatgaaaagaaattaacccaaggtaaatcacagcctaaaagtgattttctgataactgtttgcctccaaaatcgggaatggtctttactcacaagaactagaaagaataatttggacatattttcttggaccttatatctttggacccacgagacttaaaataagaaatatcttgctttcctacaagttgagtttcagttgttccagattgaattagtgtaaataaaatagaaagaagggctctagcaaatcaatactgcattggtagtaaactggaaaatactgacaaattatccttttaggccttagcgaggtttaatctaaacatcgttttctcctgacaagatgagagagaagagagtaatttattacccaagcctgatatggatgagaaaagactgcagcttgttcttcactgttatggctccgtccctttttgtgccagttcaatttttgccttgctccagaaaagtcattctccaataatgtttatgagtcttatatcttcaatgccacaccttatcatggtacatttggctacttgtcagcttgtttaagaagaagaatgtcaattgaaaaatgttctcttgagattcaagagtctcttatgtgcatggagaaccttcttaaggtatggtatgcatgaaatttcacagttttagatagtaggagagagcaatacctacaggagtattttatgaaatctggtaatgtttaacatgaataataacccaacccaataacttataatagccaaaacatgagttttaattattggggttatataaaacgggttctagtttcagttccattccaaacttgtaggaggagaatttttattttgaatgaaatatatgttcacactgtttccttcctaatcatgattttatttctccccattctactcttattcatagttataaacatgaagcacaaataagtaaaagatgtagcagaaatattttgtcagctatttgttcatctattcttttaaataaagtagttgtgttaaatgtcacatcttcccagatagatatgataaaatagcatttttaattaatccaagagggacatggacacgagaaaaccaagtacgtgctccaggcaggatcatttctcaaggcactgtattatgaacagtatttaaattactacctatatttattcctcacatttttttaaaacctaaggttttatactattacaattatatctccacagttattataatggtaataaagatatcagcctaaaacacttttgtgttcttggggaatatatgcatatttaatagtaagaaatagttcctatttattgtatcccataccaaagtgaagtctcagtaggtttagttgctcattcaaacttgaaaaatatgtacattgcaaggatcctctaccaacaaggtaaaatgaatgtagaattagtaaatatatttataggatgaggatcttgactgagaaattaagttacacacaatattattgtctcacagtgatatggatttctttgaaaaaacactatctaaaagtacagactttttaagaggtgtacaactgtgacatttaaacataaatgtttcaaacttattctaccatagtcctagacaagtaacacaactttcctctaaatcataatggcatgctgcatatatcaatgaagtaagagaaaagaatcttttggaggattaaaatcaaatatttgctttattacaaacaacaaatgaagtaccatttttctcttgtggaatctcttattatattaaataccttaaaactcccaaaaccaagaaagtttttatgtaggaaaaattggaagaaatgagaaagctaagaataaaagcacacgtggttttaagccacctacttagaagcttgattgcttgtacttagggatgctttgaaaaatatgtatgaattttccccaaacataaaattaaaaattataattcttgtagcattggaagtttgtttctggtcaactaagtcaattagccataataatactaatactttctcccaattgtctagacaatctgttttggtcatctaattcactagttcagattgctaaaaatgaaccacacttagagagataaaaatataagatagtgggaagtatcagacagtgtaagagttctataagagcaagctcatctactgattcctgagagcaatttatttactccaagaattgatatggtatctaaattcatgaggggtcttcatgataaaacgtagaagtggtgtgtttaaaaaaagttgtaaaactgtttattagaatttgtttcaacactggaatttattcaacaaacttttatcaaacacatatcatggacaaaggaatggtgacctaaaaattaatcattaggcatatttccttgactaaatttgaagaatgaaagaagagacagactaaactttgagcaactctacaacttctggcatttatttacttgaagtaaatcacattgaagcaaatctcctttccctcccctactacagaatacatcatttcaaaaaaaaaaaaagcttcatgctgatccataaagtaatcaattatttgtaaataatgtcttggcctggtgtcttctacatgaatctactatgaagaactgattaagtagggtgtataaactatctatctatctatctatctatctatctatctatctctatattttccttccttttctgcggaaatgtatagtatgtacatgccatactgtctatcccttcccctctgtgcactcccaaggcatagaagaagtgataacagaaaaaaaatagatttgaacactgagaagtattcaatgtaaaaatggttctctgttgctgagatgaaagagttgctgtatagtagatgcattttaagtgtgcatatgataaagaaaaatttcacaaaattgtccttaaatttatttatttaattatttaaagtagtcagcatgattttattgaaatgtcttagtaaatggcaccagatctcaaaattctctagtctctaacaccagggcaagcactgcaaggaatgtattcctgtatttagttgacattgtatgttataaagtgcaacacatcaataatcttttctagtctggtcttattaagcctaacctgttctagtctctattttacgctattcagtgttgccttatagtccatgtcattatatcaaacatgctttatatgataccatacatttcttttataatgatatattgggttactatgtggaattaaaaaacaaacacaaaactatgcatagtatatccttgtatttcctttataattttttgataggatgagtattggttgattcccatgaaatgcttctgaacatttgaaaggttcatgctagcatctctgtccttaagcttttattagaaacagaaaaaaaaatgtagatctggatcaccacaatatgaacagctagaggaactgtgctttatacatcaaccttttcttttgggaattgacttccatgtttaaacaagaatacttaaattttttctagaaattcaatgttttgccaattcattttaaggcacggtcagacatcctctaaaattgagagaggactcatgggtcttgccatttgtagtttaaagaaagtctcaggtgataaggtctctctggtgtgacaaataaaaaagaagcaaattaaaatgtgcctgatgggaagaagaggaatatccagaaagatcatttctgatatggcccttctaacttagcttctttataaaagataattggcagtcaaacttaggaaggatagatgtgtctacaagatacaccatcttattatatattacatataattaatatagtctacattattatattatgcattatattatatttaatatgtacttattatatagtgataacttgttaagagaaaccaattcacaccctcttctccaacacccatttatagttgaaagaaaaagacatctctattctcttcccaagaagacttcattgtgttcttttctcctttctcctgccctacatcccaaacacacaaaagctagaaaaaccactcctatacacaaactttcttttctccttgaccttattcatttgtatatttcctcttcccataatctgactttcctgttgtcttggtaactaactgtactaataatcagaaaggaaaaatttatagaatgtaggaatttgaggtacgaacagaaactttaacttcactctgcccaaaatcccctcatttctcttcctgactttcaaaaaactaagttgtgaactgagaaattaagattatgagtcacatggaatgaagggtcaaatgaattctaaagaaaggttcaaagtaatgatagatgaagaacccttcagcttgttgtagttcctttctttattgattcgaacagcattttacagcctgtatttcaagcatagtttatcagaacagccccatcaatcctttgattttgaacattttatgtggggaattgttattgaatgataattttacacaaagcagtatatttaattcatgtcacattaatatatatacatatacatacatatatgtccaaatcacagtgcttagagctgccgattccagattcactacaagggctgctgacaaaggcagtcaacaattaaagaagttactcagcagactttttctgagagaacaaagcttaatttactgggcttggtactcttctgtggccagaagaaaaactatgagctcttttaactcctagggaccagccagaaagagaaaaagagagaaaattcacacacacacacacactgagtggatgaaaaaaaggcagacttcaaaaacttcatacacactaacatgcacgcatgcatatatacatacatacatatatacatatgcacatatatacatgcagacagacctatagacagatgtatacacattcccacatagaatggttagagcaactctcaagcaagcaggttccaagcatttcacacatatgtacatctacataattggtacatgcaagcaagcagggcatgtggagtataacacatgccctgacaagcttcacatgtatacatacatgcagacacataaaccttacacaaacacacatagttggttagtggtagaaacattgttccagtcatgcatcctttattctttcttccatagcatatatattccagcaaaatctttcaaacagtatacaattacagcatggttacggtttagttttcttctggtgaatgattacaaaaaaaactgtgttccccaatacctttacaagaaaaaacattgtgtagttcaggtaatgaaaacaaagtattataaaaatcccatgtacattcagaacctaacaacttgctatggattaacaaagtgtaattaagcaaggtgcttttctcagccagtttctcttactagcaggcagcaatttgtggtcacaaagaaaggagtactaaacttatatataaaaatcaatcatatctatcctaaatcctcaaaatgcatgtttttactcatggcaattcttcataaatcatatcaggaagctaagggcaaaactaagtatatgaaatcaattatcaccagtccagcctcagtgagagtcatgtcagccagtgctcccattgctcttgttctgtgaccccataaacagtccctaagttaactaataagagtatgcctttctgaacttcaaattatcccctaaggtttttacatcagtgccagtagtaaaaacatctcaacctaacttcattaacaactatttttccaaatgtttgctaagggtggtggtcattgttgacaaactatgtctctaaaatcttgctgatttgatcataatcttctccagcagcaatgcctgaaagagatcaagcattattattgtgagtgccagaggtactgcacagtgaggggctggaagccccattagggttttcatacaattcttagattaagagagaggtgagtgtagcaagcagtgtggaactccataaagcatagtcttcaggacatgcggttctcagggccgtgccacacccaggctcatccatgtggctgtgctaacctgtgggatgcattccatgagttctaaagccatttgccattcctcttgcatagcccttggaggcagtgtactaataaatctacttttcttatatgagcaatatcaaccagaaataaatggcctgtgcttccctgcagatgagtcgtctccatgttgatcagggcaaaagtgatcacgacatttatctccacttcctcactttgcttctactgctgctgctctgttcttctcaccagtctacttccactttcatcaaaatcttcacagggtctcacctacccctccccccatcttttagaccttgtcatattttcttgctaatcatatttcacccatgaatatgttgatacctttatattacactgtcttgccaatcaattatggatcagtgttacttggtgtttaccctattctttctctcatcatgctgaatattactcccaaacaaaccatgtatttgattagtgcctatgaaaattcacaataccgaattttatcacaatcttaagactgtttgttgcctttctcccacgatagcttcattcttcccactctgatggggttctggcagaaatacttattctagtcgcataccctcacagagaggtgcttcctaactcatgcagaaaacctaggtctccagtaatgacagttcctcaatttctgccatcccattgttaacatacttgtaatttgcattttattttacaatacattttacagtcagaagtatcgttatcctttttaaatgccaattcttccatgctgttcccacttcctttgaaccttaaattttcaatgttcttttatgtgctctgcaataggccttccattgccttataaatacttcctctgtgatcactccattctcattctttgtgaattgttccctttcacttcttaatttaaatgggacttagatgtgtaaggatttctatgatcatattattgaacagtacagcctcatataccctaactacataattagtagcagctctaatttcttgctttcatttttcagtttggtctttgtcacagtctaatgccactggcttatttttcttagtcatctttttcctttcccagtggaataaatattccacagggcagggatttgcatgtgaatactcattagctgaaactatatttgacatagtataatagaaaaatatttactgaataaaattaatgaatgaactataagttgagtcctattttctactattctaattaagttataaagaatatgcacatcaggactatattctgaatttaacctagcttcagtattagttagtgtgattggttaactacttcattgagaaaaaaatattttttgagctctccaaattttcacactcctctttggcatctcttcatcagtcaagtctactttcaaaaaatacattagtcttctcaagggaactgtctctaagtaaattttcttctatatataaatatttctctgagaaattttatctatatcgtatttcaaaccactgcaatgcattcctaatgtagagcccaagcagcaacttttagctgaagtggcttatctatctgatcatgatctgatcatgtgcatctattagagagtacatagcttcttcacatataacaccaattcaataatcttagttcttcgggatgtcttgtattagtgggaccaacatctactataatttccataccgtatatatttttaaatgttccacggtattccttctctcctgccttcccttgtatgctaagttctcagaaatctatttccaaattccatttctgaagcattcatttttttcctctgtcattcccacttctctttttcatctatacatcctggtttttcacatagggtgtgaggatattcggctacatggttttcatatcttcatgccttcacaaattcaagttttcaatatttaatattgttacctaaaacagtaatacaaattgctctcttgacagttgccatgacttttatactacttgctcagctccaacaagtaatcaaatctagcctagacctgccttcatcatcacaaactctatgggcatactcacttctttatttttcccaaagtacaccaaactttctcaatgtaaaaaaaacatggttaattttaccaaaatgtcagttccctcccccatacttcttggaaaacttctaagaatgtttcaagccaattaaacactagttctacagacattcttcaggtatcctcacagtaagtaatgatgttcaccgatcatcaagcactttgtgtcacacatctctacaaagctatgtgtacattatgtcttagaaatattgtctgatttctatctttttctctagattatgaactagcaggtaagaatgcccaaagtgaggagacagtccacatatttaaaagaataagggtcagtgttggataggagaggataggcacaatatgactgaaatgaactaagaagaataaaagcaaactatatttgcttcttgagtatgagtatggacagttaaaatttaatgagaatgtggcagtgacaggtgaatgttcatttgaaaataaagtagcaaaggattaatatttcacttgaagatcatattttgggataatatttttaaaaatcagactgtaccacattgtaggcattggtactggcagatctgaacttgatagtaggttcccctttgttatcaagttattattctattattctgatatatatatatatatatatatatatatatatatatatgtgtgtgtgtgtgtgtgtgtgtgtgtgtgtgtgtgtgtgtgtgtgtattcatgtatatatcctggtccttagacaatagacagttttgacctatcatccatgcttttacatgtattctcatcctaaaattaccacatctacagtaaaagtgttctgatgtccacagagaatgcacctatttatactcttctgcttagatcaatttaaaggattgctcttggaatctgctcagttcctttagatcataaggtccagtttagagaatgttctgattctgatagataaacagtaaaaaagatagaatataatttgaattgcagaatttgtttgttgaaatgtggcaccaagtttcacctattaaagtgaagagagataagagcaacttgcatgtgcttctgcagcttgagcagccagttgtatctgtagcaccctaagtcctttttgctctctggttgtctctttattcagaagtttacattaattaaacgtggctctcctagtgtttgaatggcaatttaaacgcctgtggtaagaaaaatcacaacctataaaatcagccaacatgcacattctaagagtcaacacagttggtagtgatatttcctaatgtctctttgtcacactgttctcgctttttctgtactgtttcttttctaattattatctgttgagattagtggtttgccctttgatttctggcatggcacactgtacaaatgttttgtggtgggactttaatttgttcatgatgacactgcttctgcctttgcccgtgggaaaaataaaattgagtcattcttcctctggccttcttcagctacatatcctgtcagtatgatgtttatctcaacttgcctatcgatgatcacattgattgtggtgtattctagtgtgaatcgttgtgcttctggctttttagttttgtagagtttatgtcccttaaaagaaagcctgtatgaactttaaaaagtcactgaggagattataaggaataggacttcccctaacattagaactactaatatactaaggaataattcaaaaaggaagttgtgtgaatgctggaatataaattctatgtgatgatcaaccacattctagcaaagccaactaactgaagtttctttgttttttttttctttttattgtttgtttgtttattttgttttgtttgtctctgaagaaaaagagtgctgtaatatataatatattgggcaagaagaaaagtaactttttaaagtactacctttgcatgaatggctagtctttcaacttctcctcagtgatttttattagatatttttttatttacatttcaaatgctatcccctttcctagtttcccctctgaaaaacccctatcccctccctccttcacctgttccccaacccacccacacccattcccaatcctggcatccccctacactggggcatagaaccttcacaggacctagggcctctcctcccattgatgactgactaggccatcctcagctacatatacatctagagccacatgtcccaccatgtgttttctttggttggtggtttagttccaaggagctgtgggtgtactagttagctcatattaatgttcctcctatggggcttcagacatcttcagctccttggatacttttttagctccttcattggggaccttgtgctctgtccaatggatgactgtgagcatccacttctgtatatgccaggcacaggcaaaggccctaggaagacagttatatcaggctcctgtcagcaggctcttgttggcgtctgccattgtgtctgggtttagtggttgtttatgggatggatccccaagtggaacagtttcttcatggtcattccttcagactctgctctgaacttttcctttgtaaccccttccatgggtattttgttcccccttctaagaaggattctgagcttctgggctaatatccacttatcagtgaatgcacaccatgtgtgttcttttgtaattgggttacctcactcaagatgatatcctccagaaaagcaaataatcctatttaaaaatggggtacagagctaaacaaagaattctcaactggggaatactgaatggctgagaagcacctaaaaaatgttcagcacccttaatcatcagggaaatgcaaatcaaaccaaccctgtgattccacctcacaccagtcagaatggctaagatcaaaaactcaggtgacagtagatgctggcaaggatgtggagaaagaggaacactcactcctccattgctggtgggattgtaagttggtacaacaactctggaaatcagttggcagtccctcagaaaattggacatagttctacaggaacatccagcaataccactcttgtacatatacccagaagatgtcccaacatgtgataaggacacatgctctactatgttcatagcagccttatttataatagccagaagctggaaagaacccagatgtccctcaacagaaaaatggatacagaaaatatggtgcatttacacaatggattactacttagctattaaaaacaatgagtttatgaaattatcatcagtgatttttaaagtgttatcaggaatggcattgagatttcaaacatttatatttcttattttttcagtttttacaacctcttacgcacagcctctgactattaatcctgacttatctacatagtggactgtccatgtttatgatattttgtagccccttatatttacagcaaatttatataaggctagtgcacaagaggttagtgacagccatgtaagatgaaagatagttccttgtatatatttgctggagttacagcatgaggccagttacaaataaagccaattacatactttctcctttcttccataaaagagtataacattagataaatatatgaattaagaatttagtatttttgtatattaaattactacaggtttaagaagttaaaacatcatttattattcttcagttactctaagttcagttactctaactctaagttttaagggtctgagcacataaaactgagttctctgcttgtagtttcaactaggatgaaatgatgataacaactgggactgggctttttcctcatgattctcattaatgtgtctatggctggtgacagaattcgatccatttgattataataccaaatgcctgttttcttcctgccattagcctgttgtcactatcaggtgttagaagtagctctctagtctacgctatatgatattctgcatatgttcactcatagcatggcatatacttcaaagtcagcatttctgacataggcagaacagaggtagatacagactgacataggcaaattcatacagataacaggataagagagacagaaacaaagacaggctaaaaaaagaagctaacaaagataagagagaggaaaggaaggtgggtagaattcattatttgctaagaaaaattaatcatgtagatatatagaataatatccatgaataatgtcttttgccatttatgattaattatgagtgaataacacatcacctctacccataaagtaacaattgtataatggcataaacaaggaactatctgaggacccatgagtttcagtcctcaaagaaataagacacaattcactagcgtgaaacctacatggtatgatgagaattattcttttgatagttacttaagatgcataagtgaacaaaatatcaaatggttcatattttattttcctaagtgtatactttaaaaagtaacttttcagattattgaaggagcctctcactttaaaaaaaagttgtcctagtaattcataatcaaaacttagtataaaaacaattatagacctgtctaaaatagaactgtcctttctgctcaactctaacctgccatagcacgttactctattcagaagttatcagatgaaacactgtacttcttttatattttaataatgaaaatgaaattatactctaaaggatgctctatagctatgcttttcagaccatgctttgggcgggcacttctacatcactttttgtagttcccagtacattccttgataattctctatttgtatggaccattgaatgaatcttaaattatttttactttaataaattttatgtacatatgtatttatgtacctgtgacgattatcttgtacaaatactttcccttaaaatagaactcacaagtagaaagatatacacaattattattttgatagaaaattaagatactggtaaaatatcctccacaaatgatttatattttaaaacttcctgacaatattatggatgaggttttttttttcccctatattttcatctctaaaatgctttactgctagaaacccagtggggagacaaaatagtagttagtaaacacaataatgaaagagagaaaagaaagagacagaaagagaaaaaaagagagacagaaacagagagatagagagccacagagagattcacggagagaacaagagagcaaacacactggaaagcatggaaatggtagtgtccatttaggtgaacacagaaaatttaccttttttaagtgtttgaaaaaaaaaaaaacactttcaaagggataccgtttctcatgctatataaaattagagcattctttctaattcagcacacacttacataatgtagaggaaaggaataagtttgagaaagtcaacagcatgtttagagaatgaacattctagaactcttaaaaaatatcatggaatgctagtaatgcatgttattaattcaatgactctaagagtccttcttcaaagccatctctaaatcacctatgattacatagaggcctcttaaaacaagtaaaatggatctataaactaggttgtgtactagagtactaaaaagctatcatataagagatatcacataaaaatgtcaaaatttgtagctacccttcccccaaaagaaagagaattcctttgctaatatataataatgtcaaatgctatttttggatggcatttctggaactccatggagattttttttaattttatgattataaaaattactcagaatctcaaggctgatatccaagcatcatgatttgttcacacccacatatcttgtccatcctgtgaaactaattatgaatgctataaaaaatactcaattttctccaatttctgattcctatatcccttctagtttttctcttttgaaagagaatacataaggagacgacaacaatcaaataaaccttactcaatgctttctgtaatgcacagaccctttcgtttaattatgtctacaatttgtggatcaatcatgtaaagtggaaatcttggcttagtccaattggtttaatcaccctgaattacaactctagtgaagaaattacagtcaccctgtgcttctaatgcttaaagttgctgatgatccaatgttgtctaagaatattttaaaggactattttgtgcataagcaactttcccagcaaaggttaaacaaaatgtatactatttcttatgtttataagtaaatcattatttgaagtatgtttgatctcccaggttattttctagtagatgtctactttcagactatatttaaacaaacaaacaaacaaaaacagaataaatgtgtttaggagcttcatttaccatttctcttcttgttgattggtaatatcagtattttcatttaataatgaaatgtctgttcaaatatgtttaacacaaagctctccaaatttatttatactgagaattcttttagttattaacactagccttctctcatatcaggattcgatatgttgcccttaccagtagcagtgtcaaactctacacagtttctttcagcatctaccatggtgatttcacatcatcactttcaactcgtttcttgaaattaatttattctacaacctcagttatatttcaaaaatttaaatatattgagctggcaagctataggcagatgtacttataaacacataccatgaacgtttaataatttaaagacagtggatttaattatgtaatgtgtaggggaatacaattctcaataaccatatctctcttttcaaaaggttattttattcatggttaataaaatgcaaccctcagaagatagaatttgataaaccctcttctttgaattaatttattgtcctgttatcattgttaactgtgtttatgaaagataatctaaggatatcacaggaattagataaagaagtgctctgaagtcaccttcatccgggtgatggactgaaaactgtgattgaaaattgtagccaacttaaggaaaaacaaaataaaaaaggaaatcactgtcgcatagaagtatagttttggaggttgaacccttataaatcgtattgatacgaaacctgcacctgagccacagtgaatcatgccacttggattatatttaatggcaattggaaatatccttgttccttatgtttttattgtatggcactgttttgtggctcaccacagaaagtcaagtttattgggaaataaattttcagagtttcatatgttgtctttaaggaaacagtagtcaccacctgccacttgacacccactgatgtcatttttcttcccaatcaaaaaagcaggtcagcaatttcctagcaggacaacagtactaaaggattcttttcccttctgcgttgtcttgtgggtaggacttacacttagtaggacacagggcatatatttttaaatgtactaagctattttctctatgaaagaaaaagaacatatatacatattacttttttaaggtttgaagcacagagttgagtgtatatttacataaaatttttgttacttgtagaaattgtataatcattttgctttacctggaacattctactctcatttcccttcacctactcatgctgatcctcactattctactctatacctttacgaatcctttagatccagatttcattctactttctccaggatgttggcaacacatgcttccatgtacatgttccatgttccaaaaacagcttgtaggcaacatacattatacaaatgacatatgtcctagggtgttttccttgctcaacttgaagttcccaactctatcttgtgatcaatagtatcatcacctatgatattcaaggcaaagtaaacaactctatgtttcttatgtcagactaaagaatttgtgtgatgctctgaatataggacgttcatacagcagagaaaataatgtgacataatgtaatgttcctacaaataaatacgacctaaatgttgtattaatgaatacattaattaatgtattcattaataaattaatacagccaaagtagagtcccttagatgctacatgtcactaggtactgcaagagttatccacaaaacctgtaacaccttagaaatataaaatctgactatcacgatcattcagtgggtaaaacacctgcttcacaagcttctgtacctgggttcgaatccccagaattcatgtaaagcatgagagggaggcaaggagggagggagaagacatagacacaaagggagacaaaaagacacagcaagacagagaaatacaaaatctattcccacccaagatcctgagtttgaataaagctttgccatgattcccagatgatttggggagtattaaatgtgaatacgcagtgctccaagtgaattgtgtcttgtactctatctttgtgaagtagtgaaaaggataaaaaatgggatcctgtgaaaaatgttcccattagtatctattgatactgccattattccagtcatttctatgcagtctctttcaaaaatgactggttcacagtagacgtcctggtattctgtctcttccaaccccctcttttgcaatgttccctgatccacacatgtaagatctttaatatagatacacctattagaattcatctcccccaaatctgccaatctctgcattgtatccaattgtgtgtttctctgatgttctccactgctataaatagaggtttctatgacaagtatgctcactacactgtcctgtgggtataaggataaaatttgaaatgtagtaaggaattatgcgggtctagtaaaataaacccagtacattcttttctaagattcatgacattagtagccatacaaatctgattagtattttagtaatgattgctgggagaagaattagctttccccagagataacccccccaatagttgccaaatacagagtggtcatccctgaaaatatatacacccaaacagcaaaaatggactatgcaagttactgttgagttttgaacccaagaataaacagatgacattcagaagatgaccttgtcaggcatcactgagaaaagaagccttggtcttgtgaaggctgatgccccagtgtaggggaatgccagggtggtgaggtggttgggggagtatcctcataggagcagggggagggggatgagatggggagtttgtggaggggaatcagggaagggggataacatttgaaatgtaaataaagaaaatatccaatacatacatacatacatacatacatacatacatacataaacaaacagatgacgttttcatattacacattccaatgcaggccttgtttctggttttcccagctgccctcagtctatacctggcataacccactctctaccctgaactttccaacttaggaggtagggtgcccttccaccagggccacttctatttataacacattttggtctccctctcccttagctctcttttctttccctctctcttcacatgcacgcactttctttctcttgcccctcgcttctgtttcccactccatggcaacttccctggactcattccttgggaccagttaactcaacctgcctgagagcacatgcccaataatcctgcttatatatactctaatctggcttgaattggctcattcttaccagccagagaaataacttatcagttgtatttatatattcatacatacacataaatatctgtgtgtgtgtgtgtgtaacaatactaatcagaaagaaaatgagtctatcaccttgagtgtggcaaaaaatattggaggggttggagtgagggtacccagaagaggctagagggagaaagggatgggggagaggtgtgacatacttttattttaattaaaaacattggtcattaaaatgcattaaacaaggagagggaattagcttatatttatctgacataatattactatttcagaatctccagcccatccaacatagtattactatcttagaatctcaagtctaaaatgaatcaaagtgctgagatttttgagattttatattatctaatggttataagcaatttcaccgcattaatatatctgtctcacatgcatgtgtggtgtctgtgaacgccagaagacagcatcagaagacatgcacctggagatacagatgattataaactgtcaagtaggttctggaaacgaaacctggccctctgcctgagccccaaaacattattttaaaattaagataaaatgtacttttaaaaatttataataaataaatttacatctatatttacaacacctcttcaagtatacagtgacactataatagtagtggactctaccagtcaccttaccgtttgtcatacacagattttttttttttagaacacagcctcagagattctaaattataaagatatcttgtgaagtccatggttctgccatttattgagctgcatagatcttgatacaggtttctgttgaaactaatttttaaaaaaaaagttgtatttgacaatatggggggaagatgcaatataaatgtgttaaaatgagcactatcttgatcagacctgtagtcagcttgctaaatgtccaaaatcaactggtatgtaacttatactcgcaggacctgataaagaacatggcttgccttaagtaaaattttatttatatttaccaaagatttactattggtgacattattgtcaacacgaattattggttctagagaaggaactatagttaaaagccttagctctcctagagtctttcactggatatactcaaaacagaacataaagctggtcagcctttccccttgaatactctcattctattcaacagcacagtccatcaaaaccaagataatagtacctttctcttcacaatccattgagtgttggctatcctgagcattttaaatgcttgagaataaatttggtccattttgctcctattgtcaggcagcagataatgaggttaagtaattaggtacattggaaatgatcatctagaatttatattgaaatactaagatgctataaacataaaaatacttattgttgtaccttggaaaaatatttcctaatgtaacttagaaaacagattatataagcctgttatggcactaaaagtcattttcctagttctaagtaacgattccactgagcactgcattggaacaggatttcttttcaatgagctcagtatctagagagaagcttatgagagctattgggtgcataatgtgtttccccaagaacagaacaagaaatctgagttgacaaagatgaattttttaattctactttgcctgttaatagtaattaaacatttaatgcttattctgttccttgtgtcactatgtcatcccaggaggagagaagcataaaatagagattctcaaagaatttaaacaccactacaaaatgaaaacaagagtcctactaagcaaggtagacatagtaatggatgacccacaagtaccaagtggccctgttttgagaggcaagataactattaagaactgttaaatcaactgatgttttataggcaacaaatagagtcaagtttagtcacctcctttaaagcaagagtgatttttgctgaaagtgctaaaaatatgtgaattgcatcccatgtactgcttccatatttcatgaaataggagaaaataaattcatcagttttactcaaagtcatgcattgtgaaagatacttgaagaaccatcaacaattttgtgaaatgaggcaaagatggcagaaaggcagaagtggtaaaaggaataaggggatcaaggaggaaacagcagtgaactatagttaatttacttgtagattctaaatggagtggaaaaccaaattccttatcctcttaagcactgaaagcatttcaaaggccaggcagaacaactggctctaggagagaagggagggaggggaggctgcagccaggaggtatgctgtgaaagaggaatgaaaaaggaaccaataacaaggggcaactggttctcaagaagcagagtgtttggtaaacctgtttagcaaggtaatgaacttgttcagggcctggaaatgtagatgacaacacacattgaattaaaaacatcgtttcatttggaaaacaaaacagtacttcaaggtaaaaacaaagagggctgtttattaaaggtgctatgtaattgcaggatagcaattggaatgcctaccataatttatttctctcaagttttgatgaggagaaaactgataaccccaaatgagacaatccatacattttaagtttttattactatgggaatctgcatggttgacagaaaaaaaagtttagctatcacataataagtaatacaatttcaggaattgtaccacttactacaggaaaatcttttttttttaatacatttttttatttattacgtattttcctcaattacatttccaatgctatcccaaaagccccccataccctcccccccacttccctgcccacccattcccatttttttggccctggcgttcccctgtactggggcatataaagtttgtgtgtccaatgggcctctctttccagtgatggccaactaggccaacttttgatacatatgtagctagagtcaagacctctggggtactggttagttcataatgttgttgcacctacagggttgtagatctctttagctccttggatactttctctagctcctccattgggggccctgtgatccatccaatagctgactgtgagcatccacttatgtgtttgctaggccccggcctagtctcagaagagacagctatatctgggtcctttcagcaaaatcttgctagtgtatgcaatggtgtcagcgtttggaagctgattatggggtggatccctagatatggcagtctctagatggttcatccttttgtcacggctccaaactttgtctctgtaacttcttccatgggtgttttgttcccaattcgaagaagtgtccacactttggtcttcattcttctagagtttcatgcatttggcaaattgtatcttatatcttgggtatcctaagttttgggctaatatccacttatcagtgagtacatattgtgtgagttcctttgtgattgggttacctcgctcagagtcggctgacacccgccagctacccacaacacccgccacaggaaaatctttttttttttttgttagaaaacagtatgtttattggttattcatattttatatcctttttaaattattttttattttttattaggtattttcctcatttacattttcaatgctatcccaaaggtcccccatacccacccgcccaatcccctacccacccactccccctttttggccctggcgttcccatgtactggggtatataaagtttgcaagtccaatgggcctctctttgcagtgatggccaactaggccatcttttgatacatatgcagctaaagacaagagctcccgggtactggttagttcatattgttgttccacctatagggttgcagttcccaatagctccttgggtaattactctagctcctccattaggggctgtgtgacccatccaatagctgactgtgatcatccacttctgtgtttgctaggccccagcatagtctcacaagagagagctataactgggtcctttcagcgaaatcttgctagtgtatgcaatggtgtcagcatttggaagctgattatgggatggatccctaatggaatgactgtaagtgattgtgtcaagattctgtacagtttgatagacccaaggaaaatatgggtttttttttgggggggggatatagttccttggtgttctggcctctgtcctagaaatcttgataattagttgagtgaaaagagaatgctatagaataggttttgtccttttgtaaattaatgtatagaaaccctattcttggatatggaaatgtgggacattttgtgggttattacatttaggtgaggtttttgtgattttggtggaagtgggttgttgaagtgtcccatgattaatgtgtggagtttgatatgtgatttaagctttagtaatgtatattttatgaatgtgggtgcacttgcatttggggtatagatgttcagaactgagacatcattgtgatgtattttttcttgattaatatggcatgtccttctccacatttatttcaaggtgaatcatactttttgttgatcaaaatagcaacatagataccatgcaaaaattattaccatactcaaatcatcttccctacacccacacagatgtccataagtgtgccttattaatctactagctgtctgtcaattcaatcaaaattaacaatcagaacaaagggtataaatattgcaggattttacataacctttggcaagtctcagtatcaagataatgttatcattataatgtgtcttattcagtaaacagaaaactgtttgggagtctccatggtaaataaaatatgtagtaatacacacacacacacacgagtatgtgtgtgtgtgtgtgtgtgtatgagagagagagagagagagagagagagagagagagagagagagagagagagagagaacgctagattactcacctgcttgccaagataggtcataacccatgctctgcatgcatagcttttgagaagccttaggctaccagaaatggtacaaaaagcaattgttcatgattggtactcctttgtgctaacttttgtccactctttcttaataacagggaacacatgttgcttgctgaggaaggctttttgcttcataggagtccttgctttcatgtacagaatccaaactccctcaatattgtagctgagtttagttttagtttaaactctattgctaatttatttcagcctctattttttactttcttgaaccaaaaggacaaaaggcaccgtgctcctccccccacccaccccccctctctctctctctctgtatgtgtgtgcgtatgcattttgtatcaaccaagaaacatatggggggactttctccacccatcttaggtaatggttagagacatgtaataatttctatttactcattttttccttgcagatattttgcatacatatgtacacacacacacacacacacacacacacacacacacacacatgaatgacagggttttactcttctgagctctcaggtacaaaatctctggaggtaattttgagcacagaaaaatcttttccatggtaaccatgtacctattttgatcaacaaaaagtgtaaattaaatttaaataagtacagcaaatcatattctaacagtactcctgtcctgctctagaaaattaaatgttaaagtggcatgttcacttcaccataacatattattacctaactaaaattataatgtatagccatgcattataaaactataataaggataattatttattagaaaattatatgcgtgtctgtgcatgtataaataaatagccaagcattcttgatctcctttgtcaaattgtattgttattaatcctctagattttcacttggggtcatcaaataggcaattacactctgattagcacatgttgtgatgttttagaatgcagaacatttcaaaaacattatatgtacttgctgaattaagaaaattttaaaccatatggtatcccctgtcttttaatcttgtacagttgtacatcattgtgaacttaagagtctagtcctattaaccatatttaatattcattgtcaacttaaatgagtttagaatcaccatggaaatacccacttgggtatacttgtgataatgtttccagatatatttaactgaggagataaaaacccatccatggtccaagtttgtgcactgaataaatgagcaaagccaactgagcaataatgttcttcaattcattccattactcctttctccttcttgactgtaaagaccaactgaggatcattctcacattcttgcatccatgatttccccatcactatgggctgttctcttcaactgagaacaaaatgaacccttccttccataaatcactttgctcatagcagttttgtcacagcaacaagaaaaactaatgttccgtttaaactaatttatactcctaatttttattgagatctttttattttgttgttcgaagcaggatcttaccaagattagctcctaatttgtaatgctctcttttcagcctcctctgtaactgggattacacactaccatgcctggctaatgaagattgttctgttattcttataactttcttatttgtgatgctgagaattaactagtgcttagtgcatgctacagcaatgctttttcactgaactacatactcagtcattgatttattctgagttaaataaatgtctgatttttaaagtttcttccatgtttattactgatcatcagtgtgaattataatacttcataatattatagactcaaaatactcattattaacaggtcagtctgcatactttctcaaatagcattttgttgggaatctcaaagggaagtacagattccagtagcattattattattcataagggtgttctgtagcaccttataatcatataatagtatgcatcaagaacagaagtatattttaaaagtagtatctgttggtcaatatgttaaccttatttgaacgatttaaggaaagaggttctgagaggtcaaaccacatgtccagcttatacgaagttattgccagagattgaattctcaaggctgcgatcccatactctatccactcctgtcactcagctctcagccatcaaggatttactataatcagaactaaaaacagcaggaccttcttcacttgtgatgtaccaaagagataaggtccaatcacttgacagaatggattgaggttgattggatctgaatgacataggccagatgatttaaaagactgttttattttgtccatacctgaagcagctgctgaagtactttatttagaaaaaaaagttgcaaaaagatatttattgaattttcctgtttcaaatatggcactttaatgtctagctgataatattttttatttgatgaacagagctaaaaatgatcctaatcaacatcaacaactttccttcataattttgtatattgtggtactctgttttattacacacacaccccacacacacattaacaaaagcaccttcgtttttgtctgtatgaagcctttcaaacatagctcccaaagtagagagagcatgacatttttgttcctataactagaattaaatttatgtcaccattttgccatgtttagttcatatacactttttgctttgcttttcaaactttatgattttttttgtgctaatgaaacaaaatgtttaacaactgatagagattttctcctcccctaccattttagttccagagttagctattatctggaagctgcatttgtttaacgtggttggtatgtagatggaaagcctgtcttttcatctaatggtaaaaatctctccatgtagccagatgactgatcattttctcaaagtttaacaaggtgattatttctcaaacatgtcagaaacatcactggcggagactgcggtacatagggaagcaggctacccgggcctgatctggggcacaagtcccttccactcaactcgagccccgggctaccttgccagcagagtcttgcccaacacccgcaagggcccacacgggactccccacgggatcctaagacctctggtgagtggaacatagcgcctgccccaatccaatcgcgtggaacctgagactgcggtacatagggaagcaggctacccgggcctgatctggggcacaagtcctttcagctcgagtcgagccctgggctaccttgccagcagagtcttgcccaacacccccaagggcccacacgggaccccccacgggatcctaagacctctggtgagtggaacacagcgcctgccccaatccaatcacgcggaacctgagactgcggtacatagggaagcaggctacccgggcctgatctggggcacaagtcccttccactccactcgagccccgggctaccttgccagcggagtcgcctgacacccgcaagggcccagacaggattccacaggagatcctaagacctctagtgagtggaacacaacttctgccaggagtctggttcgaacaccagatatctgggtacctgccctgcaagaagagagcttgcctgcagagaatactctgcccactgaaactaaggagagtgctaccctccaggtctgcttatagaggctaacagagtcacctgaagaacaagctcttaacagtgacaactaaaacagctagcttcagagattaccagatggcgaaaggcaaacgtaagaatcctactaacaaaaagcaagaccactcaccatcatcagaacgcagcactcccaccctacctagtcctgggcaccccaacacaaccgaaaatctagacacagatttaaaaacatttctcatgatgatgatagaggacatcaagaaggactttcataagtcacttaaagaattacaggagagcactgctaaagagttacaggcccttaaagaaaagcaggaaaacacagccaaacaggtagaaatcattaaagaaaaacaggaaaacacatccaaacaggtgatggaaatgaacaaaaccatactagaactaaaaggggaagtagacacaatagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcctaactcaaaacatccaggtaatccaggacacaatgagaagaccaaacctacggataataggaattgatgagaatgaagattttcaacttaaagggccagctaatatcttcaacaaaataatagaagaaaacttcccaaacataaaaaaagagatgcccatgatcatacaagaagcctacagaactccaaacagactggaccagaaaagaaattcctcccgacacataataatcagaacaacaaatgcactaaataaagatagaatattaaaagcagtaagggagaaaggtcaagtaacatataaaggaaggcctatcagaattacaccagacttttcaccagagactatgaaagccagaagagcctggatagatgttatacagacactaagagaacacaaatgccagcccaggctactatacccggccaaactctcaattaccatagatggagaaatcaaagtattccacgacaaaaacaaattcacacaatatctttccatgaatccagcccttcaaaggataataacagaaaagaagcaatacaaggacggaaatcacgccctagaacaaccaagaagtaatcattcaacaaaccaaaaagaagacagccacaagaacagaatgccaactctaacaacaaaaataaaaggaagcaacaattacttttccttaatgtctcttcatatcaatggactcaattccccaataaaaagacatagactaacagactggctacacaaacaggacccaacattctgttgcttacaggaaacccatctcagggaaaaagacagacactacctcagagtgaaaggctggaaaacaattttccaagcaaatggactgaagaaacaagctggagtagccattttaatatcggataaaatcgacttccaacccaaagttatcaaaaaagacaaggagggacacttcatattcatcaaaggtaaaatcctccaagaggaactctcaattctgaatatctacgcaccaaatgcaagggcagccacattcattagagacactttagtaaagctcaaagcatacattgcacctcacacaataatagtgggagacttcaacacaccactttcatcaatggacagatcgtggaaacagaaactaaacagggacacagtgaaactaacagaagttatgaaacaaatggacctgacagatatctacagaacattttatcctaaaacaaaaggatataccttcttctcagcacctcatgggaccttctccaaaattgaccatataattggtcacaaaacaggcctcaatagatacaaaaatattgaaattgtcccatgtatcctatcagaccaccatggcctaagactgatcttcaataacaacataaataatggaaagccaacattcacgtggaaactgaataacactcttctcaatgataccttggtcaaggaaggaataaagaaagaaattaaagacttcttagagtttaatgaaaatgaagccacaacgtaaacaaacctatgggacacaatgaaagcatttctaagagggaaactcatagctctgagtgcctccaaaaagaaacgggagacagcacatactagcagcttgacaacacatctaaaagccctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccagttaccaaagttgaatcaggatcaagttgatcatctaaacagtcccatatcacctaaagaaatagaagcagttattaatagtctcccaaccaaaaaaagcccaggaccagatgggtttagtgcagagttctatcagaccttcaaagaagatctaattccagttctgcacaaactatttcacaaaatagaagtagaaggtactctacccaactcattttatgaagccactattactctgatacctaaaccacagaaagacccaacaaagatagagaacttcagaccaatttctcttatgaatatcgatgcaaaaatcctcaataaaattctcgctacccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagtgttggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattctaccagagaactcctaaacctgataaacagcttcggtgaagtagctggatataaaataaactcaaacaagtcaatggcctttctctatacaaagaataaacaggctgagaaagaaattagggaaacaacacccttctcaatagtcacaaataatataaaatatcttggcgtgactctaactaaggaagtgaaagatctgtatgataaaaacttcaaatctctgaagaaagaaattaaggaagatctcagaagatggaaagatctcccatgctcatggattggcaggatcaacattgtaaaaatggctatcttgccaaaagcaatctacagattcaatgcaatccccatcaaaattccaactcaattcttcaccgaattggaaggagcaatttgcaaatttgtctggaataacaaaaaacctaggatagcaaaaagtcttctcaaggataaaagaacttctggcggaatcaccatgccagacctaaagctttactacagagcaattgtgataaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaaaagaccaccaacagattgggaaaggatctttacctatcctaaatcagataggggactaatatccaacatatataaagagctcaagaaggtggacttcagaaaatcaaataaccccattaaaaaatggggctcagaactgaacaaagaattctcacctgaggaataccgaatggcagagaaacacctgaaaaaatgttcaacatccttaatcatcagggaaatgcaaatcaaaacaaccctgagatttcacctcacaccagtcagaatggctaagatcaaaaattcaggtgacagcagatgctggcgtggatgtagagaaagaggaacactcctccattattggtgggagtgcaggcttgtacaaccactctggaaatcagtctggcggttcctcagaaaattggacatagtactaccggaggatccagcaatacctctcctgggcatatatccagaagatgccccaactggtaagaaggacacatgctccactatgttcatagcagccttatttataatagccagaagctagaaagaacctagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaagaaactcacacaatatgtactcactgataagtggatattagccccaaacctaggatacccaagatataagatataatttgctaaacacatgaaactcaagaagaatgaagactgaagtgtggacactatgcccctccttagatttgggaacaaaacacccatggaaggagttacagagacaaagtttggagctgagatgaaaggatggaccatgtagagactgccatatccagggatccaccccataatcagcatccaaacgctgacaccattgcatacactagcaagattttatcaaaaggacccagatgtagctgtctcttgtgagactatgccggggcctagcaaacacagaagtggatgctcacagtcagctaatggatggatcatagggctcccaatggaggagctagagaaagtagccaaggagctaaagggatctgcaaccctataggtggaacaacattatgaactaaccagtaccccggagctcttgactctagctgcatatatatcaaaagatggcctagtcggccatcactggaaagagaggcccattggacttgcaaactttatatgccccagtacaggggaacaccagggccaaaaagggggagtgggtgggcaggggagtgggggtgggtggatatgggggacttttggtatagcattggaaatgtaaatgtgctaaatacctaataaaaaatggaaaaaaaactcaaaaaaaaaaaagaagaaaaaagaaacatcactggccatcttttatcctattctatttcattaagtgtgagttgtatattgtctgattgtgaaggatgtcagaaagcatatttttccaatatatattaatgtgcttttggttttgtcacctaactaggtagcagttaatatccatatctgtaagttgtaaaagtctttgtagctcttctttttgactaacctataattaagctagtgttaaatttaaaatatttttcctttgttcacagcccatctttatgagtttcaataattccctttgccaaactttgggcagcaaataactcagatataatggaattcatgtcacattcactcaaatgtgattgcttaggatttgtggatgctattctgctacatttagaggcagcatttatacagtttcaaagtaactaagccattttgcacttcattgatctttactagagaacagttctgcatgtgctccctctatccataaagccatatccagctttttacatataataagcaagtagtatttttgcaaactccattttataaatacttgagacactgaaccaattgatctagtaataatacagaaaacatggtgcatgttattgcgactagatggcaaaacttataattcactctagaattaatactttagtagactgaagccagtgagaagctcagaaaaaataatctatgaagctcacaagtcatacagttagcaaactagtatcagtacaggaaggattagaatcaacagcaagtccaaaatagagtaaatttgaattagaataaataaccaaactcagaaatccaaaacaagtagaaagttatgatcaaatagcaattagctaggagcccatgaggatacactcagttttcttaaggaagtcatttcatttatctgaccttcaatgacatcatctataagtacaaagattttcttattagcaaaagctgttttggaatttttgttgctgctttcaacatttttagttctcattctaaggtgcaaaataacacatagaactgttaaaaccagacatcagagaagctgtctacttctatgaaattgtaaaacaactatcaagaaaaaaattaacagactatttaggtctattttatcaagcattatacattttccagagtttaggatacacagggttagaaaaaatacaaggaaattacttcactactaagaaagaactaagactatactctgcctgttctacaaatggtgatcagacaaagtagtaaagagttctcatgaagaatatgggaagaaggggagtaaagaagaaaagaagagaaactataaaattttgagttaaaaattttaaggaaggttgaagagaggttcaaaaatttattgcaataagtattgtgttggccctaggaataaatgatagagcattactaaaagcaatataattattttcctgattggttacaaatgttatgtaggtacatacagtagaatagcttaagtaaaaactattagtataaaattgctttgtatatcctcaatattataacacagatttataaataaatctgttgcctttactgcaatgtcaccaagttacctatgatcctgctaaaatttttgaatagaaagtcaccatgagagtttacatggctcatcctatatatttttgtacttgaaacccaactctgcctcccttccccaactacctagtaggtactcaacaacaatgccctcaaagctacttttaagaaatggttaaatgggatgattccactgaggaaagagattccaatgatcatttctcacttgtaggggcccagattttgcttttatttctttaattttaatatttcccattaacttgaatcatttatgaaggtaaattgtgccaagtcttggtgaccagattaactggaaacaaaccagtgacctcctagaagctaatgtggagaatgtgtcctgttgctcccaaaaggatggaaaagatgaacacttaggctaagaggttaataaaaactagaggagaatatggtaatgaattcattcgtagggcagaagtatatttgaacattttgtaatatatatataaaacatttataaatatcaactaatgtatatttaatgaatatggcaaggattatactacctaatacataaacattatattttataattatgatctgctcactgggcaacatttcacagatgaaaggtcaaggctgagaaaacactttgtagaagcataaaagccccaaatgcatcttttatagcacttttagcatactggattactgtatttactcatgttcacttcaatcctttaattttgcaaaggaaaaaaatattcacccttgttgtttcaggcaaaagatattcactaagtagctcctatgggctcaggtgtctgactggacagatcagatatttcagaaagtaggattaatataaggaaaaatcagaggcatggcagattatagagttactggagaaactaaggcttattcagtttaaccaaagagaacagtgcctaagtagtggtgtaaatgaggctagagaagatgggggcttctttataatagaccttctggagtggattttattctgaaggtagaggggagcaggaaattgaagtgattacatttgcataacaaaaatctcagtctagcaactaaaaaataaagattgaaatgtgggtacatctagaaaaaagatagccatttcagaggttatcttattggttcaaatatgggtttagacaaaaactatgaaagaaaatgagttgaagactcacaaagtgatgatacagaggccctgtgataaaacaataggctttgaagtcccccagaaatcatattaaatttcaccaatattattcattggctcttagtaatgttaacttttctgggtctacagttaatgagattcaatacctcgtgtgagtgctttgatcaagtggtttgatcataggagaatatatactctcatttgtattttgatatcgagtatatgatttaaaaataaaatactggccctatccaatatgtaagtaacctttagctgttcttgctaattttagtcagtcaaacagaacatataatttcctttgagttcacttggtgcccttattaatattttgctattttatgtatattttatattttttgccatttctatatgtgtgtacaatacatgttaccacactcacttgcaccatgcttcgtacccaactcagtccaatcattgtgttatactttagcagtaataataattataatttaataatagtatgttaattgcaagaagccttctagacactgttccacaagttttccttatgtgtctacaatccttagatgaaatagataatattatcattaacattttatggaaaaggaagccaagcttacaaaacttaagcagggaggcctataagctgcaacatccgtgctcaacatgggcagtggcagtagggactccagagaccattattaccccctcattgctatgactaatactttttgcagctaagaacctgatcctcctaccttgatcattactgagtgctgctctatacaggtgtaattatgtctcccttaacattatttatttctctatgttgcctctgatgaaatccacacgcaggcagatatttctgttttgacagttgccttaagaagaacatgttttcattggtcctaattttgtttaagtttatcattatgaatatgcaccgagggcaatggcaagtattgcattgtaaaaagaggggagagtaaagaagtaaataaatgtaagaccttacttcttggatcttgagggactaagaggtgataaaggaaaacactgttaaaaattcatactagcaacttgtgttgtatattatgcatggagactaaactttttagtgtcttgacaaagccctggggcagcagagaggtaccttagagcagagaaagtgcatttgaaatggtaatgagaagtgagccccatgacaaagtgctagccactgaaatatttctctgagacaaacataaatttagagagggcagagagtcattgactgctgccagatgacctattttaaggcttctttttttcccctgggtatactcagatgacttcacagtgggtacaattttaataatgcaatagctgtccatctatttgaagtttgatgctaccatcttcacctcttatttcttgggataccaactttgagttttattgttttcaaatagcagcagcatcatgaaagccctctcaaggtttaggatacctttaatactgcttcctatttaaataaaattccaacacttttcttcatcatcctttaatagcatgacaatttgccttttctctggactgtagggtgaacagcacaagaagtcccttatgtgacacattcgtgttgcttcaaagtttggaaagtctcagccttctgtttcctggcaaaggaggccacgtccaaattttcaagggtcattgactaccatttctcaccccacacacatgcttggatattcagtggaatctatgagatagtattacaatgaatccctcaactcaactaggtattcctaacaattttgatgtagctaaaaatcttgaggtaagacaatgggagaaagatgataatgcctagggaattgttccaggctcagcgccttaagatattctgataaggaagttaggaatgcttcttgggttggagctaaagaaacagtcttcagagacagagcacccagaaaacagaacgaagctgtgagaatgtttcgtaggaacaaggaaggatggccagggccacgtagctccacaaaaagagggtcttgtgccaatacaaaacattaatttgaacctccaaatagtcaaaaacaaaacacctgaaaatttgaaacaaaagtaatttctggtaaaacatgctgcttttcattctccttcgagaaagtatgtggagttctgtgcacaaacatcaaaaaaaaaaaaaaaatgtatgccagagtgagcactgatggctaaagtcaccaacctgataataaaattgttggatatttttttcctcattatataaatgtctgaccccttcttccatacaggaacaaatttggacacacagtctctaacattccagcaaatacagctttttcctacatcaatggaggatcacagctttcatagccaaagactcccaattatttgttgggttcccactatctcacttgtcccaagccaattattttgtggtttttctgtttttaaaattgtgctgctgtgcaatgttgtcagcatttggaggctggttatgggatggatccccgggtatggcagtctctagatggtccatcctttcgtctcagctccaaactttgtctctgtaactccctccatgggtattttgttcccaattctaagaaggggcaaagtgcccacactttggtcttcattcttcttgagtttcatgtgttttgcaaattgtatcttatatcttgcacacactagcaagattttgctgaaaggaccctgatatagctgtctcttgtgaggctatgccggggcctagcaaacatagaagtgaatgctcacagtcagctattggatggaacacagggcccctaatggaggagctagagaaagtacccatggagctaaaggggtctgcaaccctataggtggaacaatatgaactaagcagtaccccctccccccgagctcgtgtctctagctgcatatgtatcagaagatagcttagtcggccatcagtggaaagagaggcccattggtcttgcaaactttatatgcctcagtataggggaacgccagggccaagaagtgggagtgggtgggtaggggagtcggggggagggtatgggggacttttgggatagcattggaaacgtaaatgaagaaaatacctcattaaaataaaataaaataaaaaattttaaaaaatgctggtgggaaaaaaaaagtgtggttgccttagcaaggccattgtcatagctaacaataaccttcttgatggtactccttgtacttcttccccatcaggctttccaaagctattatctaaatcctcttactgcatctcaaccctcattatgttctcagaacaactgtgctccaggaaggcatggggaaacagtccctctgcccagttcttcgaagcgaccacttatattcaggatttatgaacatagttccttcaaatatttttgacagaactcatgatggtagagccagagcaaagcaaataactggtttcagataaggctatcctctgctcacagtcagctattggatggatcacagggcccccaatggaggagctagagaaagtaaccaaggagctaaagggatctgcaaccctataggtggaacaataatatgaactaaccagtaccccccggagcttgtgtctctatctgcatatgtatcagaagatggcctagtcggccaccagtggaaagacaggcccattggtcgtgcaaactttatatgtctcagtacaggggaaccccagggccaagaagtaggagtgggtgggtgggggagcgtgtgggggacttttgggatagcattggaaatgtaaatgaaataaatacctaataaaaaaagatacaaaaaaaagataaggctatcctcagttgtccaattctggctctagatattaccactactattccttcaaaacatatatcatactccatatccaattgactaatgtaagcaatcccttggaagttattcaatttcccataataatttttaaatcccaccaggtcagaaccacatagcttcctgagaatcaaatatttctgtaatcagcatgccacataaaaaataccccacctcacccccaacatgcacaggttttatgtaaaatctaaagccactacaacaaatggctattgtataagacaggtaggatattgtgtgagtagaggtgtaacggaagtagagtttgtgataaatttccccacagattataacataatcaagtgtcttttaagcatgagcacagtcagaactttgagtttacagggcaagaaccctttgaggaaacagtaaagtaatccaagccaaactcctatttttcccactttgaaatctctcacctacaagctttgtcgacggattccttttaaagtagctgctagtcttgtttattatgcccctgagactaaaaatatgattgtttaaatgtgggatacctagaggacactgagtaagtctcatacatatcttttcatcatccagcacctgtgtactctcaatgaatattaagcaataagttctgaccctcttagctatacaagatgattccttgttttgagatgacatgccctgtgaataaacaataattccttcattttccatggctgtcaagctggcatctttgatcagaactaaatttgctttaagtagttgaatgcctaacagttttaacagaaaatctctcattacctttatctattcaaaaaatgtaaaacatagtgttatatttagcaggaaagaaataagtcctgaatcacagtgtcagcttcatcatttccttaatggtgtaatggtgattatttttaccataatcttcttctggctgttagcccagggtgggaaatgacatcgttacattgttaaataaatgacagtggagacattccggggtttgtttttcccccaaaggatctgtacatatgtatgtgggaagagtgtgggtgtaatcctcaggacagaaatttcctacctactattttcataataattcataaaaacttgaattttaacacttgtcgttcaaaccttggaaatattctctaatcctcaacagtgtttcaaaaaaatataaacaccatggtgtatttgaaaccactaaacaaacttacactcatgtatattttgtggcttcttaatttgtattttttttctttttcactcaaaagtcattttctcataataaagagaggtacaggtatatacagaatgagttcctttcttacccttcgtctctatgataatcatccttactgtttttgtctattcaaatatatacagttctaaaaatagcagcttctttgaaaagggtctaattggcatgagctgctcttgctgtcatgctgaagtcctgccgacaaggtgaaggttggcagaaaaacaaataaaagcaactgataaatgtcagaagtaagttgtagtaaaaacatcctgttttgttcatttggataaaagggcaagtgcaatgtacatcaatttttttccttagagagttctcaacagatagattgaaaatccccattgagaactaagtttatgtcttatttagttatacttaaaagtatataacatccatagtagtaagagtagagtgtatatcaggcactacaatgtttagcagattgaagagttattatggaaaatctgtttcaaaaggataatattcaaacatattatttcactactatacacacttagttattaacatcagagcaaaataatgattaggatgttataggaaacaagcctgagatgagataagtaaagactcaaaataagacttcactggaaaatagacataaatggctgttaattaaagcccattttaatttgattttactagattgtatttcaaggtctgttgcattcttttctgattatgactccctctgttttatcctaagtttgaatttcctattttctttctctcatctgcctactgtaccattggggcactccatattttaaaagtacctttttgttgaagtatattaatttaaaagatgtttgttattaatagtttgcttcttttggtcattgtgtaacactacttcaaataaattttttttgtttgtttgtttgttttgggttttttttttttggaatgggaaaacctgtgaagaacaaattctaatcaaggatattttaatttacatgttgattttttaaaaacataataaggcaaagaacttctaagttagcattataaatatataattcttgtaataagaaaacatgctacttctcaaatttgacatttctttcaggaccaggaggtcagggatttctctctctctctctctctctctctctctctctctctatatatatatatatatatatatatatatatatatatatatgtgtgtgtgtgtgtgtgtgtgtgtgtgtgtgtgtacatatatgtgtgtgtgtgtgtgtgtgtgtctgtatagtagaaatcatttgctagaaaggttacagaccttggatctaagccaatgatctatagggcttgaatcaaatgttcttaaaggatctccttagattcacttatctttcaaatgaagttatttcagcccctttcagattcagtgtatgaatgccctttgttgggcagtattcataatcctacaaaagagagcaatgccgagtttctcatccagaaaaagaaaagaaaagaagagaaaagaagagaaaagaaaagaaacaaataaaagaggttgacaaaaatgaataaataagtctacctaccattttaacatattcacccttcatgacttcttttattcttgtaaggactctgcagtttaaagagaacacacagatttcttttgcatttttgtaaataccaataatgtaagagacaaccaaagaatatattagtgagcaagatgtatctttgcaaacataggttctattaataaaagttacaaaataccattaaagggtgggttttttccttattttgcagaaactagataatcactttggaaaagttaaaagcataaattagtgtattttgaaaatacagaagcatataaaaattcaaggaagtaaaatttgaagaaaagctaggaaccgtttcacatatttactgtcaagctttttatgttttgcataatttgggtcatgttatttatgtccttgtacatcttgccatttggttaacagtcacatttaagttataaaaccagtaaatagttttgtgacagtccatataattgttcttttatgatctgtaatttacataaatgtcccccatctgatggatttgtaaggtgtcttcaattttctacactctaagttaagccgtctattgttatcaatcttttcctctttcatatgtacccagtagcgcttacagaaataaaagtaacaggtcaaacagaatgaatgttcttaaatatctgtaatatggttgcaaattaattttcagaaaaacaactatggcagattaaggaccatattctgtgctttgtactcttacaatgtaagtaaaacttccttcaccctttgccattgagaattactaagcattggttcatgtaagaatacttagccctaactcacattttatatcattaaagcaaagagtaaaaacaagagacattcaggcagctttaaaaaaatattagtgcttagttaatgcttgatttgctatatttgttatacttttaagaactttatagttcatgcacataaagtaagggctgtgcagtggtgttaaaaatgttcagcttgtgtctttctggtttgctacactgctcacttttcacgtagaagtcaacaaagaaagttcatatgaatcagtatggaaagtcaagtatgagagagtagttgtcagttttcactaatagattacgatttgatctacaattatcccttttgtgtagttgaaatatcttttctaaaataaagacagactcattgtcagtttcttgaaatttatgtttggaaaggcaagagttgaaaaaggagaataatttatatctagaaatccccaagttgggaaaagttttacccttaaaaagaatatgactctgatcttaatatgtaaaaaaggaaaatttcacactagtagtagtacatgggaaatggcttgtgatctaaaatgttattgtatatgtatattattttatatgttaagaataccttcacagcaggtaaaccatgaagaacaagctaatcagacttgtttcaagttttggtaacatgaggcaagctaacatttaatttatcagaaacatttttctatttttcctcttccttctcttcttccctcttcccaaaaccttttggtaagagtttgacagaaacacaaatgtctcataaaatgtgataaacatatttctaaacttagcacaggtagccataaatctaaatttatttgtgtacttcacgaatatggatgttctgtcagcatgcacacctgtataccagaaaagggcatcagatcccattacagatggttgtgagctgccatgtggtgctcagaattgaactcaggtcctcttgaatagcagccagtgctagaaacctttgagtcagctcttcagtctcatgtaggcataaatggagtaaacacaaatgtataaagagaaatatacaagggaagccaataatgttgttttgactcaatcaatcatggaatagccatatcctacaatataattcgtcattaaaaatggatagatgacatttctatgttgagtggtaaatacattacaataaaatagcatctacaggatgatcatttcttttaaaaaaatatgtgtttaaatcaaccagaagaagaccactgtactatggttgcttctagtcttcattctctttaaattattataggaatttatcttataaagatagtatgttgattttttttcctatcctttccacatagactggcaagatcaatgtgcccctcaccccatccctgagatgcttctattttcaggagataatcattaacacagatggccacatcttcccaaagtatagagaatataggactcagaatgctcagtctgaagagaaaaggtatactgcattgccttctcccaaggcttagagatcattatggaagtggcagtataaggagtatgagaaccaggggcagtagacaattataaggaagcatattctgggcatagtaacagcatgaaagttatacatatgacctcacagtgattgcaacaccatgcacaaaacctatggaagcccaaatcagaccaaatcccggtgtgaagtggatagttatatgcacacaatctcaccagtacctgtgcagctaatggcagttgttggcttctggaaaatagacaactttctctaagaatgcagtccctcataagttgaccacactccagttgaagaccacacatccaagaatacttgggcagcacaaattgcccttgaagggcattacaaaataaataaataaacaaaaattgggtgagtacgctttggagcatagcttatggaagaattagaggaggggtataaacattaaactcaagagaacgaagaccaaagtgtggacactttgccccttcttagaataggaaacaaaacacacatggaaggagttacagagacaaaatttggaagtgtgacgaaaggatggaccatctagtgattgccatatccagagatccatcccatgatcagcttccaaacgctgacaccattgcatacactagcaagattttgctgaaaggacccagatatagctgtctcttgtgagactatgccagggcctagcaaacacagaaatggatgctcacagtcagctattgaatggaccacagggcccccaatggaggaactagagaaagcacccaaggaactaaagggaactgcaaccctataggtggaacaacaatatgaactaagcagtaccccggagctcttgtctctagctgcatatgtatcaaaagatggcctagtcggccatcactgcaaagagaggcccattgggcttgcaaactttatatgctccagtacaggggaacaccagggccaaaaagggggagtgggtgggtaggggagtaggggggtgggtatgggggacttttggtatagcattggaaatgtaaatgagctaaatacctaataaaaatggaaaaaatataatcaaaacatggtatgcaacttaaaactctcagagaaacattttttatataaatctgatgtaaaattctgatatcaaatattgtcaactggacagaacctaaaatcaagtaggagacatacctctgggcatgtctatgatggtagtttcagatcatattaactgaggtggaaaaacccacatcaaatgtgagaagcacctttctattgtttggggtccttaacagaatgaaaaagataaaagtgaattcagcactagaattcagcattctctacctcctgattgtataacaggttctgtgccttgctctgtcttggtgtcctatataattgacatataaaataaagtaacacattccttaaattgtttttgtaaggtattctgaaacaacaaaatagaaagtaactaccatagaaaaatattacttttataaatttaaaatatttccagaaaatgaagaaaaattactatacaaaaatagtgtatttggatgcttctctttaggactacaaataaaaaaacatttccaagtgtctgatttttttctcttaagtttctcctttgattagcacaagtaattaaactaaattaatggatgatgctaaaaagaagaaaaacatttcataaactgctgtgccccatcctctcagtcttccattgatttttgttgacaggaaaattatctcagccaaaaggtcctatgtgcaaatctgtaaggagatttgttttaaaaacgtatcttagaggtcaccattgcccaaagcaattactttccatgctgttcacccatctaagtgatttctttgaaaatttcaagcaattttctagttttcccaagtactagtacactgtcttataaaatagagcattgtaaatctaggggacattatagaattgtggtgatatgtaaagtaaaagaaatctcttaatgtaacagtgtaggtactattcaagtgattcttggtccatcagtactttattcaattaagcctttatgatagaacacaaagctattgacaatgggcactttcaaacagctgagttatgaatgtaaattattttacattaactacaatccattatcttcctgtatgttcttttgtgttacagaatattagaaatagaggacagcataaggtatgagacagtagattggagaaaacagttatcatgcgttcattttttaaacatcaatcctgaaacctatactctttttggtctctattgcctataacaaatgtgtacttgctccaggctcatatggttacaacagcatattatagacaagcagcatgcagctcaagtatttcagtccttcattcagtcaaaaagcactttaggagagagatcctacctcggaattgtaaaaggtacacaggagactaagatatgaactcaatactcatggagcttgctctgcttgaagagataagacatatacaaacagaactctgatatgattctgaaaaaataagagtcctgtgagaaagaagcaaacaagagatagcatgatagaaatttggaggcatatcagaaagtgttatgtggcaaaattatatgtgagttataaactaaaatatgaacaatgttttggcacaaatgaatggatgccatgagcacatgttaaaaaaacatcttaaacagtcttaagtattggctccatttattatgttgcaaaaggcttattcacggtaacaacatgacccaaaacagaatatcagtgcactatcatgtaatactctataggaggtttacggagcaaacacatccactgcatacagtttaaggctatgttagaacatggaattatatcgttcatattatttaatgagcacttaaatgaagagcagattgatccatatatgaaccaggactcagtgataagaattctacaagcgcagtcctatgattctattgtaactctgaatatctagtaatgaaggaatacattttgttggctagtaaaaagtctctcctccagcttatgttatcaccaaataatgtgttatctccatgccataggtacatcctagtaatctgacattgaaattcaccattctaagcagtgaattttctgttttacaaatagattcaacccaatatattcatgatttctgtgggtttttaagatagtcttgtgtagcccaggctattctctaactcacaagttagtagtgcctcaccttgaattcttgatttcccagtttccaccttcgcagcacttagattacaagtatgtgctactgtgcccagtcaaagacagtactgttactcttctctaaaatagaaaactatccccaaggcccacctcaattcagatctaagaaaaatgcctcaaataagtaatgttcacatacttgtccttagctatcccagactatgaagagataggttataaaacattgaataatcaaacaagtatatgcccccgaactgaattgtctttggtaaatatccctgacaataaagtgacaagggaaagttagttgaactattttcatttcatatgggccaaaattatgaaaatgtatatttcaaaatatacagttttaagattgttctcagatttcctaaacaacctgcagtgtatgttttgacaaaggatctttctatataagctcatcctgataagaccatagcacaactgttaatcgtatcatatcacaagtgctcctaatactgaaagaagataaacttctctgtgataggaagttcagagttagtgcattcctcaatgttgataaattatatttgatgaaggtattgatgaaaatgataaaaatagtgaaaataacaactacaaaagctgcatcatttttattaaccaaaaagataaatttcacaaagaccttttctctttttcttccctcccccctctcccccttttctcccaatcatatagagtaaagtctagaccatagctgtataaatcatgaaaaagtcttaaaacacacaatctgagaaatttgtaaaggaagcactgttctacactttttatttctgttattgcatttacttatcctacaaatctatgagaaacacaggctaaatagtcatactttcattaatataaataataagaaaatagatttagccttttcattggttttttaattaatagaaaattgtagccgggcgtggtggcgcacgcctttaatcccagcacttgggaggcagaggcaggtggatttctgagtttgaggccagcctggtctacaaagtgagttccatgacagccagggctatacagagaaaccctgtctcaaaaaaacaaaaaacaaaaaacaaaaaaaaaaaaacaaaaaaaagaaaagaaaagaaaagaaaaaagaaaaagaaaattgtacttcaattcttttttaatttaaactctttgtatggctaggcatgcactctgcctttaagctacacctgtggcccaattttaaccttttcaaactgcattatacaagaaaataatctcaggctctccagaccaaaaagagagcccataggggttcttcattaaataaaatgcacaaataattccataacattctctaaatggttttctttgttctttcttcaggtacagacgaaggtatattgttgtagtcttagggcatgtaatcttgtttacaccatccagttctcccatttgcttgtcgatagtccatcgagagacaacgtgatttctgaggacaaagcacaagcttcagaggatgaaaggacaggagaataatctttctttaagaggctgtgtgctttgggcatcttaagatttcagaacttttatttacttttagtacctcctttataaaaggagatgcaaaatagaagaagctttgtttggacagttgaacaagatagggtatgtaaagtttctctcaaatagttccacagctgtaagaattgtacaatgtgcactgcctcagttactttctactgccacgagaaaacctgaccaaaaaatacttagagacaaataatttgatgggggcttatagtttcagagggtgagcccttgaacttcatggaaaggagcatgtcagcaggcaggcaggtatagcagcggatgaatagttgagcgcttacctgctgagacacaaccataaatcggggcgggggggggtcgagagagagagagagagagagagagagagagagagagagagagagaacacagggaatagtgtgaagttttgacacctcaaagaccaccccacctccactgacacacctcctccaacaaggccacacctcctaaaccttccagaatagttcaaccaaggagagaccaagcatatatgaatctatggaggaagataatctcattcaaactgcctcatgtactctaaaggtaactgaaaaatatgacttgcctctgaaatataggaaatgtaatacataggtaagaacatattctttgaggtctggcagattttataaaaaagatatacaaacataactagaaagcatcttgttcttattacaaccaataataatggtaaacactaatcccaattgtttttactttaaaaccaaattagctgttttttacattttctatagacaattgtcttcattcaaaaataactgatgacttgtgattgtaaatcacaaagtcaagctggaaaatagccccttgatctgtagattgaaagcaaatttaggtaagtaaaaataacatgatttctgacatatatcttcaggcatccttataattattttagccctcatctttcccttttcttctgtatctctaactaaagcaccccttttcccattttccccattaaatcactcggtaccctactattcccctctctattattattcccctctcccacaatgccccgtttactttcctggcttctgtacttacttcaggttttatagttgcacctgaagatttggagttagggtccatagatggaagaaaatatgtgatgtttggatttctgaatcttggttacaccattcttatactcttttctggttctttccatttacctgcaaatttcataatttcattttatttacagctgtagtgttccatggagtatataaaacatgatttagctatccatttgttacataaaggatatttaagatatttccatttgctagatattattaataggcctgcaatggcatggctgaacaagtatctgtgaaataggatatgtgcatcttatggtagatttactttgagatttctgagggttcttcatagtgattttcagagttcctgggacagtttgcaatgttgctaacagtgaatgaggttttcattcacccccacatcctttataagatgtttgttgatatgtaatattttggctagagtaaaataaaagggaagctatacccatagtctcaccaacatggctgcctaaaaaagacctgaacactgatgacactaatagatattctgatgtaaaagaggtcaatctcatagggcaccaacactagacaaagagctacaggcaaggaaggaatgcttaaagaagggaaaatagtcttctttggaagaagagccacacattcgttatccaaaaccaaatgatcatccttaaatttatatatgcacataattaacataatactcacagacagagtaggatgtatttatgtatttagggaaaggccagcaattacacaaagtaaaagagcagaatcagagagagcaaaggatgctacaggggttgggaggaagaaagagggaaaggatatatgtatatatacatatatatctttaatctcaaaatcttgtaaagcaaatttataaatgaagataatagaaagcatataatactccagagaaaaaagttttgtactttataaatatttgtgtacatctaaatacactgatatgcaaattaaaattcactcttctatattccaaaagcgtgtgctttcagagacattccattaattcatctgttgagctatttggaaaatggtgtgtcagaaatccaagatacatacatacatattgtgtgtttgtaaataaactataaatgtagtctcacaatacattatctgtgaatggaaatttattacataatttatttgttgtttatatattttgtatatttgagtgcatatacctgaggaggccagagatagattcctagattgctctcccagtaaattttgtaaataaggtctctcactgaaactcacaactcagcaatttgcctaaattggctctccagcaagccctagagattgcgatgcctctgcctcactagtactaggattacaaattcacaccaccatgttcagcattttatttttctacatatatgttgaggataaaactgatttttttatgcttaaggggtgtgtaggggagtgggggggtgtgggagacttttgggatagcattggaaatgtaattgaggaatatacgtaataaaaaaaagagagataaaagaggcagatctttgctgactgagccatttccccatctctgatgcatcattattcttacactttggggtcaatttttatcagaaatggtattttggtgtgttttatcaacatctatttgatacacctaataactggctttgtcattatgacagctaattgatgattgttattaatcttgaatatattcacaaatcgaaaaatttccaaatatttggtgagaaacaaaaatgtgtcttgttttgctgaaaactttaaacctaattcttctctagcacatttacgttatgagaaaatacttttcttcattttcagatgagcttatcctcaatgtaagctaagcattcacaatgccttaaatcagttttatttccctaagtgcagtgtttatataaatttttctttgtgtacctaaagtgctttttttaattaacaaagatttttttattattgaaaattatatctaaaatactgatggtgttttaaaagaaagattctatttagttattgcccataacttccttggcaactaattcaaaggacaagagtcatttaaaatttaatatctagaatattggaaagtcccaattagaacattatcttttgcagtataatgaaatcagtgttggaatgaaaacacccagcattcacagagctgtttaggttttagggaagtttcctcagtgttttaattcatggtaccaaacagaatatttcctttatgaatttggaagagcactcactaactttcagagtcttgttccctaatatatttccagtcagcttatgggatgtgatgtgatggatgatacagagcaaactctttcttctatgcacattggcttcaggaagtgtacaaataagcatttctaaaacccctagctgactctgacagacccaatgtattgatgtagtagcctgccagccatctacaaccatgcatagcttcttgaactcctcattaggaaataatgagggaacagtcataaatacgttcaattgattatgcattactactgatgcctgcatttactttcagtactggttaggcctacttgaaacatttaattaatagtttgcaggcacttgctgatggaaacattgagtatataccatcaagacagaaataatttatttccttgcttgatttaatgaaaatgttaaatccttttaagacttgtttaccacagtcctggcattgggagttactttcagtttcagctcatgcccatagtattcagttaaataaggcaggtcccaaacaggaatcattcctgacaatcagtgccaatcagacctttcttctcctctacctttaatcacagctctctatgttgtttgcctgtgtcatttggaatctaaacagaaaaggcataatagaaattataacgaagatgcttaatattggctcctggtcacacagattgtggaagcataaagcagctgaacatggcagatgctctctgactgtgtcatgacaggaagcctccgatgtttttagggtgaaggataagggcagaacccactgacatggtaacctaagaatgagggcaggaccaagagagtataaacgtgaatgaatggtggatctaaaagcaaataaacaccaaatgggtgtggttgtatggttgtagtgataatttagaagggagagagagagagagggaggcagggagggagggaagaagagaaagggaagaagagaaagggatggagtgagggaaggaaaaggatgaagggaaggagagagggagggagggaaggagagagggagagagggaggaagaaaggtagagatatgaagctgttgacaagttatagaccaaaccttaaccacagtgtaatatgcataagtgatatttaatccaagtcaagatggtgagagtacttactatttgcatttttattaatatcctggtatgagttcccaacagattagcccagaaatctctagttgtagcattctaggctttctctagtttgttttcccacactttcccagactcttcccaccaaacattttttaacatttttaaactatatcgccaggtcagaacagtaatgaacactacacaaagtttaactcatttattatttttaatgtaataaagtttataattttatgtgtagccccttgttcacctcagcagtttagaagtaatttgattctaaagtatctatacatttttaattttgataaatactgatatgcttgacaaataatgccaaattactttccacagaagccggactgattctattccccattataaatatgtgagagttctgtttccttaaacatgtgcaaacacaatatatatgtaagcacggtgttattcagtagttagtgtatagacactgcctcaggctggagatacatatccattaaagagctgacctcttgttcattgaggaagttgtcattttctcatcatcctctatacatagtcactggccccattctttgcttacctcccttgtctttatcagtctctgaaaacataatgtgtccattttatctgataagtcatttgccttacatttatgccctttatagtcctcctaaaggtatttcctggttgaaaatatcactcatcactccctttagtgttaatttgatgttacttggtatgtcttcacaacacattcattactatagtaatatcagcacagcacacttcaaccaaagtctcactttgtgtattagtcttctctcattatctgtttcctccctctccttcaggctaacatgtagctgtgttaaaaaaaaaaatcacatactggcatatcaactgcctataactatgtgactttgaataatttaaatgaaataaagtcggtattatgtttcctggcacaaagtaggtgccagtctcttctctctcatcctcccttcacatggttttctatagatttccttagctgtatacactccccacttccctgaactcttttggtatctttcaataaagttatttggcttttgtcttcctagctaatgtgagaatgtgatcctttcgcatcctttgtttgcctcagcaatgtttttgctacttaatgctgagaagactgctcaggaatgtatacataatggttgctttgtctgtgtttaaaaataaaataacagtgtcaactttcttacatcaactggcaaaatataattgtatgaccaaagataatttaagacttgttctccctttttgtcaccttgcattgataacagctattgggtcacagataataatatgccaaaatctagcaagagttattttctgactcaaaaatctttcttattggaaatcacttttcaatacctcttaattgcttttgagctcgtagtaggaaatccaatcaaaactatagtgattcaaaatatcataggatagaggaagcaggaaattatcatatttaattatagattttgaatgacttcaaaggaaactctgagttttcaagggattaatgcaggaactggtcccttattataggaggctacttgggcttctatttagctggtttctggcacattcattgacaggaataatttaatgattgtgaataatcaccaagtgtaggaaataaggtcctctttgagtcataaagcttttaaacatgagtaatattatgcatttgtttgagaatggtgaaatgtgtgaactaatttcacattgtcctaccaattatgaatgtgttatttctggcaagcaggtctctttaaaattgcatatgcttagttgcttgccagggaggtgagagaaaaacattgtcagcctctttatacccagctggggccaggtgttgatcattaacatgtaaatagtacaattactgccaattaagattttttaaacattaaaatttgtgggaacacagttatatcctctacaagatttaaaaaatatctatatcttagtgctttaggttcctataaggcatacactgtaacttgtagtcttaattacacatgatttcaaagttgccttcctttgtagaatgccatatttatcatatttaccattagaattgaaaatgaaaggatgttgctagaattaggttcatagccaaattgcattacaattactattacttggaaaattatagttatttttctcccacaaatatttattgaacttgctgtatataaagaactatgtttgagttaaattatgaataagtcaaacatggtctcttctcactaataacacacaaaccaacatagaaataagtacacaaaccgatcaacgatgttataggaagtcttacataaaatgtcttaagaaacaaaatgatgagggtggatgcagtttgctctgggaggtctctctatgaattagcatcttttcaggttctaaagggagaatcgatgctatccaggtgaagacatgggcaggagtatattaggaagagaaaacactgtttaggcagctgtaaacaagaaaaagtggaatgtcattataaaactgaaaaacaaaaatacatacctgtcaccaagatctttgtccagcctctccttaactccaaagtctttgtgatctctatataaagaattcaaaaagacacacaaagttcactgttatagtgtaaagcaggaacactctcaagagatgagagtgaacaacgactaaagagactgctgtataaagtacatactcaggggagggaatgggcaatgggctaagggactattgttcagacttccattttaagtaggctttaaactatttttaacatctctggaacagacaactttcctgacggacattttgttgtccaggtgattgacaggccctacttgcattgatgcttctagaaaggggcactggtatgaccttgatctttatctgaaagtctcttgttagataatgatcctgtatggttctgggctgctggacccaggtttagatagttatcaattaataaccttccaagcagttccagatgacacatctactcttaggaccacagatgtgacttaggtcccatttctctgactcaggatttgtttttttacaaagtgttcactatgatggaagggctctgccttaaagttttctgatcccactaatattaaactagctatttaacatgcctacttcaaagtaatggttgccttaggggataagaacacaaaaagaaatattaaccctgttattctctaataatataaattcattttattcacaaatgcaacttgtctgtaagcacctctttatcatcacgatcttggggatacaatactttgtatgtaaggtaataggtccacttagactcacaattttatatctcactttattgggtgctcaggtctcattaaaaataactcaattattctatactgcatcaaatggtaaccaagtctttttgtgatataaacaggttcacaggtaaatcacagcactatctcccaaatccgaagagagaaactccagggatttatagtaatttctggaatttcagtcctttaaccctcctgtttatcaaggtgctcttgtatatgaattaacaactttctagaaatagcgagtaaatgaaatagcaagagctaaagaaactcagaaatggtcatgggcaggtccaaggaaccaccataatatagggaagcattaaaataaccatcagtccttgtctatggatctgatgaaaggaatccagatctacctaaccaattcagtcacattacttccttaagtatttgatttagtaccatatgcaatacacttgagctacaaaacttagcagctttaatgttaaagagcttactgttccctttgggcaataaaatacagttcttacctatttctggttgaatctaagaatagaactgtaagagtctgaaagttgctaaaggaagaccccagactcagagagcatgcaaagacaaatagctttaattctgcaaaaatatccagtatgtgggagtcaatcaatctccaaaatagcaatcacagacaaagtcacacaggccttcttatagggaaccatagggaattggaggaactctttagaaggactgggtaatctaaaatatcattggtgagtactagtggcttagaggtggtgatcagtggtctgcattcctacgtcatgaccctttaaccataggatgagatagggatgtctagcacagatggcccattctgtgctgatatttcctcatttctgtggttatccctggggtatcatttgggagggggttttatgatcttgtttctggtttttatggccttttcctggagctggtaactatggccttcttttcaaaatcaggcctgttccttaaatggagccaaaagggggtttatgttttcctttcataagtcaactgaggatccagtaagtagagaataggaaatgactgcttctttcacttcagagatgaattgagtcaaattaaactaatgttccatattcttatgagattctcacaggagagaaatgagcagaaatctagaaatagtcattgtagtcaaatagatcttttaaatgtcaatataaaattcagttgtatatcattatcattcacaattgatgaaattatctctttttctggacaaagtcatttataaccatgaatatcaaagttctttatatgtaaaccttacagctgaggtttaaataactaacatttttagcactccagaaaatatagattgataagttatgtagacaagtcgctatcttatagaccataccatttatcttaagtaggataattgggttttactagaagagtgcaatattatcaaaatctaatgtctgatactagcctcgatatggttaaggtgcttgctttttcaaaaaggaagtagagcaattgtcctgaattttaaagtggagaagtcctggctttatgaattgacttggatagagagaagtgcataaaacatcatgcaagggtcagtagggttgattgtccattccaaactagtgatccctcgtggaaaagcagtgtagtacatgtcaccatgttctcagaaatgcaaatgtgtgctacgacagtgtgtgaacagtacctgctgcacgaaataagcacagatgtacttcaaattaatatttaatctgagatgaaaagcacttaaaggagttagggatatgagttcctcagaagaaattacttctttctcgcacacagcaattatagcactacaaagataacaaaaataagactgtcatagtctccttgggcttcagtaggaagtctggaggtgaagtgcctctctctctcttttttttttcttataaaaagacaaataattctcccggactgtcattgcctggatcaaatctaaagctcataaggtgcttttgaaggaaagacttgctaagtccttgagggtggatgagagtgacttttaattgacatcattagagtgttattaggatgaaatagaacaaagaaaccattattaatctttaaaaagaaaatgcctacaatcagattataatttttgagttcttcctgtgaggctatcttctgaatcacattctaagagcaaattggagtctgaagctattgtgttcttgtctttcattttaaacccgtttatatggcctgaaagaagtttaaacatcacattggagagcgagtacacaaaaccactacctcaaaagagggaagaagacaaaaacacaataccacttccttaatctctgagagtatttttgcgtaattatctataaaagaaatgactaaaccatctacattcagaggaggcttaaactaaaggcattttatgataatggtaggtattgtagggtagatgtgtcatcaaaatgccacacaaaaaattgttttaccgtggctatttttagataataggttagtcatatatgttggggcaattagaagtttctccagcttttaagttgataagataaaaggtgtcatttgacagaaactcattcatcaaccattgaaactaatcttcgttcaaccatccacatgtatttattgagtaccaactatgtgccaaacactggaagtaatattgaagtgaagtcatagcgacagggatgtgaagcagctggtcacacatgcacaacaggaaacaggaatgaatgtatgcatactactcacatccacttatccctctatatactctcaaatccttgttcagaaaaattggtgttgctcacagtgagtaaatctttcagccgcaattcatgaaatcatgacagtatcccagaaacatgcctgcaggctcatctctcaaatcatcctagattctttctggttgataatactgatatgatgtagagatgtgatgaggtcaaatgttttccgaagccatggaatgagcttgaaattttgttttgtaaaactgaaaattgaaccctcatagtgtgtgtgtgtgtgtgtgtgtgtgtgtgtgtgtgtgtgttagacaagtaatgtaacaaatacatcctgagtccttgttttattattccatttttattctttgagacagactcttgttaaattgcaagactcaccttgaactttctttaatgtattcatctatctatctatctatctatctatctatctattttttattttaagctccagattttattcccctccatgtccaccctccaagtgttccacatcccatccctcctccctgtctccactagaatgtccccactcccacccctaccccacctgacctctaaactccctagggcctccagtctcccgagggttaggtgcatcaactctgattaaacacagaccaggcagtcctctgctgtatatgtgttgggggcctcataacagctcgtgtatgctacctggttggtggaccagtgtttgatagatcttgggtgtccagattagttgagactactggtcctcctacaaggttgcccttctcctcagcttctttcagcttttccctaattcatcaatgggggtcagctgcttctgtccattggttgggtgaaaatatctgcatctgactctttcagctgcttgttgggtctttcagaaggaagtcatgataggtcccattttgtgagtgttccatagccttagaaatagtgccaggccttgggacctccccttgacctggatcccactttgggcctcgctctggaccttctttttctgaggctcctcatctccatttccattcctgcagttctttcagacaggaacaaattcgggtcagtgcttttgactgtggtatggccaccccatccctcacttgatgtcctgtcttcctgctggaggtggggtctataagttccctctccctactgtctggtctggtgcattctggagggtccccccacctcctacctcctgatgttgcctgttttcattctttatgctggccctcgcggcttcagtcctttttgatcttccttcctcaccatctcagtgcgaagttactggaattagaaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagaacccaaggagctaaagggatctgcaaccctataggtggaacaacattatgaactaaccagtaccccggagctcttgactctagctgcatatgtatcaaaagatggcctagtcggccatcactggaaagagaggcccattagacacgcaaattttatatgccccagtacagggggacgccagggccaaaaagggggagtgggtgggtaggggagtgggggtgggtgggtatgggggacttttggtatagcattggaaatgtaaatgagctaaatacctaataaaaaatgggaaaaaaagaagattacctttagatttttacataataattatggatatgtatgaaatacagggtgctatttccatgtgtgttcaaaatatgtactgatcaaatgaagcatttcattcaccttgatatttaggtttgagctcccttttccaggcctttttttttccttaatttatatacattttatttttccattcatatattatgagcacatatgttgatcttaactcttgataaatgctgcaactaaccctgaggatgaaggtggtgtatctttggtttgttcatttcatttatgaatatacactcaaaagtatgatttctgaatcattgactatcattaatctagttttagtagtggtactgtttttttggggggattcttatacaaaatcattgcctgtatttacatcttggagtattttctttatgttttcttctagccatttcatggtttgagattgaatatttgtatcattaatccactctttatacatgtgaatacagagcattatttattgaactgttccttctgagatatatgtttttttctttctcttgagaattagttagctataaatatggaagattatttctagtgtcttaatatcactcccatactatagtactataatatgtcttgagatcagatattgagatatgtccatctttgtactgattttaaatcttaagattttcctattttgtatattttgtgtttgcttttttagttatgtgaagaattgtcaatactattgtagtggaaactgcatcacatctgtaaattgctttgggtattaatgtgtattttgatttatttatttatttatttatttatttatctatctatttaaatgtatatgtatgtttggcctgtatctgtctgtgtaccccatgtatgactagtgcctgcagaggccagaagatagtatcagatcccatgagactgtaccatgtaagtttgggaaacaaccctgggtcttcttccagcccttcatagatagtttaatattaataataccacttattcaaattgtgagatttagaattcctccagttattctgccttttatttgtttcactggatattataattttcattgtaattcaacggggaaaaataagttcccatgagccttctccatcaataaatgattgttgaccaggccagctttgtacatgctcaatgcaggtagctacaactgctatgagttcaagattgcagtggctttatcatgcccagaggactttgtagggagaaggtatagctttcaggggtaaaagacaaaaataattacaatgccttttttatgtgcgtgaaaatgtcagaggataaatgtaatctaatcaataaaaaatatatgttttatgctgaaagtatgcctgtctactactttgactgttatatgctgaattccagctggatgtgtgcacttaagcacaaaaagcaacaatttcaagaaattgaaaggaatcaacaagcatcagcatatatagtcacaagagttcttgaaattcccagtcttcaggcattgatggttcttttcaaagtgtctacctacctgggaatccatcttatcagatgttgtctcctgacagttccttgaaagtatgtgcctgaggataagttgctattgctggaataaagcaggtattgtaaaagacatgaggattatataggtctaattaagaaagcagaatgaggacttgaggaattgctcaatgatttgctcttacaaaagacccaggataggttcctagaacccacatggcagctaacaaccatccataactccaaggtgagggaatccaatccccttttctgacctttgtgggcaccaatcctgtatttggtacacttacatacatgaaggaaaaatactcatatacaaaaaatgaagtaagactttatttaaaacaaaataagattcatgtggaattgacagtccaaaggcactacacgggagaagagaaaactaatagcatgaaaactaaacatgaagagagatttactctgaatgaaagtaaatcattttttaattttgcagagagacagggctactaatatatttatctgtaggtttctctgagtttaatttcattaataataattgtttaacaattatcttgtaggagggggtcacagatttaaatatataaaatgaactaattcatttgtttgtttgcagagagctaggaaatgtttgttacaggtattaaatgatgtattttaattttagcctgactagtcaatttctattataatttgtcagtatattcttaaacactatatacattattaatatgacataacttgtacatgaatataatataacatgtgcaagtacattattatatttttaacatttaaggttttgctacagatagacattaatgttaatattcatatttttattccataaatatcatacattaaggcatttccatataaaggcaaaaatatatttctatgtaagtggaactataatattaacacagcagccttatatagtcttatatagtcttttattttcttctgtttaattttatttttgttttctttttcatgtctttgtcctttaaaaattctttaatgatcagtatttatcagtcattatagaaaccactacccatttctaaggcagtgatattgattataatttattgatgagggttttcttttcaaagctttcatctatattttctcccatgaggaaaatgttataaattttttccttgtcaggcacattaaactccagaaacttgtatctaactgctagagcacaactccaaccgcttttctaggacaacagcccatttgcctcacagagaaaaatgaagcgtgttaattgtctagttaatacattatatgtctaaatggtatggcttagtttagtaataaattaaaacaatgtttagagactaacctattttctaacaaggccaaaagtgtcttgctataataaaataaaggatatttttgactgacaggagttggtgaaacaaaccaaaattatctttttatgaagttacaaataagaataatatgaggttattttacatcctcaaaaacttaaaatttctttaaattttgtgttaagaaatgctttttaaatcactatttttaaagtgctttgcctttttgaaatgattttctttttaaatcaagggaagtatttctattttcatgactaggtcccatctgtcatcatgcatatgggcttgcccttttccttttgcaaatggtctatttttcttcccttttaacaaatatgttcaaaattttcatagcaaataaggaaaatattttctctcattattatttggctgagaagtggcataaacttatgactctaaagaattaattactgaaaatgcttgtcatttcaggacttctatttgcaaaatataaacaaaagattttctttacttccattgtgaacaatatttccattgaagattgttgtcagagtacgaattcccatgccagtgatatgtttttaatgtactacccgggaaaaggaaaatctttcagaaaaagttcaagttctgggaattaaatatgaaataactaacatataatctgtactcaacatttggcataaaaacaaaatgcaaattctgccatagagaattgcttcagggaagagtcttggaaaaggaaggtggagaagatttggataatggtggaaatgaggttatgtgaattattgaaatgattcaggttggcaagtttctaatatattcccaggttccatctgagataattcagtccccctgaaagataggtcaggtgttccccagactgaggaaatattgggctatctgaaagaaataaaacccatgccttgatccacccttcatattgaggttaatacctccctgaaggttttccatcagccctggaactaaaatcatgagcctgtgctgtatattcttgcaagcattggagtgtatacatgcatgcacacacacataagtacacttcaacttgcatatatgcaaacccttaaaataaggtagaaataataactctacttagcagcttccaactgaaatgtgccaaccatgtcattcttctaatggagaaaattaatatatcccatcagggctccatgatatgaaatgctgtgaagtggctgcttatagaaaagtcgggaaatccactttgatctacatttttgatgtttgataattgcacttattatcaggtcctctctgctcttttactttgacatgagatccattatcagtgacagcatgagtgtgagcatgggtttgatttgaaaaactgcttaagatgagataatggaaaagaaggttttttatatgttcatattaacaggctaaaagaaaattaaattttatcatgcagtggctcccttgaaattatttctctttcatacattgcttagtttgaaagaaattaatccatagtgaaatgttttgtacataaaaatctagtatcatttgcctttaggcttttattccatgatcaaatatcatgtgaacaacaacaacaaaaaaatggccacaaagaataagacaggctgtgttgttcatctttgcatgctcagaaattactaaaattaaagtgtatagtcatatgtgagtagagtaagacaagaataaaaatgaaaactcatatttgatgaaaggaaatatatacaaactcacatttctatgaaatcactggtaaattcattaattgggtgtctttggtatcatttgatttatttaaataaatcaggttacctagaagcaagtcattatggcaattaatatgggctaatgtagctgaacttttctgcttgcctaaattttacaacaaggaccaatgctaatttagaactttaatggtttcctgtacacattgacaaattattattctcacagtggaagcctaagtaaaataggtggtttatttattcacttattctttatctctgttatgagcattgtttgttgtttggttaaacacgcgtgcacacacacacacacacacacacacacacacacacgatgaaatcatgaaattattttagccaaaattaaatattttcttatgtttatgagttttaattgttttgctgaaggacatagaaaaataaatttacctgtactcgatccttaatcttgtgttcagttcaattcaaaagcaattctgtttggtttgcctgtttcccattaacttttctttctaccttttttttttccctcagataaatgctcaccacaaggttactggagaagtaatattctctgtagctttggagaatatgataatgtgtttggaagtgctttatgaactagctttgttttaaaattctttaactctttcctatactatactgagtttagagaattttagcaaaacccaaagagcttactcatttcctgtttctcctgctggtctgcttcttttttccaacactgctacttttttaacacactgatttaattataatcactcataagcatgagtggcaggttatttaccagaacatacgcaatgtactaattgccacactactgaggaaaatttcaggcagtctccaagtactcattaactgcccagagacactcagtgaggagtgcggcctcagcagcctctatcccaggcatgatgaaatagtgtaaaaaggccccagtcttgtacagctgcagtagaaaagaaaggattctgaaatagcttttgtccataaaactacttgcttaaatataaactgtgtatgttgtgaaaccacagtaattatccactacaacatcaagcctccattgacctattatccttccagtctttcaattttgttttatagtatttgaatagtcttattaaatccctgtcaatctttcatatggatagattttttgaagattgttcaatctttgcatagtgctaatttaagaatttcacaaatgtttgaaaaaagagtaatttaaatgatgacttcctattcagtaactcattgaggttatactttagaaacatacattggttttggatatgtattccaaggaatagtatagcttactacaatttgatttttagttaaaatacaatgtgatagaacactacttatactttcttgagcacatgtctaaagacacaatgacagaagcaaattcctatggatccgtataaattcctttgcaaatagcaactcttactcattaccaaacagagataaggtagagtacataaagcatccttttcttcttgcctcaaaataatacataggtgatgtatattatgcttaaattgaaaattattataatgttttttattcagcttcccttggaagaggttcaatacatttctgcatgtgtattgtctgactttgacctattacacttccttaaaatttttttctattggtgtttgaccttcatgtaattctgtgtcagggtgtcagaagtcctggtactggacttacaaacagatgtgaactcttaagaacgaatactcttaacaactgaaccatctctccagcctaatttttccaaccacattctttttttcttcttcttttcaacctgttacattcttaagaaaattcaagacttgtacacagttgctacctaaaccaaatcataagaagatattacaaagtattcaaaacattcgttgaccattcaaataaaaaggaaacactgatgagcagtgtatgctatttgcctttaagctgaagtgtcaccacctgagatatctctcacagaaatgacaaaacagaatcattgtctagaaaactggttcagaactcagtgtctctcaggagtggtgctatcctgtgttttactaaagcattattctgatacttcaagcacattctgttttattatagcataaagagttcattgattgcaaagggtctacctcatctcgaactcttaagacattcataaatttataagaaatacaagtgacctttaagcaacatagatttaaactataaaattacaattatgcttagatatatttttgagatttaaaaatagctcgaaacaaacttttagacaaaccacatatgctaaaattagtgacagaaaggaaacattaggtacgacatgatcacacaaaaatcatgtatataacattctattttatcatatatcctaccataaaatgtatacaaatatagaaagttaaaaatttaaaagttgatatagatgcttacagatcatacttggaatcatttaaaggcaatataaaagaaacaaatggaatgatgttttaaattgtaaatttgaaattgtgtaaaatgcatagcttagcattgtaatagttacatagccgattcccattgctttgctttgagcaaatgtgttgtaattatccacataaaatgcaatgtcaactttctccataagtgctatttgtatttccaataaatgttatatcctgttataaagtggcctctcaggattcccatggacttttaactatatccatacctataacatacaaaatcttccttgattgactgaacatattaccagggagctacatgcaaaatcaattgataagcagaagtttcctggacaaggatagatatgagcacaaaggtgtctgtgggaagattgaatcctgataatttgatatgaaatatgcctagtgctatgtcagatacattaattcaggggacccccttaactagattagtagttctcaaccttcctaattccacaaccttgtggtgacccacatattatggtgatcgacaaccataaattttttgtttttatttcatagctgtaattctgttatgaattatgatataaatatctgatacacaggatatctaatatgggacccctattaatgtaaaaggtttattcatttgacttcctaaaaaagtcaccacctacagattaagaaccactgaactagacaaaagtagaaaccacaaaatgataacattttttctgtttctccccttttctgtgccccacatttctgggaagaaaaagtttctccaaacttctagagcttttaaccagtcaatttaatcacatctgactggattctcctaaaatatgtttgtactggctagttttgtgtcaacttgacacagctggagttatcacagagaaaggagcttcagttgcggaaatgcctccatgagatccaactgtaaggcattttctcaattagtgatcaagggggaagaccccttgtgggtgggaccatatctgggctggtagtcttggttctataagagagcaggctgagcaagccaggggaggcaagccagtaaagaacatccctccatgggctttgcatcagctcctgctttctgacctgcttgagttccagtcctgacttccttggtgatgaacagcagtatggaagtgtaagccgaataaaccctttcctccccaacttgcttcttggtcatgatgtttgtgcaggaatagaaaccctgactaagacaatgttaaaactcacttaaagaatattatatagaatagatctttcattcagatatttattgtattgtccttaatttcattctgaatcaatggcctttaccttttaaaatataaatattgtttgagaatttcatatttaagtaccacatttacatcatttctccccctttatttacccatcctccaacttgtgttatggcctttggaaatgtagtattctaaccatcaccctacctaaagccttctaagtaggctgaaaaatataaatatagattactatgtaaataagattattctgatggtaaattgcaaaaacatcagtgaaatacatagggtaccaaatttattataaggatctaccaggagtttggcaagatggctccacagttaaaagactgtactgctcttatactttaggtactcatcaggctccactatgatatctggcacctgcttctcatctctgtgtgtactggacatacatgcaaaagcatacacaaaataagaataaaacaaactatcttctcataactcaatgaaattaatcgctatagtgtctactgaggtcctgacctaaggaactggaaagaactcactaatcccccactgtctctattactttgtatatttctttatgtatgtttgtctatttatccctacagatagtctgtttgattctcactttgcatggtcagaaagagccacacttctgattttgaatgggcatggcttttaaatctaaagcaccgttcaattttaccatgtctcaaccctgattctcaaatgccaggaaagagcatcttcttagtaaagtttggatcaagaacctaatgccaatgtacttgggtctcaaaataggaaaaggataaccacacagctgccacaaaagttttaactctgcactacatgcaattgttgggaaaagaggtaagcggactcagccaaagtgcctgaagtaagatgttctggtggtctgctttaaagtcttgctatgctaattataatatctgagttattattggatttatctcaacagcttgtccattttcctttacagaaaatcataattttccttgatttttgtaggctacaatttaggaatatattttggacactgattatttctggagactgtaggatctattttacaactgtgtgcagttgtgcttgtttttcttttggtttagaaattggttaaaaattttggacatgaatatcagactttggttctagcattacagctcaaaactcagttttgtttttgttattctcagcaagagattttagaatgaattctacactaactatgccgtatattttctttgtttgtgtacttttgaggataaaccctttactttcccttgacttatagttgcctatctaatctctgtcccatggttaagtttgagatactgtagttttctgctaggatatttgacaccttaaggagtctcttactgttttatacattatgtttaaaaaaataaaatgaaacaaccatcaactggaaactcacccttgactttaaatttttggttcctcaccaaaacctactacgtttactcattctctagtgcctgtgggacattctgttgttgttgttgatgatgatatcatgatgaaggtgatgatgatgttgataatgatgatgatattgctgttgagttttttctttcttttcactattttctcatttcttacatcccaactgcagtttcttctctttctacccctatcattccatctccttacctgccatcacccatctccctaagaattactcctccatttactttctgaaaaaaaaaaaaaaagcaggcctcccagggatatctagtggacatggcttaacaatacacaataagactaggcagaaacccagtaggtgtaaaatggtttcaagtgtaagcaaaagagttggagacactcccattccctttgttagaagtactacaaaaccaccaagctacaggactattaaatatgtgcagataatctagctcagatttatacaaggtttatgttggttgcttcagtctctgggagcccctataagccctacttagttgatactgtgggccttgttatgatattctctattgctctggcttcaacaatcctccctcccctcttctgaggggtttccctggctctacctagagttctgctgtgagtctctgcatctgttcccaataactgtgggatgataccccttatgatttcagttggcctaggcatcgatttatgagtatagcagaatatcattaagaatcatttcattgacacttttttcctgtttttcttttttttatctttttcctttttttttttttgtctcagtcgtatttgtttctattgtagttctctgtgctggatctttcgtctagtcgttggccttcaggcagtggcaggagtgggctcaagttggacctgtcattggttagtcacttcacaagttctgtgccacaattgctacagcaatatgttgcaggaaggactaattgtaggtcagaagttttgtggctacgttgatgccccagtctcacttctgggaccctactctggttacagaagatggccagtttgggctttctattccctattactaggattcacttccctagggtcacttttgcagattccaggtgtttatacctaactcgatttctacactgcaccctaagggaccccaactgcaatcacctctctcaggattctctccctctatccttcccacctcccacctgatttctcttgttcccatcccaacctgccccaagtcaggcacaaatcttattgtctatagatgaacataatatgatagaactcaattaaaactttctcatcacttggactttttccactgttctttataagtgtctcaagaaagtaatccatacacacccactttaaacttaatataacccaaacacctactgtgtatataatgttttacatctgctaggcttctttttagcaatttatataaaaagtttgtttatggaaccaaatatcaaaggatcatgtgaagtgatataaagagttctatttctttcattctcatactccctgagagatgtgttcatcctgacatttcttaggcaaatgagatttttgctatatatgacctttctataatttctatactcaaaggtacagttctaattcaatttaatattgaattatctacaatacatttgtaattacaaccctatcaaattcacacacagacacacacacacatgcaagcattaacacattaggtacttacatagaaaatattaaaaatcatttttatgaatagatttctttaagataggtttacttaatcagttttacttatcatcttccttatatagcaaaacattaacatgatctagactataatctacctaaattttctgttcaatattatttaataaataaatgaattgtaataatttaaatcagtttgtttaaatgtacatggttacatagagactagctataaaataatacatgtggaaaatactttgaaatttttaaattgtaaaaaaagtatccttttagatgcatatctggaggacctactatatgtaaaattctaaactagttgttttggattgaaacacaatgaagtacaatttcttctcccaagtgaagaccatctagttttaaaacagacttttgaacagctgaactatgtttttttcttgagagatacaattaatgccatgatgttaagatatgatgtataatatcaagtcagtcagtgagggatttcaattgtagcaacaggatgatgcattagtcacaattctaccttgtattacagataacataaaaatgtacggaggctaaaaatagtaattgattctttattcatctaaatgccactaaatttttcttattagtgagcagttctctggggattaactaaaggaccacacttctttccatctttgcaccttcactgtcttcaacatgaggcatggacattactgtgtttatttgcatcaaaacagataaaaggggaaagacaaagttttatcagacctggaagtagtattaatttttctgacatcactcatatgcctttatctttcacacaaaaaagtgaaaacacacaagaaaagtgtgtctcatagagtaaatagaaaacagttagtgaagagctttgtagtctctgctgtgaattgtcagacttagttgctagaaagtatattctagttacagtgtgggtgaggaggtggacagaaagaagctaaaggtggattaaattaaggaagtctcaaattataagatatttgtgtactaatgcagggatacctctcagtagtatgatctagtgactgaatttagagatggcaaagtggacaaaatgaacaaaagattgatgataatataactgatcagctgtttgccggcaagcaatgcttcagtgtttattgagtgccacaatactgagaactcacctcattgcactgaagtgcttgcctagcaaacaaaacatcccaactttgatccctttcatagaaaaagaaaggaaaagaagaaagaaaaaaggaaagagagaaagcaggtggtagatagaggagggaagggatagagaaaatcagtgttttccttcaaaatgtttgtgataagagaaaacacatgaacggaataggttaaattcataggttctttttgtttgtagatgtgtgtgtgtatgtgtgtgtgtgtgtgtgtgtatatgtgtgtatgtgtgtgtatgtgtgtatgtatgtgtgtgtgtatgcgtgtgtatgtgtgtgtgtgtgtacgtgtgcaaatacaaactaaaaagaaacaaatgaaagactatgatagaatttctaggattaaaaagaacaaggtgtacgggctctaatacacttgaatcataaaacatataattcttctctttatttctcttttgtattgttttgaaatgtcaggatgagttagcctaggtattacactcaatagaaaaaaatgcattttaagaataagaggatcaagcaaagaatgatggaaataaataaaagcatggcaagaaaaaaattatacttttaaacttcaacagttaccagacaattcatttttaatgtgctatgaattttctgcctttccaatgagatggaataatggaaatataaaataaagcattctatacatggaaattggtttaaataataaaacatatctataaacaaacaaacaaacaaagacaagcgaagtcactatgcacttactcacacttactcccaaatgataacgagatttaggaggagaccaggtatcaggaatgtatgtataggttatttgagcataggctgaagctttgaattcaatttggtatttgttgatactgttatttcagttaagcatctcagtttgaacagaacatagatggtgtatatcagtggtggcttgcaactctgatttaaagcaaccatacacatctgcaaatgactttcattcatttgaaaaatatgtattaaggttatatattatagtaaataactagtacctgaccactaaagatttcaataatcatttttttcattttttaatttatgtggcaaataaaatgcccattacttttgagaaattgggaatatgtaaaatggtttagtagagctcacataaagctaaagaagtaatggcatgttataatagagaggtctggtatgtgtaggtacaaagcaaacatattcagaagtcacagagcaagagatattgatggcaggagagacctttgagattgtcatcaaataagagtacacatgcccatgtatttaaaggtgaaaggtaagatcttaaatgtctttccaatggagaggcaaagagtaagcaataagagtcaatggttaagatcatcaagtacctagactttcatgtatagcacttagtcctttaaagcactttaaagatgctcagaaaatatccaattccatcctggttggtatacttttgcatagtccttggtactgtgtctagtttacttcttttcagcttcagacatctaactaattaacagaggtggggaaataatgatttttccatcagtagttgaaggctctgcttgtccctgctcatgacctcactttgcattccccgaaggctacaaagtcatttgcagatgtgtatggttgctttaaatcacagttgcaagccaccactgatatataccatctatgttctgttcaaactgagatgcttaactgaaataacagtatcaacaaataccatcttgaattccaaatcagatggaattgacaaaagttttatgtgacgtgaatcgccaacatcttgaatgtctcctactatagcagtactacatttcttagaagctaataaccatagtttcttagtaaaatgtactgtttaaagtgtgtaaatatacactggtccttggagggtgctaattttaacctgaaatgtttcagaacaagatagtaaactaagaaatgagtgtttgggcataaagtatgaaaatgtcattcaagtgccactgctgtacctcatctcatcagtgtgtttatatacaaagtaagtatctataataacttcagccctttttgtctaatttcccatgatcttatttctgattccacactagtcacgataactctttttaaatgaaggttaatctggagctttcttttttgtttctttgctaatagttatcaaaataaaagtaggccaggattgatgtttggaatcagccaaacttatgttcattgcccatggttgccacttcttaacagtgtggtcaggtggctccatagcacaatgtatttctgacagtgtagccttacaccaggcactgtactctctgtgccttgacttttttcctctatgaaatggaacagaattagctacccctctgtagcctgtctgtgagcatcagaggttgtattgtacatattaccaaatgtaaacatttgtaactcattgccaacagtgtttgcatctctcaagtaaagtaagtcacttccagtgggaacaattctttttcatatacccctgcccacattcctcaagaatatattccaagaccattactaaaggcttgaaccctcatattatacacatatgtgggttctcatgtactgattcatctttaatgaagtttcgtttagaaattagtcatatacaacattattatgaagatagaatgacatacatttatcataattcaattgtcaatatccactatccttgtacttcatttatctttcatattatttggttaaagaagagttacttgaaaacaaacacgatgatactaaaacagctgatctgagaacttaaatggctataaactagtgggtagatcccatagccaggttagagatgttagacaaaggtatgatttacatgtcagacataataacatgagatttttctcttgctaaacagaatggtacacaatttaaaactgtacatattctttatttcctgattttgctccagtactttcagagctttgttaaccatcatgctgaaactattcaaagtagaaacaaatgtaagggaggtctattataatggttttaaatttcccttcttttctccataccattatgctagactcctaagtgaggaggagaagtaaaactgaagacaatatatctaggcctccagtcccatcccattccctaaaacataatcctaaaagataatttgaaaaccattccattggtgacacccattacaaagtactggggaagcagacaaaatgattagattaggaaaacactgtatggcttctcttacatctaaatggcccaaaatgcatattctataatacatgtaattttaataaaagcactgcagaggtagggagtatagctcaaagatagaacatctgtatagcatcttcaacacccttgatataaaagttttgcagtaaagatatatgaaaaaaattgtatgcattgagtactgaccttcaatttacaaaagaaacatatgagaaatggattttctttgaataatataaaatttttatggattcctcaatttccagcagtcttcctaaggaaatgagctacaacccatgcttacagttgttgaatgataagttgttcgcaaaatacttcctggcaatccatcagaaaattattataaaatactggctgttagaataagatcttgtgaagtcattttccacaaatttattttaatctgtcaacttctagtctctgatgtgaatggaacactcacatacaatgtgtgaactccatcatttatgtcagaacactgcaactctccatggttttgaaatggagatgacttctctaggtgattataattggcaaataatttaaaatacaatggtttcttaataagttgtatagatacattagaacatgtgttaaaaaaaaagaaaacagtaaaccaggctagagagatggctcagcaattaaaagcactgtttactcttccagaggatctgagttcaattcccagcatccatacgacagctcacaactgtctgtaactcctgttcccagggatctgacttcctcacacagatgtacatgtaggcagaacaccaatgtacataaaaaaatatattttttaaaagcaataaaccaagtagagattcatgaatttcggaagcttttctacaagttggtagataatgtggtagaaattcagctctcaataaaattataggcagattagatgctatttaataatttaaatgtaaagtttatagatgatcttgctcaagcttattgggttgaatatgatttacctgcactaacacatggaacttttcctacctttttttttttctgacttagaatgtatttggaaatataaatgcatcccccctgaccctaaggtgaactaatttaaaatactaaaaaataaaagaaaatagtattcatttattccagagttcaaagaaaattttgttttaaaagttcagcttaaataaccacttatttaagtaatcctggtagtaagctcagtgttatgaaatgaatcctctggataatgaaaacctgtcaagtccagcataaatgcatgagacagtggctatatgacccacataaaataaaatctttattatctacatgaaaatttgcctaaaccatgtattcaaattcatcttacatggaaaattaggcattatatatgtttgtctgaacaacttcatcaatactgagagtgcaaacccatgtttcactcttgatgttaattgttatctagaaagaacaagtgttggataaaactgaatttaaattaaatgaaacaaaggaaggacccttttatcagagatatttaaacttcagtagtgattttatagaaattttcaaaggtaaaaagccaatgatatggtgagccccaacattttactaaagcacccctctctctaaaaacaattagcattctaaggaccagtgattgctggagggagaagtcctgctgatcttcctactgagattatttaatggcattaaatagaggtagaagtcacacatataatcattaagagacattttatgaaggaaaatgaacagtgggaaatatgagggagaaaatatacatatatatgaatgaatgaaatctcatatgggggaaaaaaacaaaaacaaaaacaaaaccaaccaaccaaccaatcaaggaaacaaaaccccagtagccctgatctctgacttccaaccatcccatagagggcgctgttgtgacaggctttgatgacagaaagttttggtttacttgtcaaggagactggaagaggtatgatacagaaaagtgatttattcacattggtggacaaaatcctactttgccattttaaatgggctaatagctcctatggtatagttgaaaaatctctagtcattctaactgcagcctcattgtaagtaattgctctgcacaacccaattgctttcattatcaaataaataataataataataataataataataataaataaaataaaataaaaataaaaaataaaaataaataaaaaagcaaagatcgactaaaatggacaaaagcttgggagacagtagtctttaaagtatgatggagcgaacagaaaaagaaagcacgagcctcagaatgcagtgcagtctgttacttggggacaagaagataagaagactaactaacaccattcaacactgcagtaaagatccagaaaagttttggacaggtcagtaaacagtgctagaataaaacttgaccagctaaggactgggactcagcttggacacgtttgttggtttcagaatgaaaaccaggggtcctgtcaatgattccggtatagtagaacagaatcatggattgttatacgtgcctctgatattttgaaaaaaatgtggatttatttcaattttccatgtttggtgggctgtgcttttttaatctgagaattgtctgggattctttttttttttttttttttttttaacaatctgaggatatccttagctatcatgactccttcctgttgtcattttctaaaatcgtaattagagttaaatgatgtcatgtcttacttacttccatgaatcctaacttttgtttcagatatgtcattaagttctcccactttactttgggtaatttgacctttgcgaccaagttcattaaatcttgctttattaatgcacctcttgttattaaacatgcctttttttaaaaattaggtattttcctcgtttacattttcaatgctatcccaaaggtcccccatacccacccccccccaatcccctacccacccactccccctttttggccctggcgttcccctgtactggggcatataaagtttgcaagtccaatgggcctctctttgcagtgatggccgactaggccatcttttgatacatatgcagctaaagacaagagctcccgggtacttttgaattttactttttcatttgtattgaaaatatattttttctcatataatacatcctgaccgcaatacattcacttccccccacttctactcctcccaagtcccaccccactccccagtcccccacatccactcttcctcctttttgtgttcagaaaagaacaggcctccaagagacaaaagccaaacaggacaaaacaagatacaaaaagacaaggcaaaaaattctcctattgaggctagacaaggcaacccaaataggaggaaaggagtcccaagaacaggcaaacaagtcagagatacacctgatcctactgttaggaaagggatacaaattggaaagaaagaagtcaaagtgtagttcttggcaggggtatgataatatacataagtggccctaaaatttcactagacaactcctccagctgccttttcaattttattctgcattacagtttacattttaatactacatcatttctataatttctggtagtttttaaatatagtgctatgttttccattatttagttttgccagtttaaatatgtgtattttataaattctaattaatccattatctgaagttcttgaaatttatttttgagcttttaaaatcttttatttaaagtggattttctctttttaagtcttttatttaaagtggattttctcatataattttcaactgtgtttgttgatctcatttacatttgtctcaaccaggatgtcttgatagttttatattaatttcacatattgacaatacttggaatatacacataggaagaaatcagctttaaacctgtccttaatatatgcatgtttataaatacacaagaattttttttaattatcttcatataaatccaaggtcatggcagacaagcttgtttattttcccttgtacaaaggaacagaacttgttctagagtacacttgagcatagcattttgagggttcatatacctgcgccacttaaacaccaaccgcaatcccagccttttaaagccctatttatctgaatgactctatttactctaatgactgttaaaatgtatatctttattaagtccctagcaagaaagatacagcataatacaaggtcatgtggctctagtttacaattcctgctatggtgggtttggcttttgagcctgtttggtttgggttttgtctttttatttcttctgccagggttctccacttgaaaatatatgtgtgttatttatctttcttttctaggtttttggagtatggaatgaagtgttggttttggggagtcttgttgttgttgcagttattgtatttcattttgatttggattggggtttagctttctggtatagtatcattgtcagaaatggggttcttaatttactctattctatttccatgtatcttgattttaaagtaacaaattttctctttataacataagattatgatgttaaaaaaaagatgcatctacattcagagaaaattacattgcttccagggcaagtagaagagcttagggacatgttaggctggggtactcgaaaatgctttgaccaagcttactattgtgtcactgaaagaagagcagatgtcttgttttagagagcactagaaaggcatgttgctctgtttttagtgtaggtcattgcttgtttcaaggaaattgctctaatgttatctgttttctatcgtctcataagaacggtaaggatataatcccacagtaacccagatggatagatgtgtacattgtaaagttttatttcatcaataaagacttacttttcttaagaaggtttgagttcctgagccctataaaaacaagatacaagaagccaactgctagcttattaccacataaggttacatcttatgacaaatattgtgcaaacatgagtcaatatccttctagaaaatttttaaagtttcattttataaaaatgacaataaaaggcatctgctattttataatcagcccccttacaatcccttttatattgaaaatatccttttcctttgcagtatgttataatattgctttagccctcctattaacttaattttgaattattatctagcaagtacacagtcaaaatcagagattggctttgtaaaattttaccaccttttatagggcacttaagtgatgaatttttaggtcatttaatgtaacaaagtctcataatttttaagacatgtcatccttatagcagagctcaagtgaaaagtgcactgaactatcacatgtaagaagggaatgcatttcacctgttgaagacaatcaacaatttcagtaccacaaagtaataatgatgcaattattgtaattatttctacgttcaaaccagtgagcctaagggcctccattgtaggaccatccatgtattacacttgagagtaactgtaaaggatatgatgaatgctatttgcacttaataattagtaaaatttactctttccaaattaatctgaaattaatagggtcttaaaatatttctgctgattttttattaaatattaatcttttctatgctgttggaaagcacagtttccttttcttaaactgtttttcttttgagaatggttgtgtttattcgactcacatatttgaatttcatcttcacttactcttgcaattagagctgttcatgtcttttctacatttaaaacaattctttgccctactcattgtgaatgtgtggtcagagacaagggaggagtagataatatccaatctgaacatctttcctactcataattgaaggcactcactgcattctaaactgacatttacggatggctctggactaatttatccttctctcttcagcctgcatatttcttctgtgcataattccttcttgaagttaatgggaatttggcatgtgacatgagtacatgtttcatgagatgggaatctgggatccgtcatttaataaagaatctgccttttcccttaattggtctgtcttcctaatgtctttcattataccgtagtagtgcaggcaggccttccatcctaatgtgaagtggaactgttttaaaatgcaggttatatatggcttaccatgaacagaaagcaggtgcatgatctattggactaaagatggattttgaaatgttatacttttgaatagaagataaaagtaaaaaaaattctgtgtgcatgctacattgtaaacattttaagaataagacacaatatcacttgcctaggctaagtgaactctcaaaacaccttacttaggcaatgaacttgaaatctgaaagaaactacagctttgttttttttttttccttattgttcttgagtgttgtgcattactgtgctgaagcttagcttggcattgctaatatctgcatttctggtttgcaaataactttcatttatatgtatggtgaaattattttattatctacaccattttcaagaacttactgataatgtcacaacacattgaataaataagctatagtgtcaaagcaagagaatgccatgcagaaacaaagaaaagtgagaagagatgtctctatacttattagaaggatcttaatatgcaaaattttaaaagtcaagttgaaaaatgtatatataacacattatgatatatatatacaatttttaagaggccatgcatttaaaagaaagaagattgtggatgcatggaagttttaaggaaggtggaatgatgtaattatattgtgatctcaaaaaataagatcatcatttaaataaaaattgtgaaaatgtaatgataatatattcttatatttgtagttggataaaaattgactggaattattaatagaaaatagtaaatacatttgactccctagaagggaaagaattgaatgaatagaaagaaaacataaatgaagcttttcagtatttgcctttctacccataattggtttttaatctcattgatttattacatagtcattatttacttactcacttttcctgataggaatgaagttaaaacttagaacctagatttttttttcacactgccactaattagctatatgagactttgtatatgtcaccaaacctatctggactttaatagttataacttatggaaattagaataaatgatttcaaaagcaattatttgttcttatgtcttgagagatagaaaatgtataacagtatagtatggcgacatgtagatcactttcttaaggaataagaatgtgagtaactgacaataattttacctactataggatttatatgctttccctatttattctctgaaattatagttaaaataagttctgtcaataagtcaaacagataggcatgcctttaccatttgaaaacccaagtttactgccatgctaaaactaatatctatcttttaaccttaagctaaaactttttacaaatatttgctaaaatatcctaagtgttgtaatagcagatgaactcaaaacattgacttttaactgctaatcagcattttgataagcttctgagtctttattaaatatgtgttcatgtttgatatccattctgtttaggcttcaattatttaattacaggtcttgatatgaaacgaatcatgcacacatccatacgaagcttgcatactgacaggagaaaatcattaaacagtcattactgtaaactgacgttggcctcaaatctttgcagttaacgggggacttgatgcttgatgaacaatccaattaaaattggcaacaaaagacctaaaatgtcagccaaattgctttttaatagtcaatgcagccgtcacaaaacataaacattaaagtccccatagaagcataaagcttcatggtgaaacaattctagaaaatgaataataattacagcatcctgaggattcttttaatagatgtgcactcattaaaatgattttgttggttagaaataagatgacaaagtttgtttctctgaatatttctttttatttgttatgttaacagtttggtttagagaggtgtgatttcagttagtaaccaaagaaataattttcaaagggttttaaaaatcctgaaagttttgacaaaaaaggagtataaaaagtatacatcatagcatgctacactttaaaataataatgacgaatcatttacttccctgacttttctcttttattgaaaatagatttttcttttataatatatactgattatgtttttcatccgtctacacctctcagttccttcccatctcctttctgtctctcattggaaatcagtcttctaatagataataataaaataaaaataaaaagataaaaaaatatcaaacactttggaaaagacaaaaccaacagaggtaaaacagtctaagaaaaggctcagaatcacataaagactcattcattcagaaaacccaaaaccataatatatatgcaaaggacaaataagctaagaagtaaataaataaaataaaagtaaaaataaaaattaaaaaagaaaattaaaattacaaaatgaaataaaaagccctaataccgctttctgagaccagaatccaaaggtaccattgaggttttttgtttgtctctctgtttttctcttggccatctacttcagagcatgcagactacccaaagagccatttgtttgcttattgagactccactggagggaaataagttttcatttacaaatggttatcaattatagattgtttctacgttatgaatgaaagcacgtgtctacttctttcagctctaggacctcatctggtgcagacccatgtaggccctgtgcatgctgcctcagtctctgtgagttcatatgtatgtcaatcttgttggtttagagggcctttttttcttggtgtcttccattccttctagctcttatcctccatgtacctcctcttagacatgttaccttatgccttaaagggtaagattttatggcaataacccatttacagctgagtgttccaagatctcctactcactgcattttgtctgaccatatgtctctgtattagttcctgatcttgcactgacttaaaaaataaaattgattgcatatttcatagatatataacatgccattgtaaaataacatataaatgaaacgggtgaaaaccagtcagtaatctctgagtagcaattaacattcagaggcttcagtctctggataagcaatatcaaatacataagtggattcatcacattgatatgccttatggagcagttttatttttagttgatggtacagattcaaaggtattaatgcatgttttttttttacctctggttcaattgttttgcacatggagagcaaagtagtagattttaggaaattttattttatgtgctatgaaaaacttacttgtcattattggtatgtatttcaatagatagagaaagaaattgtgtattttttttatctgtttgatgttgccacaggggggaaaacaccaaatgtctcctaaagaaaatgttttaaacattatgattttaataatacatatttattttctcaatgaattattgatacatatataatgtaccaacagagtattgaccactctgataatcaaaaatgagtaagatttgtatatgatcccaaacttactttttacttgaagtttagacatataaacaatttacgatagttcttcaaagtattcaaatcaagaaaataagaaaaaagatctccccaatactcatgagagtcttcttaccacatcttatatatttttaaaacgacttacccacattgatagatgagtagagccctcattcagatggtgccctaatacatttatgttttgaaatatctgtcaattaaacatagccttcctctacaatcatagactttaatttaatgtgtgatgaaggatatcttgatacttacacttctccagacgctgttcctctcttttatatattggataacttgatgctatggtttcagaacaacatttattttttttaaatccctcaaaggggtaatagatatattgggacttcaaactctattagctgaagcagtgaggagaaaagcctataggaatataaatgaaactttaatggcaccatatcacaaaatattaaatgattcaactcttcataaaaattgctcatgttttctgctctttttcataatataatgatgactacctatgtacacacatatatttatatctagctatctctaagtatatataagagagaagtgatatttaggctatgtctttaaactaccatttcagcctgtgtggaaataaagatgccttggtcttttatgcgcataatcatataaagtcctgtcagtaatttggttaagtgtgttttaacaaaccaaatctaccagctcttttgtcactgcatggactatagagtaacggagttaagcataatgtgtatacaaaaatagtatttagacattcacaaagaatttataaaagttcagcttgcaaaataacaatagagagtgataaagtatgtatgtgtgagagatctaaaccttcttctggccaatataaaactgttttctgaatgcttcatatttaccagtttcaattcaaagttaaaactctttattactttactaaacaaaaattgaaattgagtcctgttatgacctaagcgtttgatggacattgagaatttaaagatgaagaatatacagaattactcccaaggtcgaggctgtcaatgaaaaaaaaaaaaaaccaatcaaaacaacaaagagaaaatactatgataatgcagtcagatttctgataggtaactgtaatatatgacttgaatatacaaagtatagtggaataaagcattacagacaaagtaacattgctaaaaagatcacaggagcatcacagcaaaggcgacatatacaatactgtggcgatgcataagaacaagacaggtataatggaagttatccaggcttatatgttctatcaatgattttgaactgtatcttacaagcaataatgaaacattttttcatcatacttaataaaatgatgacaaactaattcattttgatagtgtattagaaacacacatgattaaataaggtgttgataaattatagaaataacatttatttatttatttatttatttatttgactgttcatttgtttattcaaatattttgatgagactccaacatgttaatctcaggaaaaggtacaatcaatattcctgaatatttttaattcatataaatcttttactgcatgttttctttgtaaagcacaatcagcacattttcatatagaaagaataaaaccagtttcataaccattttaaaaatcttcatttttaagttacagtattcagacacaacactcaataatattcaagatcgtctcatcaaggaaacttctctttgtaatgggcagagatcaccacagaaaactaaagtcctataaaaacacagttggagagcccaactccaactgatacatctacaacacaactctcttaaccaaggctcagagaatattgaagaagaagaaggaatggaatgtttctaggagccagggcatcatggagtttagaacgagattttgctttctcgtaatttcttaagctacacccaaaaagtgtcaacaacgggaccacccaaacctgactaactccagtgtacataccaaagtggacagaaaaaaagtgaggactccaacctatacaaagaactacaggtaactaatgatgctgagagaggagaaatagtcttcatcagggaaaagtacatcaattgacttctgatacaatatgatcaggtctgaaaatatacatacaagtaacattattcagactgatctggttatacttatgaatatgtatatacatatattcatgtcacaacattgtttttaaaaaggggccatgaatttgaacagggctatttgggagggtttggaaggtgaaatgatgtaattataatcttaaccaaaaaatagcaaaaataaaaattattcaaacaatgaaactccccacataattaatacttaactaatgatatgcaaaagtatatcattttaatccacaattgttttacagttaaaaccagtagcatgataaacaacttgacatatcaatcatttgaccagattgtaaatcaatgttttacaatttatttgtctcactatattccacatttagaatcagattttaaatcatactatacaaaactaaaaccaaagtttcatggaacaatttattcctttactcattgtgatgctctaccatatatactgttttatttcagtttttaacatgttggtcaaaatgttgttttcataacacatcaaatgatcatagttggactcctgaaaacaccaatcaaaatcgaaaatgtggcaaacagtgaattcagagtcagagagagagtttcacgacagccaagcaagacaatgttaagagactgtctcaaaatccttaggggaaaaagactttgtgccctttgcctgctttcttttcactacttattatctctgtgaccttggtaaagtcggttaacttatttggtttttatatacaaaatggaatgatgccttccttgtctatatcacagacttctgttgtagggaacaaatgagataatatatttcaaagtgctttgcaagccataaaacactatgtaagtgtaaggaggtgatagccataaaatgagactatacttcatagttatgtatttcatgtgactttggtgagccttttaatccttcaaattcattcatgaaaaataatttccttgagggtatctagtcacaccagatatatatgaaaataagtttgacaaagtgcttcccgttctgaataaaagacatcagtgacatcaattcaagtacagtttacatttttagcctcctagaaaagagtttgatacagatcaccacactttaaactaaaaagactcttgctaaaataatgggaagagtccatgactttatattatataatttgcttatatgacacatcctttgtgatacatggcactactgctaaagttagcctttggcaaaaatatgtcataaacacgtttgcagagctctaatagaaagaaatctataacagtgaaaaaggcaggcaagctatttatttgaaaaagcaatgcttagtaaaacatcattatgaactgtgttcatcacttgctttaaaaaaatttaaaaagacctgaaattcagtgatatggggggggggggagttgaccaattttgtccataagaagtttgttcagtactgactgtgtgccaaactggaagtgctaagaatctctttccaggagctttatcctctgttttttgtttgttgggggttttgtttgttttttgtttgttgttgttgttgttattgtttttttctaataaaccaagatacaaaaattcttttttattagatattttcttcatttacatttcaaatgctatctcgaaagtcccctataccctccccctgctctgcttccctacccacccactcccacttcttggccctggctttccactgtactgaggcatataaagtttgctagaccaaggggcctctcttcccagtgatggctgactaggccatcttctgctacatatgcagctagagacacaagctctgggggtactgattagttcatattactgttccacctatagggttgtagacccattcagctcttgggtactttctctagctcctccattgggggccctgtgttccaccctatagatgactgtgagcatccacttctgtatttgccaggtgctggcaaaggctcacaggagacagctatatcagggtcctttcagcaaaatctgttaacaatagtaaaacaggcaaaaatgtagccacagtgcctgagagatggctgaatggataaaggcacttgttgccaaaacaggtgatgtgagttcaagtaccataattaacacagtggaataaaacatctgaactgactcccacaagttttcctctgacctccacacaaatgcaagactacacacatctatgcacagacatgctacatagtgtaaaaaaataaataaagagcgagctatatgaaaattcacagacacagtggcaggcctggtttgtattaccttactcaaactcccgcaagtgatgaagatttatagatttattacaagtgtggggtgtgtgtgtgtgtgtgtgtgtgtgtgtgtataaagttcaaagtaaaggcaaaagtaaaagtgactctcattcaggaaatttcagtagaaagaatttgaatgttatggtgtccatagaatacagtggctgtatttagtcctggtattttgtgtatctgttctctccttgctactacatggtgtcagatatattaagaaatctgtaggtatatgtagaatatcatgtttttggaggttaaaatagaaagtatctgcttattttttaaatctcaatcacaagttacaatatagagggttagaaataaagatggcattttttgaacaagtgtgttttagcagattcgccttccccttcatctgcttttcatttagatttcaagaactttttagtgaataagacaggactgttccttagagagaaggaatatggacaatgaggcatgaatgtaagggcttagaggtggaaaccgtcaatggtctgttggatggtaagcaatggagtttgacaggacatgaagtatagaaagtgagaatagactgaaatcatgtgtttttcgtgtttaaatttttaataaaatcaaattcaattgcaatgtaataattctggttgcattttaaaatacagtgggcattttctaattaaaaaaaaacaacattattttaaataaggcattcttcaaaagatgtatcccattggcctttttagaaactagaacccagttttcactccaccatcaagcttctctagtgttaggcatggtgttagatcatacatagcctgataacatgagaagctccctattttaaatttctctgaggcacaaggacaaacacatacagaagacatccagagatgaacacttgtgcaaacgcctccattggatttcttgctctgttatttttccatatcccttactcctcagtcttccttatattcgacagctgcagagacacctaattggttatgaaattgaaatgtcaagccaaagatttatgtccctctatcagttatacaaccccccctctacttgtccatattcttttcccatattcctgtttccaggagcataaaataaatagtttcccataggaatatattgtccttaaagaatattgatgcctttagagaagtctgggatgtggacagtgaatctctgataaaatttgattatactttatagtgtcacattagtaaatattttaaacataaattcctgaataattgttgaaccaaagcttagccaatccttgcaaatataagttctatgtagtcgtttgtaccagtagaagacttattttttgtaataattctccaggtaatacaggttcccaatatgacacagttacaatggtatccaacaagatcataatccactttgggatagaaaagtatcattctaatccttctgaatgtcttccagaaagaaaaaggtacacatctaataaggttatttcaatttaatccccaaattgggatctattgctaactgtattgagtaccaggttcagatgatcatctactggcatagcactggtcatatgtgtaaatggatctaaagccaaagaaatatcttcataagaatcctataatatttataaaatgggtatttacaagttaatcatgagacactagggtaacaaaacctttctggagagacagagccttcataacacatgccttcccactgatttcaagcatttgtatacacgtgcttatatttgtgtatatgcatagtagaatttaatattttatgtaatctagtagatcagcacaatatttcactggcttttacattctttcttcatcttcttccacaattctccctgaggcttagagagaggacagatgaaacatacatttaggactgatattccccagtattgtattctctgcacattaacaagttgagtgtctctgtattaataaccatctattttaaaagaagcttcttgacataagataagttagatgcatgactcacagtagctgggtcttcatgcacaagacctttgcagtactgagccagctaaatctccatcatggaagggagtagggtacactctttaaagtcatacttctggctggaagctgctggctattgatgactgctgggagagagagaataagttttcttcagagatgtggctcccaaaatgctacacatgctccagtaaatagccctatatgcaggcacatattatataggagtatccagttggtgaaacatgaagttgggaggaaataatggtggaaggtataggagagatatttaaaatttttccttttcaaaacataattaaattttaaatgattcaaaaacaaaaacaatgagcatacaattttctgttgaacatttttttccaggaaccctgggttaagaatacttataatggaggcaaacaaaatactttttgttcaaaagaatgcattatagtacattcatagcagacaacattttacaatagcggacaaaagtaaatgaaattggcaagtgaaaaatactgctgaaactaaggtcatgtcgaatgctcagttgtttatatgatgtctcttatggcctattgagagaagtgacattcacttttaacattatgtcttgcgtatattacaaagccaacaataaccagtataaacactcttgtttagataacaaaatagacagcttagggtcagaaaaatttcaagtcaacattagagcatctgtcatttttgttctctgtctttatccatttgtttatttccattcattgctcaagccacccagttactttgttcctttacaagaggtccatttcccttttctatgtaccattcagcctttctgtaaacgttctgggatctctttgcaactttggcactggttgctagacctggctctttcagtcacctctgtgcatgtacatacacttgtcctatcctgatgactactcactgttgcttgtggttatttctcagacagatacatccagtaggtaaaaaggaagatatatttaataacagcttgatttatatacttttttttagaataaagtgagtaaaggaagcataaatgtaactgttgctcttttatttccaacatatattttctgaaagacagatgctggtaaccattctatatagaggtaaaagggttattaatacttggagggaaagaagtcatgttcctctcaaatgcctctaatggtttaaacatgtgatcttgagaaaataatataaatttttcatgcttcatttttcctcatcttgtatttaaatgtatttatttattgcaccagcaactttataatagcaataacttaccacatcttataatgagaatgatgatggcgatgataaataaatggaatgatatttgcacctctctctgtcagagacctgaaagtaattaaacacagtagaaactatttactcagaatgtcttagacccgatctcttctagattaattatattagaatttagatatcttaatttcaggcaaacataacaatttttaaaggcatgttagctcataaattttcctacatagtgtgggatgcaaagcagagtaagaaataatttttgaaaaattctctgtgctttagaaagcatgatgcataacgtaaaattaagatttgtataaaataaagacatgttttaaaacctgtcttgataacgtttatagcatgctattatgcaatcaaggttaattaatgctatatactgaggtatgttcccccaaatccttgtgttaaaatcatagcagaggtgatagcatggtcttgctaccctatataccaacatgattgtatttgcagatgggacttgcagggatcattgcgtctagataatgccatgacagttcactctcatgggagagtaatgtccttatgaggagagactcattctcccttcaccctatgagcacacagcaaaaagggtgtcatctgaaagccaggaataagatcctcctaagaaagcaacaatgttggcatttggaaatttatacttctcgtctccaagttgtgagaacataatgttctgttatttaagcctgactttttctctgggtaaaatatcttccaggtctacctatctgtgccattgaaagtggtaggatttcctttatggttaataataccccattatgtctacatatcacatactatgtatctatttatttgttaatgggtgtttgggttgacagcatttcttggctattacagccaaagcaacagtgactatggatgtgcaaatatgttttaaaattctgtttccaactaatttatttaaattctcttaagtgaaattgctggatcatgtaggaactaaactttttataatttgaaaacttcattatttgtgtttcatagcattctaagagcacaaaactgcatcttgtctacactctctccaacatttgttatttttctgaatatttataattcacatcataatggggtaagtgacagcttgctgtggtttcatttgcttttttataaagagctgtattgatcatctgtagatcttctttggaaaagtatctattgagcatcttttatttatttccttaccaagttattcatattttgctgttgacttgcatggtggtttgaatgaaaatggcccctagaagatggtagatttgaatatgtggcctctagtttggggaactgttttgggaagaattaggtggtatggtctttttggaagaagtgtataattaagcataggttttgagctatcaaaagtccatgccaggcccaggctcttgcatctctttctctcctccttccttccctccaacttgcagaactgggtataagctcttagttgttgctccagtgccgtgcctctgttctccaatgaaatgcattcatttataacctttcttggttatagtgactcttcacagcaacagaacagtgactaaagtgactaagatgatttgtatgcattccatgcatataatggatgaaaattcctccttaaacttgtacttgcaaatatttatcccatttcataggaattttcaatttactcagtgttttcctttgatacatgagataaacaagcttaaagtaatttcaaaaaaattttcattgttcatatatttccactcattagtcttctatataaacttttgttgtattgtttagggcttgaggatgcatttgtttactgcacatttttttgatttttataaataaaaatgttgtttaagttgattttatctacatgttgtattttgaagaatataggtacatatacataccagatctccaaatatgaaataacaatcaacatgtttttacagaatgtaattttaaattcaattttaattttaatggacaagacactgctcacccttggcccagataaccacctcttttgtcatggtatagaaatagaaatgctttatataacacatgtattctgtctatacatattaaatttattttcattatattatgaagtattatgttttatatgtataaatataattctttcatttatgatttttattagagtgtgattggaaaacaaaattatatatatacatatatatatgtatatcattatgagaacttactcaccttgtttaatgattcttataatgatatataataaactcctcacttgacacagattattcatgcatatacttattttaaactgactgtcagggagctcagactggccttgaacttactatgtagttgaggataaccttgatcttttgatgtttctgcctctacaagctgagtgcttaggttgtaggcatgcaccattaagcacagttagtgcagtgcaaagtaccaaacccaatgcttttatctatattattcaaacacagtatcaactgaactgaatatatccttagccttttatgcacatttttgagaccagcttagtatccacaaaattgttaaatattagatgtgggtatatctgtggaggatttcactatgggtatatttagtataatcaaccattacagctattttactgagtaacatatgcactgttactatttgtagagttactaagcccctagtatcccctcataattatccattgttgtaattataaagtacatttagaggaaaatccctacacataattcataacttaaatagatctattttattttgatacaatttatttgatactaacttggcattccccataaaggaagagatggatatcaggaatgatcaaactgactaccagaggatatattataatatactccaatgaacatatgtacaccacggcatacatgaacatacacatgaggatatacatgtgcatgtacacatacagaaataaacataataaaaacatccttaaagtagaaagtgatctaaatacttgagtagccttgcccaatcccatcactggtggctcttacagagaaagagggagggatttttttctttgtttcttttttttttttttgtatttttttcaggaacattttaacaaatagtagaaaaagcagtagtaacagaaacaacaacaaacatgaatatgccagtcttctcttaaaattatttttaatataggttaattgaatataattgtattactttcccccttcctttcctccaaccaaccctgccagccatcctccctcaaaccagccccatgttcctcactctcaagctgatagcctttttttagtattggtacatacatatacatatgtgtgcatgtatgttcatatattcttggatatataaatacaacctgctgaatccattttaatgatgtgtgtgtggaggtagcttgaatgaaaatagcccctatatcatcatagaaggtggcactgttaggagatgtggccttgttggagaaagtatgttactacatgtgggcttttatgtctcagatgcttaagctagaccttgtgtcaccttctcttgctactgactttgacttcagatatagaactgtcagctgctcttcatcatgtctgcctaagtgcttcatacttcccaccaggatgataatggactaaacttcagagctataagacagttacaattaaatgttttcctttaaaagagttgccttggtcatggtggctcttcacagccatagaaattttaatgaagaagttgatacccaggaatggggtattgctgagttagacttgaccatgcttttgattaagagaacatggacattgggacgttggatttggaaagtagtggaattctttaaacaacactcaatgggccataatagtataagcacagacgacagtggtgctgagagtaatttgaactgtgagggcccaaagatgtttcagatgtattagtctatgggctggaaaccattcttgtaatattttggctaagaaaatgtttgctttctgcccttgtgcaaaaaaaaaaaaaaaaaaaaatctgcctgaggttaaactgaagagatatgaattaatagctttggcagaggaagtttccagatagcctaatagtgactgtgttacttggtaattagtgaccatgcttatgcagatctatagtgtaaagtaataatctgagccaagaaaaataacaaatgtacagtttgaggataaaggagtacaaggaaaaaggtttttttttttttttttaaagtctattgctaaatggattaaatggagtgaccccagatcaaaacctcacctagctaagcttccaatttgtggaagggcgttaaggagaagatgggtagcaaacacctttaatcacagcagaaatcaggaggaaacaggcagtggatttctgatttcaagaagagcctgggctatagagctaattccagtacagccaaacttaggcaatgaaggaaacagtggaaaacagaaattgactgaaaatgcatttgaccaagggagccatgtttcactcccagcaaacagtagaacttgatagcttcagctgtgtgcttctggctttagagtcaaggatacaagaaaggggttacagaatctccctccataactaaagaaagccaaggctaggaatatatcaggggtatcccacattgagtattagagagggcatttcatgttcctatgaaggtgaaacctggattgctttggagaccccaaatgttggagttgtcagaattgtgcgatacctgcagaagaaagctacttatatgagtggaaccatcccaagagaaagaagtgttgcagtcagcaaagctaaaatgagttatagatctgaagagcactttgacatcagacatggagatgtagagtttggagttttcccagctggtttttggtcttgttttggctcagtatttactatgcttcatttcctgcttttttgaatgtaaatatgtattctgtgccagatatgtcagaagtatgcgatctgctgtttgattttgattttataaaatactatagttaagcgattgtcatagatttcaaaagagattttagcctttggccttttaaacaatttgagacttatggactatggagacttttgtaggggagctaaatgcatttctgcaatatgatatagctataagcctattggtcagggagaggaatgtgatagtttgaatgaaaatgtagccacaggtcattgggaataccactattaggggatatggccttattggagtagatgtggccatgttggagctcattgttggtaggctttgaggtttcaaatactcaagtcaggcccaatgacactctctcttcctgatgcctgtggatttggatacagaactatcaggtccttctccagtaccatgtctgcctgcataccaccatgcttcctgtcataacaataatggactatgcttctgaacctgttggtcagccccaattaaatgattccctttatatgaattattttgtcatggtgtcttttcacagcaattgaaaccctagctaaaatagtgagtatatcgtttttaaggatgtctagtctgcattgtatagccaacaaggggttcatccatatatgaagctaattctcctttcccagtaataattggttacctgtagttctttgtctagacgactctgtacacgtttcctatttccatgttaacatatccattgatattttcactgttctcatcttgtttatgcaatttctagaagactgtttcaccaaagacttactggtattctggcttctccactattctgacccctcttctggataatgttctttgaaccatatatgcagaaactgtgatggagaggtatctgttgggactgggctcctcatgatctgttgatctctaaattatgtcagatgttttattttgttttgttttgttttaatttcactggcttaattttttaaaatgaaaaattcaggtgatgccagtgttgtttacatataatataaactatcatcaatattgtcatgtattaaaattatatttggggcagggtgtcttagcagttaagaacactggctgctcttccagagatttgagttcaattccaagcagttgaatacatgctgtctcataaccatctgtaaagggatctgatgttttctcctggcttgtaggtttaaaacattcctacatttaagaaatgcatgaagaaattaattgtaaagactatatttgggtacatggtaaagcagggttattgtatgatgacaaacagctcagatattattagcttataatatggctgctggtctttatgtctataaagtttctgcttatatatctactgtaaaaaactctacttgtaggtcattattcttctaaatcacatagtttgttatgtggtatttcacgtatatgatctttagatgtttctgaaaattctggcactttgaccagatatacaaactcctactaacctcatgaggtctgttatactttgagaaaattctttgaaaggcagctttgcttgaagcttggcccagtgaataaagcatcagataatatttgtgaaagtctttgaggaacgcagatgaaaggtgccttgtaaatacaaagcactaatgttgcatgcatggaaatactttcccttcacatcattgctataatagctaagttctgaggtgctgttgaaatagatactttcagaaagcatgcatatccccaaattattgagtatggaggcatatgcaagataatgcatccaaagtcctcaaatgagaaacatgaagcactacttgttatgggaagtaaaagaaactgagactaataaaaaagccaatcaatagaggggttcagagtgcttagaggaagcataaaggatagacatcagcaattcttgtttactcatgacttcaataacatctttgaagactattatatgaaaaggagaaagtgaaaaatctagaaagaattttaactataatggaggaattgctaaaaaccaagtgtcttgaaaccaagtagatttcatttcatttacttgctagatggtacttgaatattacagatctcatggtgttcacaaattcatcattcatttactaattatatgcattctttatacattataccaagtactctacacattcgtacatttgattgtagcaagtttttaaagatgctaacactatcctaacttcatagaagagaaaacagaggcttgaaaagttgtatttgcactttgtggtaaatggcacagccatgctgatctgattctaatgcctgaaactgagttcatcatcacttagaaatgtcataatgtagccactaacctaaacttatataaaatggtaccttttatgaatattttcattaattccttgaggatttcatacatagtattttgatcgtgtctactcccatttccaaagacctcctagatctacccctgattctgtatctatccatctctttcccatctaataggacaaaattcagtcccattagagttgactatatattcttaggtatgtggtcatttactgggttgtattagagacatactttaaaaataattaaatttaaattaatttaaaaatctccaggcaactacaaattaccaacagctcctcaatctaggagtggaacttcatactatcttctaattttatactgtgattttgtctggcttcaatgtccttgggccttgtgcacatcatcacaatttcagggaattcatatgaacaactgcctgggtgcgtctggaagtcacagtttcattgaagttatctattgcctctgtctattacaatcttctttaagtaagcaaggtagtaatagagaactcatggtatacttaatccactttacttaaaaactaaacaaaacaaaacaaaactgaaaccaatatgtttatttcttcattctgcatcaatgtgcaagtattccacaactaattaggtcagtttctgtttatcttttcctttttgataatttgtattaatggtcacaagtaataatagcacactattaaggttttactcctccttttaaagatagatatttgttcaataatatattacccttgagtttgtactttctgcatctataggtcttgacctataggtgagttttgataacaactgggagatcctatggtagactatgatcaaacatgccaatagacatatttagctagataaatggagcatacttgggctctgtgttctgttttctgatgagacaagtttccgtaatgttggcatagatttgaagatcaaagagctaaacaataagcttgagtgacatgacatcctgaaaatcacaatcatgatttatattacagtttcccaataccagtgaggctaagagtacacacaacatcaatcacataattttatgttagtgtatgctgatgtaaaaacatattaatgtgagtgagagcttgactttatagagtacaagggatgtaaaaaggatccatgtacccacctgaatcctgatttgaattctgtctttacaatgagtttttgacactcaacaataaaccaaagcaaaagcaaagttgaatccaatccaggttatcatcaggaccatccatgaacttaaatcactgtgtggtctatgcaaatttagacattcaggaaagagcattatgcactcagccactgagttaagatcctagaattctcttttagaaactacttcacataagtaatatgtctaatgctatgttcctcttaacatctcacacaccatcagcacaatacttctccccccaccttggatattttctcaaattatatttaaattagcctaagttaaaattaacttgttcatgagacttgcttgaatgaaacttaccaatcactaccatgaatttttttatttctaggataatgactagtattgttatcagcataatacattcataatgttttcaaaacacattcttacttttccttctgtgtatataatctgattttcttccctttgagatgagctattttttcatttgacctattttctagtttgaaaaacttctatttatctatgccttccattaatctcaatggtaggagctgtccaatatagttttcaatccacattgaatattatagtagaacattctactaatttgcttattttgatgaacatttttcacttgatccagtaagggaagtatctacataaaagtatgtttcctaactgagctgtttccttattacttctttagctgtctttcagttagtgaattctccaaacaatgtacatatagcttgaagctgcatgtggaaatctattgctacaaaaggatttatgtcaacatttttggattctggatgatattcatctaagatattgtatctctttgaagaaccataatgatctacttaattttaaagagtatctgtggagattagcaataatgtaattgaagggaagaatcagatattgaaagaaaaataaagcaagttaaaaatgaaaagcttaccacaagcaatgcttgtaagatagctttgtaatagtttcatagatcctcaagttgacatctcagaaaatatctcaacataatctcttataaaaaatgttgaaagagaaaaataaaatttatgataagagaattaatcaaatgacatttcaggtaaaagatatttttcagatataagctatgtccacacaatgagaaaacagttagtaaaaagggaaaatgcaggcaagtaagttattaggcatcataaaacattctgcacaaacacttggtagtttttgacaaaatggttgaattaaaattttaaagatttaaatttgttcaaattaattccttttgaaaaaaaaaaccttgaaaataaaataatacaaagacaggctagacaggagaatcgtaatggttattcaaatccaaatcataagggatatattccctgagttcacaataggaaatcaagggtgcctgtctatgtgtgtgtctctgtgtatgtgtgtgtgtttgtgtttatgtgtgtgggtgtgtgagagagagagttaagcaatgagaaaaaatcctttcagatcttatatatatatatatattcatataattgtgccatatgttcccattttacaagatggaagcctattcaactgttccccaaaataatgtcatgccagaattccttcacaaaactcaacttactcctttcaactggtattctttgtccctaaaattgtgtttaaggtgggactgcagagtacagggataggttttcatcagatgtgtaggaattgatgcttggcagtaggatttagaacctgaatgttttctttggctttggaggactttgggtaatgataaaaatcctctctaggcttccctgctctctaggttttgttcatatttcttagactcatctttttatttttgtagctaatgttgctgtttttttatttctgttactatttttataggatgctctaatcaattaatatatgataccttagaacttctgacattaaataccaggaaggtaagatggagaggtgacatgcagcctggattcagtttcttttcacagtgtttatttgacactaaggtgttaagcaaagtaaaaccaaagtttctgatttgtgcttcggtgttctaaattctgttttcacaaataacactgcaataatttttatgcattgctttctgagcaaatataagatgaccatttataacagtgcaatataaatgaagccctgaaaatgaaaatcgtaaaattctagaatatctgttattaatgtattaaatgatacactgacacttaattcaggactttccattagtagcttttcaataaataatgatcttcgggctgaaataacttacatacctacatgtaactttaatttcagtgtaaagtaaatattaaacatccatagatgattacttttttatattttctttatggtatacttcactagctaaaagtggaagccaaagaatcaatgttagcatgctataaaatatgccaattacctatttcttgttttatggtatatactggatgacagtttccattaaggacatatgagtacttattttaattttattatcttatattaatatatagtgatatttgaaattccaaattatacaataaaccatgtttgtttgtttgtttgtttttacaattctgcttacataaaggataatttcttagtgtaacaaatgctttggctctaatagacatgcttaaataaataggaaaagaggtttgaaccatatcaaaagaactacaggaaactaagaagagtgctaagagtgggaggaaataggtttctttaaggaaaatcaaaccaattggctatttaatattaactgatcacccctggaaacatgcattcaaataacactgtatagactgagcagattatatttagtatgtatgtatgtgtgtggatagatagatagatagatagatagatatgcaagtagcaacaattaaaagaaagaaagtgacatgtgtttgaaagagagaaagaataggaaggtttggtaaaattgaatgaatgatataattaaaaacaatagaaaaattaaaatatagaattgccaatttgggggaatgggaagctcatctgttaagacttgtggctcctacaggccacatcaggcacgtttcaaacacttgttagctctagctccagggatttaacactgccttcccagcaacactgccttcccagcacacacacacacacacacacacacacacacacacacacacacacgactcaaatgtttaaaattgtcaattagtctaaaatacaagcaaagattcacagcagtgaaaattaggtaattttactactacagtaataatttaagcaaaacagcatttactagagctctctccttcctcttgcttgtaaagtcctagtttactcatcatagtctgaattgaagaattgtcttagcaaacaagccacttataagcagaaacattaactattatgcctaaggttgggtaatttgactaagtaaaggcaatccagtgcacatctcagcgaagtcaggaacaattgggctcgaggcatgctgctttgtggattgtttttcttgtaacgcccatgaaataacaaaaagaaaaaaaaaaggaagtgaagaagacatagaaactttctgaaggttgatctctcgcttcaaatgtaaacatgagagagcttacgtgtaacatatgagtttcagcataatcatctcaaatgggagatccttcagcattgacctttacacctagtagttatgacaacacaactaacaaaacttaactatgaatactactttacttgatggcttaacaagaagataatacaaagtcttcaaagaggtatattttgccatctcagagacactgaatggtgtcagagagctgtgggagcatgcctaggtcactgatacagtaccaaactaaactcatgtacaattcaaagcattataatttattggtagcctagccccagaacttctctgaggcttctcctccagtaatccaccttaattgtgaattctccctttctcttcagctgctctttctattgttgcttggatctgcctcagcagcatggccatacacatacataaacattcgcactttttgagattataacacgattacatttctcccttctcttttcactctgaaccatcctgtatacccttttgttcaaattcatgaactctttttgcttagttcttctgtgcattgttatatttgttatgttaaaacctcttgagcctttcctcatccatttcagcatctcctaggctatctctttaatagaattcatttttctcctcaaaccacttgaatgcttaacaggtgattatatatttatatgtgtgtgtgtggggtgtgtgtgtgtgtgtgtgtgcataaaacctataagtacaatagaggctggggagatgccttggcagttaaaatcagttgttggctcttgcaaaagacccaggtttcgttgccatcacccacatataaccatctgtcactccagttccagaggatctaatacactcttcttgcccatgtgggcagcagttacatggtggcactcaaacatacattaagagagaatacccatatatacaatataaaatgtattaatgtttaaagaaagaattacagtcacattaatattaaagatgttttggttcatccagagaaaggataaactatacttgtccactctcttttcttgaaaaaaaaaaaacaaatttcttagctttttgatcttctactctctaatagtaaattgtacgtttgaaacctcaagtgtccataggcagatatacttaagattaacttcttgatcactgagcactgtgaaggtaacagtcattagccttaagattaacatttatgtgctagtttcacatgagttataagaacttattatgacaagtgaacaatttaacactataaagtagacatatatgcttaggatttgtaggagtggttaatactagtaataaacccctctgccttcctggaagcccgtttcctttgatttcctctcaagcctaggagaacagttgagaaagtaacaccaagtggcacagccttataattatccttgagatacctgataaaagtagttatgacaaaagcctggtgttatttgcacacatacattatgatgatctttatgcaaatgcattaatgttacttccaaaaattcatcattactaacatatgccaataattcctaattcaatatattttgggtctacctgattcaaaatttcaatttttttttctgaacttataaaggcaactttacgcacacactgtgcattgcataataccatgtgttgggttgtaggctaatatcctttaatgaaattcactatttttccaatccaatgtataaacccccctttaataaaagatcataattatgctgaaacaataccactctgccaccagaggaattggaaagaaagccaacagtcttcatgatctttttttactttagcccagtaagagatacaatttctgactctttatgacatttatcctaaatgatagaagtagatatggcctctttggcaacatgcacaacatgatatctttgggggaaaacaaatttgagagaacataatcacagtatcactaaagtaaagagaggtaattttaatacataatattgttttaaaaacggatagtatatctactttggttaaattgtccaagagaaatgacatagttggcataattttaatactggtaatatttttaacatccaaataaaattattttttatgttcagttaattctgctacagcatttattttgaaagcattaatttgttcctttgctattcggtgtctttaaaacagcttttaaatttaagccaaaatttgtgtttccaacctgttaaaaacaagcactagatgaatgaggaaaaactgcatgcagaggaacgccacatgcaaatccatgcaatgggcacactgaaacacccccatgcatattagtagccttctctatgaacagctgacattaggactactgtcacaggcagataatcctcctactattttctttctatcttttattatttattaatcattttactatttaaatttcaaatgttatccccatcactgtccccccccatgaacttcctaccgaattcccctcccctttgcctctatgagggtgctcctccacccaatcacccagcccatctcacctctctagcattctcctcctctggagcatcaagcctccacaggttcaagcgcctcccctcccactgatgccagatgaggcaatcctctgctacatatatagtgggagccatggacaggttcatgtttactctttggttggtaattaatccctgggagctctgaagagttctaataacacaatgtttgcaaccctccaacacccattttcacaaacagatttcaaatatttttgaaaataaaatatcatacttggtttgccattcgtccatttgttaattaccaatatgtataaaactctactatcactcttactaagtctctttctttaaatatatcattgatagtttagggagtattatattctgtattagttcttctgttgccatgacacaatattggacagaaacaaattagaaaagaattgttgtcttacaagtcctgggggtacagtttaatataacaaggaaggcatagcagtacaagtagaaggtgactgggtacattacttacaaggacaataattatagaacaatgaataatttagctcagttccatctccgcttttcatgaagaagagggtccgagcctaggaaatggtacccactacagctagaatggttcaccactgtcccggttaacttaatatctcttcacaaattgtccacttgcttgtcttttcaatgattctagctcttgtcaagctaaaaatttacattcactatcacactctccaacataatttttaaagaatttcaacgttgatttccatagtataataaattttaaaaatgaatgcaatgccttttagcagaactcaatgttaatgaaatataaaaggcaagatatcctagagaggttttgtaatttctgctgaaagtttatacaacagtgatccatattaagcatcatctgcaaaatcagttggggaagatgcatgccaccttcttaccttatagagaaaaaagaagtactctttaaaagcatatacttctaccaacaaccctgccacatgtaaaatatcttagatctacagtttggagtgatttccccactgagtgattattttacccagttattttaggacctcacacctgaaattggttcatttccacatatattatatgaattagaccttgccatttgaaaacttaatttacttctagaaagctttagaactgtgtttgaacattgatatttgtgtaaccccccatagctcccaattttgcttctttcacttgggcactggactgtatggttgccaaaaacatttggaagtgcgtgcatacaactccaaacctgacagaattagtgctctatagctcctaacactgaacactaatgtatttttcattactgtttaatgttgggaaatcccatttcatggagcccaaggattaaattgctttacttggagggaacaagtgcattctccatctttttcctgaggtgataaaaagaaaaagaaaagaaaagaaaagaaaagaaaagaaaagaaaagaaagaaaaatgagtatgagatcatttgtatttcataaaggttaaggtctgcatgtaagaaattaagtataacataccaaaactgtgaaagcatttaaagaaaatattagcattatgaatgactctgcatttgaaatatgggaataaaaatagatagtaaaattcattgttatatgcatatgagtaaatatgcatatttaattatgcatgtatgcacatgtatcaatatacacatatataattatgattactgtacataacaattctacctgcagtagaagtgtaataatatatactaatgtgtgtgtgtgtatatatatatacacacacacataaaagtagattatattgattgatttttattttgtacaacactactgaatggcaactttcttttgaataacttccttaaagaaagtatggcataggctagtaaatatcatgtgtttgtttagaggtattctaaacttgaacactgaaataaaacttcctctggctgtgaaaaaccacaatggcttctttttctctacatcattaaatgtttcttatacgtgattttggatgccaaatctgtactgtgatagtattcctcttgacactttgtgagagaattgcttaaaatgcctccttttgcatagtattgttcttccccagggtcctaagaaaagactttcaatgaagaaacatacctgtctatgagcaatcaactagatattcagtagatatgcataagaatgataaccaaagaaaacactacaggaaattctttaggacccatgaatgaatcaaaatcctttgggaccttgctttaaatcagtactgtactccatggtttctgacataaaagagaagttgaatatgacaattcactaagaaatacatattcttagagaaaaggcaaaacgtgtgctctataaaataaataccatagtttatcaacctcaaaggctaaactttattaagaacagtaaatgttaaaattatagaaaagagtcaccttcattatccaagttaatataatagagagtactgaataatgaatcaccacacaggcgattttataacagtttattctgatgggcagtgtcaattttcaacttgatagacactagaatcatctcggagataagcctctggtcttgactatggggaataattttggttgcatgttgattgatgtggggaaagtcatcttaatccccaaggcacagaactgcgaactgtataagatcaagaaagcaagctaagcaagagctcacattcagtcctctctgttttccaattgtggatgtgatatgatcaactgcatcaagcttctgctcccttgacttccccactacagtagattgtcctttgaactgggccttagtgagggtttcattgctgtgaagggacattgtgactatagcaactcttataaaggaaaatattttactagggctggcttacagtttcagagtttcggtccattatcattatgacaggaaccatgacaacatacaggcagacactgtgctgaagaagaagcccagagttctacattttgattcaaagactgcagaagtagactgtgttccacactgactatagtttgaacacaggagacctcaaaggccacctcaacagtgacatgcttcctccaacaaggctgaacctactccaacaaggccatatctcctaatagtgccactctctatgagccaagcattcaaaatcatgaatcttgggtgaaggcatttctatgaaaaccactacaattgtaagttaaaataaaacatttctccttgaagttgcttttgtgagaatatttttatcatatcaaaaggaaaagaaactaaggtagtgcgtgactgggcatgtcatttcaactctccagggccttccggttcatcatctgaagccagactacagactctgtattcttcccattcttaacatcttctactacagtcagcatatagtcatcagcatattatcttcatctccatcttttagcagccaaattcatcaaaaggatattatattagatataatagacatattgtaagtgacaggttcaagtttaggtatgaaagaaactgaactccaagccaagtttgacattccgccaaagcctgtgctcttttatagcattttgccatccactacctttcattctgtgttttataagttatagtaacttaggaaggaagcagacacataaagataagtgaaacatttagaaaatgtacaagattttatgtctgtgaatcataaggaaaaaaactgtattagccatatctgtaccatggtactggtcaaagaatcatatgtgcattctattcatgttaaactactaatttgctttggttcctagacaactttcccatctgaaaaatgagagaatctactagcactttatgcttccttgaatctaaaaaatgcaaatcatatttctgtctatgtgattatgaatacggatgcaaacgttttaaaatattaaaaaaatgttaggtactagtgatgatgtttggggatttatgggtttggtgttgaacagagagtcctagggtagtttaggaattttacggattgctttaagtatagaaagataactgaactcctagaggaatctgtaaataacataatcttcactctttaccctatctgccttttgtgcaattcatattttcatatgttgagtttatttaaaaggggaaccacgtgtactagaaaattcaaccaagaatttgtcatacttttgctcctgggatagcatttttcttttttgatatgaaaaccaagccaatgtctttaaaattcatgtctgaagtggaaggattgaaagaagtgattttttttcctctgatcagtccctgcaaagtgggcctcagaacacaccagctgagccctctgttaggcagagaaagcctctggcatttttctgcttttcaattctgtcattggggaggtgggacaaagctgtaccatctacaaagtttatccagaacgtgctggtgttacaagctatacttgacatctattatgtttctcctgtggaagaggaaaaactatctgttacaatagtgatttcttttcaaagggctttaattggggtatttctcctgggccagattctaactaactttcttgatatgtgcctgtccagacagcgatggaaaactaccaaacactagcaacatcaggagtctgaggacttctttccctatctgcaaacaagcaggaaaaaaatatctttccattgctacctagggtattctaacatagcagagctcctaaaagggtgtagcaaaaggcaaggtgttcagacttcgctttgcatggccatggaaatgtgtatagtagccagaacaacatccccttagcctactttttacaaggagatgttgggtttatgaagagattagttccgcacagttgagttacacacttgtgaagtatttttctgaaatatggatttcctcctgtgtaggcaggctaacatcctttcctgaggtaagtcagaaggtggccttatatttttatttgaagtacagaatgatttctcctcacaacaaatttgtgcctctcactagtattttcagaaatgtgatttttttttttgcaacggatggaaatcatgtcccttccattctgtagccgtatatctcgttgatgacaaattgtgtgaggtggcctcattacttttagcttctatattcctgaagaatttacacataaatgtaaccatggatgttttacatttcatatgcttgctggacgtgcttttttaagtgacgtctttacagatgaacttcaaacttttcttccaccccacaggttacattatctgaaagcccagtaagtctgtcatgctgtgctcccaaagtaggagagtaagttttttattttctgtttttcttctctcaattttagacatgcaaagcagcccacacaaccagttcaccttcagacccctcccaccaccgccacctcctccacatgcctgcacctgtgccaggaagccacctcctacagtggactctctacaaagaagatcaatgactacccgcagccagcccagcccagctgctcctgctcctccaaccagcacacaggattcagttcatctgcataacagctgggtcttgaacagtaacataccactggagaccaggtacttaagctattattcaccctactacatttgaatattgacagatgatgactctcctgattgcaggaactcctttcaccatagttatctgcaaagaaacaaacatgtaccattacacacagccaggtatacaaataaaagggcagatcccttcataggcacacatggaataatgtactgggcacattttcacatagatgtatgtataaagatgcaatcccgtgcataaatagctcattttcagacaccctccaaaactaaaataaagcaatgatctgaactgtcactgtgcccttaacatgaaaaataactgtgttgtgtttcaaagatttacagagagagagagagagagagagagagagagagagagagagagagaaaagaaaagagagaaagagaggaagaaaggaagaaagaaagaaagaaagaaaggaaggaaggaaggaaggaaggaaggaaggaaggaagaaagaaagaaagaaagaaagaaagaaagaagaaagagaaagagaaagagaggaagaaaggaaggaaggaaggaaggaaggaaggaaggaaggaaggaagaaagaagaaagaaagaaagaaagacaaacagttggataaatagtagtcactgccatattatttcttataaaaatcatttgaaaagaaagtgccttctaatagtttagaaagggtaacatgaaaattgtattctagtagcatgactcgtagaagggaaataaggcactatttttctgtcatatttgagtttctaaattcattccctaaattttattgtgagcaaagttctactcctctgtagctctgggtcctctgagcagaaaggcactttggcactaggcaaatggaaagtcactcgccatttcccatcgttctttctttaaaaatttaccatttttagaaaaggcagtctagctcagcaatagagctcttgccagtcattcagaagaccctgacttcaatcctcatcatcacatacccaaatgtcactttctattaacataggaaaggataactagtgaagcatactgctctgttgtcaaattccaggagttcctgttgacttctttatgtcttaattatttttgaaagacaattttatataaacaacattcataatatatcagtcaataaacaatgcctgtcatgaacttctatcttaatatcctctgggaatcataacagaaagggagtgactaataaactcacattatgaggttttcctccttagtagcatattaaattagagggcatcagcaagtatcaccattaacacactgaaagtgctgtggccgcaatccagaaaactgtatcatttaccacatacttgattaaaaaggttttataagccactcttttctgctaccttctgatagaaagcacagtggtagtagtcagcacctatggtgaagacaacagattttgaatactagtaatgataaggtttgtgcatttttattatcattgagaatttcatacaggtatacgtgtttttcgataaaatctaacctttatttcttccccattcctttccttatcctcctactccttgttcatcttcttcttattttttattgtaatcaaagggagaaaatgtataaagtgagagaagcaaaggttaaaggaactattcaggggcagaagaggtagctcagcagttaagagaactctctgttcctccagtagacctgggtttaattcccagctccaaggtcactcacagctatgtacctctagtcccatgggatctgataacattttctgcctaacttgggcaccaggcatgcacatggtacacagatgtatgtgtgaggcaaaacacctaaagtaaacatataaaattaaattttttgaataataatagaaatccttatagttttaaacagatgtatctccctcattctcctttcgactcttctgtggggcttgcaatagctaaggaaagagtgggacaatatggttaactagctgttctgtcaagtaacacagttccatcctcaggaagacaaataacaggaaatctggaaggaggatgagcaggctcaggcaaattaagaaataaaactattcttatttgaaatgtgcatctaggcatgtttgtacaaattgcacccacggaccttctgtatctgtacaaggaatgtattaattggtctcagtttcctaagatgtagagacaaacataagtttccatgtgatactgagaagagagcctttttagtccatttggaaatatattcagcatcagaaaaataagttaaaaatacttggaagccttactggcctgattaactaaagctttccaattttatccttgaaaaatattcatttcatgcttagtcaataaagcgtaagagtgagtgcacagtaacttatgcacaagctggataataggaccctttagagctttagcttcctcatttgtaacaaaataaatagaaaattgccttaggagcaagcacttagtccctggctcccatcactagcacacccccaaaattgcctaccatgatcatgtgataaaaagaacaaactactccaatatagagtatgtcatgaattgtaaaacactgtacatttgaaaggtgatattattatccctactaagtagttgcctgcctgtttgtgtatctctattaaaagaattgactaataactgaaatattcccttctatctcggacaattactcagattccttttaaaccaaacttgaccgtttttaattagctattttgtttatttacatttcaaatgttattccctttcccatttctccaccccacctggaaaccccctatcccatcccccccccattctcctgcttctatgagggtgtccccacccacccattccctcctccctgccctggcattccccttcactggggcatcaaacaacatcaggcccaagggcctctcctcccactgacatccaattaggtcatcccctgctactacatatgcagccagcgtcatggatcgctccacgtgaactctctggttggttgtccagtccccgggagctcgggggattctggtctgttgacactgttgctccccccatggagctgcaaaccccttcagctccttcagtcctttctctaactcctccatcagggaccccatgctcagtccattggctggctgcgagcatacgatgagttggtttgttatatgtaatatgttatatgtttgctaaattgtctcccagttacttaaagtaattgtctcccaattacttcataggttcctcatatttctgggttccaacttcctctttaaagcacactcacttttcacaaactgctctcagattctaaagtctaacactcaatgcatcctgaggcttagtttctttgccttcacagagcaaaggtcattcaggtttccctgaaaacctcacattttcaattggatattagtccctggaaacttggaaacactggtcaacacccaaagaaaaggcaaagtttgtagacacatattgctactttccttttccagtagctttttcttgctgttggctctatttcttgtgtctaccgcactgtctgctttgaccactgcaatacaggacttcttatgtaacacttaatacctctcaccacatttcttcatcttcctgtgtcattgctaactgtttcatttcattgtggtactaggttccaaagtctttaaacgggaatttgattagcccaggtcatctcttatgtatcctgatttaagcattttagcaaaccttgtcagttagtctctcccccactgagactagggccaagcagaaagccatgaaggagttacagagacaaaatttggagctgtgacgaaaggatggaccatctagtgattgccatatacagggatccatcccataatcagcttccaaacgctgacaccattgcatacactagcaagattttgctgaaaggacccagatatagctctctcttgtgagactatgccggggcctagcaaacacagaagtggatgatcacagtcagctattggatgggtcacacggcccctaatggaggagctagagaaattacccaaggagctaaagggaactgcaaccctataggtggaacaacaatatgaactaaccagtacccgggagctcttgtctttagctgcatatgtatcaaaagatggcctagtcggccatcactgcaaagagaggcccattggacttgcaaactttatatgccccagtacaggggaacgccagggccaaaaaggggcagtgggtgggtaggggattggggggggtgggtatgggggacctttgggatagcattgaaaatgtaaacgaggaaaatacctaattaaaaaaaaaaaaggagtaataacatactgaacaccaaccaggcatttgacaagcactctcaagatattcctaagattgctggttggaaaagagctgggagcatatcacatgccctttaaataggattcttggtagttgccttaactcatctatccagggatctatgctatggccatatatatatgcaagatgatgagataatcatccttattttcatgtaagtcactgacaaaaatgtatataaaaccagtatcttgcgagagctctccagaatgcaatgagaaacgcttctgcatggctgtctttgcagtcaggtagcatactactactaacatacaacccacagttctgcctcttattcagagacataccatgtaagatcttgccaaatgtcttggtgatatctacataatacggcacacctacattattactgatctgccaatctaataactgctcaaacagaagggaagttttacctaacatgaatacctttgagataatttatactttcttctcaagagtttctcaaaatcattttcaaaaataatttgtactacatttatcccatgatgtttggactctaccatatggagactatatgttgcctttccattttcaaaactaatgtctctgtttaccatctccagttttctgccacattttacctgtgccacagtccctgaaatgggtattgccctttggtaaatgcccttgtgtatgtagaactctgtgatcaggcacataaacacatatgtctgtgtgtgtgtgtgtgtgtgtgtaagggagatgtgtgtgtgtgtgtgtgtgtgtgtgtgtgtgtgtgtgtgtaagggagagagagagatgaaactcaagcatcattgttcagataccatctatcttgtttgatgaaacaaggttttgcattggtctgaggtttgcaaacttacctagtctgctggccagcatacttcgagcacctgcctctctgcctccccagaactgggtaacaagtacaccccaagtttattggcttccattttatttatccattttattaattttcatgtaatatatttttatcatattcttccccctcccctaattcttcccatatcctccccttatccaactcatgatcattcttataaaatgaaaaaacaaagcaaagatgatataaacaatcaaacaaaacaacaacacacactctctctctttattaacttagcctcaaatgtttttaatgaatgcccagtttgtgctttaatgtatatttactgatgcttgtttgccatattaagtgcttaggttctttttgcaaaaaatgttagtagttaaaaaaggattccctaatcattcattccaatagcagttgcaaaaaacaaaaacaaaaaaatttgctataatccttagtgttttctcaaaggtgtgggttcattttggatgtgaatattattggtattattttcattatacattctatacctttgtatctctggtccacatgaccttatttcggtacatacccttctaatattgaagctaaatggagacgatatagttgagacacacagatttctatcattaacaaactttctgatttccattttaaagagcctcaggatatgtaaccatacctactgtacttaaaaaaaatagaactcttttcctacagtctaggatcttagcttcatactctattcattaagcccaagataaaataatttctttctcaaaagctttaacctacaaattcctctatattttagctacttatctacatttcatttatactagcttctggggtgtacagtcaagttgagactttgctatatatttgagtttaggtaaataatatatcactatgggcctatagtcattttctgttcagtatatatttctcttatggcacttctcggcctgtgttgtaagttaacagatattcttatttatatggagaaatatatcatagatttctgatctgctatttataaggtaatgtgtctttgtatgtgctcttcagcatcaccatgttctagttttctcatctctacaataaagatgatagtaaaacctattccatgaggtctatatgagtattttaagaattaaataaattaaatttgcagtgttcttagagcagccatgaacccaggaagcacttgataaatagtaataataataccaataataataatacaaggactagttgtccttcttattccctttcaatttctttcttcatccatttaaaagtgtttctctctttatgctcatgcttgccccaaagtaaaaacatacttactgtagtgcctttcttggcatccttttacataaaatattcactgtaatcaccttattccagtattcagagtcatagtgccttttttgtatttttatgacaaaaacatgcacggtttagtgagcctgccttgtcatcaacgtccagaagagctttaggattgctgctacctgtttgccatcaatcagagaaacaatgccctaacaacccactacattccaatttataccctgccatgaacctttccttccttagccatcagcctttttacctcctcttttatctcttctctcaacagtgccagtactaatacattttggatgacctatctttttcaaccaaagagtgggcaccttaccaaatcagagagagttaatgatgtacttagacatatggactccagcatccctagactaaggcacttaactttggtcatggcctagatattactagctgccaccagcctcagttcctctaagtgttatatggagaaaattgcaggccttatattgtgactttgtctcaagagttgaatgaaaaaatatttgtaaaatatcagttcaaagtcaagaacatgtaaagtatgaacaaaatattatcatttccagttcggtttaagatcctggcaggaaccagatgacaaggagagaaattcagagtcactacagttcaaagagccacattagcttcaatctgttctaaaaaaatcaactgttcttaaataagagtagtctatgacttactgagcatgtcttgcagagtgagacattcactgaacacttactgatactggttctctgtggccccttcaaagatctctgtactccagaaccttaattctgtctgtcctctttcaccctaacctccatcttgatgctattatatagctttgaccctttgccattctaatgaaagctgtcaagagtagatcacagaagccactagatctagtgatgaatttcacttccgtaatgtggccaggggaaatttgtggaattctaaacctcagttttctcatcttaaaaatgggctcctcctcactcatatcactcactgacatccaatcaactgtgacaaggtttgctttagaacttatataggatttatacacaccttttagctttctctagatttttagaatctcctgtttgttttggtttggctttgcttgcctgtctgaatgtccctcaattccatccacacatctttgagtttatgtggccaggcacactttaagatccggttaagtggtacttctttctgtggtaacatctaaaagccacacccacagcctgcaaaaccagagcatgaccttcagcttctcaaacttctcatgcagcttctccttcaatgacaattttcactattatagtctcccttaactatgctcttttgtgtctctcaagtcaattccctaactcagtttatagcctctcattcatcagaatatttagccaagtgctagttcaagaccatggaagttggtttgccatgctcctgaaaaggtaatttatttattttgaatgacagctatagacctgaaccttggtcttccaccaaaataattcctacttaaaacttttgctgttaattttccaatgctagggagaacatgagtttaagaaaagaatagtcacatcaactaataaaggcaaaccagaacgatgtgaaggagttatgcctgcccacaggagttggggaaaggtctatctatttatttttagcatattctgacagatgactataccttggtatgacactaattgcctttattggttttaggcccatatatacaggattattttttttaaagaagaacaaaaacaatcagtgaataagacagtgactggcaaagactaaagaaagaaattaaatccatataactaatgcttattatcatacttctagacctagtgtctgtctctgggaaaagtaacatttggaagaaatattaactgtaatgacagtattataaatatctttgaaataataccttttacatattaacccataaatataagctatctagtgataattttatttctgtattataaagtagtactaaaatctacctaagatttataagtagctttttccttaggatatttgcaatagaaaaatagatttacagacacaatttttcctccaataatgactaaaggaaaaaaaaaagcttggatgtacacattcagtgcttaaatttgacaatttctcatgttctaatcctttaacagcaccggggttagccaaatctatcttcagccacagatttaaagattcattttaagacaggaaaatacttctgagaactaatctatgacctataaatcctgtttaatacacatgaacagggatcaaccaatcttttcagactataacaaatgataaatgtggaatattttaaatttaaataaagataactctgcattctcaatatattctttggatattggagatggagttttagtaataaagaacaatacattggacaccattgtcacaacagtctgccatcattttggtgatggtatttttaatcatgctttttaataaaatatcctcaggtttatctcaaaataaaaccataagtaaacataatttgttatattttataaggaaggggaatttcttccaagatgagaagaaatctaattttatatggagatttatctagcaatccaaatgtaaatgtaaacaggtgtttttaggaatttaaagagatgaactgcttgatgtaatatatgagaaaaacagtcaaaaattaaaatgtagacaaatcaatctctctgacttttttccttccctcactgtatatctacacagttccctactgaattcaatatttaacacaaaaatgcctgattttcagcaagagagaaacctcttttaataattatcccactccaatgatatttgattaatcataatcaatatgttcattgtcgtgtcaagttaatccacacttgtgtgatatatttttctgaaagcatggaatatatttgacatgctagaaacacatttcctttttctttttttctacagaagtctctctctctctctttctctctctctctatctctctctgtgtgtgtgtgtgtgtgtgtgtgtgtgtgtgtgtgtgtagtgagtgcatacacataaatgtatgtgtttgtttctgtgtatgtatcaaggagattctactgaatctcacccattgggagaaaccagctggttctttattaatccacaacacaaaaatgtttgtgctctaaaagcagcagataaaattgggttaagtattcagatctttgaagcatctctgcaagatctgtgaaagcttgatactgagcatttcatttaagaacttgaaagctcaagaaagaattgccccctttggcaaagagataagcaaataagcagtaacatctgcttctctgttctattaaaaaacaaaacaaaacaaaacaaaacaacctcagcttcggtgtgagggtataagactgtgcataagaaagactttaaatggaaaaactgttcattataaatgcaatgatggattaaatgccatgtagatgccttttaacaaatttcatcaggttattattatttctttaccatgttccagtcctgttctagttgctcgggattacaacatagtacacaatgaaagaaaaccctaccttcaaagatcttatattctttttttttctttttttttttttaattacgtattttcctcaattacatttccaatgctatcccaaaagtcccccaccaccacccccactcccctacccacccattcccattttttggccctggcgttcccctgtactggggcatataaagtttgcgtgtccaatgggcctctctttccagtgatggccgactaggccatcttttgatacatatgcagctagagtcaagagctccggcatactggtggggagtatagtcttttctcttagaaaagtgaacaattgacaacagcagcggtcgccatcttggtccgggacccgccgaacttaggaaattagtctgaacaggtgagagggtgcgccagagaacctgacagcttctggaacaggcggaagcacagaggcgctgaggcagcaccctgtgtgggccggggacagccggccaccttccggaccagaggacaggtgcccgcccggctggggaggcgacctaagccacagcagcagcggtcgccatcttggtccgggacccgccgaacttagggaattagtctgaacaggtgagagggtgcgccagagaacctgacagcttctggaacaggcggaagcacagaggcgctgaggcagcaccctttgtgggccggggacagccagccaccgtccggaccggaggacaggtgcccacccggcaggggaggcggcctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagttatgaaacaaatggatctgacagatatctacagaacattttaccctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaaaaatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcaactgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccataatcagcatccaaacgctgacaccattgcatatactagcaagattttatcgaaaggacccagatgtagctgtctcttgtgagactatcccggggcctagcaaacacagaagtggatgctcacagtcagctaatggatggatcacagggctcccaatggaggagctagagaaagtatccaaggagctaaagggatcttcaaccctataggtggaaaaacattatgaactaaccagtacccctgagctcttgactctagctgcatatgtatcaaaagatggcctagtcggccatcactggaaagagaggcccattggacacgcagaccttgtgtgccccggtacaggggaacgccagggccaaatggggggagtgggtgggtaggggagtgggggtgggtgggtaagggggacttttggtatagcattggaaatgtaaatgagctaaatacctaataaaaaatggaaaaaaaaaaaaaaaaaagaaaagtgaacaatttgtaccagacttgtagactaactagatgtggtctggaagaggaaagatacaactcaaagaaatattttaactttccccttttcttgctttcacatttgttttaattaaaactgtgttaatgaaatctcttaaactgggtaatttgtgaacagcagaaatgcattactcataactatggagctttggagatctatgatcaaggcaaaaaggagtggtgtctggtgaggatctgtccttcatagatggcatatgttgctatgtccttctctaggggtagttgttcacttgactcttttatgcatggacattagtattattcatgacctaacaatttcccaaatattctaactcactagacattagaattcaacatacaaattaaagaagactaacacatttaggctataccaaattcctaccacagctttttgtatgaaaacatcttatctgtatttttatagcatgctgtgggagtagtgacacatatcatttattccagtccttgaggggcataggcaggtagatctttgtgaactaggggataacctagtcaacatagcaaattcctggctactgaagagatattcagaccctaacaaccaccacaccaaattttggcagggtacatagaaaaatagaataactgagagtaaacaaaagaatatatgtaaaatcaggaagaggggttagtagaaaaaaagatagttttattctggaaatattaggacacctgtataagttatacaatttttcatgtaattaataattgaaaatattaatctatatccataagaagagaaaaaactatactgtcacttttttcagtgtctgtgtgtatacgtgtgaatatatagattcaagagtatgcacataatagtgtgtgtgtgtgtgtgtgtgtgtgtgtgtgtgtgtgtgtatgtgtgtgtatgtatgtaagtcagaggatgattataggtttgggtcttcatttttcaccttatttgaaaccatgtatttttgatgtttgctaatgtgtatgccaagttggctggcccacaaacttccagggattttcttgtctccacctcccaacttgctgtaatgtcagtcattgtttatgtggcttcttgattttgaactcatccattcatcctagcagagcaaatgctttcttactgagccatctctccatctatcattttctgaatgcttataatggagaaaacattttaccatatttgttttaacttgtggttttaaaaccaatagtcacaaaagtttaacaatattcctctaggtcactaagtagtttgcagagaatctagtttaaacctaagtgtttctgggctaggtgttgtaatatatacctataattttagaacccagaaagttgaggcaggacgatttccatgagttgaggcccactttatataaataatgaatgccaaatcactccatgctacatacagactgagaacatctttgtctcaatttaagaacacacgtaacaaccagaaaaacctacaacaacaaaatttggaggttaaaaaaaacaaacaaaatttgtatattgtctgactctagagctcacctatgataggtacgggaaagtaagagtttcacagatagacatgatgagtttctgtgaatgatgtatgaaatcttggacatattaaaatagtttaatgcaagagtgagaaaactaaattttcgagaatactgatataaaagtctaaagaaaaggacaaaattgctgaaaaggaatagcctaaaagtatagaaatgaaaggagaattatttcaaggcaatggtaatcacaattttcaatgttagagatgagtcaaattaaatatggatgagaagagagacctttgactctgactgttaaaagtgttatgcagccagttttactaaaatggtgagtaggaagcagcacagatttggattagaggaagcaggacaatggaggcgtctgagaaacagcccactgttttacacaaagctgagtcaaggtaaatccctcatatacattgaaatgggaaataaaagaatgactttctataattatgtatttggtagtcagaataattatagtattgagaggtataagagagtaagaatatgggaaaaagtacaggtatgaccaaatggttgtaaaggaaggagcacaattccacacagcaggtcagtcttctaaacctctcacaagggtgatatggtgatgattcagtttgagaattcctccattgcccatctgcaaaacgattgcttttttcagtatcaaggcagaagaaggcattaaaatccccccgcccttactaaaaatctgctgtcaaacttaaatcatatattcccaaaggcaaacagctaccttgccaagtcatgattataagacatatttctttcccccatctgacatacatacacagaactctaggcagtcccacattactgacaaaaatactcagtagtgacatatgtacacctcagggcttacattgataaaacagctgctaacttatgactacttctaattcatccatggaattatcaaatacaacatgatattagcccccttagaaaatttaatttcttttggcataaaatattcacaatcttctgtttctcctgaattcaattaaaataattgtccttcatgtgtgacagtccaatcgctcaaattttgtcatctactgtagtgaactatgtcaagaaccgaggtaactttgtagcaacacattactggttgcctttcaacagctaaatatttttaacaaagtcaaaaccttggattttaaataatgcattggatatatgtaaaaatgtgtgcatgtacatataaacatacatgcatatatgtgtccataggtttttattcaaaatacttttacatggcatcttatctcagactgtgcaaccctggcagggcaatatgataggaagcagtcccaatttaaatgcaagtaacagaatcttggggaaatgttattaacagagtaagaattgaaactttacaaaatcaacacaataatctttgcgtatgaccatgtctctgctctaagaagaactccagattatcccattttgtctatttgtgagttggtttatggttcagctaattttccctgactatgaatgtatgttagtttgtattctattaatatgaaaatcttaatgaggctaaatgctcagaaaatggcgggcttctggttaattggatttggtgattagcttaatgttaaaaagaacttttcaaaaaaaattatcattcttattgaaaatcactcaaaaatgaatcaacattttaaaatccaaatgataataaattcaatctttcacagttatataagaattgtcattttagacatgaatttttattataaagtgctctaaactggaaagatgttggagagtgtgtaaaatatctaatggcccgaagatatttgttgcaaattttaatagtcacctgtgagtagtggaaaggcacaagatttgaagttagaaatcttgagcccaagtccaattttgctgctaaataagtatatgacattgattattttctttcttcaacataacatcattttcatcaactgtcagatgagagactgaagcaaaatgtttaagatcacttatggtttgcaatttctgtcactctgtggcttatctttctgtgacttgctcctccattggaagaattctgataatttaagctttccaacaagttgagttataattaattgcaagttggttaattctatgtgacatgcctatatatgagaaataaatttaactcggaacactgagataccttcagaatttctattatgtaaggagaagtgaagaaactaaacatgccagcctgtcagaacagagtagtaatggcagtcaagtatacttacgtcatgctagcctaagcaatgatctctttgatacattctctctctctctctctctctctctctctctctctctctctctctgtgtgtgtgtgtgtgtgtgtgtgagagagagagagagagagagagagagagagagagagtattttaaaacacaaacttttcatggacataggatttaaagcacttcatataaaaatttgtcacacatagggccatactttgaagctaaagtagaatttcaatctctttcctcatacttttattttttgtctaattataaaggaaatagaacagtatgtcatgtagtctgagttacactcacaacccaaccagccatttttatgctgcatcttatgaatctttgatggaagttcttttcccaaatgttgacaattatgcatagagaaaagaagtatagatttctcattctatttatcatataggtcaaaacagtgcatggaatcattgcactcttgacattgaccttctgttagctgtgcccctgtgttgtattggaggagaaaatgtgaaccaatgcttctctttatgttctaacattcatacagaagtatggacaattcagagggaggcctgatttttcaaaaattctcctgtgattcaagggggattgtacttactgagttttaaatcacagcacagagcctgatttggctgtttcataggttttcaaattgtgggggaagttaatgtttaaattgatgtgattattatatatttcacatattttaatcagcagttaaggatttggatttatgctttgtggcaagttcatgaaagctgcaatttgaaaagcaaatttttaaaattgaagtaccaaatgtcttcaattctccataacttacaaagatttcctatgtttggtcagcaagggtaaatatttacggcaattatgaatgagttgtatatgattgtatatgtgttctggccctaaagtttggggcatttgtttggataatagagaaatcacaagtgaaaatagcctcaagtagtaataactgtgagcttagagaaaaggataaaatcataaatttccgacagaaaaatatttccctggaaaaatttcaagagtggctagttccctctcatagagttagtgatactgaagactgcatgttcccattaaatgaatagttttagaccatgttatttccaaactgtcattgacatttcaaggtgaacaaatcattgatgtgtgcatcttgaagagacaacttgccaggatgttttgcagcctctcccactgcatgtcagtaacaagaaacaccatcccccagttgtggaaatataaaatgttctttaaacatttccatatgttcctttctatgacaaaatcaatccacagttgaaaacacatctaacttcacctaagacagaattttctatggttgttagccagcctatcttcagtatctgggaggcaaaatctgtcattgtcttctcactctttttgttttatttaaattaacttatttttttacactccctattccattccccgccccccatccaccctccgactgttccacatcccacacctcctccccacccctgtctccatgtggatgctctaccccaccccaccccccacacctgacctctaatctccctgggcctccagtctcttgagggttaggtgcatcatctctatatgaacacagacccagaagtcctctactgtatgtgtgttgggggcctcatatcagctggagtatgctgtctgttttatggtccagtgtttgagagatctcaggggtccagattaattgaaactgctggtcctcctacaagattgcccttctcctcagcttctttcagccttccctaattcaacaacagaggtcagctgcttctgtccattggttgggtgcaaatatctgcatctgactctttcagctgcttgttgggtcttttcgaggacagtcatgcaggtccttttttgtgagtgttccatagcctcagtaataggccttgggacctccccttaacctggatcccactttgggcctgtggctgtaccttcttttcctcaggctcctctccattttcatccctgcagttctttcagaaaggaacaattctggtcagagttttgactgtgggatggcaaccccatccctcccttgatgtcctgtctgcctgctagaggtgggctctataagttccttctccctactgtctggcatttcatctgaggtccctccatttgggttctgagagtctcttacctcccagatctctattgcattctggagggttcccccccccctgctgcctatttcctgaggttgccttttcccttctttctgctggctttcggggcttcagtccttttccctcactcaataccagatcaggttcccctctccccaccactccctgtcctgttcactttccctcccaggttcctccctccttccccacttgtgattgcattcttctccctcccaagaggaactgaggtgtcatttgggcacttcagcttgttgacctttttgagttctgtggactgtatcttgggtattctgtactcttttttgtggctaatatccacttattagtgagtaaataccacacatgtcttttggggtctgagttacctcactcaggatgatattttctagttccattcatttgcctgtaaaacccaggatgtccttgttcttaatagctgagtactattccattgtgtaaatgaactacattttctgtatccattcttctgtcgtgggacatctaggttgttttcagcttctggaactatcacagataatgccgctatgaacatagtggaacacgtgcccctgtggcatggtaggacatcttttggatatcctcccaagagtggtatagctgggtcgaatggctgagaagcacctaaagacatgttcaaagtccttagtgatgagagaaatgcaaatcaaaaccaccttgagattccatcttacgtcaatcagaatgtccaagatcaaaactacaggtgacaacacatgctgagaggatatggagaaagaggaacactcctccattgctggtaggattgcaaactggtacaactactctggaaattaatctggaggttcctcatgaaattggaaataggtattctcactctttacaggagccttcttctgtgtcttaaccccccttttttcttctccatttgaaaaggtcacgttggaggatttagatagtctctaatctatagtttgactcacattggagaccccttcagcaacttgggtgctttctctagcttctccattgggggccctgtgttccatcctatagatgactgtgagtatccacttctgtatttgccaggcactggcatagcctcatacgagacagttatatcagggtcccttcagcaaaaatcttgctggcatatgcaatatttataatagtcatacttacttttcaccttgtttagcttttaatatatttgattttatatatataaatgttctgcctacatatgtgtatatgtgtaccacatgaatgcctggtactaatggaagtcagaagaaggcattggatgccctgaaattagagttactagcagttataagccaccatgtaggtactggggaccaaacccagtcctctgcaagaataagagcctgtagtcactgtgcaatctctccagccccttaacattaagtttttgtaaaaattagatatacaaagcataaatataacttaaataatgagtcatttactaaaaaagagtatgatgaagtttatacacactcatttaatgtatttgagggtctaccaaagcaatttgattaaatattatagagttttcagtatttttgttttctgtctataccaggaccacagtcccattttacctttaagttgctttatcagaaatgtttggtttatatgaaaattcagacatccctcacattataaatggaagcagtacaacaacttcacttttctgatagttttcaatatgtataaccttcttaatataattttctgttttcattaattttgatttgatagaaatatttccattaaaagattcagttaggtactttgcatatatataaacattcatctttgaaattataaataacagattaccatgagaattaagattatagccgggcagtggtggtgcacgcctttaatcccagcactttggaggcaaaggcaggtggatttctgagttagaggccagcctggtcttcagagtgagttccaggacagccagggctacacagagaaatcctgtctcaaaaaaacaaaaacaaaacaaacaaacaaacaaaaaagagtacacatgggggaactcatggctctagctgcatatgtagcagaggatggcctagtcaatcatcaattggagaagaccttggtcttgtgaaggctctaagccccagtatagggaaacccatgggccaggaagctggagtggatgggttggtgagcagggggaagagaaagaggagggggttttcagaggagaaaccaggaaaggggatagcatttgaaatgtaaataaagaaaatagctaaaaaaaaaaaaaaagattacattgtctgacaagggttgagtaatgtactaatctatgggtataatagtaggtcattgaaagttatgttaatattatgaccatttagcagagtaatagtagattgtctcatagggcttatgagctgtgttactagcactgataagtcagaatctttttgcagtagattgcatttaacattaagacccacaactggtgaagatacaaaaataagagactatagaatgatcagccctaaatgagacatctctaacacgtggtgtcctcccagagttcagagatcattgcaggagaggcagtagaaaggttgtaagacccagaggtagtgaatgacttcaaggaaacagtatttgatggtcacagcagggaagttgcacatataaaatcacagcagttgtgacagcatgcacaagatgtgtacaatgtcaagacagagaaaatcccagcatggagagggaaggaggacacaaagtgccactcacagccaaggagctcttggaaattgatagcttctgggagaagaagaatcatttgatataaatgatgtcttactcggccatcatgatagaagtgtcctcctgaagtagatgggaacaattcagagactcaaaattgtataattttcagagagtgataccttcgaacactcggtcctaaatgggatgcctctatcaaatctctcccctcatagcttagggaacttagcagaagaggaggcagaaagtctgtaggagccagtagggatagaggacaccaaggaaatcaggcccgaagacacatcagggctgatatatatatgaatttacagatactgtggcagcatgtaaaatacccacacagatcaaagccagaaggggttccagcactgagaatggaaaaaaaaacaatcctccatcactagcccagaaatgatcaccagttgacaattgtgccaaaataaaaaactacttttgttcaacggagtctcacagaatatacaaaccacacttaatggcaggcctcatggcagctgtagatggcagacacaaaacaaactcagtggtatctttaagggtttatttttactcataatgatttttctatgattttatttttaattttataggtcttttacttatataatgtgtgtgagcgtgtgcatatgcatgcatgcacacatgtctttttgtgtgtgtgtatgtgtatgtgtgtacatgtttctcaaacttgttctttagatctgattattctctttgttttgtcttattttgatatgtttggttacttctttgttctgttttctaatgagggagataaagaaaagatgattttgagtgggtggggaagtgaggaagctctgagaggattttggaggagaaacaatgataaatatattgtatgcaaaatatattttaaatacaaatattaaataacttaacttgtggtatgttggccatgcttcagtgaaaggtcacacatccaaaagcttgtgaacagtacaaagtatactatattggcttaatcaaaaagaagagacaaagcagagtgagtagagaacaggacttggataagggaggctgaaggaaaggaaggtgaatatgagcagaatgtactgtaaaaaagtctcaaaaattagcattatgagttatagtgagagctagtatacccacaatcattgagtttcatgaatcatgcataagtatcaaaatattcaccgatcacctatttttgttgcatatgttttcagattgtaagaatagagtacaatgtaaaacagagaaatacctactctcatgtaagtcattttgtagtactcaaccaaactgaagttaatattaaactcaataatttaccagttgtgtgatcttaggaaatttgcaaactatctggtctttggtcacctcacctacaaaatgtagctttcatctatattattggaatatcatgagaatataataaaaatataaggtaatttacccaaatatctagcatgtaataaaattttcattaataatgtcctttgtcttgctattgctattgagtatttaaaaatcactagcatttttattgaaataatccttcattaccaaaatatctcataaaatttgagatatgaatgaactttttcttttttaattcagctatctttctatttaataacacacacacacacacacacacacacacacacaattcagggctgaccagttatacttctttggaggtgggaagaaactatttctcttgttttcagccttcctttgttgtctatagttctttgtctagagtttagaccctgtaagatttcctctgcaactttagcatgcctactgatgctgcccttgttcaggtcttgtttagacagtcatagttttaatgtgtcagaggtacagcttctctgtggtatctgataaacacgtggaaagcattgtaaaaggagcaaaggcatcctgcaaaccagtgtgttaatgttttcttatatacctctgacataagagaccataaagctggaatatgtgtcctgtgttcagctgatatgtaatcagggaaatattaacattcaggacagatatttcttcttacagaaaaattcatctgaaaaagaccataatactaatgaagatcacagaatattgccatttgagaatggattattagctcagatttaaacttcacaaaattaagaattctataggaatgcagaaacattggtaagaactacttaaaattataaatgacacaagaacaggagtttctcaatatttggcaggtgaaatttgcaggggacatgtgaacaaaggctatctgaatatttggaattaagaataagaaacaaaaatgaaatcctcctcgatgtaactattcatagagaaataaaattatttaccccacttcattttcaaactcataacactaataaggtcaagaaaaaatatataattacctttcatgagtatttattctacgttggagtaagggaaaacagagtactgaggtggaaatacctttccacagtcagttctagatattttctcagcagagaagaaaatggggctgactcaaaatattgttttcttttcttttttatatgtgttttttgatccattagattgaatacatatttctccaaagacagttaacaaaagcccaaaataaatgtggaaatatgtacaatcacaaaaatgcaagtaaaaaccgcattaataagactataatcaaaacagaagctcaagggctggaaaaatggctcagtattaagagcacttgctgctcttccagggaaccaaaccccacagcaggcagctcacacctacccatctgtaaccctagttctaggagttgagaagtgctcttttgacctctgcaagcaccagacatatgcatggtgcctgtacacacatatagccaaaacaaactcacacataacgtaaaataagtaaacctaaaaaaaaaacacaataataaacattgaaaagataataataaacatgtgaaaaattgaaaactttttacaatgttagtggtatttaaaaatataagcttctatggaaaagtgacattgaagtgtctcagaaaaaaaaaaagtagtatatgatcctataatgcttcctttaggtgtgtattcaagtcaactaaaaccagacatcaaagagatgctagttcccttgttttcaaagaaggatttccaaatagccaagagagaaaagtaccctaaatattgataagagagtgatcagataaagaaaatgtgatttatacatacagaggaatattatttgaccttaaaaagaaggacatgctgccacgtgctgtaaaataaacgaatcttaacgaagtcatgctgagatgattcagtcatgaaaatattaatactgtatattttcttaatggtaaagtagtcaaaatcacagaaataaaaagggaataatgggtgctggggaaaagagttatttaattggcaaataatgtttcagattttagaggaaagtgattctagaaacttctcacaaagtacttaacactacataattggaaaagtttaagatggcaaatttatgtcatattatttagatattttataaccaaactacatttaataactttaaaaataggtaactaaatctcactatcccatccaattgtaatttaggtctactcataatttttttaaatcaacttcactttcactagaagcaaggggaacctgtttctctgggaaaaagaaatgatccaaatgcttatagctacagtaatacaggctttgatgtgtctcataagaatgtttacaagatataaaagagaaaaactattgattctttatgtatctgttgtttaaaagctgtagatttttgcgtatttcctgtagaattttaagtgcgatattaaatcacagtatttaatgctaacagataccttcagaattatgtagtataagggcttaaaagagttcattttcacccttttatagatgattttaaaatccatacaggagcatttatgatgctcccatttacctctactgggtctcatcagtcctgaagatttttttttcccaatttccttatgttccaatttcctttggtaatatcttactttccttttttaaatttgaacttgaatattaaaacagaggcaaaaagaagcagtacttacacataaactcttgaactgcattttcatcatttgctctgtggcagaaaagaaacccaattgtatgaaattgataacaacattttagtatatcctcgggacctgaggggaaaagcaatgtgtgtagacagatgatctgattttatgagcacatagctgaagtcgagcactgtgcatttgtctttatgctcctactttttttcaaggactatgaaaacacattaggtaccagattcactttccacaatgacctgcaaagctaatgacagtacacaccatttatattgctgtttctcaggatacacatcacagtatagattgcttttagcatagacacttaggctgggcttgttaatatgaaaacaagaaccttagtatacaaacttattttattatctactctcactgaggactgtgatttggattccactcaaacatgaattagtttaaatgctgctctgctgtgactgttgaatttattcattaagatgtaatattttacttatgaaactgcatttggaaattctttggtgtacatcagatgaaattacagtgctcagggatattgattattgcttgtaattgccataataatagccaacaattctctctctttcttctacctcttaatgatataccaaactaaatcaatatctagcatattgggccacttacattgtcttcaaaatccaattgttgttcttcataaatatgcaaaagattgaagaatttttatcttcaaacattaggtaaaaaggtctctactcctgggttttccctttagctcataaaagtacatcagaaagatgctatataggattagttatatgtctgtgacactttatcacctcaaaatactcacagggtagaggtcagaggttagtaaggctgtattgctcataaattgctaaatttcttactcattagtaaatttaatgaccaatgaggaaaattctgactggaagaggtctctgagcattgaggaaatctgcatctttgagtctaagtttatttaaatacctaaaagaagttcaattacatgaaaccaaaacaatggtataggtcacttatccaataaaatatattttctcttattgctatttatataccatgtctccattatttcattattgagataaattagatgccttttagaaacagcaaaacttcttttatctcctgaagggtagcttgccctggaatatttgcctattctcccaaaataatcagtctttaaaagaggctataagaacatatggcatacaaaagagggctcaagagatgacttagagaatagagtacttgtcatgaaagtagagctacaagaacttgtatcataagtatcttagatggactttctactgttgtgctaaaatactattatgaagaagcaacttggagataagatggtttatttcattttatacttctacctcatagtccattattgagagaagtcagagcaagaactgagtcagaagcatagatattccttactggcttgctcaccacagcttgaacatcctgctttcttataccttccaagaccaccagcccagggttgatactgcccagaatggtctggtaactcccatacccatcattaattaagaaacttctgtatagacttccttctagcccaatcttatggaggcattttcttaattgtgttcccctcttcttagatgactctatcttgtatcatggtgaaaaaaaaaacaaacaaaacaaaacaaaacaaaaaataaaaacagcaaaattgacacctggtcaacttgacacagaaacatgctgcttattaatccatggcctttctttcctattcatctctaagatctcatgttaatatcaatatcaaagtataaatcattccaaagccccacagtctttttttttccattttttattaggtatttaactcatttacatttccaatgctataccaaaagtcccccatatccacccacccccactcccctgcccacccactccccctttttggccctggaattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggagggaaagccccacagtcttaaaaaaaaattcagtgtctttaaaatattcaaatactttaaaatgtcctgtctctctaaaaccccaaacattctctacaagttcaaagtctctcaagtgtgaactcctggaaaatcaaaatccaagttacatactttcttatttcaggaggtgggaggtattcaccacggcaaaatcaaagtccaatagtgtaaacttcagtgtcacatatcaggaaatcatggtcttctacgccccaagaggattcatttctccattccgctgttggcagcacacacagcttgttggaggctcaggccagctccactccacactgtcattggcagtcatcccatgatattgacatatctgatatgctggggtcttcatgaaaactgagacttcaccttcaccaatggcctctcagagccaagctccagctgcttttcatgaccatttcatgccttcaaaaccagcacactctaggaagtgtacacaatacctggttgagttgccagcacaggacacagctttggccaactctagactacagctaccatttgctgaccctggggaaacacttgcagagaaaatggtggtagtctctttttttttctaattttattttatttttattaggtattttcctcgtttacattttcaatgctatcccaaaagtccgccatacccacccccccaatccactacccacccactcccccgttttggccctggggttcccctgtactgggacatatacagtttgcaagtccaatgggcctctctttgcagtgatggccgactaggccatcttttgatacatatgcagctagagtcaagagctccggggtattggttagttcataatgttgttccacctatagggttgcagttccctttagctccttgagtaatttctctagctcctccattgggggccgtgtgacccatccaatagctgactgtgatcatccacttctgtgtttgctagaccccggcatagtctcacaagagacagctatatctgggtcctttcagcaaaatcttgctagtgtatgcaatggtgtcagcgtttgggagctgattatgtgatggatccctgcatatggcaatcactagatggtccgtcctttcgtcacagctccaaattttgtctctgtaactccttcaatggatgttctgttcccatttctaagaaggggtaaagtgtccacactttggtcttcgttcttcttgaatttcatgtgtttagcaaattgtatcttatatcttgggtatcctaagtttctgagctaatatccacttatcagtgagtacatattgtgcgagttcctttgtgtttgggttacctcactcaggatgatgccctccaggtggtagtctcttaatcgcagcattttcttatgacccagctgccaagcatcaattgttcctgcaaaacaaatttttcactttagtagttatagtctcttgttaatcatagccaattcttcagctccagcagaccagaatctcagagtattattaaaaatagcacattaaaggtcctgaaagaatcttttcttgcctctgaaaccccataagacaggcttatgttagcgcattgctcaaaagtcttcccttccaagaacccacagtcaagaatctactgagctctgagcatccaatgtcttttccagcctaaagttcaaatgctaccacaatcctcctcaaaatgcatgaccatatctgtcacggcaataattcccagtctggtatgaatttttgttgtaactaggatttctattgctgagctaaaacaccatgaccaaatgcagctttgaccttatactcttatcagtgagtgagctcaaagtaaaatctgaggtagaaaccaaagtagaatccctgaaggaaaacagttactacttattccccttgtcttgttcatcatgctttcttataccatctaggaccaccagtgcagagtagattaggcacttccatatccatcatcaatcaaaatatcccacagacttgtctacaggccagtatgatggaggcaattccttaactgagcctccctctttccagatgatttcagtttgggtcaagttaacaaaagaaccaagcagcacaaagacatacaaaagaaaatacatacattgtgtaacacagtttgaacagatagtgtttctttattgagtcagctaacataggttattagaccatgatgcttctttaacgaggattattgtcactgataacatcagacaatggaaaatactaagtggggaatatctgatactagtttcattcacaacattaactagctgttacctaagtcacttcaattctttagttcctagttattgtcattgaaaaatgagggcattggctactagatgatttataaggaagttccttcccattttctgaatctataggtgccattctcatattcttctcacattaagccaaagggagaagtaaataaagctccattgaaagtttacaaaatgtgctgcttctgacctttaagagaccaacattaacctcgtaatgtttttcaggagctgcataacctagtacacttattgtatgatagaggtggctccaggcttcaaaattgtacatcaccaattattggtaatggaaccatggacccagtttctgcttccctttgttttgttttctcatctgcaaaagggatataaacattagtaagcttgttaggaacataaagtggtataatactttatgttagtgttataaaaataatcagttatcacttgtactcaatttttgtcatctgtagagtaagataatagtgccaatctcacacacatataaatatcaaactaatacatttacagaaactaacttgggacctgacctctttagataaagaggagactagaaaatttacgtgtctctagctgcatatgtatcagaagatggcctagtcggccatcagtggaaagagaggcccattggtcgtgcaaactttatatgccccagtacaggggaacgccagtgcctagaagcaggagtgggtgggtgggggagtgggtaggggagcatgtgggggacttttgggatagcaatggaaatgtaaatgaagaaaatacctaattaaaatgaaacaaaatatatataaaaaaagaaaaaaacaaaaaacaaaaactagccagcacaggtgggtcatctatatgtggcttacatctgaatggttagaaggacagttcattatgttgaggaatgagttttgtaacatgcatggtttcttcttgggactggctatgtgtcatgacacgggtcatagcctggggaaaaaaacaaaaaagaaaatttaccaaataccaaccttttaattttagctataaagttgacatgagatcaagaacatttttcattaataaaatatccatactttctaaaagtaaattacattttctctatgaatagcatacctttttattttaaaaaatgatattttacattttgaagcctgtcttctttcccttagtactttacgtaaatgcttttcttagtgaataaatatgttggtagcacaagttgtaatgcgggtgaatcatgtgcttttaaaattacgtaatgaaataccaattattagggatatgagtaggtcattttggctattataaatatcacttcaatgaatatgctttaaaataaattgtcataaacatcatttcatgagaaaaaactcctacaagcataattattatgcaagcaaatatatatatttaaaatatcttggtatggaatgttaaattgccctctagaaggacacaagactctcaatatcatccagaaacccagctttctagaagaaaacagttaacctacatgatactcaagcaaaattccctattgtcaacctttctcatcaaccggcatgtagagcacatgtttctttgcctttcaatgtggagtctagaaatgaaacttatgcatttgggcatatgttgcaaggtgatgttgacttataacttactgagaggttatgtaactcaacagcagaatgtgctttgttgagcagcgcattttactgccatagaaggcaccatagagtgcttaagacccagcactgtgaagcctggataccctctatgctgattctaggtctgtcacttgggtggcaagtgaaacaagctgcttaatctatgtttgccttctcattcttaaatattcaatgaggagcataacatagcctgcttcacacgaataaaaaaatgaatgcaagccaggcgatggtggtgcacgcctttaatcccagcgcttgggaggcagaggcaggtggatttctgagttcgaggccagcctggtcttcagagtgagttccaggacagccagggctgcaccgagaaaccctgtctcgaaaaaccaaaaaaaaaaaaaaaaataataatgaatgcagtaatgaatacacacaatagaacacatggcacttagtatctactaagggtaaattatggggactaaatacatatatttgtttttctcaagtccttacttatgaatatatcactattctttatgaagacccagttataataataatgagcaacctgtgatcatcctataagaatataatataataaaaccattagtccacttgtttgaagtttcatactaggcataataaatgtatggtgataaagtatacagatgaatttttgtctctgggaatggaggtagaaatttgcttcaaaaaataagtgagaattactggagttatgaaactgttctatatttggatagggggtgtgctgcatgagtgatcacatttatcaaatctcagcaaagataacactgatatctagaatgttctaattagcaaaatgtgatggtacaattcagtcagctcttcagaatcatgattaataaatgagaaaagcattgcgaatatcaaatctggaagagcaacatttacttgtcagcaagaaaggaaggaaggaaaggagggagtgagggggacagagtgacacagaagatgaggaggaagagaaagaaatggcatagataccaaagaaaattcagctaactctgaattacatgaaaatgttgtctcgcccgtttttggtctcaagagttttgccatagcatggtagtttgaaatcagtagtgttcgtgggattgtagcaatttgctctggtatttataggaaaacttttctgtttctccctattaggcatttcctgttcaaacatggatctggttcttctgctatcttcagtgcagccagtcagaactaccctctgacatctaatactgtctactcaccaccacccaggccgctgcctcgaagcaccttttcccgacctgccttcacttttaacaaaccatacagatgctgcaattggaagtgcacagccttgagcgccactgcaatcacagtgactttggccttgttactagcctatgtaattggtaagccctttattctatgtgtcagctttcttttttaacctgcctgttttgtttgcagtggggtaggaattcactctcaatgttgtgatggacaaatttgtagcatagttaactgctgtactaacaaatgtatttctagttagggttttttgttttgttttttgtttgtttgttttgtttttcatccctaaacttaagtactgttgttggtgtggaaagagtacacttttagaagaaatatttgtagtactaacacaatcttattgattgtggttactgtagttagccatgttcctttcaattaaagttgttatactttttctcattaaaagtcatacgtactaatctacaatagcttcttaaattacaggtgcatagtaatatggctactgagtcctcaggtactaatttcaccaaagaaatattatttaagagctttcataaaatttagtgcataatgtcttcccaaagattcacagaaaccaaaccatatataaccttattttcacaagaaagttggaaagtgtatagttcttgagcttgggagagtaattgtatacagcctttgaagggaaaaatgttgttcttcagtcactctgattaaagtcacccacacttaatagaaaattgtattgacttttctggatgacattttattttgactgaatattaatttctgtgcttcggtggttctgccagtttaaaatgtaaatatgtgctttttgaaaaccttattccaagaatagattggagatcctgataaaaaaaatctatctaggtatgtcattaacaactttttttcaggtttaacctgaaatttcatttcccaactgaagcagaattattcactaagatataccaaatatgattctgagaagtgaataaaaagatttaaattttttcataactgtaaataacaaagcatgcttggttggttcctatttttcaaagtgttaacagatccaagacttcccatatacagtttttctaggagctataatacaagaggatgaaagcaagtaaacagataacttttgaagaactattactattatgccagcaataaagagacatggcctttgatggcctccatgattcttgcttagaaatcctcatcaagcaatctatattctattaaacatggatattttcctgtgtcatatatatttcttgcatatcatgtttcacgcaatgcttccattgtatgtttatttagtttacaatgacctttaatgagaaatacttttgttgagatggaaggataaggacaaattgcaattccaataaattttatcatgaactcattcacaataagaaataggaatcagaaagatgacttatcatgaagagacataagagttaaatgtcctgaacccatcttattggaggagagaactttatcctacaagttgtcctatgaccttcacatacataacatgacatgtgtgtccacacacaaacacacaaacacagtaaataagtgttcaaaagaaaagatacaaataaggagtaatctgagatgttccagtaccataaagacccttcaaaatgttattgctgaattatgaaatcaacttggtgttatatgtgttagtttctattcactttattataggaaagtaatgtttttacatgtaagatagaacccttactacaaataaatccagatcatatgagactgttttaatgacaagttcacattatgtttaagtctatatttctatttaaatttatatgatataagatttcatacttatgtcagaaattttattatataatcttagactcagtggtttacctttttcattttcttagtagtcatttcaggggatgatattttatatagaatgtgattttaacgtaacagacggtaacagcctacaatagttatgagcatagattttaaactttctgctgcttactatacctcttgccatgagtgaataattaaatctgttcagacctctatttgctaatggattatgaggagacataaatgaatgaataaaaattaaattaatcaaaacaggaaatatatgaaggaagacattacaatggtaaaataataatacaattctaattttcacttattatttttgttcctgggtccaaatagttaagcatattgctcattgttcatttatgtttaatgacagggcaaactcataaaacatgtttttttttaatattagccttcactttctttttagcatacaagtaaatggtctagtttactaaatgaactggcctgcctgttttaaaatttaaatagctataccatgttatgtcttgcaatggtgagtaaaactaaatagtttgattggttaagaggtatcttttgaaaatatttactgtgatgttttctaattttatccaaaatgctaacctcatacaaagaatgggttcaaaagaagatttcttacagtgaatgttgtgactttcttcttgaccttcgataaattagggaatgcatctgcctaaagttgggtgttatatagctcaatggtgacatgcttgcctagcatgcttgagaccttaggttcaaaaccaagtacaaaaaaagaaaacctgtcttcctggatttatcttattactgccctaatgctgaccatctcaggaaagtaacgtaagaattcataaacacacattcaggtgaaagatgccacataagaactatattatataagatgatttttaaatggctttctgtggttggaataaaacactattatacttcaaaatatgaaaccatttcaccctccactcttttggggcctgtaagagttgtcttttttttcaatcccttttgcatttgctgtataacacaagaaaatctttcaccgaaactattactgctttctgtttcccatgcaaattcctttctgctatttcattttcctctattatccattatacataacctttacatactaatgactgtatgctgggttgtcctcaatccaccagggaaaatcacatcaatatcaatgggacatcaataggtgttctgtgcataatgcctctgtaagtggtcattggaaagcagtagaaatcgagtatgtgaaaagccagagttgaggtgttcagccaagcagctatagcctcacatctacccactataccttttaagtcagcaagaaaataattcctttgaataagttttgaagtcttaaaatttggtaaagagagctatggagagctactgattatatgaagatatcatggaaaggttattgtcaggactttctcataaatctgaaatatattccatctgaatcaaaaaatatgtccttatgcttcatcctctctgatattgtggcatgagtgatgtatcagtgccagtcagaagcacatttgcttgaatttacaaataagccatatgaagtagtagtcaggaagacagatgaccatatgcaaggcatcaagagaaggcgaggttaaggtactacatcaatggcttgaagggcacaaacacggcttctctgcaatctttgatgttttgatcaaatttctacagagtcagcaatttcaataagcaagaatagaaactcacaggcaataggaaatcatgaatacattgtaacaggggtcaaatggctgctgcattgaacaaatccagggaaaaaattcaagctttcagacccagtatcatcagttaatgacatggatgattcttttgattttgccatgaaatagtaatgattcatgccacctttaagagattcagctagtgtccaaactgtagatattaaaacattaaaatctataaatgatggcatgaaacactatatagcccaatatgtaatgttaatcagatggatattagcaatatagaattagaaaagggtaaactcttcagtttgtttctgtgaactatagttatgaataaaaaccattctagggagtcaaagacctacttcatatttttctccacagcagaatttgagtaacaccttatttttgtgctttcttttgcctcctttgtacttgcccgaattgccctaatttctatgactatcattatggtgcaataagaacgtaagtcatggagagtgagatgtggtccatttgcccacaatttgtaggccaaaatttctatacctcactagaagcaaacaattagatgggacatggaatgtcctggttttgtaaaaatccaagatcatctattgctttaatgtagaaaattaaaaatggagaaactttcccatgaaatttaaacataaaatgacccttcatatagtatttttaaatattttatttttaccaaaatcattgatataactgcttatctgaaaaaatgaaatgtggatgatacatccatgagaatttcctttataattgaatcatagcatgcaaaacacccatgataatgcttagaagttctacataaagttctacataattggtgtttactattagtggagctgaactaatatgagcattattaatttgaactgaggttagtataatgaacattaatttaccctaacctgacaggaccttgttttctttctttcctatgtcttctaaaacattgtctgaataactgtcacacaggaataattttattcatgtatttgtgtgtttgtgtatatttgtggtcatgtttgtatctgcatgtgtgtaaagtacatgttaagtagaaattatttcacatggaaggatacatactcaccctactaagtacttcataggctaaagagaagcttaaaattggactctgacacagataagcacccagcagagggcatagtaaaagaggtatggagagtagtttggaaatttagaacttttataggcttaagaaactttactatggcaaaagtcaattagggaaaattcagatgaaatatttctcaagaaatatatggacttcaaagaatttctccacatctatatatacacccaaatatacacacacacatgtgacatgtggatatttttagacttatatcacatatgttgctaagctatcattctctgaaatgaataataatgaactatattagagcaatggttttaaacagatgacatgctaaggcattttatactcccgaaatgggactacattttcatctagagcatccagaattggaagggctaacatagccaagcaaatatcggatttattacagtaaccactaagaggttactaagaggttaacaatgtgagcttagccatttgggcttctgctctactccttcttcagaatggtgaatatatgtgtgtatcagagaagacaaatatataagaatacctgaaaaagcagtaaaaataaaggatacaggagtcctataggaagtaagggtgatgaatagaagcagatcatgagagcaattagtccaaaagcaaatgagaatttagaggtttgtagttaaggcaagaaagctattttagtagatttacactagaaaactcacctaatgaccctactaaagttgggtttagcagacaagatgaaagttgaggtcatgaagacaaatagaagagtacagtattaatgcatgtcaatcatagtgagagcataaacttctgggagtaaagagagtggcactaagaagtatttagaagataaaacatatttaacatatgtgatgggaaagctgaattagattaggttgtagtgcttttataacaccaagataaaacatggaaggaagacataaaaaataaatacaaatgatcataaaagactattataaaaatatgtaccaataaattgaataacatagaagaaacagataagtcccttaataagtacaacctaccagtactgagttatgaatcacagaatatcttaacagaccaatgccaaatatgaaggctgtgttactagtactctctcaacaaagtagagccgaagacaaagtagctttatggctaaactctacaaatatttgaagaagaaatagaatggagtcttcttataacatttaaaaatttatgaggaaaaatgcttagaattccattccagtccagcatcatgctactaccaaagccaagcactgaaactaaaaaggaaagaaatgttattaatggggaaaggcagatgaaaatcatattgaagcatccacatactccaattaaattgctgctatctcaaagactggagataacaagtacttgtgaggatgtaggaaataagaaattttcacattgttaaatggaatgtaagtttctacaactactatggaaattgatgtaaagagatttcaaaaccctgagaagtggcacctacttccactattccggggtatgtactagaagaaatcaaatcggtaagtcctggataccaggaaagcaagaggctcccaggacccaacaggaatgagattagctgaaatgcccaacaaaagggagtgagaatctgtagagatcatatccataggttaagcaaggtccctagttgcggggtggggccaaccacccatctccaaaatcttagcccagaattgttcctgtttaaaggaaatacagggacaaatgtggagcagagcctgaaggaaaagccatccagaggctgccccaactggggatacatactatatacagacaccaaacccagacattattgttgatgccaagaattgcctgctgataggagcctgatacagccgtctcagaagctctgccagagcctgacatatacagatgtgggtgcttgcagccaacctttggactgaacaagagaatcccaatggaggacttagggaaatgtctaaaggagctgaaggggtttgcaaccccataggaagaacaacaatatcaactaaccagatgcccccagatctcccagggactaaaccactgaccaaagagtacatagggagggacccatggctccagttgcatatgtagcagaggatagccttgtcgggcatcgatgggaggagaggcccttggtcctgtgaaggcttgatgccccagtataggggaatgccagggtggtgaggtaggaatggttgggtaggtgagggagcaccctcatagaagcaggtagaggggatgagagagggggtttgtggaggggaaacttggaaaggggataacatttgaaatgtaaataaataaaatatccaataaataaagaaatatttgttccattctgactgaatggataaaatgttacatgtagaaaatgaagtgctattcagccataaaagaagaaattataattttttttgcaacaaatgagtgatcctagagaatattttactaagcaaaataagaaatactcagaaagatgcatacgtcatggactcattcatgtggaatattgagtggtatcaaaataataaactgtgaaatgagagaaggttgcagatatgttgttcacagtatacaaaattttaagagtatgataggagtaatacatttggcaagattatgccacaaatttaaaaacacattgtacgcatgaaatatgcaaatgcaccaacccataaccacagaagagataaatgtatgagataatgtatatgctaagtagccacattgagtaattttgaggggacaatcatattgtacaccataaaaatttctatcctctttttttcttaaagaagacattataaagaagaaagaactttcaggataaaaagagagatggctataaagacacctagtatattatttatccactactgaataattggaaattcctactttaagagatgccaagatactaggagaagaataagaggtaaaagaagatgaaatctggtgctccagggaacactgatattccagagggcttaaaagtgaatctgataagttaactaagaagaagtaacctgaaagattgcaagaaagccattagaattacaattctccataggtggtctgaggatcaccagagagactcaggatctctatcaggattcctgtcaggaattcataaactaaatcatattcattgtgacaaaatcaagtatttatccttctcaacacaattctctcagtagacagtgtcattttccagaatccatctgacatgtaacactgcaaaagttcagggagaaatggatatgggggtgtaactttcttttataagcaagtcattaatgattttcaaatgtgcagagcaattgcagtcttctcattaattgtatgaattaaaacgatatttatttactttatatctcaatcacagcttttcctcactcctctccttccagtccatccctctcaccaccgcccccccccattctccccttccattctctgaagaaaaacagaaagcctcccatggacatcaatcctcctcggcatatcaatttgcagtaggaatagatgcatcctctctaactgagcccagacaaggtagcccagttaggggaaagggagtccaaaggcaggcaacaaagttacagacagcccctgctccagctgttaatggtccaacatgaaagccaagcggcacatctgttacatatatgtagagggtctatgttcctaccatgcttgctctttggttagtggttcagtctctgtgagtccctattgacctaggttaagttattctgtagatcttcttgtgctatccttgacccatcttgctccttcaatcctttctcctgctcttccacaagaatgccctagccctaactcatgtttggctgcggatctctgcattcatttctgtcagctactgggtgaagcctctgagaggacagttatgatagtttcctgtctgcaagtataggagaatgtcattaatagtgtcagttgtgggttctttctctctcatgtcatgggtctcagtctgttccttctttatccctgcacatctggtaagcagggtatttgtggttccaaggttttatggctgagttattgtacccctcccaccattataagtcttgcctggttacagaaggtgggcatttcaggttctatattcccttttgctatgagtcttagctaaggtcaccctcataggttctttggagtttctcttgtttctagttcattcaaaagatgcccccacggccaattccagtttgctctctccattctttctgagttttttaaaaatttaattatcataaagtatgacatttatgtcaaatgtaatggtttatacttattgttcaataagtcaataaacactttcaaattatcagttactctaactgtgtctaatacaataaacatcaacagacataatacatcagtgaaaggtccttaacattttcagtaagttattgcttaaaattagagccaaaattgcttctgacactaaaatatttgtaaaatgccatagtaaataaaagaagttccaaaggtgtgattaaaggactgaatgatttcttagtgtttgtatcaatatagagaggattacacaacaaatacaagaagaagaaagcagatcagactaaaggcaaacttagtggggagttacatacaaaaagaggactatatcagagtcttagatataaaacttgaggtgccatatatggttacccaatttattttagacttaattaaaacactttccatatgattaacttgttttgttaaggaatgcactttgactccatatgacttcacaatgtagtctttcttgaatgtagcattaaatagtgttatattgatgtacacagagcagttaaataacaatactacctgcaaatccatatcacagtatagattctaaagaatttttctcttggttccttcacttctgtctataggacaataatgaataagttaagagggtgccaggtgacccaccgggattttcttctgattaaaatctcatcagagtcttgccaatctagttattgcaaacattataaaacatgttgtagctgacttttaaagaaattgactaccacgagagttcctaatgattggctttacagttgccagatactggtttgaatgtgataacaggaaaatttaactgctagcgaatgcacataactttgtactttgtaaaggacatttgattctatttcatttcttcctgataaagggaacctggtgttcaaatcaaataatccagacactacaggttagcataggtgcatagaacccagaaggtaaaagttaaactagttgtatatctgccagaaaccaatacaaaggtagtttggacagcaagcattctgtgctgccgtaaaacctgtttcagaagacatatactctgcacagcaatagtcttatgttttgtcaaatcaagtagcttatctgttgttgttgttgcagacaaggctcttattccagttttttgcttacttcatttaatgaataatctagattctctttaatcttggaagttagattttcattaaacatacatattagcattcaaataacaacagtaaatagttttgtttctgtatacaatatacctgaaaatactttacagaattaagtcataaaaatgttgggattaggtcaaacaatatcaaacagaaaaacatagaaaggaattgttttactcaaaggaggaaaccaaattaatatcatttttataatgtataaaaagtaggtgatggagagatgccaactgtcaagaaactagagtcactttctgactctttctgggagcataagatatgaagttgaggacatggtgggtcatctagaatgaaattccagatttccctgggtcttccagtaggagctgtgatcaactgtgctgacatatgtataatctctgtgaagggaatcaagggatgcctgaacagacttcttactgctggtgtgggcaacatggtgatgttaagaaaggcaaaccagaagtaagaaaaaagatccatccagcagtggtaatttgacaacaaaagttacattgaagaaaagatggggtgtttctttgatttgaaaatgatgcaagggttacagtaaacaataatggtgagatgaaagattctgctatcacaggtccagttgcaaaggagtgtgaagacttgtggcaagtattgcatccaatgcagacagaattgcatggttttccagtttatttgtaaaataaattcattaaaaagtgtttgctttatacacaagctgctctgagacccctggcacatatgttgaagaagactgctttgtctggcctcagtggcagaggatgagcctaatgccttatgaaagggagatgtcgtggaggggtgttggagggtgggaagggggagcacacactcagaggtgaagggtaggaggatgggtgaagaactctgggaggagggaccaggttggggagacaaaatttgtgatgtaaagaaagtaaaataattaattttttaaaaaatatgcacagcctattgacagaaaacataaaaaatagtctttgctcaaaaaaaaaggaaggaaggaaggaaggaaggaaggaaggaaggaaggaaggaaggaaggacactagaatcaaataggcagggaactggtcataagctacccctgaagataacaaaatctgctgatactccaggccactttatacagtcatatagtgttttcatatgaaatacttccattgcttttaaatatatatatatttatattagtacattgtagatgtcttcagaaacaccagaagaggtcatcagatagttgtgagctaccatgtggttgatgggaactgaaatcaggacctctgacagagcagttagtactcataaccactgagccatgtctccagtcccttcaccccccattacttttaatataatgtaaacggtgtctgtaatgttgttaccatgtattgcttagagaacataagaaaaaacatctttatatgtttaaaacaatttattctttttgaagacttttctacccatagttacttaaatccacagataccaaacctataaataaggaggtttagctaggactgtactagaaatgaatatagaaatatttaaatacattggctttttctaaaaggagacagtgtcctacttctacatacaagatcctcaggaatgaaatgctttgaagctgtcaaagagtttgtgaattttcccactaactggcatggagccaaatcaagtctttaacttattttgttttacacacacacacacacacacacacacatacatacataatcaaggtgtggcctcagaaagtttacgtaagaaacttgccagttgctttttgaacctaattgaatcatttgttactttgggtgttcagttttaatactgggagcaatacagtaaagcatttcatgttcgtggtatttctttaggttatagtaacacttgcatacacatcaaaatgtaggatattgtagagatagtattccttaaggtttaccagcatatgaggttgtgggagtatctggaagccaaatggaacaaatggattctttctttgtcgagcctaaaatacagactgtttcaagactgaacaaaacccaaacaagcccttcgtttcattgctttctccttctatcttttgtacatttttagtttgctttccctgtccaaggctttcctgtggattagtcagcataaacacctcatagctgaaaggcaaaaccttattcttcaaatcaatgaaatagtaagcataaaaaaccatcagcatctaatgagatgaccatgtggatttttcctttgagtttgtttatatagtggatacattgatagacttacttatattgaaccatcccttcatccctggatgaatggtgaatgattattttgatgtgttcttggattcagttagcaaaaaaaaaatattgagtatttttcatcaatatccataagggaaatctaacattgcacatggagggaccctatgactccagctgcatatgtagcagaggatggctttatctgacatcaatgggagggaaggcccttggtcctatggaggctcaataccccagtgtaggggatgccagggtggtgaggtgggagtgggtgggtggggagcatcctcctagaggcaagggaaggagggatgggataggggacttgcagaggggaaaccaggaagggagagaaaatttgaaatgtaaacgaataaaataaccaataaaaaaaaccaccagtgaagaagcaataaggactgaattgttaactgaactttaaaaactgataaaatgaaaaaataaatccaatgctagggatatccattttcctaaaaatcaaaaaaccataactaatcattagcatacatgaaaaactgaacaatatagtcctgtttaataaataattacagtatacatgtgttttgtgatttgaataattagggaaaatatttagattgatcacagactctcttagtagcaacactgataatgagactgatgtaatgctttgttatttcagcctgttagctctcttccatccaggactaaagcccatgatctcatttgccttttatgtcccacccctcttcctgtcaaatgaaattcagactgagagctaatgaactgagaaggtgctgaattttgtacaattatgtcaaaaatgtttgaagttaagacaaaaatgttacaataatatgatttatatacagattttgatttctgtttttgccagtcactattcaggaatttttcccctgtgcccatatcttcgaggcttttccccactttctcctctataaatttcagtgtctctgtttttttaaattttttattagatattttctttatttacatttcaaacgctatcacaaaagtcccctatacccctcaccgccccgctcccctacccattcactcccatgtcttggccctggcgttcccctgtactggggcatataaagtttgctagacaaaagggcctactaggccatcttctgctacatatgcagctagagacacgagctctggaggtactgattagttcatattgttgttccacctatagggttgcagacctcttcagctcttgggtactttctccagctcctaaattggggaccctgtgttccatcatatagatgactgtgagcatccacttctgtatttgccaggcactggcaaagcctcacaggagacagctacatcagggtcctttcagcaaaatcttgctggaatatgcaatactgtctgcatttggtggctgattatgggatggacccccaagtgagctagtctctggatggtccatcctttcatcttagctccaaactttgtctctgcaactccttccatcgatattttattccctatactagggaggaatgaagtatccacgcgttggtcttccttcttgattttcttgtgttttggaagttgtatcttgggtattctaggtttctgggctaatatccacttatcagtgagtgcatatcaagtgatttcttttgttattgggttacctcactcaggattatatactccagatacattcatttgccaagaattgtataaattcgttgtttttaatagctgagtagtactccattgtgtaaatgtaccacattttgtgtatccatttctctgttgagggacatttgggttctttccaccttctggctattataaataggactgctatgaacatagtggagcatgtgtccttattaccagttgaaacatcttctgggtatatgcccaggagagttattgctggatctacccacagtactatgtccagttttctgaggaaccaccagattgatttccagagtggttgtaccagcttgtaattccaccagcaataaaggaatgttcctctttctccacattcttgccagcatctgctgtcacctgaattttttatctttggcattcaaactggtgtgaggtagaatctcagggttgttttgatttgcatttccctgatgattatggatgttgaacattttttcaagtgcttctcagcccttcagtattcttcagttgacaattctttgtttagctctgtaccccatttttaattcatttctgggtcttcaattctattccattgatcacctgtctgtccctgtaccagtaccatgcagtgtttatcacaattgctctgtagtacagattgaggtcaagcatggtgattccccaggaggtacttttattgttgagaatagtttttgctatcctaggttttttgttttccagatgaattagcaaattgccctttctaactcagtgaagaaatgagttggaattttgatgtggattacattaaatctgtagattgctttcggcaggatagccattttgactctattaatcctgccaatccatgagcatgggagttctttccatcttctgagatcttctttaatttttttcttcagagacttgaagttcttgtcatacagatctttcacttccttagttagagtcacaccaaggtattttctattatttgttactattgtgaaggttgttgtttccctaatttctttctcatcctgtttatcctctgtgtagagaaaggccagggatttgtttgggtaaattttatatccagccactgtgctgaagctgtttatcaggtttaagagttctccggtggaatttttagggtcacttatatatactatcatatcatctgcaaaaagtgatattttgacttcttcctttccaatttgtatccccttgatctccttttgttattgaattcctcaggctaggactttaagtactataatgaataggtagggagaaagtgggcagccttgtctagtccctgattttagtgggattgcttccagcttctctccatttcctttgatgttggctactggtttgctgtaaattgctcttattatgtataggcatggaccttgaattcctgatctttccatgacttttatcatgaaggggtgttggattatgtcaaatgctttctcagcatctaaagagatgattatgtggtttttgcctttgagtttgtttatatagtggattacattgatgaatatccatatattgaaccatccctgcatccctgggatgaagcctacttggtcatgatggatgatcattttgatgtgttcttggattcagtttgagaggatattattgagcatttttcatcaatattcataagggaaattgatctgaagttctctttctttgttggatctttgtgtagtttaggtatcagagtaattgtggcttcatagaatgaattgggtagagtaccttctgtttctattttatggaatagtttgagaagagttggaattaggtcagctttcaaggtctgatagaactctgcactaaacccatctggtccaaggtctaatagaactatgcactaaacccatccggtactgtttttctgttttttgtttgtttgtttgtttgtttgtttttgtttttgtttgggtttttttggggtttttggggggttttttttgggggggttgagagactattaatgactgcttctatttctttaggggatatgggactgtttacatcattaacttgatcctgatttaactttggtacctggtatctgtctaggatgttgtccatttcacccaggttttccagttttgttgaatatcgccttttgtagtaggatctgatgatgttttggatttcctcaggttctgttgttatgtctcctttttcatttctgattttgttaattagaatactgtccctgtgtcctctagttagtccggctaagggtttatctatcttgttgattttctcaaagaaccagctcctcgtttgcttgattctttgaatagttctttttgtttccacttggttaatttcagctctgagtttgattatttcctgctgtctactcctcttgggagaatttgcttcctttctttctagagcttctaggtgtgcaatcaagctgctagggtatgctctctccagtttctttttggaggcactcagggctatgagatttccttaggactgctttcattgtgtcccataagtttgggtatgttgtggcttcattttcattaaactctaaaaggtctttaatttctttctttatgtcttccttgaccaaggtgtcattgcgtagtgttgttcagtttccacgcgaatgatggctttctattatttatgctgttattgaagatcagccttaatccgtggtgatctgataggatgcatgggataatttcaatatttttgtatttgttgagtcctgttttgtgaccaatttatggtgaattttggaggaggtaccatgtggcgctgagaagaaggtatatccttttgttttaggataaaatgttctgtagatatctgtcagatccatttctttcataacttctgtttgtgtccatgtgtactctgtttagtttctgtttccaggatctgtccattggtcagagtgggttgttgaagtctcccactattaatgtgtgaggtgcaatgtgtgctttgagctttactaaagtttctttaatggatgtggctgcccttgcatttggagcatagatatttagaattgagagttcgttttggtagattttacatttgatgagtatgaagtgctcctccttgtcttttttgataactttgtgttggaagtcaactttatttgatattagaatggctagtcaaacttctttctttgggccatctgcttggaaaattgttttccagccttttactctgaggtagtgtctgtctttatccctgaaatgggttttctgtaagcaacaaaatgttgggttctgtttgtgtagccactctgttagtatatatatttttaattggagaattgagtccattgatgttaagagaaatcaaagaaaagtaattgttgcttcctgtcatttttgtctttaaagtttggaatcttttcttgtggctgtcttcttttagttttgctaaaggattactttcttgcttttcctagggtgtagttaccatctttctgtttgtgtttctctttattatcctttgaagggctggattcgtggaaagatactgttgaattaggttttgtcatggaatactttggttttccatctatgttgattgagaattttgctgggtatagtagcctgggctggcatttgtgttctcttagtgtctgtgtaacatctgtacaggatcttctggctttcatagtctttggtgagaagtctggagtaattctaataggcctgcctttatatgttacttgacctttttcccttactgcttttaatattctgtcgttatttagtgtatttgttgttcagattattatgtgtcaggaggaatttgttttctggtccaaactatttggagttctgtaggcttcttttatgttcatgggcatctctttctttaagtatgggaagttttcttctacaattttgttgaagatatttgctggcccttgaagttgaaaatcttcattctcatctactcctattatctgtaggtttgatcttctcattgtgtcctggatttcctggatgttttgagttaggttctttttgcattttgcattttctttgattgtgtccatgttccctatggaatcttctgcacctgagattctctcttccatctcttctattctgttgcttatatgtatggttcctggtttctttccttagggtttctatttccagagttgtctctctttgagttttcttcattgtttctacttccatttttagatcttgattggttttgttcaattccatcccctgtttggttgtgttttcctgtaattctttaagggatttttgtgtttcttctacctgcttagtagtgtttgcctgtagttctttcaggacttctacctgtttagcagtgttctcctgtaattccttgagggatttttgtgcttcctcttcaagggcttctacctgtttagcagtgttttcctgtatttctgtaattgagttattaatgcccttcttaaaatcttctagcaccattatgagatatgattttaaatccacgtcttgcttttcaggtgtgttgggtatccaggactcgttgtaatgggcgtcctgggttctgatttctgatgcccagtgttcttgatttctgttagtaagattcttacgtttgccttttgccatctgaaaatctctggtgttaatgttcaagctgtctctggttggaacttgatcctcctgtgattctgctagcctctgtcagcactcctgggagtccaactctcacctgagttccagtggccagagcactctctgcaggcaagctctcctcttgcagggcaggtgtccagcagtctggagctctaatccacctcccgagtcctggtgtcagaaccctaggccaactttcttcttgcaaggaatgttcccaggtgtctgggtctcagctctgcctcctggctgagaatgaaggcctgaagggaccttgaccaagaagctctgttgcttctatcacccatgtgctctcaggtaatctgaggtcctgggtgtgctaggggtcctgcggtctagagagtcctctggtgccctagatgcccttggccgggttcacacagaagattgcagagctggcccccacatgaatggatcctagcctctggtcgggcagggttcctttgtccctgtttctgccagcacaagaccctctgtgattctttggaagggatgttgcgttccactcacttgtgattccaaggtgatcacaaggtcctgcagcgtggaccttagtgctgggctaagaagtgtgtctctggttttttgtggagttctttgatccacttagacttgagctctgtacaaggagataagaatggatcaatttgcattcttctacatgataaccatcagttgagccagcatcaactcggcggacagtcccatggtccccagaggactctccatggcccaggcatcctagcacacccaggatcttaggatcactggtgagtggaatgcaacatctgttccaaactaattgtgaaggccctgggccagcagaagcagcgacacaggaaacccacccaaccagaggctcaggtgccttccaatcagtgccagctccaggccaccttgggcaagaactcggggaacagccccatggtccatagaggactctccacctcccaggcatcctagcatgcccaggatcttaggatcactggtgaatggaacacaacatctgttctaacacaactaggactgggaccagcaggagcagggacacaggagccctgcccgaccagtggctctggttccttctagtcagcactggtctaccttggctttgaacacagctgacagcaccaaggtccccaagggagttaccaattccaggtgctctaacatgtccaggatcttaggattctaggttcccaggatcctagaagctggtcacatgaggatcccaggtctcagaggaagcttgactgccaagaactctgacacacccagaatcttaggttcacaggatcatggaatcacaggatcacagagaaagctggactctgaagagttctgactcaaccaggattacaagaaggacaggatcaaatcagatatattgagggcagtaagtacttgagacaatcagatggcagggataagaacagaagcaacagaaaccaaggttacttggcatcatcagaaccaaactttcccaccatagcaagtcctggatacaccatcacaccagaaaagcaagatatggatctaaagtcacttcttatgatgatgatgatagaggacgataagaaggaaataaataactcccttaaagaaatacaggagaacacatccaaaaaggtgaaagtattgaacaaaaccattcaggatctaaaaatggaagtagaaacaataaagaaatcataaagggggacgactctgaatatagaaaacctaggaaagaggtcaggagccattgatgcaatcataagcaacagaatacaggaaatagaagagagaatctcaggtgcaaaagagtccatagagaacatgaacacagcaatcaaagaaaatacaaaaggatcctaacccaaaacatccaggaaatccaggacacaattcgaagaccaaacgtaaggataataggagtacatgagaatgaagattttcaacttaaagggccagcaaatatcttcaacaaaattatagaagaaaacttccctaacctaaagagcatacaagaagcctacagaactccaaatagactggagcagaaaagaaattcctcccgccacatgataatcaaaacaccaaatgcacaaaacaaagaaagaatattaaaagcagtaaggaaaaaaggtcaagtaacatataaaggcagacctattagaattacacctgacttttccgtagagactatgaaagccaactgaagctcctttctctgtgataactccaacctgtgtcaagttgactcaaaactagccagtacagtatcctaattaacaaaatcagaaatggaaagggagatataacaacagaatctgaggaaatgcaaaatatcatcagatcctactacaaaagcctatcctcaaaaaaaaaaaaaaaaaaaaaaacaaaaaacaaaactgggaaacatggatgaaatggacatttttttagacagataccatgtaccaaaataaaagcaggatcagattaacaattcaaatacccatatcccctaaagaaatagaaacatttattaatagtctcccaaccaaaaaaaaaaaaaaatcccaggaccaaatgggtttagtgcagagttctatgagaccttcaaagaagacctaattccaatactactcaaactattccacaaaatagaaacaggaggtactctacccaattcattctatgatgccacaattactctgatacatataccacacaaagatccaacaaagaaagagaacttcagaccaatttcccttatgaatatttatgtaaaaatactcaataaattccttaccaacagaatccaagaacacataaaaatgaccacccatcatgatcaagtgtgcttcattccagggatgcaaggatggttcaatatatagaaatccttcaacaaaatccactatataaacaaactcaaatacaaaacccacatgatcatctcattacatgctgagaaagcttttgaccaagtctaaaacctcttcatgataaaagtcttagaaagatcaggaattcaaggtccatacctaaacataataaaagcaatatacagcaaacccaacatcaaactaaatggagagaaactagaagcaatctcactaaaatcagggactagacaaggctgcccactttctccctacctattcaatatagtacttgaagtcctagccagagcaatttgacaacaaaaggagatcaaggggatacaagttgaaaaggaagaggtcaagtatcactacttgcagatgatatgatagtatatataagtgacaccaaaaattccaccggggagaactctgaaacctaatgaacaacttcagtgcagtggctggatataaaattatctcaaacaaatcagtggcctttatctacacaaaggataaacaggctgaaaaagagattagggaaacagcacccttcacaatagtcacaaataccttggtaaatagtaaaatactttggtgtgaatctaactaaggaagtgaaagatctgtatgacaagaacttcaagtctctgaagaaagaaattgaagatctcagaagatggaaagaactccaatgctcatggattggcaggattattagagtcaaactggctagcttgctaaaagcaacctacagattcaatgcgatccccatcaaaatcccacctcaattcttcacagagttagaaagtgcaattggcaaattcatctggaataacaataatcccaggattgcaaaattattctcaacaataaaagaatggaatcaccatccctgacctcaagctgcattacagaccaattgtgattaaaaactgcatggtactagtaaaatgacagacaggtagatcaatggaactgaactgaatacccagaaatgaatccacattcctatgctcacttgatctttgacaaaggagctaaaaccatccagtggaaataagacagaatcttcaacaaatggtgctggctcaactggcagttagcatgtagtaaaatgtgaattgatccattcttatctccttgtacaatgcttaagtctaactggatcaaagaatgccatataaaaccagaaacactgaaacttatagaggagaaagtggggactagcttcaaagatatgggcacagggggaaaattcctgaacagagcagcaatggtttgtgctgtaagatcaaggatcgacaaatgggacctcataaaattgcaaagcttctgtaaggcaaaggacactatcaataagaccaaaaggcaaccaacagattgggaaaagatctttaccaatcctaaatccgatagggggctaatatccaatatatataaagatcctatttaaaaatggggtatagagctatacaaagaattctcaactgagggaataccaaatggctgagaagcaccacaccaaaaaaaaaatgtacagcatccttaatcatcagggaaatgtgagtcaaaacaaccctgagattctacctcacaccagtcagaatggctaagttcaaaacctcaagtgacagcaaatggtggtgaggatgttgagaaggaagaacactcctccattgctggtggaattgcaagcttgtacaagcactctggaaatcagttggcggtccctcagaaaattggacatagttctactggaacatccagcaatactactcctgggcatatacccagaagatgctccaacatttaataaggacatatgttccactatgttcatagcagccttacttataatagccaaaagctggaaggaacccagatgtccctcaacagaggaatggatacagaaaatgtggtacaatttacacaatggagtatttctcagctattaaaaacaatgaattcatataattcttaggcaaatgggtagatctggaggatgtcatcctaagtggtgtaatccagtcaaaaaagaacacacatgatatgcactcactgataagtggatattagctcagatgctcagaatccttcttagaatagggaacaatatacccatggatggagttacagagacaaagtttggagtagagcctgaaggaacaaccatctagagactgccccactctgggatccatcccataaacaaccaccaaacccagacactatggcagatgccaacaagagcttgctgacaggaacctgatatagctgtcccctgaggggctatgccagtgcctggcaaatacacaagtggatgctcacagtcatccattggacagagcacagggtctccaatgaaagagccagagaaagtacccaaggagctgaaggtttttgaagcaccataggaggaacatcaataagaagtaaccagaacccccagagctcattatagctaaaccaccaatcaaagaaatcacatggtggaccttgtggctctatctatatatgtacctgaggatggcctagtcagtcatcaatttgaggagaggccctgggtcctgtgaatgttctatttcccagtatagtgggaatgtcaggaccaggaatgggaatgggtgggttggggagcagggggtggggggaggaataggggattttggaggggaactgggaaagtgggtaacatttgaaatgtaaataaagaaaatagctaataaaaaaacaattttggtttcacttgaaaagatgcaagtatctgttgcaccaagacctgcattcaccacatttgtccatatatttactgaatactttctgtgtgtcaagtattattttgatctttagtataacaaagataatatgataatcattaaaacccaataagatctcctatttaaaagaaaataatattgccagtctgtcagaatactcattctacccttttctctctttgtcttttccttttcttcctacattatatctgtatttatatatgtatctagagagtgtattataaaatctaaaatttttctcaatatataatccttgctgtgtccattgacagaaattaaaagcaaccacagcttaatagtaacgaacatacctcatattcaaattgtggtttcaaaatacatccctactaaaatgtatattggcaatcacctattcctaggcctctggacggaaagggaagcaaggaaatacagatgatacatgacactgttaaagagcttcttactagctacagttggacatcagaaataccctgtgtctcttctctcaaggctcaaactgcatctccaaaaggggacagaaagattttaagagagagaggtagtatatgactacagcaaaaatgctttcacgcccatgaatgcaccagccactgtgaccacatccacatcacatgcacaagatcaaagcatccaaaataccagcttggataggaagggcacttaggacgttcaaactggaagaggacagtcatattgggtggtgggggttgtttgcttgttttttactttttgtttttttgttttgttttgtttttctgaaattttatccttgagaggctacccttgatctagtagacggccctacacctatgcacagaatgatagttctaaggggacatatgaaatcaggagagaatactatgtgatgatgatagaggaagaattgacaaggagtaactggagatgtggatttgatcaaaacacatcatatccattatgaaacccgcaaacaataaaaaaaatcatttttcccataacaaaaaggacatgttttagtcacaaaagcattaaataaaatggacatgaattgttctttaacacatttagattttattatatgtaataccttataatcagatattttgactcactaataaagaagctgagattcagagaacttaactatcataattttatatacaacaggaagtaaatgaaaaggtcattgttctttggagttctctgatttacttattagattaattattctttaatagtgagtaattattatatattttcctcatgttaacatccttatcctatttttcaatatgatttgtaatagaaaccttatcatctatttgtattgtttttattaattccatactgcttactgggtgtttgagtaattttccatattttgttattatacacaatagaatgtgaaacatcaatgttttatatctgtttatattctctgtataatattttaacatggaattactacatgagactattttaaaaatattccaatactgtggtttcttttaaatttttcccaaatatgatatagcactttatactcctagaactatataggaatgctctgaactcttgaaaacctttgatagcatcatttattatttttatattacataaagaaattaagtgtttttgaaaaatacattggatttttcatgttttggcacacattcacatcacatacattgaaccacaagttaaaaatgtatacctttaaggtacataacatgatgtattgatacaggtctaccttttgaattaataatgaaaatcattttaggtaatctatccatcactttaaaatgttgcattgttgatggtaagagacttcaaaatcttgtaggaagccagagagttgaccaaatgagcaaaaaacctgaacactgagttctatccctaaactcttggtagaaggcacaaactaatgctgcaaacttatgatttgatagccacaaaccacaaacatatgcgtcacacatacagacacaacactatattgatactataaataataataataacaataatgaagttaacatttaaaaattgccaacacgtgtggaaataaaaagaggccttgatgggagaagggaccagcagcagagatggtaaaagaggatctgcaaaaacaaagtgtgcatgagaatgctataataaatgtatgttgttaaaataattcattccaatatcgcatacagtttaaaagaagatgagagacatgtgcaaaagtagctctgatttagagattgttcatgttaattcctcttgcattttttggtaaatgacatgaccacatacatatttatatactgcatgcacattaaaaaatcattttagttttattaaactgtatatgtattgggagcctcatattagctggtatatgctgcctggttcatggatcagtgtctgagatctcaagggtcgggttagttagttgatactgctggtcttcctatagggttgccctcctcctcagcttcttcttccagctttctcctaattcaaccacagggcttcaagtggaggaaactctaacccagaattattcccagttcgggcctgtcaaagacaggagaaaataaaaaataatagaaacaaagaattcaagaaggaaaaactaagtcattgaggaaagtagagtaactatgttctacattctcaatgagagaagcctaaggctggaagtccattaaactgatgctggttttgatgttttatagagcctgtcctcaggctcttctccacttttgtccctgcagttctttcagacaggaatttttttgtctgtgggatggcaactccatccctcatttgattccctgtctttctgctggaggtgtacgctacaagttccctttctccgctgtagggcattttaaccaaggtccctccatttataagtcctgagagtctctcacttcccaggtctcttgcacattctagagagtcccctccccacctcctacatcctaaggtagaaggtttccattctttcttctggccatcagaccttcagtattacacctccataaatgatcatgttcccctcttcccctctctgtcccctttcccatccatattcctccctccctccctccctccctccctccctccctccctccctccctccctcctcttctgattgctttcttctccctcccaagtgagactaaggcatcctcacttgggccctccagcttgttagccttcttgagttcttgtcgattgtatccttggcattgagtacatttttggctaatatctacttattagtgggtatataccatgcatgtcctttttgggtcttctttcttcatgaataactctttattaagtgggtctataggtcataaactccttcacctactcatttctgaatgacaacttcgccattagatattaccagtgaaggagagttaaaggacataggtaaactaggaaagcaaaatcaggcttcctgagatatctgcttcttgttcccataaaacattgtgaggagaaatgttaggaaggtatgggagcagttacctaaataggactgacagaggaaaggggaaggcacaggggacctataaaacatcaaaaccagcatcagtttaatggacttccagccttaggcttctctcattgagaatgtagaacatagttactctactttcctcaatgacttagtttttccttcttgaattctttgtttctattatttttattttctcctgtctttggccttctgtttttctctctcctccaatgctttgttcatgctaagaaacaaacttgtcaataccctagataagcactcttacccattatattcattgaagaatttgggagtctggagggaacttgccccctttcagagatttgaaaggattttgctgagaaatccactgatgatggatggtcttattgatgttgtcattatgtggtaagttttcccttgctgcattcaaaattctattatctatagctcttagaattgtctagtttctttaaatttggagttctttgactttgttcagcttgacgtttctctctatctttagataagattaattttgtcattatttctttaactaggattttaattctttatcatccatcattcctcctgaaactcccatgctgcgtatgttgtttcatgtaatgctgtaaatatgttcccacgggatggataaagatagatagatagatagatagatagatagatagatagatagatagatagatgcctttgagctctgtgaaacagtctttataatacattcttcagttgaaagttccatttggttattttttgcagtttttaatcatgagttgatcttcataaagtgttcttattttattattttgggggctttatttagaaatatattcacttactgttcactgttatttaagttgtttattttcaattctttatcaaaatgttcatctatacctctgtttctgtatggctatttacgatttgtttcttttgacctgtcatgcttccctggttatttgtggtcattttagctttatcacatcctgtagtatttagaaactatcctcaacccttcatctgtctgcttttccaaatattatgcatggattgttttggaggttcagtggacatgcttattccaggaatgtttgaagagttgggcttggtacttggtactcagggagactgacttgaagccggatcctacagatgccatgctgtcctggaatggaaacttggggcataagcaaagtcaggaactggaggccctgtgagccaagggccaacacagtgctggtatagaacttgagcctgtttcaataatagagtagataatgagtatttgggagtctaaatgctaatgaaacagatctgtgaactgagtttgtgggtgccgatcttaagcctagaacaacaagaaagattgggttggagcctgggttatttagcatcagcctcagatcacaggtatatatttagcacaccagggtgccaacagccttgatctattgtgactagcctagaaataggactttctggagggcatcttgtgctggagtccagagtaaatgtactcacatacttcttttcctcctaacacagagaagagttctctccacaatgaattagaagggcttaaagaaggggtgtagataatgtgaaactccccttcctatactcttgatggatctttttaaaagaaaactctatacataactcaagtgttttaatccttcacttaaattcattagttcatagaaaggaatttttgaacatgatacttattcaaattaatgtttctgctgctacttcaccatttaactaaagtcattccccttggttatattattaaattaccactgtggttgaacactttaagttccactattaaagtacctttcctcctttcttgaattacctcttgatatcctttgtctatttctatttaagatttcgccagctgttttttatttacaaagggatttatagctatgttttacatttaacatatgttgcttattttaatattacataaaatataatgaaaattctagttttaagtcagaaaacaatgaaatcaagacacagccatattaatttcccattatgtcctaataccatgaaaaattgcttcaagaagcattaagaataattttatatctattttcacatatatgtgaactttagaaaacttctcaccacctacctatgtttaaagagaaacctgcatttttttaaaatataccaagacttcggataatagtgtcaagtttatataaaaagaacaaacactatgaatccagttgaatatatatgcatacgtgtgtgtgcacatgtatttgtgggtatgtgtatgtgctcgtgtgtgtatatgtgtgtgtgtgtgtgtgtgtgtgtgtgtatgtgtgtgtgtgtgatatacaggagtataacttatatggcctagtaatgcagtatagttatccgtgtctttatacaagtttattattttactgatatgaatgtgtttgcattagaagaattttatagtctttctagttgtgtatacttacctgaaatagatagacaaaattggctttgaataatcagtctgaggcaaagatcagaggtttttctctctgtgtgaaagcatctggtcgtcacaaaatttaacctacagcatagacctcattaacctaatatttaaacaaaattacttgtatattaaataccaatacaagaggggactgtttttgcactgaataagatacaagcattgtggcttggtaggaagaggctatgatagaaaactaatgtgtattagtatctaagttgtagtgtcatctttgataaaatgaagagactgaatcaatatgttttcctacagtatttcctttccaaaataagagattaattttagattgcatttacgtttacagaaagtttaaatgttagtagtgagaattctcataaccttttcatctttttccttctgctgggaacattctctcatgcagacatgtggtacacctatgctggtgattctgagtcaaggcaatcacacatctgaagcaaggatagaatacaagtgagaccaaggccagcctgtaatgcatgacatcttcgctacttttctatataactgataaaactctctgactgaggcaacttagaaaagagattaatgggactaaaagttccagagaattagaagctatggtgcaaaggcatggtagcaggtggctggaacagcagttgagaactcacatctctatccacaaggaggcagagaaggctaactcaaaatggtcttagtcctttgaaacctcaaagctcatccccagttatacacccttgaaatctctaattactgaaaatatttttaccaagagaattcaaaatctacaacttccaacccccagtgatcataaccacatagtaaagaaaaaagactagttttaaataatgatggtaaaagaaaataaaagaatatctgtcttcacttggaattgaaaagttgggtagaagcttgttttatagttataaatccatataaagattacacctgaagttctctccaaaactcaaattcctctatattaaaataaaaactattaaagcttggtttgataacatgtacctattatcccagaacttaggcgatggagagaggagaatcccatttgagttaatggcaatcatgtctatgaacagtaaaacactttcttttaaagcaaatcatagactgacatggcacaagttacttaatcagaaaaacatttcaaagcatcaactactaccaaagactgggatcataaatcagtgaagagatttttactttaaaatatgaaaatatataggacaaatccataagaaggagagagaactgcatgagtcagtgtgttttgtaatctctatagatgaaattttagcttagatctttatggaagaacgtgaatattttttcccatatgtattctaagctgggggtgtggtaaggaaaggacatttggaatataaaagacattcatcatcaataataccatagacaacagttctagtcatagtgaaaggaaaacttcattgcgctaaagatgaattaaaatgagaaatgaatggaaaatttaggcaatcaaaactactagttcctgattaaattgatatttttgcttcattatttgggaaattaaaaattgtctgtcattatagtactattcctcccaaatccacaaagcaagtagcagcagacaaaaaataaaatttgatttctagagaacacttattagtgctgtgacttgagatgaaagcactaaataaccgtgtctgtctgataagagctacacagatgggcctgttatgcaactgcaaatggagatcatatattaaacctgcgataaggtacccaaatagacacgttatttataaatattgctgcagctttggatggggaaatataaaatacatactaaatgaaagcgttaagataatataacatagaactgagatattaaaatgatttattactttgatagaatcttttctagcctgagtactggatacaatgaggactatactaagcaggaataaaagcaaccatactgcaatatagaataattcagttcatttaggagaggaaagaggacaattcaaagcgcatggaaggacaagaaaggtgtcctcaatgtctctgtctcactgtctcagatttaactggcacttaattgtataatttcattaaatgtattataaagtactgtaaaatgctccaagctaaagtgattttccttctcttttaaaaagacagtaatacaaaaaaaagtaatgcactttcttccaaaataaatactacccatacctggcacaacagatttttatgattaccaaaatatttgaaagggatctcaaagtcatattgactacactgaaattgctttgaaaatggacacttaagtggggtttatttattttcattatgtggtaaggcacagataatattttcagtaaaaaggaatagatatataactatagaaaaagaagaacttaaatgaaattgctgaggcaaaataagacagtcataaataagcacacattaagtcccttatttagttcctgaaaaatacttcactgaaaactaatagttttcaatcctacatataatctggttattaccaggataaaaccgagatgcgaagggtaatttatcaaagactgtagttcactcatacaccaatgtgatgtttagcataataaaaatgggatttgttttaagatggaaagatatcctgctttctgtaatgtttgcaatcactatatttaactcaagtactgtttacatttacaatgatattccagactgcagaaatggttagtgtaaataatgtccacaaaagcaatggtctgaagagactatttgccacagcagtaaagtcaaaagcctgcctgcagtcatcggggtcaccatctgggtgatgttcttggtgtatttttcaggataggaactgtccgacatgtaagtagatctgtagctttgacaagctttggaagtaaagtacaaaagctggaggattccctagcctgaaggaatgtgaaaaaagacatgtaagggaagtggtgaagggcagtaagtgctggaaaaaaaactggaaaataaaggcaaacgttatatgcctcagtacgggggaatgccaggggtaagaagtgggagtgggtgggtgggggagtgggtgggggagcgtgtgggggacttttggaaatgtaaatgaaataaatacctaataaaaaaataaataaatgaaaccaagaaagtgtcacatacttttattctgtgacatcaactatgatgataagactttattgatgagacagatttcaaataatctgagcataattatttaggataattagaaaaatgatacccccaaagatcttgcaactagtaggtatagcatcagtagctgtatgtgctgttagtgctcctgcaaaggacttgagttctattgtcagcgtccatgtcaggtggttcacaatcacctgtaactccaggtccaggggtctgtcatccacttctgttctccatgggcatctgcactcgcaggcacacatacacatacatacatacatacatacatacatacatacatacacctaactttagtaaataaaagaaaccggtacctattgttgagagaatgcttagccaaccctattattgtttcatggaggcagcattcctgtcatacataggtcttgcaaactttatatgccccagtacaggggaatgccagggccaagaagtgggagtgggtgggtaggggaacaggccaggaggagagtatagggaactttcgagatagcatttgaaatgtaaataaagaaaatgtctaataagaaaaaaagaaaatactcttgctgctgcctccttgtactctgactctcccaatctttcactccctcttccacaacatttcctgaaccttagatgcaggaactgtgttgtggatataaaacaatgcttggtatccattcaacttcataaaggtattatttatcacttaagtattttcttacttaaaatatatggatatacatcattgcaaagagattgcaacaatagttcaaaatactaaagtatcctttgggtatctccagttcctattccaaagagccatgctttagtatttcttgtttcaatatgtttcttgtgaatttgtctatgtagagatacatgttttctattaaagcagaatcataggatatgcattgttctgcaacgtttgccatataaatcttgccatgtcagcacgtaaaggccattctgtggttagttcatacatatttgatacatagatccttgagtaaaggtttgtttgtttctaagatacagtggcacctaccacgggttgattttagccaccacaatgaagtcactaaaggtgaaaccgtgaaaggatgtacaaaatgtgtttttataaaccaggaaaattggtacaagcacatacatctcttattctctccttgtgaatctgttgcttgttgtgtttttctggatctctctctacatcactgcatatctctgcgtgactctctgtctttctctgtctatctccatttttctctccctctctacctccctcccttctttcctcccctcctcctttcttttcacacacactccctctctcaataattataggctcccaaaaaaggcaaaaatatatgaaattcttgtatatgtaactgagatttctaatgttagaaatttgcataagtataataaatcactaaaactaggaaattaacaatggtgttatgctattagctgtgatgctattatctgagtttggagtttaatagagatatcgctagtttttccacaatccttcttcctatttcaatgtcttatgtaggatccaatattgcattgaatttttttgactctagtttcttccaatctaagattcaaagtataaatccttttaatgacttgacatttttttgcaagaactttacatttatttttaactaaaataaaagcataaaatttgactgaggagatgtttctaaaggtaataatacttgttgaacaagtaaaagatccttagattggattccaaatttccacattaaaaggcttagcactgccatatgtgcctataacaaacacttgtgcaggttactggaagacaaaatgggaagtattgttgaagcttattagccagccagcctaggcaaaaactaacgaattccagattctgtgaatctccctcttgagaataaggcagagacagaacaggatggcatgtatctacacactggctgctatttctgtgcacactggaaagtatactcatgtacatacatgcacacacatgcatacacttaccacatatgtgcacatatatagcacaaagaccccacaaaattgtgggacaacaagcaatgtgcacattatacatatagtgcatactatatataataaaaatatataattgccatatactatatataattatatagtgatacttaaattgggcttgaaaaggatcctaaaatatgagcacatcactctttggcacaaatagctatgttgcttctaatttgtatgtattttaaaggtcagcatgaaattgcatataatacatgtatcatgtatacatgtacatgtatattttatatgaagctatgccatttggactgacaattttactccaagagctataaggtgaaagctccaggactagaaatgagaaatcccctttacacaaatgattttatttatttaccttccaactgttgtccccctccatcccccctccctcagactaaaggactggaagaaagttttccaagtaatgttcccaagaaacaagctggagttgccattctaatattcaataaaatagactttcaatcaagagttatcaagtgtgatgggaaggacactccatatccatcaaaggaaaaatctatcaagtcttaattctaaacatctatgccacaaatgcaagagcatccgcatttgtaaatgaaactttactaaagctcaaagcacacattgcacagcacacaataatagtgggagacttcaacacaccattctcaccaatagacaggtcattgaagcagaaaataaacagagacacagtgaagctaacagaagttatgaatcaaatggatttaacagatatctacagaacatttcacccccaaacaagaggatatactttcttctcagtacttcatggaaccttctccaaaactgaccatatagccagtcacaaaacaggcctcaacagatacaagaagattgaaattataccatgcatcctatcagatcaccccataataaggctggactttagtaacaacagaaacaacagaaatcccacatgctcataaaaactagacaactctctgctcaaagataacttggtgaatgaagaaataaagaaatcaaaggctttatagaattcagtgaaaattaagatacaacatccccaacttatgggacactgtgaaagtggggttaagaggaaaattcctagcactgagtgccttcattaagaaattggagagatcccaaacaaacaacctaacagcacacctgaaaggcctagagcagaaagcagcaaacacacccaagaggagtagacctcaggaaatagtcaaggctgaaatcaaccagttagaaacaaagagacctataccaaaaaaaaaaaaaaatcaacaaatgcaagagctggttctttgagaaggtcaacaagatagataaactcttagtgaaactcccaaaacaatatagcctatgctcttgtctgggggtgcctcccagaggctaaatgtatgtccctgatgctgaagaaatcatgtgcttcagatataggatttgacctgaatgtctccactctgaggactagatttaatagtaccagaaggtaatacacaagattccaagggagagaacaaatattgtgtgtgtgtgtgtgtgtgtgtgtgtgtgtatatacacacatacatatacatatatatgtgtatatatatgtatatgtgtgtgtgtatatatatatatatatatatatatatattcctaaggatacagaatcagcattcatatatttgcttatagtctgctctacatgggaaaaaacatgcctgatactggacccgagccaactacctggggctagtgaggtcatggatcttagaagagatcctactaccaccaatttacaaaaacagcagaattttaaagtggattctaaatgtttatcctatacccacaattaagtgcaactctaatcccttggcagagaaacatccttttggaacagaaaggaaacatcacagaaaacaattgtttaaaccacagaaaacaatttattgtggagttcttagccctggtaaatacacctcaaaacaggtcctacacctaaggctcagagaagttcacagaaaagtgggaagaaagatagtaagaaccagtggagtaggagatctgtcacaagattttctttcctggaaataacagggaagcttcacccatgacacttcaataatatggcttgcctaaacaagacaatagaaacagacaatgctaacagacatgcaaacatcaataaggaatcaaccctagacaaagaactagaggtaactaagaaattctgagagagaaatggtcttctccgagtatgaatcccctaacaagttattaaatactaaccagttagcactgaaataatatacatgcaagtaaaactaaagagattgagtatagggctagagagatggctcagtggttaagaacattgactgctcttcctagaggtctgaagttcaattcccagcaaccacatgcagctcaaaaccttctgtagtgggatatgatgccctcttcttctggagtgtctgaaaacacaaagtatactcacatatttaaaagaaatatttaaaagagagagactgagcttgatatatctatatcatctatctatctatctatctatctatctatctatctattatctatctattatctatctgtctgtttaggttgaatttgtaatctgctccttgttttatggcagaatcttgcctggctttatcttatgaacatgaggacaagcagaggtgccatgggctccagagtgcatcagtactgccatgttcagaagatattctttctttctttcttggccacactgacctctgactctgagccttgagatttgaggtttctcagttgagcccagtgactcttaaaacatttacaccactctgtcacccttggacatacatttactccactctgtcactcttggcgatatatcaccattccagtcattattgtatttcataagtagtggataatggaatacaaggtaacaactgagtcctgagtttagaaccagggacagaaaaatgatgataacaagattcctgcctgttgaggcaactatgtcagcagatattttcaatactttggtagactcaatgctatagttctaaagaaaacatatctttgggaactattctaggtaatgaaagttatcactgttcattagaaatataatgtgagctaattatgtgatttaagattctacggtggccttatttgaaacacaaaataaataaaataacttttaataaaattttatcaaaaatagtctttcaatatgtaattaatatacaattattaatgtggtgttatatattccctctttcatatttccttgactaggcaaattttgagggctcactaaatgcatgcatcaagtggctctcctattggcacacacagacctaacttatccagcttgcatttctcacatttatttctaaaacacctctgtagtctgaatattgtaactgaatatgtgtttcttgaaggggagtagaataaggaggcattgttagttatgttactagagagcaatgggctcatttaaggaaaacaaagtccaacttcctagcagatattgcaaaggtatatatgtagtaacttgatgaattctatagaaatatacaagaaagatttctgcatctggagtcagcctccttgagacgcaaaatttcagaaatgttttcaacttagttatatggtatgtaatctgaatagcttaggcctgtgtttggttgtggactgtgtttggcaacaggaaagagcatgatattccaattgtaaacttaactttgtaatgagcttgtgatttcagggcatagctctttacaattggataaaagaggtctaataattacaaattgtatagtgctgagcagcagggaacatttgttaaaggaccattaggaactgtcattcttaatctgctgagaagacattactctaggatgatctgaattggcatacacattctgtctagtcagtggatttcagtaaaatacaaagtaagtagtaacccacagagagctggatagagtctgctcctcgctgagtatgtacatttgtgtatatgtcattaagagtgacaacttgaatcttgctttgaatcaagtactatgtttatgtctactttaactcatttggagccctacttgtgaaaatttaactttatcagtttctgttcacttcttctttattgatgaccaattgagaagtgggttagaccactgagataacaggattgtgggactagtgattatgggcctgactttttctaccacttgtcctgactggcctcacattgagctactgaatgcctctcgcattgtatctctactctctctatctgaaaggatttgctctagaaagcggtttttaaccttcttaatgctgtgaccctttaatacagttcctcatgttatgatgacccccaatcataacattattttgttgatatttcagaactgtcattttgctactgttatgaatcataatgtaaatacctgatatgccatctcaaaggggtcatgacacacaggttgagaaactctgctctagatattcatgatgatgcctctgcaccacccattctatattatcaaatggcacctcctctaagaggcccttcctcactgccctgtattagttgttttccatgttgctatgataaacctaactggcaaaaacaacatatggcagaaaaggttggctctgttagatgatatattccatcataacagagaaagtatagtaagagaagtgggaagtcaccaatcacattggatctgcagtatggcagcaaagggagatagatgatcaggttctcagctttcattcttttttcttttttctttttttgtaattttatttatttattttccttttttaaaattaggtattttctttatttacatttccagtgctatcccaaaaggttccccccccccgcgctccccccctactcccctacccacccactcctacttcttggccctggcgttcccctgtactgaggcatataaagtttgcacgaccaatggacctctctttcaactgatggccgaataggccatcttctgctacatatgcagctagaaacacaagctccagggggtactggttagttccacctacagggttgcagacccctttagctccttgggtactttctctagctcctccattacaaaactataatacatagtttctttttttttatttttttattaggtattttcctcatttacattttcaatgctatcccaaaggtcccccatacccacccccccaatcccctacccacccactccccctttttggccctggcattcccctgtactggggcatataaagtttgcaagtccaatgggcctctctttgcagtgatggccgactaggccatcttttgatacatatgcagtcattcttttttcaaattcagagcaggactccagcacttataatgatgtcagccacagttaaactaggtcttcttgtctcaattaacttaatctagataatcccttcaagtatacccagaggctaattttagaaggtaattcctcacggtcattatcagaggcttgtctcttaggtgattctaaatcttgtaatattgacaatattaactatctgcacctatacctatatttttcctcttaggatttataacttcctaaaagtatctcatttgtacttcttttttccataaaaattctactttataatttatattacaccacatattttcttggtctatcttaatccatcactattttctgaacaactctgaacactaaaataaagaggttccttgcacaaaatattcaattaacatatgaatataacttaaaattgctgtctagtcattgtcttaattctatatcattaattcagatgacaacacttgggtttaagacagtcaaaaggatttgattcacatgttaattaggctgtatggattgtttatgtctagtattcattttaggtgtctgtgtgtgtgtgtgtgtgtgtgtgtgtgtgtatgctcacgtgcacacatacacaaaggcctggaattaatccatatatacaaaaaatgtaatctttctatttctgtgtagtttgcataatatgataatttctagttccttctatttcatgcctacatctcccatatttcccagtgtgcttggcacatattttgaaaatatttcccaatcaaaagataatccctacatgtaaactactgccaaatcattctattgatatactgacatatatcacaaattaacgtacttttattgattgccttagcatgggcaaactatgattgtttctaataaaattccagagttctttagtggctacagtctttctgcacataaatgcactgtttgtattcctttcaaaactcaccatatggaaattcaatttggaatagaagaaggtcagtcaccttgtcttggtacccttgatctgtagcaagtaattaactttcattttatagtcacacaaatatatattctaaacagcttgctccctaggcaacatataatatacttaagaaattataaagcttcattgctgctacagaatgttcagctaatgtgtccttacctccctatcagccttgattggtttgaagcagtctatttcttctgacagtgaaagataaatcctcctcttacatattttaaaatgacagtctctccacacatatttttttctcattttctcatgccctcaggaaactgtttgaacttaaataaagtatataaaatagctctcttggtcttcaaaatgacactcattatgccttctgttataaatggtcaatctaatttcacaaaaataattgaaccaaggaaatgaaatgcatttcaatatgatttgtaatatcaatgatttaaaaattatttggggaacaataatataccaaactttctaacatagtgataaacatctaaataccttgaattgagacaataatagtaaccagacttcatgtcctttggccaagaaacctcaacaacggcaaataatatagctttatcaataggacatatattcctcaaaaccattatcctctagtgccaattgtctccattaattaaaagaaaaattatcaagcagctctggctttgacccaaagaaaagggaaaaaaacaatgaaatgctttaaagttttaaagataacttagaaataatatgttagaaatctctttagctccaattaaaagtaggtaaatgatttttatttattttttaattgggtatttatttcatttacatttaaaatgctatctcaaaagtcccccacatgctccctcacactcccctacccacccactcccaattcttggccctggcatttccctgtactgaggcatataaagtttgcacgaaaaatgggcctctctttccactgatggggccgactaggacatcttctgattcatatgcagctagagacacgagctcgggggtggggggtattggttagttcatattgttgatccacctataggattgcagatccctttagctccttgggtactttctctagctcctccattgggggccctgtgatccacccactagctgactgtgagcatccacttatgtgtttgctaggccccagcgtagtctaactagagacttttatcatatttatcatgttggctactggcttgctgtagattgcttttatcatgtttaggtatgggccttaaattcctgatctttccaagacttttatcatgaatgggtggtagattctgtcaaatgctttctccacatctaacgagatgatcatgtggtttttgtctttgagtttgtttatataaggtaaatgatttttaaatggactctttggctagtgttgcacttttagttacccactcacatgatatatatgagtaaaagaagtacaaattaaatttcccaatttctctaataatatgaaggaaaaacatgacatgtttatagacaggtgaagtgcgaacatacggtttctttgaaaagttggttagagcatcttttgggtatatgcccaagagtggattagccaagtcctcaggtagtactatgtccagttatctgaggaactgccagactgatttccagagtggttgtaccagcttgcaatcccaccaataatggaagagtgttctttctccacatcctcgccagcgtcttctgtcacctgagtttttgatacacatgtcccactatgttcatagcagcctaatttataacagccagaagcggaaagaacacagatgtccttcaacagaggagtggatacagaaaatgtggtacatttacacaatggagtacctctcagttattaaaaaaaaaaagaatttattaaattcttaggcaaatggatgaaactagaaaataacatcctgagtgaggtaacccaatcacaaaagaatacacatgatatgcactcactgataagtggatattagcccagaagcttggaatacccaagattcaactcacaaactacatgaaactcaagaagaaggaagtccaagtgtggatacttggatccttctcagaacagggaacaaaatgcccatggaaggagttacagagacaaaatgtagagcagaaaccgaaggaatgaccatccagagactgccccacctggggatccatcccatagactaccaccaaaaccagacactaggtctggcatgggctttagaaacctcagaacctacccccagtgaaaccagatgtccctcaacagaggaatggatacagaaaatgtggtacatttacacaatggagtatttctgagctattaaaaacaatgatttcatgaaatatacttaggcaaatggatggaactagaaaatatcatcctgagtgtggtaacccaatcacaaaaaatgacaaatggtatgtactcactgataagtggatattagcccagaatctcagaatacccaagataaaattcacagaccacatcaggttcaataagaaggaagaccaacaaagtgagttccaggacagccagggctacacaaagaaaccctgtctcggaaaaaacgaaaaaaaaaaaaaaaaagaagaagaccaaaatgtgggtgcttcagtccttcttagaagagggaataaaatactcatgggagcaaatatacagacagcgtggaacagagactgaaggaaaggccattcagagactgcaccacttggggatccatcccatatatagtcaccaaatgcagacactattgtggatgctaagaagtacatgctgacaggagcctgatataactgtcccctgagaggctctgcaagagcctgacaaatacagaggtggatactttcagccaaccgttgaattaatcatggggtccccaatggaggagttagagaaagcactgaaggagctgaaggggtttgcagctccataggaagaacaacaatttcaaccaaccagagcttccaggatctaaactaccaaccaaggagtacacatggagagacccatggctcgaacagtatatgtagcagaggatggccttgttgggcatcaatgggagaagaggcccttggtcctgtgaaggctcgataccccagtgtaggggaatgtgaggctggggagtcaggagtaggtaggtgggtggggaacaccctcatagaagcaggaggaggggcataggatagggggcttctgggggagaaatagggaaaggggacaacatttgaaatgtaaataaataaaatatccaagaaaaaagaatagaaaagaaaagttggttggttgttgttttgctggggcaaacgcatgaaagtggacacagctgtgaaggctcagacagacacgtgaaggaatgttttactgaagcagacacgggagagagtatgttctgctaaggcaagtatgttaaaggacgtgaagaatgactccttgctaacaacacacatgcattcgtccaccttatactgcgtagttgagctgtagagagagaaaaacaccaaaacccttctggtggtatactacagtttcttgccccttctgaggactcacactgattggatgcacgtgtgctgaggcaagaatcatgctgaagcaaggtacatggaggacacatgatgtttgtagggtatccataagactccatggaatgagacagagagaaggggggagggagggaggggagggaggggaaggagagagagagagagagagagagagagaaagagagagaaagagagagagagagagagagagagagagagagagagagcacttcgcttgctcatacagctagctgtgcaatgcttaggtgtctcttttccttgatcttcacttccctgagaaattcccagctaagaactggtgttcttcctggtccctcctactggaggcctggctgtctctgctaggtagtctgacactgttgatttgtgtttgctatcctgactctatggaactggtctgccaatgtatccgtgaagtggatcgagctaccactgctaacttgtgaactgaaccgctgatttccagtataacactgataagagttgctccaaaaaacctttctaaacaggctcacttcccctacatcccttcttttccactacttcttgtggatggtaggctacaaaggaagttaaaatgtttaagaaccatcattaaaataatgtttgaaaactttaaagttcaagacaggtttactttcttcatttttgctttttggtagagtttgagaaaacagaaaagaggccatatccaatttctgccctgggcactgttctaacattctctccagtggcctcataacttcaactgttgactctgtgcatacatgtttttacaatttgattttagatttgatattctttcctaacttcaaacctctgtactaagcattattatctggatgccacatcagtccctggaaccccatttctctagggatgaattatttcattcctctcatcctgcctcaaaccatcttttcaactagtcatcaataaaatacagatccagctacaatcacttgtaagcgaagtggagaatcccctaaatattttagtggatccacagttctttcagttgttgtggctataaatcacaaccatttgaaaataattttccattaattcaatggacaaatagacctcttagtacacctatattcatgagtgcatatttctaggagacacaatatcacaacaaactcccagatccattggcccttacaatctttttgttcactcttccacaatgtccctgagccttaagtacaactgttgttactaaatttacaagttcttattaagaaacctctattgacttcttgctataaataattgagactcttatggtaccacctcaattgagaaactctttctcatctacattatgaaaatccactccaatttgtgtccttgatacatattttgcatttcttactcatttgttttgaactgttattagatttatctttaataatatgttaaataatataccttgatattattcacttaccttaaaacacccagcaatgccatttgctatcaaatttaattccacaaagaaaatcgaccatataaacttcttagaaaaacagttacttttctgtttcttaataaattaaatgaaaatgtctaagtgtggcagccatagttttctaaaatatagcctaaaaactaccattctggcttcaccaccattatctatgatagctaaactcaatagagcccaaacaattttatttgcttcaagtccattctgtatattacaaagaaatactttgttcacccttcccctcatccttgcccatctctgtcatgcttcaaagcacaaaataaatataaatgtctatctctaataggaattcctctgtaaagtcatttttcatcaatctagccaaatttaacttattttaatccatttattttaaaatagaaaatgtagaaatcattaaaaagaaaattaaaatcatccataagctcccaaaccattaacatgttagttccaacacattctttctctaggtatgaatatatgaatatacagtcacaaacattcaaacaatacagattatataatttatgcttttgggaaacctggtaatttcatttgatgcttcatgaatatttcccagtttgacatcttcaatatgattttaataagtatataattttgccttactaatatataaccagataatcacacaccagttatgtacattttaactttggaatattattatcagatactgttgtggacaatagaaactaaatttttgaagcaaataacaagttaaaatttaaagttttgttatgtttgtttttggttttacttttattaataatgccacattaccttgtgtaatatgtgatcatattcctgcataatgattatacaaaatatttctttgtcttctgatagaaaattaaagctacattatgtcaattcttctacatagtttatatttacatatatatattattaaatatatatcttatatttataatactacgaaatcctaccctaacagagatctagattttaatacctgtagcaggtttttttttcatgagatactatttttattagatattttctttacttacatttcaaatgttaaccccttttctagtttcccctccaaaaatcccctatcccttccccccctgcccctgctccccaacccacccactcccattcctggccctggcattcccctatactagggcatagagccttcacagaaccaagggcctctcctcccattgatgaccaactaggccatcctctgctacaaatatagctagagccacaagttttaccatgtattttcttttattggtggtatagatccaaggagctctgagggtactggttagttcatattgatgttccttctatggagcttcagtccccttcagctccctgggtatttctctgactccttcattggggaccttgtgctctgtctaattgatgactgtgagcatccacttctgtatttgccaggcactggcagagcctcgcaggagacagctatatcaggctcctgtcagtaggctcttgttggcatctgcctagtgtcttggtttggtggttgtttatggagtggatccccaagtggggcagtttctggatggtcattccttcaggctctgctctgaactttgcctctgtaactccttccatgggtattttgttcctccttctaagaaggaacgaagtatccacactttggtcttccttcttcttgagtttcatgtgttttgtaaattgtatcttgggtagtctgagtttctgggataatatccacttatcagtgagtgcataccacttgtgttcttttgtgattgggttacctcactcagactgatatcctccagaaacatccatttgcctaagaattttatgaattcattgtttttaatagctgagtagtactccattgtgtaaatgtaccacattttctgtatccattcttctgttgagggacatctgggttctttccagcttctggctattataaataaggctgctatgaacatagtagagcatgtgtccttattacaagttggagcatattctgggtatatactcaggagaggtattgctggatcttacagtaatactatgtccaattttctgaggaactgcgaaactgatttccagagtgtttgtaccagcttgcaatcccaccagcaatgggggagaggttctctttctccacatcatcgccagcatctgctatcacctgaatttttaatcttagccattttgactgctgtcctgtaggagttgtaaagctcctatgtttactaagcatacagtaaatatttgtcaaattgaattagcagagtcataaggaagttctcccgtgttgatacttttctatccatgtggagagagctcttggtgccacttcaaagatattggcaagaatacttacattgggctaggacaagaaatttgttcaggccagaatttgacattaggctagtgccagacaaggctcaagatgaataaagctgaggaatgtgttccttgtatctggatcatcctgataaatccctaggtacaatgaccataggattttgtgtgttgccttgtttgttccttgactagtttgcttctgcgttatttgttccttgatctagaactggccctattctttgtatgtacctggaatctaataatctttcctttatttaatcagtccctctctccctgttgactaactaggtgcctttggtcatatccacattattctgtagaacttctgtgtgtaaaccagagttacatgaatagggaaaatggaaacaggcataagcacagccctaaggagatgagagcaatcccactgtaactggttaactaagcctccaatttctaaaattctgtaaatagagatacaaaactcatagtccattgacttaattaaaagacctctgactgtgacatcttcaggtgcaagaggagagctggtttagcagccttctaactgagtcagaatgagttaatatacgcttgttttcttgcagcagtacacttgtttggcctgacgtggcagttgcaaccagttggacagatctatgcgaatggaattagcaatgggaacccagggaccgagtccatggataccacttactctcccattggaggaagagtttctgacaaatcagagaaaaaaggtacagtgaccaaaatgattgatgaatatttgattaattttttcctaattaagttattagggccatatttgggttggctccacttcacattaaatttcattatcacttgaaagaactaccttatgtgaagagagtaagtccacttcttgtgtaagcaaattttctttgtctccagtgcttttgagtataaaccaattaaagttttcaaatatgttgccaattttgaaaataaaaaaatatttatagagtgaaactttcgatacaataaaaatttcatttcacataaagctaccctgaagcaatgtgggattttgattaagttcccttatgtcctagcccagcacttatttatagataacattttacaaagggtatataggaattccttctgtttataataagtaaaggcggtttcaggctcatgtaaaggtgaatgtttataacaaactgggaaaaacaagaattattttctagttgggaaacatgtattcttctttgttgaaagaaaattaatatgactcttcaattgtttaaattaaccaaaatgatcataaactagaagacttatttatttaaaaaatgccacaatgataacattcttaaattctaatttataataaatgattttagccttaataaccaaataaaaataactaaatccttatgttatgatttttcttgaaataagcttaaatgcaaagctatgcatatcatgtaaaaccttagtatgtctgtttttaaagtagaaattgagaacaaaactatcctgtttgggttctgattttggtttttgggttgttttgtttttcaaaacagggctccctccaaatagctctgtagaccaagatagccttgaatttataaatccaccttcctctgccttcttaatgctgggattaaagttgtgagctaccttttctggctctaccctctatttctgtaagattaaaatcaaacaaatacatgaatgaatgaagagaataatattcttaagaaacacctttatagaggtgataagttttgttttgctttattagttctaaatacagaatcagtttatttcccccttatttgaattagtagtttgtttcattgcttaggctgagtgtttcccggttttgggtgttttgttttgttttgttttgttttgttttgttttgttttgttttgtttttttctgcttttggaaagacaactttgttttgctccatgatttagtaaaagtgaatatttaaggttcaaaaaagatgagacttttgtttgaatttccaattcacagtgcactttgatttgcatctcatttcagaatacttaatgctagccaggactgactgaccttttccagaagtttcactgttactgctataggaggcggggctgaaggaaagggtcagaagtgaacaaggaaaggaccagactaagctcagacttttctttatctcttttatctacttttcctttcttctttcttcttttttctttcttatttgattccttcacatctgaagacataaaagcaaccatctggtattatctttctagggactttcttgtcattcatggcaaaaatcagaaatacctgcttaaagaaaatggaaaatgcaggacagcaaaagatgatcacatagttgttataagattatattcaactttgcatttgaattcaaatgtgtcataattttttcccagaaagtaggttgaaaatagtctgaaacattaaggaattctatgttccagacatttacctggattacatcatgaatgcaactttatgcttcccctattcaaggggaaaacagaggcagagagaggttaagtgatttactcaggctcaaaaagctagaaacgacttgattgatcccagactctagtctcttaactgttttttacagtatcgtattatgcagctttggcacagtaaaatgctataaaaagttttccccttgaaatgagctcaatgaaaattgtttcatatttctgctgaattataaaacaaacatggaaaactacttcagtttaataattttttttttaaaaactcattatatgtgactccttataggtcaaccacacattccagggctggccccacccctaaaggtagagggaaacatatactagactagataaacattaaaaagaacattcaaagttgtatttttaggaagatatgggtgtgtagaatgcatagaaggaggaggcagaaggcaagtgagtgtgatcaaaatgtattaaattgttaaagaattacaaaatattattttaagagaagtacaattatttattcacataatctaaaagcataagtgaagctatttaaggagcagaaacagcagcaaaagcaaggggtcgaaggtgtaatgaagaaagataaattagaataaagatacacacaaacatacaaacatatgcaaaaataacaaaatccattcctttgtatgttaacttaaaatttacttaaatataaggcaaaaaaactcatgagattttttttttagttgagaattttgtaaatgcattttgatcatattcaccccctcccaactcctaccagatccacccccttctctattcatccaactttctgtcctttttattgttaatggccataacatacaattagtactgccaaatattcctggatatgtggccttccactagagcatggtcaacttagccgaggctactctcttaaagaaatttaactctcagaaggtatcatttgccaataactgctcaactaggaatggaatttccttcccactttcccttccatattgggatttagtctggctggagcttttactggttttgtgtgctatctagactgctgttgagttcatgtgtgcagctgccctgttttgtccaaaagacccagtttccatgtaatcatctactgcttcttgctcttatactctttctgtccccacttctgcattcatctctgagtcttggaggatgaaatataatatagatgtttcatttagtgtggaacatcctgtaatttcttattctctgtacattgaccaattgtcgatctcagtgttaatcattatctactgatacgggttaagagataccttaatctattcataaaacaataaatttcgggagtcaggccatgtgatgccatgtataccaagttatgagtttcaattaagtttatagaaaccttaactataaatgcatatgatgattctgttatactgagattttactatatattgttatatttactaagtaaaaacatagctctttttaaaaatactatgtctatatgaaagagaaccacacagaagaaataatacattataaggatattttaaatgatcatatgattcctttaagaatgcagttctggagacttgtataaattttgtatgctctaacttatgaaactgacaactaggccatttttctttcattgttttctttaatctctaaaaagttcagttataacactgaagttaagaacccaggacttatagtccgacagacacagctctgtatcatgcacaggttcgccaaactcaagcaaccgaatcctaagttaagtacaaggaagacagtgaatagaacctcatatgtctttgtaaagactaaatggaatgatgaaaagaatgtgtgtatctcaccatccctagcacattgtttaacctagctataataatatttattgtttcaaaaactgggaaaacaccttgagtatcaacttttcttcttggaaaataaataatggtttagttcctgaacatttaggctccatgtatttccaattgttcacctattatttttaaattaatgccatagtaaaggtcatagataaataaagtagtttttaaatcactttccagtagaatgcattccccagttatgattttgtctgcttctcattaagagatgagtgtttttaccacttggtaaattaaatgtaagaaagcagatcatttattatcaatatttagtgtggtaagatttctacaaatatgctagaacttctagcatgtctcagcaacatactagaatttaccagattatctgccaaatatctaagttgtaattgttcagtatgcacactcacaattgaaagaattgtatttgaatagatactaactacaataataccttaccatttgtgatggcttgcatattcttggcccagggagtggcactaataaaaggtgtagccttgttggagtgggtttgtcactgtgggtgtgggctttaataccctcatcctagctacctggaagtaactcttctcatagtagccttcaggtgaagatgtagaactctcagctcttcctgcaccatgcctgcctgaatgctgtcatgctttcaccttaatgatactggactggatctctgaacctgtaagacagtcacaactaaatgttggttttataagagttgccttggtcatagtgtctgtttatagcagtatagccctaagacagaagttggtaccagagactggggtatttctgtgatagccctgagcatatttttgtttggaagattgtggatttagggactttggttttggaaagccataggatgctttaagtggagcttaatgagccatattatagaagactttgttgctatgagtgatttgaactgtgtatacctggcccaagaggtttcagtggagaagaacttcagtatgtggcccagagaatgcttctgtggtattttggtgaagaacatagctgctttttgcccttgcctgaagagtctgtctgaggctaaagtgaagagactcagattaattgcattgacaaaggaagtctcaaaatgcccatcatagactttgttctctgattaagtctcatgaagagcatgttaaacaagcatagcaagctcagaaagaaaaataaaataaaatatatagcttgagaatttaaggggctccagaaagtgaaatggagctgaatcctgtgttcaagaatattaaaatgaattaaaggactgttgactttagggcaagatcccacccagtaaagttaaggtccaggcttggcagaaaaagcctttaatcccaggaggcaaaggcaaatagatctctgagttgataggatagccttgaacagagcaggttctaggtgaagaaaagtttaagtctaggcatggtggtacacacctttaatccgagcattaacaggagacagagccatggagatctctgagttcaacgtcaatctacagaaaaatttcaggacagtcaagattaggcaatgaggaggttggagaacaaatagctggtgatgatataatagaacaagggaggccatgttccagcctcagcaaacagcagaacttggcagctttggccatgtagctctggctttcgagttaaaaatagaagggactagtgagacaattgatgctgattagttggagctaagaaattactggttattaagaaaagaccagcatcattgtggtaaaatcttctgggaagtgttttgagagaacaaagaagctgtgttccggaggtagccaaggttgtacctaatgttatagctaaacttagtaatatttaagaattacccaggaggtatgggttttgaaggtatgaaggggtcatggagagcagctgaggcatgacactgtgaaagtccaggaaaggccattggtgaaggttaagcctcagttgcaattgatggcccaggactgaaatgatcatgcaaagaagatgaggcttggcaccataaagagagcctatgagagggtattggttgcagcagaagaccccagtgtattggagatgccagtgccacaggatgatcaccaagaacagcagcagcagtggagcgaagtcaaccagggtatagagtgctacagagggcagcgctggagaagtgacacaagccgtttggaggataccagaagattgtaacaagaagctgtagtgttgaagttttcttggagatgccaagatgtttgagatgccagatctgtgggctatgtactgagaaaagctgctaacagggagtggaaccagcccaagagaaagaagtttgttgcagtcaacaatgatgaaaaaggaggtagagatctgaagatcactttgacatcagacaggagattcagagtttggagagtttgttcagctgctttcctgtcttgctttggggattacagttaagtgattggatgaatctcagaagagaccttgaactttggacttttaatattgttgagactaccttagactatggggactttggaagttggactaaatgtattttgcattatgctatgcttagatatggcccccatagactcatttgtttcaacaggcctatgggggccagggagtagaaagtgatgatttgtatatgcttggtccagggagtggcactattaggagatatatccttgttggaataggtgtgtcactatgagtatgggctttaatacccttatcctagctgcccagaagggtcctcatagcagccttcatatgaagacatagaactctcatctctgcctgcatcacacttgcctggactctgtcatactcccacctaaatgatactggactgaatctctgaacctgtaagccagtcctaactaaatgttggttttatataacttgccttagtcatggtgtctgtacacagcagtaaaaccctaagacaccatttactagaaacattatgaaacaactagtataattggagcagagtagataagaaggaataaatgcttacagttagatctcagccatgtaatacgcataagtaaaactacaatacatagtttacgtactatatattaatgagcataatatatagtttttaaatcttaaagatgataagatccttatttaaatgtggggaaaatgagagtgtgaaaatctagatcacaaaagaaaaccgggcactggaacttggttccattttatgtttgtcttgtctatcattgtaacaacataatgcaaaataaacatctggattgctatagaccttctcagcatgaaaattctaaagacaaaacaacaacaacaacaacaaaaacacagcaccaacaatgactcagagtatattcaggctaaggccacaggaaagtttttggccttcaacttgtttaggaaatggagaaagtaacatgtgggatgatttacaggtaggaattgttttgcaaccaagggaaggctcagttagataaccatatagggaaggtttgtgtttatgactagcttctttcaaattaaaaaaaaagctattttaatgtcagctatcttttcatgaacaatgaagaggcatcccatttcaacagtcacacaaaaagggaaaggcttggtctccagtgccaaggtactcataggcaagtctttaatttttaattaataaaatgtaactatatcatttgcctcctttctactcactcctacaatggccatgcccacgaacccaatcccctcctaaatttagtgccttcccttatttaaccatatacatatgaatgaataaacataagaatgtaaaaacatgttaagtccattctgtggtacctgcatgtatttttgtagggttgtccacttggtattagataaccaatcacatggctcatccttcatctttagttgcttgtagctttttatctaatggtgggtcccttgagatctcccccatctaagtaggactgttcaatggtgtcgatattgttgaggtttgtttaaatgctcattttgttgagaaatcataggtataactttcctgttgttgctagaatgctctcagagcagacttgctgatttgctggctattacaatctttctaccccctcatctgtagtgttccctgagccttaggtgtatcaattggtgccaggcacccaaaagtcaattgttctctgtatgttgaccatatgtggatttctgtaaaggtctttaatctgctgcacagagaagcttcattgatgtaaagtaagaggtacaattacatatgggcataagggtaattatggagaatagttaagaataaggccatgcatcttagatgaaaacaagcttactgtcattgtcataggcaaatcttattaggaggaatggacaggatacttttaccaaacatgctgtttagagaagggtgtattttatgttttcagtgcatcgtatgagtgtgtgtgagtgtgtgtgtgtgtgtgtgtgtgtgtgtgtgtgtagtaaacagtttcccagaacactaaaaggttgggaatattgcttaactattatttctctagcatcaggatcaagtaaaatcctaacatttttagtagctatctgactgaggataaaatttattgagaagttcaacaatgaattcttccaagttgaatgtcaaaatagaacaccggaacaaagaaaagtggtaggaaaaaagaactgaaatataccaaaggcagcttcagggtttttacagttttgcaaaatactggccttggtggggcgagtggcacttctttgaaattcattccagaagatctatctttgcaacactgaaggggaaaaactgatgttttctagtcagtttctgctgaatatatgaccatgtaaacaacactccattgattgatatgacacaatttatatcttgtcctgaacattctgtagccaagtccagatagcaactgtagcttcacttctcttggatctagtttcttatttgaaaaatggggagtttgctttcagccccttaagagagtccaggaggaaaatccttatgcaaaataaatattggtcagaaattacttgtgcaaatacaaccacagaggccacagttctgtagatcaaataagagagggaagtacatccctgtcaaacccctctttcctttaactttaacagctattaaagctttgacaaacatatcgtcataccaggaccagctcatctctaaatttgcccccaactctatttgttatgagaccatgaatccaaatctgtagttaaggaataataattagcccaatcaagtaacaacagtcttatttttgcagaaggtatatattgttgaaactggttgaaaagtatgtttgtaaggtctaccacttaggtacttgctgagaattctgttaaattcaagtaattgattcctagtttttgcctactaattttagaatttttgacatgtgtgtaacaatagcaggctgcacttagagagcatttatgatcttaaaatatcttaatgtattttatctacatgtgagttttatgtagtggcagctattgttacctctgtcttacagttaaaaatgaaaacaagtaaaggttaagtaacctgctttgcataattgtcagaaccatggacagaactgagttaggggcccagttttcttcttattcttatctcaatgtactttgagcctcttttttcttttaggtttaaggaaattactttcttcaggccagttgtttaactaatagctatttctgcatacacaacacaaatatggaccccttgcatgggaatactttgaaaatttaagatttcagcccaaatatctccaattggtgagcacatttattaaaacacacacacacacacacacacaccattgtgaaatgtaaaattaagaacagtacaaaatgtaccattggaactgcctttcattgtggactgtagaaaagagtggcaaagggaaaatacagaaggggagagagtagactatttttctttgctttgtctttcctgagtaaagaaatttatgtagcgataagtgtgaacttctaatggcaggttaccttctacatttatttagtgttttgcagatgttgattttacagacacaatctgtgtctgttaaaagtcatcagagaggcttccagcagcagatgggagtgagtacacagccagacatcatatggatagagtgtctaaattggagttctctatcagcaccctctcctcagagctcaggaaaccccacagaagtggggaggaaatactgtaggagacagaggagatggaggacactaagagactatggccctctgaatcaactaagcagaggtcatatgggctatcagagacttaaactgcaagcacagagcttttaatcatccgaatcagattctctgtacatatgatatgttagcttggtccttctgtgagattctaacagtgggagctggtgtatctctgactcctttgcctgttctcaaggctcttgtcctcctattaggtttccttgtccaacctcattaggaagatacttttccctgtcttgattgtatcttgtttggtgttgtttggctgttctctcttttctgaacagaaaactaaggaggagtcattatggagaagagtgtaggtgaggagaagctgggaggagggaggggaaactgtgtttgagatgcatagtatgggagaagaaactattttcatagatagatagatagatagatagatagacagacagacagacagacagacagacagatagtcttgaggaaaaaagcgctctgtggcaccaaatgaaaagactgtatcacttgcacacaggtaatcactgttcattcagatggaacacagtcccatagtattcaggttcttctgtattggttcataggacatatggatattaaaatgcactcaactgctctttgagtaaaaccaatgttgcagtgtcttttatttaaaggatatcagagtataggacactggtaaaattgggaataattcatatacacacagtaaaccacatgaataaaatagtagtaatgcactaacaaagacaacattgttgagagcttaacattattatttttaaagattgatgtcaaattacagtaaatgctacctataatgatatatagatgtttccataacacaaggtttcagagggcccagctagagtgctgcagcttgttttcaactatattaaatcactttatcaatatatttcagttttaacaaaagctattctaaagcatagtggagacctgacttctaaagcagatttataaaatgggttttctatgctaaaaggcaaacttattgtataaaaaattcatgctaaatgttcttggtcatatatgtttaatgcgtgattctcatttcagcttaagtattatgttattttcaaccaatatgtaccttccctgtgatgacataataaaataagtctgtcttatgggccctgaccttaatattctacctcaacaaagctactagtatagaatagcataaataccatctaaggctcatgcttccagacctggggagtcttcctataccatctgtgtaattttataggcttttagaaaaaaatcagctcactgtagaatttatcatccatgtgtatatctgactctagtgattatccacttgtatttcaacttatgctatttctatagaaatatcaactgtttgtcagcattttcacgaagtcattttattcaagttaactgaaattttcctttcaaagtgaagtcttgcaatttcattgttaaacacaaggttaaccacacaatattgaataactaagttgagagcttttccctaagaaagactattcgcactctcaccattccttacttgcctgtagttctttacaaggattgaggccctatgagatttcctctttccatgttgtcctgcatattgatatcatccttgtttgagtcctttttatgcagccatgcagatgagactttatgggtgtaacatctctaatatttctaggaggtaaatactcactgcactcttcccactcccctggctctcctaacaattccattccctcttctgctatgatctctgatgccaatggtcacccctgaaataatacataatatggatggaataggttatatgtatatacttaggaatctctctctctctctctctctctctctctctctctctctctctccctctccctctccctctccctctctctctctctctctctctctctctctccctctccctctccctctccctctccctctctctctccctctctcgctctgtgtgtgtgtgtgtatgtgtgtgtatctgtgtctgtgtgtttgtgtgtctgtgtgtgtgttgtatctggaacacagtcctaaaaatagagatcttgatctgagtgagaacaaggcacataggggtctggagagataaaaaggaaatgatgtaactatattttaacttcaaaatgaaaaatatttttaaaatcagaaatacatacttctactgtgcatcttaataactgtataagaaattacatatatatatatatatatatatatattcgctttgcctctatatttctaatactaggcatttgtatttgcttctttatcgtctaccacctatcttcccttcgtcctttgactggccttttcctgtcttcattatatatcctactgaagttgtcttgttcagagtcacacacaggtaccatctttcttacttagacttggagaaggaagaataaatgaaaatgttgggttgacagagaaattacacctgaccacatcagtcctcttttaaagagattggaaggaagctaaaatgaaaagcttcgtattcaaaatcacaggaaccttttattttaaatgttatgtcaattaagtttatatttaacagtgctaagtactgtagagcgttaacaaatgaagcagaaaacacagttgctacccttaaggagtgtcattaaataggagagctgaaagaagcatgcatacaggtacctgctatgcaaaatagcataaacctaactgttatatagaaatagaagtaagatgattaagtatttaaaggcttaaaatgaaaaacaaaagtatgaaagggtaactctttcgcagtggtcttagctagaccttggaaaacaaggtggataattcaatcctgataacagtacatatgtaggagaatggaatagaagtagagtcagagggaaaaatgcaggtgctaaaagtctacatggtatgtatgaaatgaagcaatacttgtactagatggagacagtttggcaagaaaatgaaaaaaaaatagtataagtaggaaaaggtccatgtaaggcattgttttcacttggagaaagatttctgctttgaagacaaagaataagtagccaatagagagggacccagatgtagctgtctcttgtgagactaggccagggcctagcaaacacagaagtggatgctcacagtcagctattggatggatcacagggcccccaatggaggagctagagaaagtatccaaggagctaaagagacctgcaaccctgcaggtgcaacaacattatgaactaaccagtacctcggagctcttgactttagctgcatatgtatcagaagatggcctagtcggccatcactggaaagagaggcccattggacatgcaaactttatatgccccagtacagaggaacgccagggccaaaaaatgggaaagggtaggtagggggatggggggggggagggcatgggagacttttgggctagcattgggaacgtaattgaggaaaatacgtaataaaaaaatacaagagaaaaaaaaaagaaaagagactgtgaagggactaaggtcctagaggcagcacatgtgcacagagaagcctctgggatacactagtgtatcagactgtgtgctgtactagtaagaaagacacatgaggtatatttttaaaaataacaaatgggtactcaataaagaaggcactataaatgttcaataatgctatcacttatttttattattcctacaattgctattctctgaaatgagttttgtctgtgaaaaatgttaatttcatattattgaatttcttctgtgttcctaaattgtacatatcaaaggttagagcaacatgacaaccagtgaaaatcaatactgtaaaagctgcctctttgtctggaggccaggtattacaagttataaaatttcctcattgctctcaactacgtgataaatagataatcatctaattgttaataaatgtccagttagatgacactaagaatttgggcagttgttaagtgttctgtatcctttaccttccacaaacaaactagagtgaactcctaccacatcaaagtcaagaataatatgatttttgacacgttagctgtatgtacacaacatatctgatattacatctgaaatgtagaaagcaatcgtccctctgggtactctcttccattcatactttgtaagagtactgaaaagagagtaattcagccttctcggtatcacctacagaccacccagaaatacatgaaaattcttgagacattgtatcatagtgtgtgtgtgtgtgtgtgtgtgtgtgtgtgtgtgtgtccccgcgcacgcgcgcgcgagcacacgtgcaaatgtgccctatcaactataccttttaactatagttctgtaacaattatgttgacatataatttatacaaccatacaatttactcccttgaaattcacaatccagggaatgctattatgttcatagttgtttgccatcactattatttagtacattattatcattctaaagaattacaagtattatacagaactcatataacaattatcgtcacaaatttctacgtttttatataaatagaattatgtgatatataaacatttgagtacaaacattctcactgaaatgttctcatagttcttgtaattaatacaggtcacacttagtctttttatggatgaataaactccaccaattgaatatacaagattctgttcacacattcattatttgaaggacctttacatacattttaatttttggactactatgaataattctgctataaatattaatgcacatatttttaaatgtttttattgtttgagtattttgtagacaaatataatgtgtcttgaacaggggcacttcccattccttcttctccaatactatcctaacccatccacagcttttacatcctcatttcatgttctcttttgttaagtccaataaatctacttgttgctgcttatatgtgcactgctgtaggaacaatctattggagcataggcaggctctcaggggtcacatctctgaagaaaactgaatctttctctcctagaagccttacatttctaataatagctccttagcaagagatggtacttcagcaacacctccaaaatccatgctaggattttgtctgtcttgatagtatagaagtcttgtgcatatagtcacagcggcagtgatttgatgtgtgcaaaaaaccctgtcatatcaagacaatacagtcttgtgcaaactttttactaactatgggccctaaaatagttcctccaccaccccttcatcaatatctctaaaccttgatggaaaagtgtgatatacatattctataaagtgcaatattcctgactctagtattctctaaaggttggcctgttgtgaggttttttattaatttccatctattacaaaaaggagcttatttgataaagattgagaaatgttataatctaaagcataaagataagaactggggggatcatttattacaaaaatagagtaattggattgcctcctaagatctaggacctagccagctgtgggtttgccaactaattaagtatataaagcaagattttcatcttttgtagtggggggtttaagtcaagtgagaaagtggttgcttactcccataatactcatgccactgttctacaagtgaggcaatatggccaggccagttattatttaagcattattgcaggattcaaatatgaataagatggtttattacttttctcctccaataacttgtagagaacattccgacactataaaaccaacacaaaatttatttacaaaaaaattaggaaaccattttaaaagaattatgtttcattttacacattatcaatgagcaaatatataatcaaagtaccattccaactaagttgttcaattaaaagacaaagttttagcaatctcattttatcatatgccatatacataaagaaaaactatgtactttatgatataagctattctgatatgttataaagaatttccattcatagacctaatcttttatacatgcagtgatatgtttgtcaagtgcaaacttaattaatggattttaaacacagcaatctattatcaacatcataaagacaaaggagctttatttacaaacatataatattctctttgatttctcaaatgtctaaggatttagacatattcaagtactccttttgtcaaaccttggaatgaaaggataaattatgcttttattaacaactaatttttcatctactatttacaatgcctatgtgtggggttcatttctctacttctttcttctacctgttttggaaatatataattcatgcagaaatatgtttaatagacaatctggacaacctcttttgatgaaataagagttaggtgtggagtgggactcgatgttagagtgcttaccttgtaggtataagtaaagacttttgcttatttcatttaatacccttatagttttaaattgtgagaaataaagatatactttacatctctatttttctctaagaactaatattctaaattttacaaagatttattaatgtgaaaatattatattcaaaataccatcaatatggtacttaaaccatctcacatacaatatgaacaattattctttcaaaatgttgaatattcagtaggatgaaatgaagagtaaatacattctttgtacattcttgaatgcctttatgaaatgttcatgtttctgttaatataaatgcaataaaaacagtagcattaacctagccagttttttatgaacatcctttttagtaaacacatgtccaatcttgtaccaacatccaattgagttttgattttcatatattgaacccaatagaattatatctatcatagtatattatgtaagaaaaatatatgcatatgttcagaatacagttattaccttgcatttataaaacggttttcttaataaccgcattgttggtgttcaattgtatgtctagatatttaaaaccttggtttaagagacacaatcactgcaaaccatgtccatcataattttcatgccctattttcttgcccttaaggcagcttgaccatttcttgttcaacagctactttcacttaatgtgccatccttcaatatcacttatctggcctttgggttttccagctcagcagttgatacctgtgttgcaacctataaagagagtgtttagctcaaactaaattggtggatattggtaagactgtgataactacagtacttcacagtatgatataattcatggctctatacatttcattccccatgtgtacaaggaaaagcattctgttactagagagcatgctcttcttgagccttttgatgtgcttcaggaaaaaaaaaaaaacatgatcaaatgatcattgaaacatgaacaatacaagagcatagcttatcagtctcttgctggaaatttgtataaaatcagaatgttatacttgttcaatactatttcatttgcttttattaatcaagtatgtttttcacaaaaaaacacattttgagtaattttcacatatattttttctggagttttccactcttttgagttacaccattaaaaatgaaatcataaatgacatcataatcactggactgcaatatataaccaattttgagagctaataaaatggagaaggtaatttaacaatgtatgttgccagcaggaagctacttctctttctgatacacgaggctctaagagggtagagcctggtatatttcccatctgtaaattatgagaatttctcttctctaataccactagattaatttattttatttaaattatggtctacttgtttgttcatgtacttttatctctactcaccttatcgtaattttaccctcttaaatgatgagaccatcttcttgtaaagttacttccataaattattgatgcatatggactctagatgtacagtggtgataacaaccagaaactccaacagtagaacttcatgagcttcttttgatttaataaaaatcattaaagaagcactattatgtaatgtatgatgctatacagtgcagaaagagaagttgtaatattagataaggtttccatataaagattgatgtccctcaaccagttttgtgcagagatttaaaaatgaatttatttattaaagactattcatggcaccccaaaattgtactgctcgatcctagaacattttgaattgttttatatttataatattgtttgcacgaccaaatggtgcattttaagaagtgataaaagcttctaatgaggatagttattggacaaactgaatattaagttgagagcaaaaatgcccacataaatatggtctattaatctcctgcccatggaaggtatttattgcttctaaacccttaagagttaaatttataatccaccctttgggaaccaaattgttccatcttacgtagaagaaaagtaactttcagtgaaaaataaaggactctgttggtcatttattatctcaaagggtgtgttttattagaaatgtcaattccacaaaattatgtgtcctgtaatacataattatgttcaaaattgcatttgaaatctattattaacagttaacagtgaacattcttaaaatagttattactcttggccttaacacaaaaagcaataatgtaggtattttagggagttaaaagctgcaaggccttggcctctgaataaagtcactgcaggtgtgtttcttaatgggctgttaattttatgtcaggtgaacacaaaggacaaggaccgtgcgttttaaaactgtttggtatggagacacagttgatggctggaaagataaagatgggacgaaatgaggccaaatttaggcctccgggagaataaataatccctgcttaaaatggaagcaaaccaattctctttcctctttttatattccttctctccccgctatcacatgacgtagtattccatagaaatatacattaagctagcacatcaaataaagttactcttcttcaaactaaacatctgcccctcacagacgaggtccttctgggtttcatgtatttggctattagtgctatccaaatgattcaaactcataatcatggtgtcagtttaatgtttcctttgccttcacaactattaccttcactgctcaggtattgacgagtgaacaatgcaacatcagcaccacttggagtcacttcaaacatgcattcaatgcttgtgtttgaaaactccttttctcagttacattaaaatttgacaagctccgctttggcatcttctatattgttctcatatcttcctcccactttccacctatactaaattacttttcactgaaatgtaccttttctacagaagttatttgtgctttaatatttgtgaaagagttaaattgccattaccctacagagatattagtgatcgtttcaaaagaggcatgttgccaaataaaagttccagtatactatatgggatattgcccttctagttgttggtcagagataacatggagaaccccccccccccaagcaattcaggctactgctgtcaatttttgttacccagcagaacatgatgttaagatcttattgctaaattcaccataagctttgcacataagatgtggagaaatcaaacaggtaactaacctggaagtttcctcattgtttccaatgtatcaaaagatgatttacatctaataggagagaaaaatcatctgtcttactcagtcatcaacctgtgatccagaatagcgacaagcctagcaatatacgccaatgggaacaatagtggcaggaatgcaattatggggaggggggataatcaactactttctgattttacttaaggccaactcccaaacaggtaaaggatgcctggcactataaatctgctcaaaagccaagagctgatgagctcataggcacatcggtgaacctacttgtattattttactagatggacatagtatcacaaaattccatcgaaattgtaccctaacacttatagaatagtgcaaatgtaacttccaggcttcatccgagactcatttttgcacggtaggcagtggtgaacacagaatttcacaattggttaaagcacaaacagcaagtacctatggtatacttatccatgaatagaccacctgtgtcatatttctctcctaaaaggctcaggatagatcatggagatagtgcagaaagactgtaagaatcagagttaggagattccagaaatgaaacagtgttctatagacatgcagaacttaggtattcatgaactcacagcagccgtggttgcctgcacaagatctgcacaaagtcaacccagtctttccagtgtggagagaaagagactcaaaaaccttcacctctagttaaggagtcagtaacaggtgatggcttctggagcagggcaaatcagttttctttaatggtatgatccctggtaggataagcatactctgttgtatgaaaacttgtatgttttcagggccaaccatttggtattggaaaaccagttagtatgatcattcctgcagagaactattattcttactctcaatactccttaggactattattcttactctcaatattccttagctacctatagttttttgttgtgagttgagatctcatgagctttctcccatctacattgtcatgtctattgttggacaaccttttccatctcatattaggtagtcatattggtgagactttatgggcataaactctattattacttagagacacaatctcacaggaaaccccctaaccttctacctcttagaatcattcttcacccttttctacagtactctctgttatattttctatggtacttgtaaagagcatctctagctaagttgaaatatttgatttaaatcatatatgcatatttatataaagaattatttatatgatgggtttcctttagataaatagttaatattattcttgtggttttttcaaatattcttactgttctatgttaactttactaatcaaatcctcttgactagttctaaaagcagtatgtatgaacaatgagtcattatttccaactctatttagaactcttccttatatatgcatagcccacagccttaagataaaaaaaaaagttttagcattgtgtgttagtgcaagctgctcctaagtcttgtgtagagtgccatgtcccataattaccatttttgactcattcatctacacatttattaagtaattatatattgatcatttgtgtgtatgtgtttgtaaaatctttacatacattcacatacatttattagatactgaagttaaaggaatggacagtgcagctctactccttgtcctcaaaatgcgtactttatatcctggaaaaataggcaatatgtgacacatacataaaatatgtaatgtgatggatagtaattactacaagaaaataaaaggcaatgtggttattttcatatttgttgcatttattcagagattttcaaaactcactgagaccaacaactacatcttactcatctctctaattcctccatctatcaagagaatgagtgttcagtaaatacttcaaagtagtcgtgctaaacaaaataaatgcagtaggagtttaagagagaatttggcataatggttgatcagaaaaagcctcttagaagatatttaatatgagtgatacattgaaagatacagggagggaaaaaaagctgtgtaagttgtttcaatatatttgttcttgaaaagctaaagagcattgcttttaaaattaagattaattgtatgtataattctctctttttaaaacagtgttccagaagggacgagcaattgacactggggaagttgacattggagcccaggtcatgcagaccattccacctggcttattctggcgtttccagattactatccaccatcctatatatctgaaattcaatatttctttagccaaggactctcttctgggaatttatggcagaagaaacattccacctacacacactcaggtatttgatataataggtattttcttaaatccttttagagggtagtatatcaagcacttcgcacgtcagatgttgtgatttgtgaatactgtaggattcaaagatgaaggcaaaaaaaatctttgtaacaaaaatatataaactaatcacactttaatgaaaacacagcaactagaaataaagaatagcctttaggaaaacacattcagaacagatagtctaaggagacagtctttaaactccatctctgcttcctacaaaaggatcatgatgagtttctctgctctctcattttagcactagagtcgccctgttttgcatatccttttactattattccagtaacagtgtagaaatcaacaagaacatattggcaatatacacacacatatatatatacatatatatgtacatatatatgtatttgtgtgtatatatatatatatatatatatatatatatatatatatatacatatatatagaaagagagagtgagagagagagcaggttttatcttacatacagaattttttctataagcaatcattcacaggatttcaaatatataaaatttctgcagtttctaaagcctatttataatcagatgccatatttctcgtgtttttcttaaccttattttttccacattaatccattagtagcactgctctatccaagattaaatttgaaagaattaaacgctcagtctatccttcccccaacaaggatggctagagtcaataatcaaaatgtcattcaaatgtgaatcagaaaacataggaacatgtaaaacaatatgtttaccaaatgattagaagggggaggctagcctttgaatatattaatacatactcacaaagataatgagttgtgataaatattctcgtttgtaagtttcatttatttggggatttttgaagtgtaaaaagcttttaaatttgttaaaaaggtcacatttctgagcagaatacgctctcaagtatcttctcttagacagatattttcataaaatgtcaggatcttatacataatcctcaaatttgtttctatttcttgagatttttgcttttttaaatatttttattagatattttcctcatttacatttccaatgctatcccaaaagtcccccataccctcctccccactcccctacccacccactcccaccttttggccctggcattcctctgtactggggtatataaactttgcatgtccaacaatttttactttgaactgagttcacaacatttgtaaatgtagtgaaacaattttcaaaactaaaaattcatttgacttcaaatatacttaagaattggtaactttcttttacattttgccaactctatgagcaaagaaatacatactgaatatgtcagtgataattaaaaatggttatatatccagaagttcaaagtggttcaagttcatatttgtgtttgtatttgttccagtttgatttcgtgaaattaatggatggcaaacaactggtaaaacaggactctaagagctcagatgacattcagcactccccaaggaatctgatcttaacatcacttcaggagacaggtttcatagagtatatggaccaaggaccttggtatctggcattttataatgatggaaaaaagatggagcaagtatttgtgctaactacagcaattggtaagctgccatgcctgttatttgaatttacagtatagctctagaaagtcactagtggttaaaagtacttggttacttacatactgttccttctactttaacgtcattattcaataaatgtcactatgagtaacattttatttttgttctcattgttgttaaaacattggttaagaattttctaaagctccccagtatttgctaatattctaagactcttgtcattaatccctttataagttcttaacagaaaaaaaatattccatggttaatattgtttaaggagctagatagatgaacaacttcagagagaaatcttataagcaaaattatttctgttaagccgagcccaaaagcttgctcctataataccagtgacataaaatatagatttgtgagttcaagaccaacatgagcataaaaggatcttcaaagccaatcttggcaaaccagtgagtacctatcttaaaatataaaatatattagagagtatagcctggtgacagaacaattacctaacatgtatgattcctaaggttcgatccctggtgagagaatgggagataggaaataaagaccttgttaatcagtttgattataaaataagagcaaataattacctcttaaaatagaaagactggcatcaagacaattctttagaacaattgattctcaaacctctaaggcttcaaaatacaaattgagaatacttagagaagaacagtggaaacaataagggaagtcatctcaagcctcctttttgggtttctttaggtctgataatcaaatagctccttcattgtgcccatggccttttaaatggagctctttcgaaatacaatgcctagcattcaccatcaccctccttagtctgaaatgtctcagtcttttgtcatgttttctcagtaaacacactcccctgaccctttgtgtgaataaagctaagctctttagcaatttgggagtccttgggggtaaacaacttgtaggcacagccttgtagcgtttgaatt

SEQ ID NO: 630 - DNA, 604646 bp, mus musculus; identical to SEQ ID NO: 629

SEQ ID NO: 631 - DNA, 29939 bp, mus musculus
gggaggaacatggcgcaagctctgtctgaagaggagtttcaacggatgcaggtgccgctggatgtggggaagaccacccgtctagtagactgggggcggggtagagacaagaccagccatcggttctgaagatttggttggaatgggtcttaagtataagggggtggtctggagaagggaaaccgaggctctgagtggcgatcttagtgatttcgaagattctatgtgggttctgaaggttggattcttttagcttttcaaaaggaatgtagaacgtctttaggcgatacctttctcagtccggaatcgggatgggatctttgggtccatgtgtagggcataccattaaatggtgatgatgttagactttaaaggatggagattctgaggagaaattatttggtcgggagagaaaagaagcaggcatttgcgtcatggggaggggggaagcctctggttatttgacaggacaagaccatgaactactgggaggtggaaagtttgtgggagataccaatactactaagccaggggagtagggaaagaccgtggatctcttccctagagttgttgtgccattgatgctagaagatcctaagaggaggggttggcataattgcatggattgggatgattcctttagacccagggtgatgagcattctgagtaggtaataccattaactcagattagaggaagggccggaggatatttataaactgatactttgggagttcagggaaggggacatcactgggtttgggggagtagtctgacctggtcctctgacttgttgatccttttccaggcatctcgagagggaatagaagcactgcataatgaatggacacttagtgagggagccttagtgggaaagactgaaatggggaaaccttagagtcctataggttgggggcagaacacttgagggagcagaaatattcgattggcctgggagctagttagtctgcttgagggacactgaagatgtaagagtgagctcattggaccataaatggggaggaccactggaaattgcagaagattctgaataaaactagttcaactggcccgcccaagggcatttgagagatcctgaaggacagacataatgtcacccccattgaagacatcttgtaaaaagtggatagatagatacttgagcaaggaacgtttatcctatttgagccatgtgtaaggagatactattgggctttggagagggacttcaaggtgaatagaaaggtattccagttggccaaagattaggagaaatgctattggggtcctgaagagaacagaataagaaagatcctatagtagctaagccttctgatctgatctggagcaaaccagtgtgctgagaaaggtggagctggtactttgagagggacataaaaccaggggtagtggacagtgggtggttctgggaagaatcagatttagggctctccaaggctggtggatatacatgtattgtgtgaagtggcctgtgctgcacttcctcttaattctatacttaaggggacactgacttgttttgaaaaccttggcagttccacaggaccttgagcaacatcccctgactcatggaagttgggaaggaaaaagaccagattctctttccttgggaaggaattttaaagccccccgcccctcgccaaaggggcctcccgggtctaggtaggacagtgttcagggtgtaaggaggtcagccaggatgatttcatctgcgtgtatagtcacaagaactcatatgaacagcagcctaactattccaatacccttcagtggtccaggtggggaatggatcagtggggaaatgatgggttgaggctggctgtggttctaaatggggctggacaaggtggagctggggctcagggcttggttgcccatttaagaatacagtatccaaagatcttaaggagcaactgaggaagtgcttaggggataccagttcagtctttagggcttaggggcttggttgcctcatgtgggggtaggaatgctttcctgataaatatttttgtttcttggctccttccaaagactcagctcctggagctccggacaaataactaccagctttcggatgaacttcggaagaatggtgttggtgagccaagcgagtgtcaatagatggggtggttttggggggaattgaggcaaaggttttcctttagaagcctgataagatgacccttcagttccttgttaccgcctgaggctgagattccctgctttccccgcaccagaactttccagtcttcgacagaaggtcgcctacctggataaggagttcagtaaagctcaaaaggtacctccctccgcctaccccatccacccaccacttgcttcgcccctatccatctgactcattcccagtgaacacccacactgaagcagacctaatgtcacatgctgctttcttatagtcattcgaagtttgtttttttcacagaagtctcttcagttggctaattttaacctaatcttgcctaatttcggtgtatgtttcttttgagacaggatcttgctatgtagcccagactggccttgaactcttgattgtcctgcctcagcttcccaagtgctgggattatagatgtgtgctgacatgcctggctttgcctaatttgttgatttattttaatttattctaatatcaattgcttatttgtttttatttatttatttatttatttattcatttatttttgcggtgctacagatcaagcctaggatctcatgcatgttaggcaagctctccatatttgatcttagccaaaaggctaaaaagggatctttttgttgtttacaagacagagtctcttgaagcttaggctggccttgtgcttatatgtagctgaagatggccttgaattcctgatcctctattcctcacccttctgtctccaattcccaagttctgggattacaggagtaagacaccacacctagctctaagctgcctctactcccgtgctccatctgcagccctcattcattaactttgtcttgaaaaggacatctagctgtgtttctcaggctggtccccaattcctggcctcagcttggcttccttcctcaacctcttgagtacctgaatctataggcatgtataccgcacgtggcttcattcattaactttgaattagtcaggtctatcagtaaatctgccttgagtctgcctcctgtcttccatgtacactgcttctttttgctcctaccccatccacttgtcctggtcctgctggtgacatgagaccaaacctaccttttggatcctttcaagataaggtagaatagagcctagcatggcttctaaagagaagctagatccttatttatatccttcttcattgctctgtgttcatatgtagtacgatgttgcatagagtatgtgctgaataaatacttgttggatgaggaggggctggagctcattggttaagagcactggctgctctttcagagttccatcctcagcatccacgcagcagctcacaaataggctgtaactctagttccaggggatatgatgccctcttctggtctccaagagtacttcatgcacccatacacacaaaaataaccatttaaaaaaaaagatggaaggtgaactgactccatgaaattgtcctcttatctccatgtgtaagtggtgacatgtgtactcctgtgcacagacacgcacattaatagtgaataaatagatttttaaaatactcatttgggtgaatgaatgcagaattcaggaaaatccagcagttagaaaatgggagtttttgatagggcgttgatttctttgcaaagcctgacacgatccttggctgccaagcaaaagggtagaagtcgctatgttgcatgcgagggaagcgcattgatgtgcttgaacagatggagtgatgaagccacaatttcctagcttggagatccagtatataaagggttacattccgagacacatttccgccctctcctcaagccctcaagagcataaaagaaagggagactttgagtgctgtggcgccaaggcagcaccatccccaactgtacttccctcatttcttctgttatttctgtgggcttccagttgttatgcaagttctgtgtttaaacatatttccatcccacaacccgccattgccctcacttaacacctgctgcagtagtctccatatcccacaggggggtccattgctgttcactttagctctcttccacccttccttttaggcactaagcaagagcaagaaagctcaggtaaggggtctttggtgggtgagtatgtgtacaagactgtcacagtggggatatttctgtttggtggcattgtactggcctttatatgtacacctgtgtatctgcaacttcctcactgctgtgtgtttctctgtctctctttgttccctgtgtttgtcttctactcttcgcatctttgcatcttttcctttatcctcgctgaatctgtgtctgccttcctgtttccctctctgctgcttctcttcaactttccttttgtctcttccccacctgtttctgtctctttccttgttttccccctctgtctgacttcttgtttctctttctcccgctcctctatctcccttctttctttgctttctactgtattcttcccctgttgatacctctctgttcctctcttcttgccttttctctttcctgatcaacctctcatcttgcgcttttctccccttccatatctctccatcattatttctcttttccctcattcccttgcctatatctcccttcttgttccttctccgtacttcctcatgtctcttttgcccccacttccctatgtttctattcctatatatcgccgcattctttctacctatatgcttcctacccaatgccattatttccttctctctccttctttacctacctccccatcttttccacccctgttggagtcctggcccgtgtctgccactgcaggaagtggaggtactgctgagtgaaaatgagatgctgcaggcaaagctgcacagccaggaggaggacttccgtttgcagaacagtacacttatggccgagttcagcaaggtgctggtgcccgggatagctgaggggggaaatgggaatggtgcatctgtgtatgcgtgggccggagctacctaggctgaaagctcagtggtggacaggggctggcgctgaacactgtccatggtgctgaaacaggccttagtctgttgctgggggcagtaaattgacaggtggggccaaacacgttcatggaattaaatcctctgagccctgagtttatttggttcctaagtcactccttttatttagttcaagtctccatttgtatagtttttggctggtgctatggagccccagtgtattctggagctttaagtaaagttttaattgcttaacatggatggaaaagtatttgaactgcttccattttctttttctttccttcatctgccatgaatctggggttccacttcttccaggtaattaatcctggattggctaactctatctccttactgattttaatatcttggctatttctaaaccttctgggcagttggaagtcctgtgggttttgttttttcctagtagtcttctatatgtatggttgatcagtttgtgagttttcagtgggttttaaggaaaaatatactgtaggaaaaaaaaatgttatttccaagacttcgcctgattggaatatactgcctttaaacgcagaacaagaacactgcgatcgagatgcatgtatacaataagaaatggtcaaaaataacaacagaagccatacaagggcttggaatacggcttaattgctggagtgcctgagtcgtacgaatgcaaccctggttttgatccctagcactgcacaagctcatacctattaccttagcacttgggctttagaggcagaagacttagaagtttaaggtcatcctcacctacatagtgagttccaggccactgggctacatgacaaatcaaagaacagaggcaaatatttaaaaagaagctcaaaacaaaatacaacagaaaacaatctttaagcatttacaatgccaggagagaccatttaatggtcagtaattctaagcagggactctggagccagaaggcccagatgaggatcttggctgtagagtttaccaactcaaactttaaacgtgtcactgagcctcctctttcttgattctcaaatgtctaaaatggaaatggtaatgctagaagcacctgccttcccgggcttttgtgaggattcaaacatatgtaagtcactaaaagcctcctacataagaccagctatggaagtgttcactaatgacattatctcgttagttcaatttccctctaaactatgtcttgacttgtttatggtgataaaggtccaacccaggaatcctgcatgctaaacatgcgttctctcactgtgccacatcttcatcccattccgtacttatatagtaggtggggagaacaaaagaaggtaaatgagagggaggagtcttatattagggaatgtggactgtcactcggtggaagagtatgggtcatgtttgtattcattccgtggttttgatctgcctcagctctaccacctctcatctacttctgcagctttctgatcttcttacctggatttttctctattgatccactccactatttagcagaagttattctgacctctagatctgagcccactgcttctttaattaatcccttctggtatgaagctctctcctcagtccctggagctttctggtgctctcataaactactgccaaggattttctgcatcactctgggttcctttataatcccctccctactcctctcaggccccaatggtacttaccggaaggcctgatgctagagcctgcctgccaagatatttcatcagctcagttgttccattgacagataaagggacctgctttatatcctgtgttctgggataaagttgtgagctgcacagaatggtcctaattcttgggtaacttactgttagtttactttctttttttttttttttttttttaagatttatttatttatttattagtaagtatactgtagctatcttcagacactccagaagagggcatcagatcttgttacagatggttgtgagccaccatgtggttgctgggatttgaactctggacctttggaagagcagtcgggtgctcttacccactgagccatctcaccagcccctagtttactttcaattgttgtaataaaacagtgacctaaaacaaaaagggagaaaagagtttatttggctgacaactcacagtccatccttttagggaagccaaggcaggaactagaggtgggaactgaagcacagatcatggaggagcccggcttattagcttattctctgtggatcactcagctcacttgtttattccacccttgtccatcagcccagggatggcagcactcacagtgggctgagccctcccgtatcaatcattaatcaggaaaatgtcagactagagagatgactcagcgggtaagagcactgactgctctttcagaagtcctaagttcaactcccagcaaccacatggtggctcacaaccatctgtaaaccatttgtaatgggatccaatgccctcttctggagtgtgtttgaagacagtagacttatataaattaaataaataaatcttttttaaaaatgaagaaaatgtctaatagactcaactacatgccaagtggatataaggttttctctgacgaggttttctcttcccagataaccctagcttaggtgcagttgacaacaaatggaccagaacactaatattttatgggtgggatgggaagaaataataatagtgatagtttactaatgctatttcttctatccctatttgaattgttctacattattcatttaattctttctttttaaagatttatttatttattttatatatatgagtatactgtagttgtacagatggttgtgagccaccatgtggttgttgggaattgaactcaggacctctggaagagcagctagtgctcttacctgctacgccatctctccagccacaagcaatctagttttaggctctgttttgtgattccatgctacaaaacaaaatttagccaggcatggtgatggtgcgtgcctttaatcccggcattttgaagactgaggtaagaagattttaagttcaagcataagctagggctatatggtgagattctgtcttgaccaaaaaaaaaaaaagcaaaccctgtacacagacacataaaataaagtaaaacaaaaataaaatacggggctggagagatggttcagcggttaaaagcaccaactgctcttccagaggccctgagttcaagtcccagcaaccacgtggtggttcacaagcatctgtaatgagatctgatgccctctttggtgcatctgaagagagcaatggtggtgtacttacatgcataaaataaataaataaatctttaaaaacatataaaccacatcaataaataaataaaatttaattgtgattgatatccggtcagaaaggagtgaacagagaatgctgtggtaaaatactggatttgtgtgtgtgtgtgttggctaatcctaggttaaagatgacatagcggtgaagaatgcatagaagccagtcaggtgaaaaaaatgggtgaaagaaatgatgttttatccgaggcaatattttttccttgtgggccttagtgagcttcagttttaagcaggagattggattgcatgcctgctgtatttcattttcatagtgtgccccttcaaagctaaagactataagacctgtaagatacagttactctggaaatggcttgcaagctgtctatgatgcctgtgtcgagagggagcttggatccagggatctgggatattgttccacagatgaagggtatataggtatgccagtgaggctgtccatggtggtaatagcgtccatagcagcctgagatctttgcttctgatgagaggttgggagtcaacaaagggaaggtggttttcagtattctctctcttttttttttttggactttgttacttaaaagatgtgtcagttggaaattgtttactatcaccatgtctcagtgtctttatccacagagtgtaagggcaatcacattattggcttcttgtgggaatctgatgaattctacactgaggggcaaatgctatttgtgtgttggttctgacttgctgtctccgtcatgtctctccccctgctcagctttgcagccagctggagcagctggagctggaaaaccgacaactcaaggaaggcgttcctggagcagctggagcacatgtggacggggagctgctgaggctgcaggcagagaacacagccttgcagaagaacatggcaggtgcatggacgccttccaggaatgtagcgacttcaggccttgagcggagccaggatgggtatagtcctcttatgggagaaagaagaaatttcggagggagacttggccttacctgaactagtgtatgattttgaatttcggggagcattttacctttctgggtctaatgctcatctgcacagtacaccagaatgtctatgccaggaagatggagcaattaagcaatttcattctgccttacttccgtgtctggtacacagcaaatgttagagaatagcagaacgaatgttgaaaaggagatgcaggtgctaactaagaagaactaggacactagggagattctgaggccagattgtaaattgggtctgggatgaaagcagagaggcagcttgggagagtgtgagaaggccctgacacatggcctttgttgagtagctgaggcttatgtggtagtgggtgatggttccatgatcaggaatgaggccaggtccaatatgagtaggaattaggttctatatgtaaatatggtatgaaacatggtagataggatttttgaagttggtgggtcttaagaattatttgtgacaggcctgaatgaggcttcctctgggacagggtcctgtgcagcctaaggagctgaaggataaatcgttctccctatatttgagatgtggcaagggacttcagagacgatgtcattcatcacacattcttgttctactcaacagcactgcaggaacgctatgggaaagaggctgtgaggccctctgctgttggtgagggccaaggggatcccccaggagacgtactccccactcccctggctcccatgccattggcagaagtggagctgaaatgggaaatggagcgagaagaaaaaaaattgctctgggagcagctacaaggcttagaggtaaatctgggtctcttgggactgggatgctgggagacagcagatgccctacctcccacctgtgggcctatggagatgtctgtgacatcaccatctcatgggccaaaggggggcgggacaggcaaaattagaggccttcctccatccttgctgataacaactccatcccttatcttcccccctaccatccgcagagctcaaagcaagctgaaacctccagactacaggaggaacttgctaaggtggggtttgctgccgcctggctttctcatgacagcagaggagtgttgtgcctcctcagagcttcagtttgatcatgtgtgaagcagaggctcacaaatctcagagttcctttcattgtggaataagctaacgtggtctcattctaccttgtgcatggaaggccccatcccttctgttgcctcaattcatccatataagaatgcctttagaacctggggggcccagtgctgagacaaccagtcaggatcctactttccaggcctgccagcctagccattctgtgatgtggccattggcactgctttgggagcctttggaacccaagggaggtagttggagatgatgtggctgctgctgctgacaactgagccttcaaattgcttaacccttctgagactcagtttatccacttgtaaaatcagtagttttcagtactcaaggatgtcctgagaattctgcaagaatatcataagtaaaacccgacttgtaggaaggactcagtatgaagtatctataaatgttattttttattttgttttgtcattattcttactgttattattttctgtactccttcctctttctccctcagctctctgagaaattgaaaaagaaacaagaaaggtatatttttcctttccagggtttttgggggcctgtgggggggggagggtagcttgtgggaatgacatatctatgtcttgtctttctgtgcccagtttttgccgtctgcagacagagaaggaaacactgtttaatgacagcaggtaactactggggttgtcagtagcagaaaaacagggaccatgcccaggcaaactaagcaaagaccacaggggtagagatggaagagtgggcttctagccatgcctaatgtatcccatccctatcctcgtcacccctagaaacaaaattgaagaattgcaacagcggaaggaagctgatctgaaagcccagttggctcgcacccaaaaactacagcaggaacttgaggctgccaatcaggtgatggggctgactcccaagatcccctaagtggagaaccaggggggtggaggtatgaggtctttagagactgattgggatgtctgagaattagagatatagcaacctgaaaagtaggagtaagctctctaggagctagaaaaatagaaactcaagagccttaggagttgggataagagattacatgaatcagagattcctgaagtgggagtctagggacgctggttgtataccacaaattgtgtgagtcagaactttcgatggggtctgggatcaggaattagggtgaatgtagctgtggactctcccattagaaattgggtgataggctggagagatggctcagtggttaagagcactgactgctcttccagaggtcctgagttcaattcccagcaactacatggtggctcacaaccatctgtaatgggatctaggtgggcggtagtggcgcatgcctttaatcccagcacgcaggaggcagagaactctctgagttcaaagccagcctggtctatagagcgagttctaggacagccagggttgttacacagagaaaccctgtcttagaggaaggaaggcacatgcctttaatcctagtacttgggaggcagaggcaggcagatttctgagttcgaggccagcctggtctacaaagtgagttccaggacagccagggctatacagagaaaccctgtcttgaaaaaaaaaaaaaaaagaggaaggaagagagggagggagggaaggtgggtgggtctggtgatgctgaaacctttaaaagctgcgctatcagctgggcagtgtggtgcatgcctttagtcccagagcttaggaggcagaggcaggtgaatctctgtgagtttgaggctagccagagacacataatgagaccctgtttcattaggggtcaaagacatgagggttgggtagacagtggacttccaagtatggggcagttggggctggaggcagagtacagttgagagcttcaaggtctggttctatgatgtttaggaagtgagttgctcatgtgagttgggtggtcttgaggtccttgggtagcctctgggttttacctaagaggagacaagtctgaggtttctcagaatggagaatatggtgcagggaccctagaaaactgcaatgtgagagcaaggaccaattctggataaagacctcaggagctgttggtgatctaggtctaaagattccaagcaatgggaaaccagaacgttagtggagatgggtcagtctgaggcttcttcaagagctggaaagtgaggttgtgagtttgagatctctaggatccggggctaggtgtcggtgtgaactgaggctcctgcgcttgggacactgaggttaattaagtatagcaacaactcctggtggataggttctggagatgggtaaagttacagtctgaaactcctagtgttcccaagctggaatctggatgagtatgagcccctcagcagttaggtttaggaacttaggtgtgtccgagatgctcaaaggctgagaaagagggagggaatgtgtttgagagctctgtgtgcaagtgatgtatctatcacttggagtctgggtaaacatgaaatctctgacagctagtccaagattcacaggtgccaagaacatgcttttaggtggtcccagagggagtctgtgtatctgtgtccacccagagaaggacgagatctggaatggggttacctgacatccctgttccacagagtttggcagagctaagagatcagcggcagggggagcgtctggagcatgcagcagcgttgcgggccctacaagatcaggtatgttgtacttggtgggcctgggagttggggttgagggtggccagcaggctgcgttggtgtcttacaggcaggcatggcccagggggtcctgctcttcctagccctggtctgtgcgtctgtgcgtctgtctcctttctttcctgttcctctgttctggacttgctctcacctgtcgtgggggtggggccaggtgtccagccagagtgcagatgcgcaggaacaagtggaagggctcttggctgagaacagtgccttgaggactagcttggctgctctggagcaggtacaggatacctggggtccctcgaggatctctccctgtttcttttgtctctctcgcttttggtccatgtctggccagagtgatctggacccttgactcttctgtggcctctgtttttgttcctcctttctgttggcttctagccttcttttccatctactcctgcttttctgccattcacgtttctttatgataaggtgcatgaaatgtaattatcataggtgtacactcagtaagtccaatgtgttcctttataattctgggtagctaccttccagaacatgatacagaatatttttcagtatgttggaagattccctcacttacttttagcatatccctggaagtaaccaggattctgacctttaacaatataaattcatttgcctgttctctaacttcatataagtggaactgatgctcatctgtccttgcctgctttctggtacctctatgtctgtggttttatccacgttacatggctttcttttatcacttcatagtatttattgcacgaatctttcactcctcttcctgcttttccattttaaacgttgtctttcttcctccctttatacttctctctctgtctccccggaactgggaggtccggggttcctgggccttagggccccctgcagttccttttgcccaccattaccacgttctccagatccagacagcaaagacacaagaactgaatatgcttcgggaacagaccagtgaattggcatctgagttacagcatcgtcaagctgaatatgaagagcttatgggacagaaagatgacctcaactcgcagctccaggtgaaggtttttctgacctgtggtgtagtttactagtattagtgcagtgacttgcttttgaggaatggtgagaagacttgggagtcaaggagacctgaattcctggctggcttcttaacatcctagtacctgtcctgacatgggtaattttacttctgcaaaactgagcttcttcagttagtcagggtttccattctggtaccgtaatgtacaaattgaatgtctcccatatgtaatgcttatgcttgcttcagattttgtctcatttggaatatttgcatatacttactgagatatcttggggatgaaacctaaatctaaacataccttatacatatagcatgaaggtaattttataaaatatttttagtgctcctgccttttttgagatgaagtagagctctctgcaaccttagctgtcctagtatttgctctgtacaccaggctggtcttgaactcacagaaatccacctgtctctaccacccgactgctgagatcaaaggtgtgcattggtggtcaggtgtggaattcccatatgtggctttatgtgctaactcaaaaaaaatcagattttaagccagatatactggggtatgcctataatcctagcactcgggtacctgaggcaggaggattcccatatgctgtaagccagtattggttgcatagtgaatactaggccatccaaggctacatagtaagaccttgtctgaaagaaacaaaaaacgttttagattttaggttttaggatgaaggatgcttagcctggagaaactagaataatactggattaagaaagaaatttggggctaaacatagcagcacaagcctttaaatgcccgcacttaagaggcagatctctgagttcgaggctagcttggtctatgtagtgaattccaggacagaaatggctacataataagaccctgtctgtctgtctgtctgtctctctgtcacacacacacacacacacacacacacccacacccacacacacacaaaggtttagtgctggtgatacagcttagttaacagagtacttgtataatatcacaaagccctgggcttagttcaaagcactgcataaaccaggctctgtgatatttatgttgtgatctcagttcttaggatcacacacacataacagaataaggaggatcagaagttcaaagtcagctgggtgtggtggcgcacgcctttaatcccagcactcaggaggtagaggcaggtggatttctgagttcgaggccagcctggtctacagagtgagttccaggacagccaggactacacagagaaaccctgtcttgaaaaaacaaaacaaaaacaaagcaaaaaaccaaaaaaaaaacaaaaaagaagttcaaagtcatcctatgccacagaccctctgggtccctttgtctgcgtggaacgagtctctggggcaggtgggcaaagagtgggcgaatgaatgacagacagacgaaacacaagaggttgtgtagaatctgaatgtaatttgtcaaattgcgcatcaaactttttatacagaagaaaatagggaagttaggtgacacatgggcaaggtacaaatgaggttaccggatgcttaatgactcttacacaaaacagaggaatgtaaacacaaagactggcaggaactgggcaataaaataactgagacaaagtcagctctatctaaggtcagctatagttttaggagccaggtgtgagatcttttcactcctagggcaagggctttcacacataagtcatggttctgattagggagttccgatctagctaaccatctcatgaataatgcaatactctaaaaccacagcctgatctacttcctaaaccattgtaaattcctgcatatgggagcaacttggcttttattctaagtgatagtgtaataccagaggcaattctcaatatcactgaataggcaacattcttactaaattccaagcccatggtcagctcaaggactttctaggatgttggaacactggcgaaggcttagctatgtcagaattcaatcttaaaaggcacttataataagataatactaaaagagagcatgtggatccatacaccagactaacgcggaaatagggtatgagtatatgggtttaatgagaacaccaaaactccaggaggtgagtttccatgaaactctttgcctcgtgagcgcttccaggcctctcggcctgccaagcagatttcagcggactgtgcgtggcaatcctagctacataggaagatggagaccagtctgggctacataggagacttgtatcaaggtgcacagggggtgggggtggggcacaggtggagagatggttcagtgggcaagagcacttagtaacaagagcaagcatgaagacctgagttcagaatccagcaccatgggagaagtatgcctgtaagtcccatgctgggaaggtggcaaggtgatgccagggtagttggggcttggaggctagccagattatccaaaaactgtgagcgacagatttagtgagagaccttggctgaaggaaatgaagtcaaaagtgagaggaggatggaccaagtaggctgttcagggattaatgatagcaatgatggtggattcttttttttcttttgtttattttgtttgtgacagttgtctgttatgtgttcctggctggcttggtactcatgtgtagcccaagctagcctctaactcatggcagtcatcctgtctcagtctcctaagagctgctactataggtttgagcctccacatctgttctgaattatggatctccaatcaccagggacctcggttcttgctattttccagcctttgacacggacctgtgttttgcttccaggaacagttgttgaaactgtttcactttcatatttacatcgtatgtggaaggaaggaaggaggaaagggaacagggaatagtagtaaggagaaccttcctttcttttgagaacatgttctgctgactctggtggttcctgcctgtaatcccagcactcagaaagctcacacagggctggagaggtgcctccgcagttaagagcactggctgctcttccagagaaccgggattcagttctcagtgcccacctggcagctcacaactgtctgaactccaattctggggcatctgatgccctcctctggcctccacaggcaccaggcatgcatgtgggacacagacatacatgcaggcaaaacacctgtgcatgtaaaataaatagataaataaaaattaaaataaaaaccttaggaggattgtgattttgaggccagcttggtttaaaaaaataaaatcaaaccaaaacagtcataacaggtggtctttattccaaagagatggaggcacagagatctccttgagcttgagccaaagatacatagggggaccctctctcaaaacaaagaaatcgttaataagggctggagagatggctcagtggttaggagcactaactgctcttccagaggccctttgttcaattcccagcaaccacatggtggcccacaaccatctgtaatgggatctgatgccctcttctggtgtgtctgaagacagctacagtgtactcatataaataaataaatctttaaaaaaaagtggatggtggctgacaatgtttaaaaacaaagaaatcataataataaagacttaagttatacttaacaattctagatacagattaaccacctgagctgtgcccagtgatgctattcctagctacttgggaaactgaggtaggattctttccattaaggaatcaagactcagtctcaaaaaagaacactggggctagatgtggtggtggtgcatgcctttaatcccagcaccagcagatctctgcgaggttgaggcccccctggtctccataagttccaggacaacaagggttacatagagagatcctgactcaaaacaaaacaaaaagaaagaaaaaaaaaaaaagaaaagcgttgtgggtctcaatcctctgtgcagctgcccttggttgggggctgtcctgcacttcaggcagaagagcagtggctggaaagaggatgaaaaggctctggggtcgctcaactccagtctccagttggttaggaagagcagaaagtgcatgctaggagacgagcacactctgaagaggaccaaacagggaaaaataaaattggttactctttccaacatacccatctttgaggcgatctgaaatagagtaccattagtccatggtggccaaaactgttgtgtgtcactacagtggcacaatgtgtggaaaatcattacagagtatgcacactagttttgttgaccctggcattctgatattataacagactggtgaaacgcaaacctggaaagtttttcttttctttttcttttaatttattttatgtatgtatacataaatgagcacagtatctgtcttcagacgcaccagaagagggcaccagatcccattacagatggttgtgagccactatgtggtttctgggaattgaactcaggacctctggaagagcaatcagtgctcttaaccactgggccatctctccagcccctggaaagtttttctttaagaaaacttgccagagcttatttgcttacttgttaaagaagagagagagagagagagagagagagagagagagagagagagagaaaactcacgtggtggtggcacacacctttaatcctggcacttgggaggcagaggcaggcagatctctaagtttgaggccagcctggtctacagagtgagttctaagacaacctgggctacacagagaagccatgtcttgaaacaaaacaaacaaaccaacaaaaacgaaagaaagaaggaaggggggggggggaagaagcccagccacgatgtccaggacctgtgatcttagcatttgggaggtaaaggcaggtgaggagtccaggctcactgctggctaccaagcaagtttgaaataaggtcctatctcaagaaaaagacttttgatggagcattttattcccccaaatagaaaggaatatagcttggcacttgggaggcagatgagtcccaggccagcctggtctacatagagtttcaggcaagccagggatacatactgggaccctgtgtcaaaaaaaaaaaaaaaagagagagagaatacaaagaagcaagaagtgagtcacatggccctacctgtctgtgaagggagaaatacttcagactattcccaagtataaattctgttgctaaggaagcagagaagaaagtactgaggagcaggaagcaatgtctgtcatttctcccattatgattaagattatagcacctactttattcgggggacggtctaccagaagtgttggagttcattggtacctaaccagggactcttttccaacttcctcttctctcctgaattaggagtcgttaagggccaatagccggctgctggaacaacttcaagaaatagggcaggagaaggagcagctaacccaggatctccaggaagctcggaaggtggggcatcatgagaggaaggaacgagatggcctagtccatgagggtagggagtgttatggccaaatcttggcaatgcaaagagagagagagagagaaacaaacgatcatttccaaaaagactggagaatgactcagccagtttgaagagccggggaagaggtggaatctggctagttccttgggcatagaaccgaatggtggtcattttgtggtgttggaagataaattgcccctctcttgacccaccgtcctggtccccagagtgccgagaaaaggaaggtcatgctggatgaactagccatggagacgctgcaggagaagtcccagcacaaagaagaactgggggccgtccggttacggcacgagaaggagctgctgggcgtgcgagcccgatacgagcgtgagcttcgagaactgcacgaggacaagaagcggcaggaggaggagctccgggggcagattcgtgaggagaaggtgggtgccgtagccatagcctatctcttctaatagctgaggaccgtggcgttgcttgctgctggtgacatggaggcaggtaagtgatatgcaaggtggccagtcctctgctgcccaactcctgcctgggttctccttccaggctcgaacaagggaattagaaaatcttcagcacacagtggaagaactccaggctcaggtacactccatggatggagccaagggctggtttgaacggcgcttgaaggaagctgaggtgagtcggtggtacctggtaaagctacaaagctggtttggtgaagatttgaacaggcattttttcctcttagattgttcatggtgtcctctgcaaaaaaaaaaaaaaaaaaaaacaaaaaaaaaaagaaaagaaaagaaaaaaagaaaaaagaaagaaaaaaaagaaaatagaatacattatctttctatgtttggtaatatactaatttttattttaacaagaacatttagccgggcgtggtggcacacacctttaatcccagcacttgggaggcagaggcaggcggatttctgagttcgatcgagtccagcctggtctacagagtgagttccaggacagccagggtgatacagagaaaccctgtctcggaaaaaaaacaaaaccaaaaaacaaacaaacaaaagaacctttatagtctttttttctggaaaactcaagacaataataagaggcagtgtcgtgtagcagagaagaacacactggagctgggtatttctctcagcttgaatgctgactgggctacttcgtagtggtgtgatcttaggtaatgtattccatctttctatggccatttgcatctttggcagaaaggggacaggagagactgaaggtagctcacggtagaccacatggttagcatgaatgaggcctcaggtttaatttccaacagcaaaactattcagacctcgctgccactgagtatgagaccacctggggtagacccttctgacttagatggctctattgttctgtcacctgctgctgctcttcaccaagacgctgctacctgctgagaggcccttgagatattcagtagacagcatcctacaggctggcaacaggcaccaagaatggattggcaggggatgggccacccccctttataagcacagactcttagtaaacttgggggccttgaacagaaacatgtcttggcctccattatttctctcgccgtttgcttccatacagctccggcctcccacttaggaacccagttagtgtggccgcaggcggttacgtgaatgttcctggcatgcagtgttgttttgttaaagaaagaaaatataaatgcaaatcacttgctctactatgtgaatagtatagttagttttccacttcttatttctgccttaaaggcatatgccatttcctacaagaatggcagtgagttccctgttaattggagcacttgggagccttgaggtcacgttaagagttcagggccagtgagggttatgtactgagacctcgtttcaaaatcaaaaggcgctgggcagtggtggtgcctgcctttaatcccagcacttgggaggcagaggcaggcggatttctgagttcgagaccagcctggtctacagagtgagttccaggacagccagggctacacagagaaaccctgtctcgaaaaacaaaacaaaacaaaacaaaaaaccaaaaaacaaaatcaaaaggtgttttcataaacacccaaagaacttgtctgaaatgttcttgtccttaactggacacacattcttctggggaccatgagcagagctgggactctccttccaggaatctttgcagcagcagcaacaggaacaagaggaaaccctcaagctgtgccgggaggagcacgccgctgagctgaaggtacctcttgaatggtggtggtcctgtctcagggcgctgggcacccctgcaggagaacagggccttcttctcatgccgtggcctgagctgctgttgcctttgcagggcaaggatgaagagcttcagaatgttcgggaacagctccagcaggcccaggaggagcgagatggccacgtgaagaccatcagcaacctgaagcaggtctgtggtcccagacacaggcctggcctaagcttgcagaatgaggcgggatagggagggacaggatacgctgtgggcaactgtgccaacacctgcccagctgtgccttctcaaaccacaggaggtaaaggacacagtagacgggcagcgcatcctggagaagaaaggcagcgctgtggtaagctagcgaggccctggaccttttccctttcttcatgggccacccaggtcacagctctcatgggctactctgccccttacctttatttagctcaaagatcttaagcggcagctgcacttggagcggaaacgggctgataagctgcaggaacggctgcaggagatccttaccaacagcaagagccgcacaggtgagaggccaggccactcggaagctgctgcgaattggggcgatctttcattcctccctgagccttgctccagccctttgtcctgcctgaatgctggctgtcttttctctccctgcactgcctgctttgtgtgtgtgtgtgttcctctctctgcctgtgttctttctgtttgctttgtaactgcctttagttctttttctgtttccattcttggattctagaaatcctcaccatataagtctaggatacaagccccacctccagccccctccagacattcatggtgaatcaagggagacagttttccataggtaacagcacaacacagccatcatcatcaccaccaccaccatcactatcatcattatttagacaacatcactttgtagcccatgctgatttcaaactcatggcgctttgccttagcttcctaggagtttggctactgacatccgacaccatgtttggcttgtactgttttcagtatacagctaactcaacccacgatgcttctgccaccaaaagcagaagacgtgcccacgcaaaactggagttgtttctaccttttcttggttggaataactcaagttcagtaacgggtctggtgcttgtcttagatcacagacagacttagagagcactggctgtcaactgaggtgctggaagagccccactcaggcactgcaccctgtctgaggatccctctttgccctgacacctgggagcacttgtaagggcagtgtcaccaactcagtaccaatgttttctggtttgtttttcgccattgcccagactgaccctgagtccctcagctcaggtaatctagcggcgagcgtgtagcatgctcagcaagtgttcaactgacctggcaagtgacatctctctcaccaaaccagtttcctcctgagatgttcagcctccctgaagtaatttctcgttttagtagatgaacaagctaggaatagattagaattttatttatttgtttgtgtttttgttttgttttgtttagttttttaagacagggtttctctgtatagccctggcagtcctggaacttactctatagaaaaggatggcctcaaactctgcctgcctctgcctcccgagtgctgggatcaaaggcgtgcaccaccaccacccagcctagagttttatatatatctcgttcttctccattacatgggactgagagctaggcaaatagctacgagtacgactccatctttgttctgattttgctctaaatatgtctttctctgtggtgcctgccagtctccagcaggtgctggctccctgtccctgcgctttcccctgcgtgtctgtatgagcactcgcaactccctgtctccctttctctgcatggaggtttgaatacttttgccgctggaatcttgtgtctactccttgccctttcccttcgccccaccacttcccttcttccactgggcatggttaccgacagagttaccagccttgtttctgcctggtccagtccttgagtttgtttgcccggggggtgtctcttttcctctttgaatctctggcaagtcttttgatgaggtctcttcctactggttgctgtcttgagattccaagggatccgaacgcaggttgctttttcctccacattcaggcctcgaggagctggttctgtctgagatgaactcaccaagcaggacccagacaggggacagcagtagtgtctcctccttcagctaccgggagatcttgaaggagaaggagagttcagccatcccagccagggtaagggtcaccttctaagtaagtctggacattccctatttcctcctccctcaaaattgactacactgacctttggacgagcatttcttctctgtctctttatgtgtctgtgttttctctctctttctatatgtatgtgtctgtttgtctatgtctctctccaactaaggattgaacctggagccttacacatatgcagagcacatgtcaacatatgctgttctactgagctgctaccccagccccctgactagagcactttgtcaccttctccccaaacccatcagcctgagactgatgcacaggaggcaggccagttagttattctctgggcccctctatttcaccgtctgtaggttaatcccaccgctcccagtgctggaaagtgcaagcattgtgggaagttaaagacgtgccaccatgcctggccttaaatatttactttaatttgattattttatgagaatgggagtgtgttggtgtgcctcctgtatgcagtatcctaagcggccagaagaggggggaagattcccccggagctggagttagagcagctagttgggagctgtcacgtcgctgctgaagccagtgctcttaactcctgagccatctctccagctcctatttgattgtttccccccactttttctttaaaaagagattttatttatttaatgtatgtgagtacactgtcgctgtcttcagacaccccagaagaggggatcagatcccattacagatggttgtgagccaccatgtggttgctgggaattgaactcagatcctctggaagagaagccagtgctcttaactcctgagccatctctccagcccctatttgattgttttcccccacttttgatattggattcttgctatgtagcctaggctggccttgaattcataatcctgccatcagcctccaaagtgctaggattttttgtttgtttgtttttgtttttgaagacagggtttctctgtatagccctggctgtcctggaagtcactttgaagaccaggctggcctcgaactcagaaatccgtctgcctctgcctcccaagtgctgggattaaaggcgtgcgccaccacgcacagccaaagtgctaggattttaagcatgagctactggtggctgattcccttcaacagcatagactgatcactgttactattgccatctgtcgcaccatgttccttgccaaccactttttatttagattttgttttgttttgtttttctagacaaggtttctctgtgtagccctggctgtcctagaactcactctgttgaccaggctggccttaaactcacagagatctgcctgcctctgcctcccaagggctggggctaaaagtgtgcaccaccaccacctgactaagtatcatattttcactacccaaagaatattattataaattcttagttcggggctgctggagagatggcttagtggttaaggtcactggctcctcttgcagcggtcctgagttcaaatcccagcaatcatatggtggctcacaaccatctgtaaggagatctgatgccctcttctggtgtaaatgaagatagtgacagtgtacagtaataaagtaaataaatcttttaaaaataaattcttagttcatattgggcatagtggcccatgcctttgagcccagctactcagagtgcaggaggatcactggaattcagcagtttgaagctaacctagacaatgtaatgaggtcctgtctaaaaatacatttcctctgtgctaccagggtcctcatacattgtaggtgagtattctagtactgagctacatttccaacccttcctattaatcctttttaaaaaaattctttttcttattttatatgaatacgtgttgcctgcatgtgtaatttgcatactgcatttgtgcctagtgccctgtgcccacataggcccgaagaatgtatcagagtccctccaactggagttatagatggttgtaaactttcatgtgggtgctgggaattgatcttgagtcctctagaagagcaggaagtgtctccagctccatttttttatccatgatttttgtatttatgtattcatatgtgtatggatatttgcctttcatgtatgtttgtgtaccacatgtgcctatgcccacagaggctagatgaaggagtcagagcccctggactcgggcataggcctatgcatctgcatgcaggtgcccacagaggctggcggagtcctctagggagctgcgtttcttgtcaggtacgagcctctggatgtggacgctccgtactgagctctagacagtttcttgcatgaatagcaagtgatcttaatcatcatttctgatcagaatatattgtatgaaagtattttttgttctttttttgagatagggtttctctgtgtagccctggctatcctggaactcgttctgtagaccaaaccggcttcaaactcagagatctgcctgcctctgcctccctagtgacagcattaaagacgtgtaccactacccagctaaaaccaattcttttttttttttcaattaaaataaaataaagaaacaactaggaggctagagaggtggctcagcagttaagagcactgactcttcttctagaagatccaagttcaaacccagcatctgtattaggcagttcacaactacctgtaaccccgtctccgggggaaccaacccttgcttctgattcccatgtggcatacacaacagacatacacatatgtaaagtaaaagtaactatgtatattttaaaaaataattgagatggtgagtagcctagttttgttggttgcttcttctcccttccccaggtgggaaatttccacttcatcgaaagtgtcttttctttgtaccggctagaattcacgttcacagtaccccttggttttgcttgttatttgttttccttacgtctgactcttgtgtctattctggtcctatcttcttggcatccgctggtggaggaaagcagaccatttgacctgcaggaaccctcccacctttagctttttttctgctcgcttctttaatggtaccatttagctcttcccactgttgcctccatttcctgccatctgggaattagatgtcatttgctgctggatttccctcagtcctctcagcaacgctcttgtggtggtggtggtaacactgtctgcctccctttaagccaaaggaaatgtggagttttctgagagtgccaagtgtgtggcctgcgcctccagccccagagcctatactgcccatgtgcctccggctcctacctcatgctgagaatagcttcatttttctctttcttctttctttctcctagtctctatccagcagtcctcaggcccagccccctcggccagcagagctgtcagatgaggaagtggctgagctgtttcagaggctggccgagactcagcaggaaaaatggatgctagaggagaaggtgccgtcgctcttgctagtcttcacatgaaatgccctgggatgggctcgtggctgggaagggttgtcttgagaatgctctgggcccctcctcatgggagaaaatgggaagttgaggggcctgagatggggtggaccatcttgcaggtgaaacacctggaggtgagcagcgcctctatggcggaagatctctgccggaaaagcgccatcattgagacctacgtcatggacagccggattggtcagtgcccgtctccagccctcacctacagtgaaaccttcacctgcccctctttttccattgttccattgctccttttcccctcttgaaactcagtgaagctactgacaagctcatgagccatggagaggaaagcagggaaacgttgcttttttgcctggcctcggctttgtactcatcccttctcccctccccccaccctctagtggattttccccggacttctctgtctctttctgtctacacttccttctcccctgctttctagttctctatgtattttttttttctgttccctttctttgtcttctcttaatagctgttgctctatttctatttttatttctttgcgttttttttgaaactggattttgcagtcctgcgctaacctgctaggtgctagggttccaagggcgcatgcctacacctatcatccatttctatccactatatctccatccctcttctcctctctgacctccatgcttttactccctattcagtacgagctgctcacatgctctcagggtttactctgtgtcctgtgtcctgtgtgtcctgtgccccaggagtagcaatgaccctagttttcagggtcaagtaactaagaacagctgggcttccccatgtcagagcttctgcccccaaacagaacatggcctttctcccttcttgcctgctctctgttttcctcctctctcctttggctctgcccagtcttccctacaccaaccccggctctgccgagggggcggtgctcagcctggacccttgcagatgtgtctgtggcagcaggccacacagaccgaagtgggctgggcagtgtcctgagagacctagtgaagccaggcgatgagaaccttcgagaaatgaacaagaagctgcagaacatgttggaggagcaactcaccaagaacatgcacttgcacaaggcgagtgtggaccaccagcctgcccacccatccctccaaccacctgcttccctacccacacagtccctggcagtgtccttccaactggcccttgtccccccagctaccaccttccagtcatctaccgcccttttgtgttcacctcttttaccctccaatcaacttcccaggttagcccatcagtctgccatctgtccctctgcccactgatccatccatgtatgcccttgctccctgtttacccatctacctgctctcctacctatctgtcagactatcatctccgaggctgccagccatttcccgatgcatcgtcctttcacgaactcatcagtcaccacctatttgtcatttgctacctacctgccttcttgacctctacaaagttcatttgtgaacccatccgcctgccataggtccacccacacattaattcctccccacacctccacccaaatactccctcctcactaagggagtcatagccaggttttgccttgaagaagcaagctcacatttgctataaagagaaggtggttgatcttcctgttcaaggctggacaccactgggcaccgagaatccatcagtccatctaactacagatcacagctcagatttgctaacagagctgccc

SEQ ID NO: 632 - DNA, 29939 bp, mus musculus; identical to SEQ ID NO: 631

SEQ ID NO: 633 - DNA, 16534 bp, mus musculus
ggggggcccgagctagctcaaataaaataaagatcctgctgtgatttgcatcagattggctcctgactgttttgggggggatcactaacccttccctggcactatacttggacctaggaatttggggccaacctagcaagatattatccctaaaaaaaaaaaaaagcaagtaaatactagttttaacctgtcaattaaaataagtttatgagtgctatacagaaaggccttaagatcccagctataccatgtaaaagaaagctatcataaaccaggtggtggtagcacacaccttcagtcctagcactaggcaggcagaggcaagcagatctctgtgagtttgaggatacagaacaagttccagaacagccaggactacacagagaaaccctgtcttggaaaaaaaaaaaagagctcttttatcttatggccaccatcagattagacattgcctctggcaagaaccgccaatggatgctaaatttgtgtgtctactctggagttgagaaacaaattgcacaatctccagtatctcctagtagttggagataaggaagtcctgtctttaaaaaaaggctcccaggaagacactagatacaaggaaaagtacgtgtgacatgaagaaacctgtaggatactgccttaattaactgaccaatgcaaataccaacagtattgagacagttcactatcttgtgcctcctgctaactaagcacacagcatcacctttgtggaattcttgccctaaatacatatgaatctaatcatatcagataaatccacaatgacgaacattcctttcaggaacggacctgcataaacatccagacaaacaaaaacaaaacaaatgggaaaacccatcaagatcttaaaagataagaaaacactgaggctagccaggcagtggtggcaatgcttctaatcccagcatttgcaaggcagaggcaaggaggagctttcaggacagccaaggctacacagagaaacctcgtctcaaaaatgaaatgaaataaaataaattggagaccgaaaccaacagaaaactaatagtataacacagctcatgagacttcttattccagcacttgagtggtacaggcaagaggatcataagtttatcttcagctatatattgagtccagactgggatacataagaccctgttttaagaaaaatgagggggctgggcatggtggcgcacacctttaatcccagcacttgggaggcagaggcaggcaaatttctgagtttgaggtcagccaggtctacagagtgagttccaggacagccagggctacacagagaaaccctgtctggaaaaaaaaaaaaaaaaaaaaaaacgaaaaaaaaaaaaaaaaggatgggaaggagtgtcagggatgctgttgagatggctcagaggataaaggctctggttgccaaactggcttctgatctccgtacatctgtcatggcagatgtggatccatcctccccatcgataaaatttttaatcaattaaattaagggaggttggagacatacataagtcatgggttaagcacactgggctcctcttccagaggacctgggttcaattccaagcacccacatagcagctcagctcacagttgtaactccagtctcagagtatccaatgcatttttctgacctgacttgcttgggctctagggacacctgtgacacacagacacagaggaaggctaacacccgtacacataaaaggtaatccataaatttatttataagtaagttgaataaaatggacctgggcacaaaggggcatccctttaatcccaggcagaggcaggcagatctctgtaagttcagggccaccctgctctatccaggtaggacagccccagtgaaatagtgataccctgcctcaaaacaaataactgtgggggtgctcacctttaaccccagaattcaggaggaagaagtagtgaagctctgtgaactcaaaccagtcaagactagtgagactctgcacccatctccccacaaaggcatgcaaatttagttaagatgtacagactttgaagtacaggacagacagacacacacacacacacacacacacacttaccatttcagatattgtctgctctggattgcctgtttgcttccactatcaatcgtattagtttttctcttcttattgatttgtacatgttttctatatggcccaaaattctctctctctcttctctctctgtctctctctctctgtctttcttttttgagttctttcttttttgagacagggtctcactacatagccctgaaaagcctgaaactcaatatgtgaaccaggttggcctcaaactcacagagtttgcctctgccttctcagtgatgagactagaggcaggtgcagccataccagctgtattctactgttatttcgatttcttttatgtatgaatacatagcacaagggtacttaggagttacagatagttgtgagccaccatgtaagctctgggaatctaggtcctctgcaagagtagcaagtactcttaagcactgagacatccagccttgcattactttagaggaaaggacgttgtatttgtgcataaatgttagctgatgtaaatatttatgtatgtatgcatatatacatacccatggtgttaaatattttttttcatttgtaaacgtgactattaatttactccatttgaatacatgttaaaaagctcagcgactgagcatttacctagaaagcacaaggaggccatgggttgcatcttcagacagcagggacagaaacaggcagtttctcttaaccaagaattgctaatcccgcccttttgtttaacagaaagggacaccgcccagagtgaatgggcacaacttccttaactccatacagccaagcattaatcttattagaacctgttttccttagctcctggggtcagaatgaggtcaagattgacctgggtgtgtttctccgttcacattcacatttggagctaagcccccttaatgccctataagtgcgccttaggggaaatgggctcttcttgggagttgaaggtttcatcagcctaagaatagaattgaatgcccaagactgtatctcaggttcagtagagaatagtgctgcacaaacccttttgttgatacacagaaaccaatacagacagatctttatcagatcctgggatttttgtttgtttgtttggttggttttttttggtttttttcttttttatttctttttttgcgcgtgttcttagcctccttctagtttctttacagggcccattctattgaggaattaagcaaacaaattcagttaatgataaaccaaatgccgactactaacccttagggggtcgataaggcacttagtgagtgttcctaggtgacacagtcattacggacaaaagcttcgatctgttccctggggctaaagaacacttggaaattccttcagattccttaagagatagaaaaggagaaacaatggcttttttttccagctgtgacaagggtcacgccagtatgaatgcaagagggactattggggcgagcatttggcagaaaaggggctagccccctccctccctatcttttccattctgattctcaaggtttataaaataatcattaggaagtgttttcttggaagttgggaaattcttgcgccccgaacgttcctgagctggaatggcaagtggcctgaaaaaggtaccggtgaaccttctgtgcgccgacgtgctccagcgccccgcgcccctcaatcctgctcctcctcctcgcgatgctcgggctcactcctcctggtccccgccccgctcccgctttcggattggaggaactcagctgctagcccgccccgggatttaaagggcccgctcggccgcgccgccctgggagccactgctggtcccggccttgcggcctgcgggggaggctgccaggaggaggtggcgacagtggcagcggtgcgcgtccccggcccccaggaccacggcttcctttctgccaggtaggtctccagtagtgtgcgcgcggttcccacgttcccatccttaagctggcctgcggggcgcggatctataccccttgtcctgggacctagtccgcatcacctataggactccctccctgctatgttccctgccggcacttccactttcctgcagtccctcgaccagggcaaggctttgttgccggctttttgctgagtagggtgagatgaagctcgcggaagatacatccatacaaggagagatgcacacggcccctaagtgtcacagactccccctttctgcactccacattgagtgactaccttggaaacgaaggagcccacttcttccgccccatttgatatataggtctagaatgcatatcatttttatcatcattgaacaagactgttaacaacattctagatacacaaggtccttcattccctgcgggtcacagggcatccagaacacccgctgatatcacagttggtggctcagcccgatgtacctgatattcatatcctcccccaaagccttccaatagcaccctggggggttggcagccccaagctgaagtcctgagtgctcaaatcccaaccttgattgtggacagcaccacggacatctcactccctctgtgtcctccctttggcagctccatctgtccatccatctgtgtgggtccacaatggccaccttcagccgccaggaatttttccagcagctactgcagggctgtctcctgcctactgtccaacagggccttgaccagatctggctgcttcttaccatctgcttcgcctgccgcctcctttggaggctgggtaagtgcctaccaaactgtgttccaccacaacagattttatcttatctgtgacattcatggatatcaaactacaccttaccccaccacatcttaccatgcaacgtcctgcaatgccaaagcaggtccctacaggtccagccccatcatatcccattaagctaagccccaattccaccacaacacatcctttacatacagccacctcaagccacaccatggcaagccacatcctgttaaaccaagacatgaccttcagcattcctgcactctgagacggtgggatccggaactgtctgtgttccaaggtgttccaatcagatcctggaatgctgctgttacaagtatcctatcccaaagcgtcctagttactaggtatgaagagtctgccaagttgacattttcacatgctggacttccaaaaatgtgacattatgaatgtctataatcaggacattgtgaaatttctggattctttgattctataatgttcctgcagttatagcaaagtcaatatccaaatgggaaagttctgaaatccccaggattcctctaggatacaggcatttgtgaaaatcaaacgttctctaatcaactctttcctcttcatcttaagtgggtgctttctttcccccccccccagctttattattttgggacatgtcaaagctactgaaaagctgaaacaatattaatatacatttacatataaaagccagtcaccctggtttcacagctagccacaatagactgctctgtcttcctgcctgtctatcccgtcctcctctttctgaatcatttcaataacctgatggcatcaggacccctcacctcaagtccttccgcatatggtccttgagaacaatcccaccccatacagaaccctagccgcatccatcatccccacccctgtgacattttaatatggatgcagtcctgtccaacatcaattgataaattttcctttcagggtccctgaaatgtccttggtagatgttgctttttaaacccaggccttgccacacgtgccagctctccagtaccagctttgggtccccttagaccccagcatgttctaggcttttgcccaagtccttcttctcttgccagcctaccaacctcccgcttcttgttttcccaccctgcctctgtctctccctctccctctccccctaagggttaccgtcttacctgaagcatgcaagcaccgtggcaggtggcttcttcagcctctaccacttcttccagctgcacatggtttgggtcgtgctgctgagcctcctgtgctacctcgtgctgttcctctgccgacactcctcccaccgaggcgtcttcctctccgtcaccatcctcatctacctgctcatggggtatgggtgtgcatcctcaccctccccttgttggcagaaggcaggcgggggggggtccccaaggccttgatgaagtggtccaagataggatggcatgagattctaagaaagtgaaggagtcagggaccagagaggatgacgagtgttccagaaggagacctgaaacacgtgtccttccgtgaggctgtacaggataggttgaacatgggctttccctggaggagggggtcctggggattttttttttcttaatgtgttatatgggttaggaaggcagaaccccttcaatacctccgtgcccccggtagtgtccaaagccctaggaggcataggcccaagaccatcaccttttttcctcagtgagatgcacatggtggacaccgtgacatggcacaagatgcgaggtgggtagctctctgccctcccacctgccctcctcacctcctgagagccctcctggaccttccccttcataaaccaaccaccatacagtgcaggcttccctttcccctgacatctttgtctctgtctctttctacctatcactgtgtctcccttctcctctcatctcacacttggtgcgccctatctttcatggtgacatgctttcttatccatacacttgaccatgggccccacacataggggcccagatgatcgtggccatgaaggcggtgtctctgggcttcgacctggaccggggcgaggtgggtgcagtgccctcacctgtggagttcatgggctacctctactttgtgggcaccatcgtctttgggccctggatatccttccacagctacctacaggctgtccaaggccgcccactggtgagcttctgggtggccaggtgggcagggactgtgggagccgccatggggcagtgctcatggatccttgatcccacagagccgccgatggctgaagaaggtggcccggagcctggcgctggccctgctgtgccttgtactgtccacttgtgtgggcccctacctcttcccctacttcatccccctcgacggtgaccgactccttcgcaagtgagcacagccttcaaggccccccgtgtagcagtgagggggttgggtagaaggctgggtcttcccaattctgagcctgtctcttaatgcttctgtctgtcttctgttactacagcaagaaacgcaaagccaggtaaatgagggcaggtgctgagggcaagtgggctgaccagggctgggccttgggccaattgcttccagacatctgaatctggctgaccatctaccccattaccgcacagagaccaagtgtgtctgtctgtggatgtctgtttgaccaagatttggctctgtgactccatgtgtgactgacactccaacactattgtgtctggatgtccttctgttgtaccactagaaacaagttctatgactgaaatgggaagcggcaagtgtgtattagttggtgactctaaactgtctgtgactccagataatttgacttgtttgcctgtggccactgactcccctgagtgtggaactgagaatactgactggctgggctgtgcatcatcagtggtgggcttgtgtggctgtcactggctagggtaaaccttggtgggtgattctggcttatctgtaactctggtttgcctgtacagcatgcagtgtgcccgcttatgattgactctgccagtttgtctgccttctcagaccgcttgctgctacccgaggaaaggattgtgacaagctgtgagcctgtgtctgtgtttgtccaggactgtatctagctgtttgttagcggtttgattgtgtgactttcttcctgtacttactggctcctggttctgtctgatactgagcaagactccaaaaagtaaccgggcagtagtggcacacatctttaatcccagtgttcgggaggcaaaagcagacggatctcttagttcaaggccagactgcctgatctataaaaggagttctgggacagctagggctacacaaagaaaccctatctcaaaaaaagaaaaaagggggaaaagaaaacaacaaaagagagaggtgagaggggagagacagactccaaaaattggaatcacttgaccagtgtccctgagttaaacagccgggcacaaaactcaggcctaatcctatgtacaagatgctctctgcttttgacactgtctgggaaattgacagtgtgtgtgtgcactgtgagtgtttaactgtctctgtatctcacaacgattttattttattgtcttagaaggtgacaaaatctggttagagagctgagaggctgagaaccttttgtctggctgtgaggccattttagcgtgtagggccatgtcatatgccagctcgcccattcatttgggccacatgaaacctatcacctgacagtgtgtgtgtgtgaccatcatagtctgcctcttttgctaccatgtttctgtcttatctatgaagaactcaggccaacttccaggccctctctgactctcttttctctcttctctgctgcattcctgaccccttggggccctaggggcaccatggtaaggtgagtctgtaaggccggggtgccatgaaacatggggggtatcgtgtcggggcccaaatgtaatgcctctcttcctggcccttcacaggtggctacgagcctacgagagtgctgtctccttccacttcagcaactattttgtgggctttctgtctgaggccacagccacattggccggggctggcttcacggaggagaaggaccacctggaatggtggggagggctttggggccccttctcccacagggtgctgcctggaggaactgtagggcggtgggtggtgctcctgggaagggaccagtcaagacaaaaagaaaaactatagcagccggatagcttgagattccaaccgtaatggaatgtctgttttttgcccacagggacctgacagtctctagaccgttgaatgtggagctgccccggtccatggtggaagttgtcacaagctggaacctgcccatgtcttattggttaaataattgtgagtcacccagtcaccactccagaatagttggtgacccagggcctttcatgcatttgtacagcaaacatttactgagcaactactgtgtgatgggcactcaagctgcaccaggggctgttagtgttatttcagtttatagagtgtttgcctagcattcatgaagcccaagatttggcccccagcaccacgtacaaactgggtgtgtacctgcctgtagtcccagctctatagaggtagaggctagacagtcagaaatccaaggtcaggctggagagatggctcagtggttaagagcgctaactgctcttccagaggtgctgagttcaaatcccagcaaccacacagtggctcacaaacatctgtaatgggatgtaatcagatgccctcttctggtgtgtctgaagacagcgactgtgtactcatgtaaataaataaatctaaaaaaaaaatgttaaaaaaaaagaaatccaaggtcatcctcagctgtatagagctgttttaagtcagccttggatccgtaaggtcctgtctcaaaaataagatatgttagggacaacaacaaaaccacacaacatttgctaacctgctagaactgtcaatttggagagtggataatcaataagaaagattatgcagtaagtcaggtagtggtcaatgccacagtaaatcgtaatgatgttgaaacgagaaagagggaataaggagtggtctgggaattatccataatttatccagggaacgtttcactgaggaaagtgaaggaacaaggagtgtgggggaaggaatggaacagatggcgagaacagcaggtgcagaggtcctgaggtgggagttcacctggtgtatatgagagacggcaagacaatcattgggggcatggggacatggctccatggtgggccattgtaaggctcagagttgcatccccagaactggaagacttaaggtctttgggcagacccagggaggggtagtagtaggacatgagttcagagagatcctcaagaggctctgggacctaagaagtctttggctttttctttgagagacagtcactctgggtgaggctgggatccaaggggagtcatttggttttggtttttgttgttgttgttgttgttttttgtttttccagacagggtttctctgtgtagctctggctgtcctggaactcactctgtagaccaggctggcctcaaacacagaaatccgcctgcctctgcctcccaagtgctgggattaaaggcatgtgccaccatcacccggcagaggggagtcatttggatattggatcgtaactgaacccctttggctcgacggagggaagtggagggaagatggatggggtgaaggcagtgaggcccacccactgtagctgactgaggattagcagtagtggtggcaacagcccatggtgagaagtgggcttctgaaggaagagctgattcgatttgccaagagtgtgactgtgtgggaagggagaactttgtcctgaggacctggaagcctgcagggttggctctgactgaccttgggaagtccgactaaagcagactgggagttcattttcaggcttgtgacagttgagggcatcctaaagatgttatcctgagggtcccctacagattatggttatcatcctacctgtgattctctggaaaagttggtgggagttccagaaatcttgacctgtgtctctcccacctgtagatgttttcaaaaatgcccttcgcctggggaccttctctgctgtgctggtcacctatgcagccagtgccctcctgcatgtaagcaagacagaccatgaacaaggggaagtgggtggggggattcagagcctcctcttcactctccttgtccccttgtccgggtctctagggcttcagtttccacctggctgctgtgctgctgtccctggcattcatcacttatgtggaacatggtaagtgcacacagagcctggcacagtacaggtggaaggttcatgggaggctggggctaacctttccatactgtccagtcctcagaaagcgcctggctcagatcctcagtgcctgcatcttgtcaaagcgttgtctgccagactgttcacatcggcatcgcttggtgagggttcatcacgggtaaccttgtacctaacactgcccttcaaaaatgtcacttctgtctccatcttgtatctgtctccgggtacccagcctcctcttctggtgcctgagccatccctaaagcctcccctctattcactggcatctgtttctctaacaggcatttattgagcacctgctgtatactcacctggcattcgtttcccccactgaacatttattgagcacctgctggttctaggtgctggagacaaagtggtgaactaaagcaggccaaagtcctggccctgtgggacaaagattttaattgggtagacaggaaagtcagtcaaggctaagaatagcttgtgaggttgcgagtggcactaagcataaggggacgcggatgggacatatggtggtggtggtttcccttttcactggaaggccaggaaagcctccctgggtgaggcaacttttaagttcttctaagtgaagaagggaagggagggaaacttctcaggaaaagggggtacccagtgtaaaaagccccaccccaacgtgggcctctgagcaacagtgtggcttgagcagagagtgagggggaagggaaagatgggccctctaggtcagggcggggtttgttttggttttgttgttgttttcattctgtttgccataaaaaaaaatgcagacaacctcacatttgtctcccacccggcaaagatgctcatcaccataaccccacattcttgctcctctgcctgaacgctcgcatctcccccaacctggacgccctcgtggttaccaacaccctcgtccttggatacctctgagctcccataagagactccttgaaccatctctttcctatcttggggtaccctgggcatcctgggacccacagtgccttgtgttccccctgggcttccctacacaggtggtggtgggggacagtgaccaagtccagctgccaaatatatccatctgtccaccacagggcctgggggtacgagccttaaacttgctctttggggccctggctatcttccacctgtcctacctgggctccctgtttgatgtcgatgtggacgacaccacagaggagcaggtgaggtggggccctgggctgggaggtaaaccagggatggcagttactgtttgggggaaccttgaaggccaaggcagtgagaacaagccaggaccatgtgtcttagcttgtacaaatgccttccttcatcttcgcactgtctctcaaattcagtcatgctgctggctctttcctttgactaaactgcaatatttacttacttaccctctaaaatgcattctcctgcaatagaatacaaaatccaggcttttctctttttttaactactaggaactgtgaatccaggccctccttcatgttagatacacttgctatacctcctagccccaggttttacttttgtttgtagctttgcttgagacagggtctcagatattctaggctggcctcaaactcagtatttccccaaggtgatcctcctgtctgtacttcctaatgggttgggattacaggcatgcaccaccacacccagttttgtggtctgctagagaccaaaccaagagatgcaaggcatgtaagcactctactgtgttacacaccccagccttgtgtatgggtgtggatgtgggtgggtgggtgggtgtgcacacgtgagagggataggaaagagaggagaggagaggagaggacaggacaggacaggacaggacaggagagactgacttgtgtagctcagactggtctcaaggttattatggagccaaagatgaccttgaatttctaatcatcctgccgccacctcccttgaggtacattatagacctgtgcctctaggtccagtatgctgtgctgggggcagagtccagggcttcctgtgtacagagtagtcaatgtaccagttgagctacgtcgatagccctggatcctgctttaaaatgttatgttccttgtagtggtagtgcacacatccaggtgccagctacatgggatgctgaggcagggatggcctgtgagtccaggagtgttgccacctgtgcaacataactgagaccctactttgaaaaaaaattctcaatttgaaaattagttcatatggcttttgaaaaatctaaaatttgccctttttgggggggtgtcttactttttctctttcttttttttttttcttttgagataggatgtcataggagtctcaaactcagtatcttctgtcttagcctctctagtagttcaattttttaattttgttgttattttcgagacagggtttctcagtgtagccctggctaccctggaactcactatatagaccaggctagcctcaaagtacttttatttttatttgtttatttatttatttatttatttatttatttattatatgtaagtacactgtagttgtcttcagacacaccagaagagggcatcagatctcatgatcggatggttgtgagccagcatatggttgctggaatttgaactcaggacctttagaagagcagtcagtgctcttaactgctgagccatctatctctccagcccctaaaatttttttaaaaagatttatatatatgggtatcccgtctgcatgtatatacaccagaggaaaacatcatatcgcatggaactacagctacagatggctgctagccaccacgtaggtgatgctggaaattgaactcgcccattatactggacttctggaagagcagccaacgtacttaactgctgagccatctctccccaattttaaaattcttttttttaagatttattgattgattgattatatgtgtgtatactgtagctgtcttcagacactccagaagagggcattggatttttgttatagatggttgtgaaccaccatgtagttgctgggatttgaactcaggacctttggaagagcagttgatgctcttaaccgctgagccatctcaccatccccaatttttaaattcttaattgaaaataaaatttcatgttactttcctaattacaaatatttttttagaagttttccttgggctggagagatagctcagtggttaagagcacagactgctcttccaaaggtcctgagttcaaatcccagcaaccacatggtggctcacaaccatctgtaatgagatctgatgccctcttctggtgtgtctgaagtcagctacagtgtacttacatataataaataaataaatcttaaaaaaaaagtttttccttcagattgagtgtagagaatctgaatttgcagctaggcactcaggaggcagaggcaggccctgtctctgagctcaaggccagcctggttcatggagttctataggctggcctgagttccaggacagccagggttacacagagaaaccctgtctcctaaaaaaagtaagtaggtaaagctctgggtgtttttttttgttttgttttgttttgttttgttgttattatcatttcagtccaggctgacttgaaacttgtttgtcaaatctcagtctccctagtgtgaagattacttgtgtctctgggcagtggtggcacacgcctttaatcccaggacacaggaggcagaggcaggcggatctctgagttcaaggccagcctggtctacagatgaagttactggacagccaaggccacaccgagaaacgctgtcttgagaaaaagaaagattacgagagtcagccgtcaagcccactttggtttctttttagagaaaacgttgctctttgtttcagcctcccaaatcgacattataggcgcacaccaccatgtcaggctttaccacttcttaaaacattttagttctggctgtggtagtacatgattttactcccagcactcaggaggcagaggcaggtggatttctgtgagtttgaggccagcctggtctacatagtaagcttcaggccaaccagggctacacacacacacacacacacacacacacacacacacacacacacacaaaccctgccttgaaaaaaaagactttaaggctgggagtatagctcagtggtagagcctttgtctgcctgccatgcttggaatgtgatctttagcacccctaaaacaaaccaaaaaagtaagtattgtagagactcactgcaaaatgtgcacacattcaattttattctattaacccacttcctcaaagcatatcaaaaacatacactctatattttaatttctttccccttgagacagggtttctctgtgtagccctggctgtcctagaactcactctgtagaccaagctggcctcgaactcagaaatcggcctgcctcccaagtgctaagtgctgggactaaaggtgtgcatcaccacgtctggcttcccccaattttttaagtacacagtcttccttttttttttttttcattgcaagaatttgtcagggtttactttgtcctgtattggtagacactcagatttctagtggtctcatatacaaacgacctcagggatcagcatgacccaccacatccaacatatttttaaaataactctttttggtgtgctggaaatcaaaacctggggcctccccatgtagaccctcccatcaagctgtatactcagccccttaaaatgatctttaaagaagaagaaaccaaactgtatctggtcacccttgataagcacctagacccttcttttactcaggaatatgaaataccaaagatccctgggcaagagatgggttttccggagactcactgtccttgttgaatttcaaaatcatgacttgtttctctcccacagggctacggcatggcatacactgtccacaagtggtcagagctcagctgggccagtcactgggtcacttttggatgctggatcttctaccgtctcataggctgaggcatatgaccatcataatccccttcaatacccctccttagggtgccaactctgatgggggatgagaaaagaccctttctctactccttttcccttatccattcttgacccccaacacccctccacacaacataggaacacacacaactttctatgcctgtcaatcctcaccccgccaccaggcaggaagggggtggtccttattgggccaaggaacgatggatacttgggaaagcagacaggagcagatccagggcctctgcgcctgccgtctcccttttttatatgcagtttgttattgtcgaataaaagtagaacttacacaaca

SEQ ID NO: 634 - DNA, 16534 bp, mus musculus; identical to SEQ ID NO: 633

SEQ ID NO: 635 - DNA, 12133 bp, mus musculus; identical to SEQ ID NO: 105

SEQ ID NO: 636 - DNA, 7146 bp, mus musculus
gtgtaccgctaggttccgctaagttcggctaagttcagctaggttcggctgaatgccacttggctcggctaagtttggctggggcctctgggctcgattgggttcggctgagcatcacggggctcgattgggttcagctgagcatcactgggctccattgggttcggctgggagtttgctggagcctggggcaccgctgggcgagccggcgcttctagcctgcactctcagtgggcgtggaaggcggagcgccccctagcgaaactgcgtccccaaacagtgagcaaataggctcgcgctcgagcctcggaggctaccggagcaccggaactcggctgggcgccgcagcagccagcctcaggcgccggcggtgacgccgtcttaacgcgaccgcgcgctgaccagccccggtctccacgtctcaggtttcgcagagacgcatgggaggggagcagttggaggtttatcaagatggcggaagcggaggactctccgggagaacaggaggcagcggcatccaagcccctggtgagttaagaggacagtggcagaagggactgagggcgaggcagagctcccgggaagcgagtcgggaaggcttcgggatcagagagccagagcttcttggctttgcaggcccttggcgtctacaaccagctgacactacacctggtctttgagttagctgcatctcccttccattcgctggccttctgtgcctttctgagactctccgctgtctgtccacactctaggggttctttgacagtgagttaaatgccgagcttggagtggtttctgaagtatcctctatcgctgtcatttatcacgacttgtcaccagtcattgtgaagtactacacaagtaatgaaactgcttctcacaggacgttgtcgttttattggttgtaaccggaacctttacttgcccggtgggtgactcaaagcagctaattattatttgcaggtgcttgctatccccttcatgacacatatgtcactaagagccaccaatactgctttaagaacactggcttcacagttaaccccatgtgagctagagtgcattcgcactgaagcttttgtgagtttgagcatttcgtttcagtgaagggtgtttttgactcttaaactgaaaagaaggtacctgcctttaaaatggcataacttctatgaagtgcctaatacagtcatgagtggaggagtataaggaagtcgttgttacgccctgtcgttcttcttcccaaacagtatttgcttatatactgtttgctcagtaactgctttcatttcttttgttttaaattggcagcgtaacagagaactgaactgagaggcaagggaacttggttcaagtcccagctcttctgcttactagctctatttgttcatctcttcagcaaaaatatttctcgagcatctagagtgttccaggcagtcttttaggcaccaggaatgaaactgtaaaggaggatattgaatctggggctggagctcagcgggaaagagagtgcattacatacgtaagaccctttcggtccaatctccagcactgaagggataaggtcatttgggccatcttatggatcagttgtgaccctgagtaaagtctctctaaacccaagtttagacgttcggaaaatgatgaagctcaccacagaatagtgaaaatatgtaaactaatgcaaacattatgcctcctgccacatagttacaggttacctagctgttcttagtttccctttactccagactgttccccgttctgtaatgcctgtgatgtgtttaagtacgtgtgcaagtttgtacgcatgcacgcatgcatgtgtagacagggcttactgtgttaactaggagtgtttaggaattagttgtattgcccaatgtctgttgagctacttttagttactacgcaaaaccttaaatagccaggcccaactctagaaaatggtgatgtttctgagacattttgcagttgtaagcttaattttctttcccccaatcttttctcagtttgcagggttgtctgatgtgtcaatttctcaggacattcccatagaaggggagattaccatcccctccagagctcgtgctcaagaacatgacagctccacactgaatgaatccattcgtcggaccattgtaagttagacgagttgagagaccacttcagtgttatgggagcgaataggcactaatactttgaaatacttttgtttggttctttgatttttttttaaatatatttcttctactgaaatgtaagagtccccctatgactgagttgttagtgttcttggcaaacaggggccttcatggtgctttgatcagcacaggacatggagttatttttgtttttcagatgcgagatctaaaagctgtgggaaggaaatttatgcatgttttatatccaaggaagagtaatgcactgttaagagactgtgagtatatgaggtttttgaggatttctttcaaaccattgatagtttattggttctgctttataaagcaaaggaaaaagtaataaggcggatgctgctgttttgcaggactaaacagttctgtaaatgaaattgttggcagaagtttagaacagaatttcagaagttgagaggcctggctcatcatattaagttcaccaataaacatgaacgtagaacctgctcacagttgaatttgctaatgtgatttggctgtcgttaggaatccaaggtgattgagattctctctaggccctgacatcacaggcagaatatcttacttgaatattgtgtccatgtggagaacagattgtccatagctcttaatgtgctagaatggggattaggaaatgaagaaagggtaatttatgacacgtgaaaataacaaaccttaaaggatatatgaagtaagggagggaaacagaaaggttgggaaggcttaggtaaaccttgctgctaggattctgagtggaaggtaagtaattaggtaaagatagaaaatatggcatattggtttcttagcatcttgtctttcctctcattgtaggggacctgtggggcccattgatactttgtgtgacacttgcattgtaagtatttatacttcttcctcactggagcctgtttttgtttagttttgttttaatgggctttccagaattaaggaaaaaattgactaggcctttagggcgtcttctattttttttaatttatttattaagaaagaaaagataagagttgtagtatgtagcccacactatcctggaactttctgtgtagcccaggctggcctcaaacttgtgcttctcctgctccaacttctgagtcctagtatttcaagtatgcaccaccacaccataacttaaaatttatatttattgtatactcatttagattataatgtagtttcactttcttgttcttttaataatcacatcaaggaaactggttctgtgccttgaaaggatatgtgttaagagctcttgaaaaaatatatatattgctgagttttaaaagattaaccttagagcatatgtagtttcactacacttattttcagagacaactgtaggcctaaaatgaactcacgtgacatgtctagtgatagtactagcatcagtattgggtcccttgcctcccagcttagttcatattcttgccacctgaccatactcaagtgataggggttccagagaacagattccagcacattctctgtacccagtgctccggacttggaatagaacacacacagccgtagaatacaaacgcctgcacatactatcaggcagtgtaaccgggtaagacttaatatataacatctttatcctatgtaatatgaggttatggacttttttattatttttcaggaaaaacatactgagtctaagtattctaagttcagaattcaaaacattttacatctattaaatttttagatgcagaatatttaagtgacagttcagtatttactcagcttcaaggcaaaggtttttagaaattttatatgtgtttatgtgtgtatgtgtgtattatatatgtatgtgcgtgtgtgtgtatatatatatatatatatatatatatatatatatatatactgatttttaaaaatcagcaacgaaataagtttaaagagtatttctgctattaagcattcgctctaaaaccttagtgcacgaattagaaattcatagctgagcatgctgcctgtaaccctggcacttaagaagctgaggcaagaagatgacaggttagaggcttagcctaggccacacaactagaccttgtttaaaaaaaaaaaaaagaagcaagcaaacagaccatcattcagatttgctaacagctagaaagtaacctaagccctgagaatactgatctgataactggaaaacccttactgtcctgccagctacacctgacggtattgttggaatggaggtcaggtgtgaaaaaatgtcacttttcacataactacagctccctctttgttttgcttgggaatgtaacctcgtgcctcgtacatgctaggtagacactaccactgagataatcctcagcacacaagtacattcttttcttctgactcgagttttctgactccatcatcccagggttgggattatcacccaagccatcttcataaatgcagagtcctaggtgaagccctccaacttagaagtactgtcaagctagatgtaaagctagtctccatgtattatgaacaacaataaagtctcatgcttgggagctatgttcggcccttaagttcaataacttccgcttggacagagagcttttagtaagccagttaaacactctagaaaggtcaaagtgcaacactccttatagtcttcaggcatttgggtttttaaataaggaaccttgccagttctgttagtgttttccttatacaaagtacacattacagaacagattatgtactgatttcagacgagatacgttaccgcagtatgatgagaatgcatgcctttctcgctttgtgtaaaaggttatgtagttttcatactgttttcttaggatgttacagaaaagttccattgatgggaagaatgatggcggaggcccagaattcgcagaagtatttgttatcatctggtttggagcagttaccatcacgctgaattccaaacttcttggcggaaacatgtgggtattcatatgtacctttttcctgcttgctaggtagcacgtgggagatgttaggaaaacagtgctattttgctttttttttttttttaagaaaaattgacttaaggaccaaataaaaagtttctttaaaactcaattgaaatgaattttaaagttcactgataagcttcagcttttctctttaaattttgaacttataggcaaaattattctgaggcatacatttggggcatatggtacaacacattctcagattggtctcttaactagaatagactaagagctatattatagggtcagtgggatacctcgaagaattagagtagattgtttgatattagaaaattgacatttatggggactaacgaagggaacaggaagagaatagagaaaatgaaagtatgcgataacaggagactagacccatgaaattaccattaggataaaggtatagataggctagcaggaaggaggcagtagtgtatagaatgtctataagacatctgtgcaatgagctatgtcttatactactcagtgacacttctgatctgtggatgtgtgtttgcagttctttttttcagagtctctgtgtattagggtactgcattcttcctttgaacatcgcaatgctgatctgccgcttgctgcttttggctggacagggaccaataaacttcatgattcggctttttgtagtgttgttgatgttcgcttggtccgtggtgggtgagtaacagaacataaaacaaccaagataaaacaaagacacgagttaaagataaagagctgatttggaacaaggaaattctgctgtcaaatgaaagtagtatgcatagactcttctgtcctacataagtattaaaggtaatcatatccacattttgtgagctgcctatctgaactctgaagatgtgcagagtcaccaggtatggtgttgtatacttataatcccagctactttggagacttgaggcaagaagtttgcaagttcaaggccagcctggacaactagatcctatctcagaatgaaaactttataacaaggctgggaatatagtactcctcatagtagagtgcttacttagttagcatttatggaccctgggctcaagcctctgcaccacagaacaaaagaaaataaacaaaaagatgtatataaccacattttttgagacagaatctctgtgtcactcagattagccttgaacccatgatcctcctgcctttgcctcttaaattgttgggctactggcctgcaccactctgtccagcatataggagttttcttaatgagtaagatgagtaggcttttattgggtggatagaatgatagcacgttaaagagaactgataggttgcaggcctatagtccccatagtcccaggggacaggtagcagcaggagtattatgagttcaaagtcaactttggctacatggtagggtcaaggccagtggttcaagcatcaagaccttgtttggaaaaagaatgccaataacagcagtaacaaacagacccctttcccccattaactcataaaaatgaagcagtatgagacatttagcataggagcagataaacttactcacatttaaacctgctaagcataactctgtctttctagaatagattaagacacttgcttaagaaggatttgtaccaaattagccaaaaccttttgaagctttagtatatgaaagaagctacccctgggctgttgtaagtttataagtttaccctgcttatgtgtgttggaacctaggaccttgtccatgcttagcaagtactgagatacacacttctgccctataactgaacttgtattattctctgaggagccactaataaaacggaacttttagtgtacttctataatctagattatgccaatgacattggaatttagtaaatattgtagttctgataataggaccatactaaatactcctttttgttttctttagcatctacagcattccttgctgacagccagcctcc

SEQ ID NO: 637 - DNA, 27864 bp, mus musculus
gtaggtgggcggagcaccactacggcttactcgcgaatgctccctctctccgaacctgcgcggcgagcatagtctagttgacaacggctaagcagctactatagctgcaattctggctcgcacctttacccctggctccacgcgtgtcttcttcgagcagccctgcccgcgcttgcctcctatccctttgccgctgtgtggacgcggctgccaagtaagagttggggcgacgtcagggggacacccaggcagactggggccctgacctccagtatcccgcttagccgctgtggcgctccagcccttctgctctcctggcagttccgctgggctgaggacgcgagagacaggaaggaaagtagcccgggctgcctctgcttatgggcggggttcagagttatagaaacttagagacccctgattgtgccggctgcacactcccataggagccccgcaaacggctggtctggtggcctgaggacccctggcgtaactggcgcggcggccttcccagggactcagtgggcggcgggcgctgggcgggggtgcccagtctgccctccttctacttcgggggacatttccaggaaggcttcagccccatggacttttccgtcggcccctgcctcactgccttcccacctggacaactccggagagtgagctgttctcagggtagctgtgcagagcgagttaatcaatacttctgaataagtcgctgggactcagtttgccaggaggtctcacagaagtttagattagaaaagctcagacgaaaggctattagatggaagtttgggggagctctaacttgggtagtctcaatgtctcttccaacacttgctcaagttcagcactgaattaccactcaggaaaccggggttccgccagtccttatgacctcaggcgggtcatgctttcctgagtgacaagtgttttcaatggcatctcaattggcagctagatttctgtatcagaaggaccccggtttcttcagctctgatactggctaacttggtgcctgggcccagtcttttaaaccagtaagtaaagaaagatggtctctgagacacttgggtgactggaggtaggcagtcagcggctcctatgatggttatgcagctagattagctggaaaactactgtggggtagatggcaaactgaatgtgaggaggggcaggacttttttttccccagacaccaggtttctcactttggggaccccagagattgcacttagacatggtattcaggcaaaggactgactggtgtcctagtttgcttgggtctcactcagcgcacccagtaatcctgggagaagagggtaatgaatcacccagggctattttcaaaccttgactcctgctgcagttctagcgcccacgcccactcggagggtttcagtccctgcctgtgccatcagtattcttgctgtctgggtttcctctagccttcccttcttggaatgaaagggagacatttctttcttgggggactggaggtgagcagcccaaggcacaagtggtgtctaggtgagtggtcgagtgggagaggtggagataaagtttttatcctgaagttgtagctgccatttcgctgggtagctggtgttggtccttacttcagagtgttggtctttcttttcgcccaggttcccgacttggaatttctgttccttgaacctctatagttattgctgagagatgccatactgaacagaggctgtttgcccctggtcgcttaccctcattccacagtgctaagggatctttgaagaatgccaggcctctgtgtacgtctgagcttctgccttcaggagaggctgccaggagatgatatctgaagatgtaaagatggcacagtggctatgcaccttgtgtggatgcaaaggaagggacaacgagtcttgtaaagatgatggccttaatatgttcaaggctggagcagaggagcaaaagaaagggggttaccaagagggccaaactggccttcagtcttatctttattaatttttagttaatgagcaaaataatgaatgccactatagtatttccatacatgcatgctgttgtactttgctcataatcactcctctgccacctcttgctccccccatatgtattgacattttaaaaaaaaatccattttggagactacagattggaatgggagcacaggacatctgcagccaggtataagcatagcagcaggatacaccggcaagacagtcacaggggaaggaggggcagtctcgggttgggatgccgctttgccttttgttagctaacttctgcagcatccttgttccagccctggataatgtgtgttccgtgaatggcaagttcttggggaaggatggaaaagagggtcctcatctgaaagaaggggttactttattcttgagttaaaaagataacttttttcttttctctttcctccccccccccttttccccaatttgggtaggatcaaaccttaggccacttggctgcccagtgtggagttgtcagagatttcagggcttggaataggagacctatctatgtgcatcaatgtgttaaagtcttcgaggacctggggctggggggttgttttcttttgttgttgggatgtggggatggaacccttggtctgatgcattctaagctagtactgagatccacccctaaccattggtaagttttatagtccctctcaccccacaaccccaggtgagatgtttgagcactgtgctggtcatgcagttgttggtgacaaaggtttattaatgctttcctaatttgtgactcgggggcttggagtgtgcatgtgcgtgtgcttttatgtacatgggtccttgtcggaatgagtcagtgcagtagaggtctccagtctgcgccatagtcacaagtctgaaatgctgagtttgtgtattgagtttcctctggtgtggtcctccatagtggggacttgcacgctgagcacttgctgttccggtttatcccagccacaagcagggatttcagaatccactgttaagtgccttagcagtccagggtgtcccagaacaaagaacaagggattggaggtctaaatccagtctctgttgttctctccacactgtcacccctcgggtggctttcttctttgtacttcaccggattaaacaaggggatcaatagctaagtgctttgtaagctacaaaaggctagggctagctagttctcaggaaggacccatggttctgacacccactattgggaaatccgccatccagttgaggggtttagtggcctgagacactcctcattgaggacttaaaaatattattaaaaaattaagcatatttttaaaagggaagcaatcagtgtaattagggctcaagaaccatatagtcccacctactgcttttcttgttactttgaaacaaatctcagacttgtgtgttatcaaattgaactaaaaatagaccagtgtatctttctaaaagagaaaggacttgcagcaaaataaccacagtgtcagctatcacaccaaacctagtcccctagtgtcacccgaagtgtggttagtagtcacatttccagttgttttgccctggagttcagaccagggggaattgctgaggaggaggtgactgacaagtaggagacatttgatctgggctgcagaacacaggctagagggattatagagctcgggcctcttcattttccagatgccacattgccagtagcagatgtgagctgctctggggctcctgatcccgcggctgacttgtagaagcttcttgcagaaacttcagaaactcctggccttcattcctgaagtagcaaaagagagattgaattcccacttgactcctgtgctaggggccacccaagagtttgaggtcaacaggcctgggagaattcctaggaggttgctctctttctccaggcccctccccggctccaggaccccgaggccaatttgaagcaaaacaggatgcatccaggatgagcgccttttccagcttgtcatctaatcaccaaggcccagcttggagcttcctctttcatttatgataaaaaaaacaaaacaaaacaaaaaaccctttgctgtctctctcttttccctccttcctcattgagggtagctgacttccttcatttccggggccagccctcctctagccccatgtgggcagggtggcctgcctctgcctcacctaccccactgttgctttgtcaaggagataaagaccccaggaatgtcctgtctgaagacagcttcttgctcttgggctgtccttgggagaggagtggcccctttccaacaagcctggggtcctgccactgcttggttaatgattgagccacatactaaccaccttgcaaagtcacctctacagaatggccattaactaactccctggctactccaagccttaaagggaccccatcctaaacctttccctcctcccagagggataccgactaataccaaatcatgagaacttctggagccaattaaaattctgctcctctagtctatgtttaagcaaacagaagcagttattcccgttgtttgaagtatgtatacttatacttggaatagatgtcaatggggtttttgttgctgttggtggtggtggtgtttttggttggttttggttttggttttggttttctgttggtttgtttggcattagagtaagaaagaggtttgggtatctctagcagcttaaaagaacaagaactaagcctggtagtacaagcttgtaaccctagctactcagaaagctgcatcagaagggtcctaagttcaatacatgtcttactacagagtaaatttaaaggacatccagacaacctagcaagaccctgcctcaaaatgagagggggggagacggagaggtggagggagacggagacagagagggagggagggagggagagagagagagagagagagagagagagagagagagagagagaggtctcagctcccatcccaggtctcagtgtcccatcccaggcgctgctgctatggggagctgggagccagtgagccaagagggaagagcttcgggcgtgaaagaaaagagtctttttaaccaagaacctgtatctagacaggtagtgagaagagtccaactggaacccagaaacaatttagaaagttctaggccacatgcacttctctatagtcccagaaggaacagaggaatcaacatttcacgaactctgtgtgtctaccggagccaggaacttggcctccgtttctgtttctgagtgacttcaggaaaaggcatgtgtacctgaggggtcttggggcctcaatttctccatctgtaaattgggtggggcaggtacactgactcagaatttcctagctccctttccagctatgcgagcctgtgttcccacgtaataccttttgcttatccacagtgtgatacaggttcagggtgatacagattcaaccaggtccaggcactaatctccacagcctgtgtctggttgagctgtctgagtcctggagtttcctcaaaggcatgtgtaatctggtccctagcccctctccatgtaggtatctgccttaggaggtctccttctgatccattcagactcaagttaatgagtgactttttcctcggggggggggggggaatataagcccaaggtgtccctgggatctcaggactctggggatcagggagggcttggcctgtttctctttttctccccactcaccatctcccctagtggtaggtatgcaaacggagtcagggggagaaggacatgtagaggacacgagggccccaccccttctgaagctagactctctcccctgtcattgcacagtcactatttacctggcttcagcatcctggaacaatagaagttacaagacgttgtttcccatcaatgggattactgcaagttagtgtcctgttacacacagaatagtatctccttgaggcatcgaagcctgacacccagttctgccccttggagctacctagaatcgcctttttgcctctgactttctgacgtctgaagactgagcacagatccctccgttttctccagcctacacagctcagctcctgcaaagattccttctagacatgggtcgacccctgccctcctcagcctcatcattgtcccctggatgtgctattgcgtgtggcccttttaacagtgcggtatgccccattctctgaacttttcaggatgaccatctcagtcatccctctctaatgatcacaacaggcaggcgctaagccccaggatcttgagccgagacattttatacaaccctatcccggtccaaccagatctctgacttggggaacctttgttgcgaggcctttctggtatcctcttccttgacagataacgagactgttgagggtaggtattcagctgattataatgtcgcctgggtaggggggcttgaacactgtgcttttctgccgtgtgttttcagcaactggtatggtgggaggaagggggtattttagggactactgaagccagaaatgaggatgagctaggcccacagtggggactatgagagtgaatcagaccagagagaaataccaactcagtcactccttcctgtggcaagtgatgaggagagcaaccaggcccatttctttcgtttccaggaccctgtgtgctctcagagtagtctgaccaagtagctcccccagccccatccctctgctgtgatcctcaggagaggaagggaacggtttgcaacgaggcaagatttgggacccaggtctcctgacactcagctctgcctgttttccacaaaccacacccagcagccagggcagctggggctgacgaggcagcttcctcaccacagaggaagctctgcctgagcggcagctctgttcctgcagtagatggagcaacctccaggggagctggcctgggatttcctgtcctttatctaggctggccaaagactggcttgtctgaggtatggacttgtatcccaccattttgctccaggctgaggtcaaatcaggccgggcagggtcagagactttttgtaggaagggcttggctctaaacaactggctcacatagcctgtaccccagcacgaccttctcaatgggcaaaaaacagagaggctaaggatgaagcacctttgataatatacttgcctagcattgcaagaagtcctgggttttagggattactgaaagaactacggggtactgaattccctatgccccataaacgggatgtggtggtcatgaacacctgatcctagcacttaggaggtagagcggatgaatcagaaagtgaaggtctgtcctcagctacctagcaattgtgataccagcttgagacatataggaccctggcaaaaagaaagaaagataaggagagagcgcggcgtggggaaaagggcaagagtcgagcctatgtcaaaagcaagagtgtgctgtgaagaataggatctctgctttgatagtctcctacaaagccttgggtggcttcacctctctgaacggggcatctgccaacaacgaggagacatgtacctacctctcagggttgctaagcattcattctgactatataaacaaaatccttgtgtgagtgtcactaagtagtacttgggggagcctggttcttttgctgctttcactgacctggggttctacagggcttcagcgcaccacctccatgcattgagtctggactttcctgtgacttcaggttctgttccatctaggaaatttctcttgttgtccttatagggctccttcctctggtcatctttggtgacatttgtaacactgcaacaggctgtgctaatgatgtcaatagcaataatggtgccctattctaaattcttgacaattttttttttaccatacttagaccccgtgacaattccttaaggcagttagagctattatcttccctgccttacgtataatgaagatgagtaaggagagatttttttaaaatgcccaaggtcaggcgattgaggagcgataaaaagaccacccaggtagtctgactatacctcctataagctgcatagctgactctctttcttgacccttgacctggaggaaaaggcacaggtttggacctctcttttccctccaagtgcacatcaaatccagaagcaattaatctttctggccagtcagtctcccagatcgcttgcctccttgcacccccaccccaccccacccccaaggtaagaggaggaaaaacatgaagtagtgggataaagactccaaaatagagtctcagcagggttgaggagggcctgaaggagggaccgggggtggttctggcatgggcacggagagtcgggagcagggtgctgggtgtcactggggaagaagagacattttaatgtgctgtcttgacaacgggttgcattatttagaacgtgtgggtgggtaggggtgggcagaagatggggtagattagcgcttaggagatcccgtcagctcctgtagcccatgcttgtattgggattatgtgggtggggaagttgaccagaaagaacatctagcctccctcacccccttcaagtttacccatttcagactctttgggggctgcaagcttccttccttagactgtgctagctgccagctcccctgctttggagcttgttccctgttatcttgtcctcaaaggatagtttgtcccagtctctgcccttcctgagtaggatgggccagataacacctctggccaaaacactgggagagcttttgttgtgttttcggaccttggtgtccacccagcacagggcctgctactaagtaaatgctggagtactgtgacttgaggccactcacagttcacaaggaatggttttggaggggaaattcaagagaggctgacatgggaactcacgaataggaggggttctggcacttggcaggtttctggccccatctgtactccagcagaagagacctgatctctcacaacattccgttctatgtttgtgcaatgggcgttacttgctttgcactgggttgctgtgaccaccaggtggactgtgaggtgatccagtgcttctcccatggatgggagttacttcacgctaagccttcaaactgtgctcccaaggactcgcatgcaggcctgggggttgagagggtgggcaggttggggacagtgagatcagtggagggccagtggttagccctgttttgagatcttcaaatagccatgcgcacaccatccaccacacacacaggataactgggctgctatctcatttgatctttacaaacaacacgttggttctgagattacaaccccattttagagataaggacactgaggcccagggaaattattaagcttaaggaacaccatctgtgcagtccttggaaacacactaactctttagtaactgtactgcctgtgatagtatactatctgtattcgttgttgttcaatttggtatcatacattttgccactaatgagcagagcccatcaacaagcagcaagcccaggactgtcttgaggctcgtagcctctcttttcccaccttatcccacgatgctgttcctgtaggtcttacacatctggcaggtcaccattggaactctccatctgatggtcctatcatgaccaaagcactcgaactgtcagtccatgtgcacaccacagccctctctctggctggtggcagggctcaggggaggggttgtgtcagctcgcttcttgaagaggccacttctttcagacccatttcctttctgtcagagacagtttttttttttctggatcccagggtggggccaggctactttaaggcatttcctgcccagagtttatatttggcttcagcaaaaggaaagggaaataggcaaagggagtaggactaaaaggtggtggcgcggggtcaaaataagtgaacaccgaagcttggcaggccgagagggaagtgggaggtaatgagtgctcctgaacagctcaggtgaacttccttgcccatacttaagctcaagtgcaagagctaatagctcccccagggcggaatgcctccacccttaggcagagttcattctcagttctcatacctggatagtcccgaccctttgctttctgccccagggcatgatgttctgctgagcagtgctgcctgaagtacagcagctgcgagcctcaggtaggatgcttgcttcagaagaggagctagagccagatgtgcatacactgttaagttgggaagcagagcttcctgtccaggcattgccagaacattcagtatcccttagcacactgcattgagagcaccaagacaacaggacccagtgcaatggagcaatcagtcaaactgggaagacagcttcgcatgccggtgaatggtgagaggccaggagggaggcttcatgggttggaatgctcgatctagtctgtagcttgggtgtctgtttagaagtaggccaatttctgccctaggctttgggcaaggttgggtttttgggggccagttaggtttcagaaccggaagcgtaaccagattagggctggggtctttgggagaagaaggctggtagggtagcctgttgagaggagagactggagactagaaaaagagagggctgaggtgctctaggcatgagaacctagaacataattgtatggaaaagctgaccatttagtgggagaagttgttagaagctgagatgactcaatgtgtaggaggagacaggaggacaaggtggtggatggtttttgaggcaagaacatcagcagaattcttccctcccatttcctccttgaggacctaagcccaaatgcatcttcctccacaatcaaggacaactcctttgccgaaccaccaactgcccttgccagctcagactccagggcttggggaatagccactagaagatgagaaactcggttcatacagaaatagtggcttcccaaaggttacacacgagttagtaagggagctgaagctataaggtggcttgcctgaccttcagcccaaaagtttgaacccatattgcagtggagagagcggttactcctggtctagcatctgccttagactagtttcgttggcatctcattcctctaggctggagactggaaggagtgaaatagcacatggcttattaaaacaaatatctttccttgtcactggtcaccttgtcagagcacctaggactgagttggagacagtaacccctaggggcaagaaagctaagagagcaacttcagcagagcaggtggcagctttgaccttcactgtcacagggaagctctggactgggtaagaatgtcagctgtctgctttggccccactgtgtcagttactagccttggagaccacaggcctggctgtgtctggacccagattctcaaacagcccgagtgaaccaggatttacctcagagctcatgtgaatcttattatttacagccaccagtactttggggagttggagaggagacactgttctagtgtcttttggggggtcttgaataatttccatatatgtagaacttcataccagagctgccacctctctagctcacccgtaaagtctagggaccaccactgacaaacgtatgtattctttacttcatcaccaggacatctcccaaaatagatatggctgccttaaggcatctgaggcccccttggcaagattgaagttaacacttcagagacccccctccccccaaccctgcatctaggtaggatggccaaaaatgtctccagacattgtcaaatggcaagggaatttgtccctggatgggaatccattcattagagactccaagttttaccctgtgagcaggtacagacatgaagtgtcagaggagaggcacattacagggtctgcacaagtagccaaaaacttcagttgtttgatggctcgctaccgcccgctcccagacagcctccctgtatgtaggctgtttgctttgtgggtacttcatttgtgacaggaagactccaaaagtattgctcacatgggcccaggagcttggcatccagctgcagttccggcagagactcgggctggcatctgaacaggtgcagccgggcccctagtcctgccctacgacctagcaagcaggaggccagccagtgtcttgtactgccaaagtaggctggctgaaatacagcggcccttgctgtggtgcccctccagtggggttcggaatgtgggatgggagctattttggtcttgtctcccttcctccctgtgcctccctcccctgccagaattgaattagagtggcaattccagctaggagcagcaatagcagaaagtgcctgtggatgtgccgggccttctagtaggcaggaaatcatctactctcttccacttcatggtcaagaagggacgtttcagtggccccagaatacctgctagttgagtaaagaccctttctctttgtcctggagaggtagggaaatcaactagttacctgttacagcgtctctcacccaggactgctgtcaacatgcacaaactgcagtgaggctatacctgtaagagtcccattcctgtgccagactcaaaggctatgtggacaaggtgtgtccatatgctagacatgaaaggaactggtcataagcaaggatggtagcttctaagatagaaagttccctcccaaggccattctgtcttgaaaaggctcctttccaggggttcggagggaaaacaggaaatggaccttagatcagccaagaagaatgaactaagaaactttttggcagagctagttgcagtggcagggtcggtactggtatgtagctccactgtctgcctccctctcctagcccaacaacacaggggctcaccttagcttcatagagcccaccctgagaacttacattgacccatagacagtggtatcccagtacccttgggatgctagcgtttcctccggttcatgctaaaagtgaaagagagcagtgttgataccagaccctgcttgtgaggcatccaacctatgacaagggccacagggaagatgcctttccaaacaggaggctaatcattaagataaaggagatcaccatgtttgccgaaagataggaagtcaactaatgatttaactgacctctgcaagtacctgagactccttcccctttccctaccatatgcacccatatcagtgttgcttgtattctcttgtctataccctcaaggcctggagcaaacttcagcccgtggcttagaacaggcttgattctgggctctagagaacatcttttcaggactctctctctctctctctctctctctctctctctctctctctctctctctctgtgtgtgtgtgtgtgtgtgtgtgtgtgtgtgtgtgtgtgtttcattgccaagactgttagggcactagttatctttttgttctttataatcacttgtagaactcacagaagcaaagaaacaaatgaaaaccaactttatcccaagagattctaatttaattagtcatgggcagagccagggcactggcacatttcaaatctccccaggagttaatgtgcacctagtataagctgagggagaaatggcatacccaagagcagtaattaacaagagacattttcttgtcagcccttgtgacatctgttcattccttcttttgggccctttgtcttacctggtacacaaaaaagatgggctttttttttttttttttttttttggtggagaaaaagaacgatgaacctggagcctgggcagcactttcacagatcactgagtatctatagacagaaggaccctaatttaaggcccttaatcacatgtgaagaggggtacccatccctggactaaggttcaagcggctggctgagtgaagccttacttacctcctgcaacatcgttctctctctctctctctctctctctctctctctctctctctctgtgtgtgtgtgtgtgtgtgtgtgtgtgtgtgtgtgtgtgtgtgtgtgtctccatctcccccatattaaaacaggatctccatgtgtcttaaagtctcacgaagttacaaagttcagatagccttaagcaaactagccccctgtaatgacaacttttgtcatatttcaaaccgatgaaggaagactgtgggtgtacggctcaactgcagagtgcttgcctagcctggacaaatggggccttagagtctatctccagtgcagaaataaacaggaagaggaggggaggaagaagagggggagaagaatgaagagggggagaactggggaggaggaagaggagcagtcgtacagctaaaggttaccacctgtatggtaacctaggaactcagaagagaatcttcttttttttttcttctattgatagtagaatctttccttatatgtcctgattatagtccctcccctacgcctcccagttccttccacttctcctctactccggatccacttaatttccttctttcattagaaaagaataggcctcaaagatataacatccaaaaaaaaaatgaccaaataacatataagaagaggaagcaaaaactatcagatcgaagaaaaaaaaaaaaagtaagagtcccaagagcaggcacaggagtcagagacccacttgttcattcaggagtcccataaaagcactgaactgaaagctacagcaaaaatgcaggggacccagtgtgggccctgagcttgctgcttcagcatctgtgagttcatctatgccttgcttagttgattcagagggctttgttctagcaggagcgtctttaatcctcactgtataaatgtgggaaccgtagtttagagaatgaagtgaggtacccagggaacctggctcaattcgaatttttttctcaatttacttattattaggcattatcctcttagacagatactgctgcttttttttttctgagtgtatgaaatgttcccatgttcatagaatgtgagctataggacccctggttttcaccttggtccctcctctgcaaaacaaacaaacaaacaaaaatttaaaaatatctatgctaagaagatctatggtatttgacttgtatacctgcaggtacgtatattgtcattgacttctgaaaccttgtgacagctctgtataccagtatcctttttctgacattctttacaggagaattgtgggtaaaactgtgaggcctaactcctgtcaggagcttactattaccctaggccctgtatcagttaggcacttcccctgaggagattgagctttaatatagatggaatccagtttgtaccagctaaatgctgttactgacctgtcctggctttgaccagagcactagctgcagagtacaacacttgaaactactggcagtcgtgctctggaatttgcacatctggacacagaggttacggccaggggctacagacattcctaccccactcgcctcagcctgccctgtgtcactcttcctgctgggcacataagccagtgctcagtctgggctgtgctagttccagcctcaggtgagttgactctgaaggaggggggggcggggtcacttctggccttgccagacaggctggggcatgttggatgaatggaacaaagtactttagctcaccccttaatcaccaagacatatgtccctgactgctccatctgagaaggagcctcagggcctccaggtcttcctgaaatgctggattgtcgaagtcagtgtccctgacatcctgctctgtaataacccattacattctctggattcctgctatggagaactgctgaggaattcagtcctgagacctaccccaaactcctttgtcttgcagcccttccaaagtccctgcttcttaacctcccttccctgggccatttagctccaattctgagagtgatgggactcgttgctcagacacagaggcacatgtcagccaggccactctccagttccccccttttattcaggactttcaaaaccagatctgagagggagcacagttagtgtgggcttggcataagatgccaatagtttttccctttttattgttttgcttaatgctctttttagtggaggcaatagagagattatatagcttgctcactgtcaaagagttggtgcctggaaatatcaggatttgagcacaggcttgtgatttctcagaacttagaattggttctttgcttgtatggaatctgagggctggtagtgtaatgtcctggaaaagaatactgaacatggaattaaatgtttaggtttagagcttcagttatgatacttacttctgggggatactagagagttactttaaaaaattatttttgggtgtgagtgtcctcatgcattatagatttaaaaatattgatacagggctggagagatggtgagatcgcatgtgtgcatacatgtgtgcacacacaaacaaacaaatacatttaaaaaaaacacatgaaatgtccctggcatgcagaggattagtgagcataccagtttcgttacctttttaccttttagaggtctcgttgccttttcacacctctctggaaagtctgaccagctccattctttagatttttttatcctagtaagaggacagcaaaagcgggttgccgtgctgtgggtgctgagatattagaaatgccttctgttggggctatgatggaaacagaggacaagggagtgactgtggacagcagcttagttgtccttgtggcccaaccatatgcttcagatgctctctcctcgtgcaattccacttttcccttctattaaccctgaacgactggcccggggacatgcatctttcatttagacctgcattgccccctgccagatgagctgaggtactgctagtagggctctgaccctaagaagcctcacagaaggccccttctcctgctctgctctctcttgtgtacttgagtgttttaagagtccttcttctcatcaatcctggctgccaggatctcctcctagacttcctcgtctgggcactaagattatagagctctttctgtctttgaagaaaccctgcagtctccctagagttctttggtcagcagggccaccacacagagaggaaacgttgagggcaagactccatggtcaggggaactctttggagaccagcagctttcccctgccaagcccatagtgccacagtccacggtggcaggatcctccggggcagtgccttggctacacctgcgtggggaacaggtagctactgctggatagttccagagcactgctgctagtgtttttgtgtctttggtggccagtagagcctcttctgtagctttggttgtgcgctgtgtccagttctgtgctaggccctcccagaacagaagagatagaccagtccagctattccccccccccaaagccagcactgtgacagcctaaagttcagcactagagtgttccacaaataggctgagcccataaggacaggtagacctgtcctgggaagccacctggggaaggtggactgcacattaatgagtagggagagaggggaaaaactagggaagctggtatgctaagggctggaagaccagaaaagagtcagacttatctaggactctggtcccagcataggtaaatctcctctcccgttctttccacttccctcctttcctctcagtttctcaagcccaggctggccttgaactcacacctcccacctccaccacctaagtgctgggattatcggtatgtcttatgtctggcttgagtcattctctttccgagtttgtctctatggctgttgtcctgagaagaagagctttctcttacaggcaatgcggtgttaaatgagacttaccctttcagtgggttggatgatggtaagtatgttaatgagaaaggaagtagtaagagttgttggacattttgcatccccaagctgaactaggagactctgactaggacctggaagattgacaatcctagaagccactgggggtattgtgttctggtctaggtcatgggttgggagagtgggaaggatttgggacaggcagggaatgagattcaagaaagctgagtgatacagtaaatggagctcagggagcagagggtgccctcattggccagtcaccttgtgccttccttgtcaccagaactagacatgcttgcctactgggtgtgaggcagtactcagccaacaatttgctaatcccattactctgcctgtttcttttcctctgttctcttttagaagcggaggccaaaaaagcatgtgaatggctccgggccacaggattctctcagtatgctcagctttttgaaggtaaagtcactcaattgctctcccttccctgttccaaaacctgctttctccggcagcttttcatctgcagaatgggaaaaacacatgcctactgcagccacacaaaaactcctgtgcatcctgatcatctttgtgcagggaatttattccgggtgctcagaactctctacctcttagttccagacaagttttaaaggactccaacccacccccgaccccaccccccacccccggcatcctgcttatcctcctgttgtgtccttcctggtggctcagtcttggaccccacttcgcccatggcaatggcctcacatctgttttccttctcttctctgtatttttctgggttctgttcttagagttccagccctcaccttactcttctctctcaatagtatttggtgcgagtagccactcccttttgtcttctgaaatacctcttcatctctgcctgctgccctcagtctgcttgctgcctctgcttcttctaactggcattcaaacattagggtatcccagggctcagccttttgctttcccacatttctttgctatgagatcctcgttgatctccagtgacagctcctggaggggtctgtccaggcctcatttcaaagcttctgatttcctctagtgagccaccaatttaatgtctttactctgagacctttaggtgcctttgagatttttctaagccaggaaaaaaaaaaccaacaacaacctcctaaagacatagccatccaccctattccatatccaggaattattctgaattcccttcttccccatggccaaacatcctgcaagctttttcttctggaatgaattcatttcttaacgcctccgctgccaggtctgttgtgatccaccaccgctcactcagactagggtaccagggtccttcttgacctccatgcttctatttcacttccccagacctgcccttgtcagtgactgaccatgcgactcagatactttgataagtggaatgcgtgccagtactacactctggctagctactgttctcctttgctcactacacccttgctctttcctacttgctctaacccaggctctccctcatcataatcttagtcattttatttcttctggacaaaatactctttccaatttctctgcttagccacctttttctcagtcttcaagtcttgctgtctctgtctccgtctctgtctccctccccctccttcttcccgcccccctctctgaaactgcccctagaaaggcctgggctacctctatctcattaagtagtcacactgccacagccagccaccagcctctctttgccctgtcaacctgcttaggcttttcatggcctttgtgttgttcatctaggttttgcacattgtttcttgcctgtttcctatgagagcgtaagctccctgaaggcaaggacctgtttctgtgttgttcaccactactttgtgccgtgctcagtgactggatgtgtgatgggttttttttctctctctcccttttctcctgatgtcttggtttttcctctcctttccctgagtcctgagaagatggctcccactgctctggaaagacattgtatggctacatgcgggccgctctgtccttgttccctccctccatcccattatttgccttgggctggcaggaggtcccctatctgaaagctcagaattcgaatgaaagagaacacaagatggctcttggcagccatggagagtctcaagcttgttgtctggacctaggcctgcttgacttgtttcttcatttcatctcaggctcccaggacattcttgagattctccctcaactaccaactccctgggtcttctctgcctcattaactttcgttccccgtgacacaatacctgagacaaacaactggaaaggagggacaatttacttggcctcggggtttccatccatggttgtttggtcatgttgctttgggcctgtggccaggcagagcatcacagtggaaagtggactggaggaaagttccatgtctcagggtaggctaaagaggaagggtccgtaggaatagagtggacagggatgcaattctgatacccattcaatgactcaactctttctactgggctcaacttcctaaaggctccaccaccttctaggcacctgcagttggggacataagcttccatcccatgccttacactctgcagcatggttctcaagttctaaatgcttctcacccttcctaatgttgcaaccctttaatacagttcctcacattttcctaaccccaaccataaaattatcttgttgctacttcataactgtaatttgctactgctatgaattgtcatgtaagtatctaatatgcaggatatctgatagggaaccccatggggcgaaggtctaaggcttagagagactttaagaaccaaaccctaccacctctattgtattcccaggctctctgtgtgctatggcccctgccttcttgcttcctgtcttccttgctccaacccctgcaggtcaagtgtagctggggccatttctgatcccctactagactcatcgttgcttctttccaccacacagaaggtgtattccccctggatattggctctgtgaagaaggactacagttttctggaccaggactctctgggggccctgtgcaggtagggggctgagggccagacctaggaagccttgagcccaattttgtgcttctttgtagaaaagacaaccgccttgtaccttctattagaagggagcataatttatgaatgaggctcattttctgcagtcacattgctcattatagttactgtatctatgatccccaactctacccctatcactgtagctagaagatccagatctggtcttgattcaaattcctcagagcatgccttgcactcagtctctttcaactgaaaccagttctgctgtttcctaaggttaaaccactatttctccttgagtttattaaagttgcctcagtggctagcccctgttttctgctcctccttcccaacaaagccatcttctctacagccaccagaatcaccattttaaaaccccaggtaggcaccctctcctgtttaaaaatatgccactgcctctatgcaaaaatacaaaaccatctcagcatgacacctttggcacccttcttttgacctccctcagctttaagcacactctctcctgctagcttctttgttgactgactgtggccttccttctttaccttgtcacaggctcccacagaagtctggaatagctattcctgtgtcttttatcctcagtaccccatctctgctttccaggaagccttctgagactgtaccccatctcttcctgaaagttcctggtctcatccttggtgtgtctgctgtccctctgcatgctctgttcttgatttctatatctctcagtacccagaagacagagaggctctaatcttcccagcatcatacttaagacatcatggacattaatcttggaagagttttgaccacttgaccatgggaaatggtggatggcatcttgcaagtgtcttggtaggctatctcaggctctggggaattgaggaccttgggtgaacacatcctttgtgttgcaggaggctgatgaccctgaacaattgtgcttcgatgaagcttgaggttcattttcaatgcaagcaggtgaatcctggcaaggggtgaggtcacggtacctggcacagtgctggaacacgcacttgcgaacaagctctagcgtgggggtggagatgcagggacctcctgtactgcaggtcctatgagatcgcttaggcttttggtgagcatcacctatagggacatgtgcgagcaagtaccctggctcatgcctgactctactccgtactcaatccacctctcccatttgtttatgtcaataacttgatgtaatgatggccttcctcagagaaaaccatttacctccactgcttggtttgtcatagctaaaattccttgaacaggagaagggacgggacagtgtagcagaaaggtcattggctcgatggtattagaagtcaggatcaccatagccttacctccataagatcttcctcccttggcccctagcctcatttttcccatcactaaaatgagtcaggcgactggactgataactgtctaaggccctcccgtaaggcctctttgtatacagcctcaaaaatgagccttatggcctcattgtttctgcaggacaaattttgctggtttcctctggagctttccctaccagaggcctgcagtcaggtagggtagccaaactgacaaagcactgcctggggacacttcggtcactgacaactaaaagtgccctttgtcaagcttcaactcctgtctggatgtttcctccccttgccaaggagaaaatgaattagaaaacctaaaatcctctccagctcttagatgccataattttaatttaaagctatggccaatgaacatttaataatctctttcattgacgtaaccatgacaacaaatgatgttgggcaaatgtctcctgatttgagtcacattccctatctgtgaattggggacagtagattaattagatgacggtcactatacatctagattccatctacgattactagtgagagacagctttctgttcctactccatgtcctctaccagaaggcaaagttcctcaccctgccctaccccaaagcacttggcagcagagtagggcacaagcaggtacttgtctgttgggcttctgtgaccccttcctatgatgcctccccaggatgacgactcagaagaggaggagcaatgcaccattagcagccactgggcctttgagcaggaaagcaagtgtgggtctctcatgggctcttctgccctgctggccccaccaagccctagcctcctggggacctcaagctgcgaaagcgtcctcactgagcttagcgctgcctccctgccagccatctccgcgagcctttcaccagagtcagcagaccagcccttgttaggtcttgtccccagcccaagtaaccaacccttccttagtcccccccaaggccaggagggttcccaagacaaagtaaagaagcattattctcgaagcttcctcaagcaccttgaatctctgaggaggaaagaaaagggtgacagccggcagacagaacccgagcaatgccttgccacctcggaaaaggccaccaaagcttcatctttccgcacttgccgtggcttcctctcagctggatttcacagggccaagaacagggtcaccacttcagccagggtcagagatggtgagactcagaaagcctgggaggcttggcctgtagccacattccggcatcctcagcctatacgcaggcgtgactatctggtgcatgtgcctggggaccataagccaggcacgttccctcgttctctgtccattgagagcctttgtccagatgaaggtcgtcacctggcagattggcagtcaagtaggtgctggggctatgaagggcgccggggctcctgtggttccacaggcagccatgccagcacttacgacaacttgcctgagctgtacccagctgagcctatacaggctgaagctgaggctgaagctgaggagggtgaaggcagctatgcccatctagatgacatcctggagcatgtgtgggggctacagcaacgggtagagctgtggtctcagaccatgtacccagacctgaggcctggagataaggaggaagaggaggaggaggaggaggaagaggaggaagctacttcatcagtggaagtagccacagtggaggtggaaggccaggatgaagatctagctcaggcagagtctcaagcccacagagggttcccaacccaagtcaaggaggaagtcccactgattgttctggatcaggccccaaatgtggtcgaaccattggtacaggctgaggctgaggctccagctcaggcccaggatcttgagcaagaagctaactcgactgcagagccaatttctgcctccagcctgtctgtggaggaagggcattccatttctgacacagcggtttcctccagtgagcttgacagtagtggcaactccatgaatgaggctgatgctgcagacgcccctgcaggactgcaagcatcagtaccccgtgaacgtcgtgactcaggtgtcggggcctcgcttaccagaccatgcaggtaggagtttggagtagggatgggggtgggactccttctcagcctgtgccttctttctcatctgctttcctagttgtaaagcccaggggaaagttcttgggggccaggagatcatttccaggcagccagtcccaagagaaaaggaggccaagttcaagaatccagagttctaagtgttcagtacaagctctaagcctggtgtggccttgagaaagtgttgcctcttctggacttggtttcctcatcttagcagcaagggtgttagagatggccactgcttctcagctttgatcatgacagttgcttgccatggtagccttagaatggggtcgagactggcactgtctcttgggactaaatgggtctgagaacttggtgccaccctccatgggagcttcttgaaccttgggtgacccaaaggttgaagtcaatcatttgctaccccaaagcatcgtagtagcaatcatcgcgtccccacttccccatttccccatacttcctttctgggcagggataggatggggctatatatttaaaaaaaaaaaaaaaaggaccagaaggagatggccttctctaaggcctagaaaaccggtgtctcaggtactctctgcccctctcccttcaggaaacttcgttggcacagcttccagaattcccaccgacctagcctcaactcagagtcactggagatcaacaggcagtttgcaggccagatcaacttgcttcacaagggctcactgctgcggctcactggcttcatggagaagtacactgtaccccacaaacaggcctgggtatggtgagtgcctcttgagccatacaggacgggagctgtgggctttcttagattttatgccctgggagcacagcccagaggcaggacagacaggcaggctgagcccacaggccagtggagtggtactgttccaggaggctgggcgttgggggggaaggggcgggccgggggatactgagttagaatagacatgttctggaaatccccaggtccaccagctgtcctttctccttcccaccctccctactgccaccagtgagattgtcctaaagtacacttcggttgtcgtgtattgagtaaataaacagccttgtggcttcccgttgtccagattcctttctgtcctgatcctctcatgtagccccatccctctggccctttagtcacccgttctcaagcaatgtcatctgacagcctgtgggactagttgaccttctctctgtgcctttgttcatgctgtcctttctacctggagtgcctttgccttagtcctcctatgggacaagagtgctctgtcctgcagtgagtggtctgcggagttaccacctccactctgtaggcctctctaacttagtaggtggacttctccttcctaatggctcttcttctaagttcaagacctactgcgggccacatgaattacgatgagggctcctatgttcctatggcttttgccagctgaggctaaagcaggcgctcactgaatgtgcttcctgagggcataacatgatccctggctctcacttctggacaagagacagtcttcaagccgagttctcttttcctgatttcttgttaacccctccacacacaggtcaatgcccaagtttatgaaaagaaacaagaccccagactaccggggacaccatgtatttggggtgccacccctcattcatgtgcagcgcacaggccagcctctgcctcagagcatccagcaagctatgcgatacctacgaagccagtgcctagaccaggtgagtccgcctcagggagcccgcatggaaggtggaagggatgctgggaagtgaggaaggcccaaggctgactgctgtcccctttctcttgggttcggctactcactagaaacctttcctctctttgcaaggctcagcaagattgatgccaaagttcctttcctttctttatagctggagccttctgcccactttgggggcagcttctttctgtcccaggctatgtagtcttcctcgcctcagagactgccttagcctaaggccacctgttcaccctcgcctccatgacagccatctttctctttggcaccaggctgtaaagcagcatccctctggacttgctgagccaatcaggaagcctagcaggcttcccagtctcccaggggacctatgttccctacactccagtcctggcctcagagtctcccttctcttctttccctcaattggttaggtgggcatctttcgcaagtctggggtcaagtccaggattcagagcctacgccaaatgaatgagaactcccctgacaatgtctgctatgagggccagtcggcctatgatgtggctgatttactgaagcagtatttcagagacctgcctgagcccatttttaccagcaagctcaccactactttcctacaaatctatcagcgtaagtcacccggacccctccttagtaacctacctgatcctgggggcttgtgggaaatgaacctggcagctggccacatgggctcatgggaacttttactccctggatttgaaaaggccctcggagaggggccacaccctacgactgactccctcagacctagttttggtaaggtaggctgaggccccgaggaaagagctttcccaaaggctgccctgagattagagcagtgccagaggttgccggcagctacatcacagaacccatctgaccctttcctttggagactctgtcaggccttgtgcattctggtgctttgggggaaataaagaaggcccttgtgcctttctcgccctacagtcctccccaaagaacagtggctggcagcggcgcaagctgccaccttgctgctccctgatgagaaccgagaagtgctgcagaccctgctctacttcctaagtgacatcgcctctgccgaggaaaaccagatgacagctggcaacctggcggtgtgcctggcaccttccatcttccacctcaatgtctccaagaaggacagctcctcacccaggtgaagctggtagcgcatgctaggaccagtccaggagaatttggctccatgggcttttgggccttggggagttaccagtgctcttcctgccttcacccgaaggggttttagccttagcctctgtggagcaggcctctcctaaaagaggccagatgattttatggtcaagacaggcaagctggcttcccaagaactaagaggcacctgtcacccatcttgtcctatgccttcttgccatcatcatctgtccctatctccttccaggatcaagagcaaacgcagcctggttggccggccaggccccagggacctgagtgagaacatggctgccacccaaggcctatcacacatgatcagtgactgcaagaaacttttccaggtaagccaggaaaggctgtggtacctttggactctgtatcctgggtctctagagcagtggttctcaacctgtgggttgcgacccctctagcaaatttctatctcccaa

SEQ ID NO: 638 - DNA, 20197 bp, mus musculus
ggaagccgggggaggtcctgagttgagagggagggaggggcagaggtgggatgaggtcctcttactttggaggtctgcatggatcttaggagcttaacagttgtggttgtgtgtgggagggaataggggaggggtgaagagcatacctaacaggtaatgggcagctgactgtagctatgccccaaagttaatggtccctgctccctgtacacttgggcccaactagtccctgtatcttctatgtctctgagacagttctagtcccctgccctgtcacctgtctctttttggaataggtactcattttctcagggtccatggtttggtctgcatcttcctttatatcctcgtcaccatcttcctgccattctgcgaaaacttggtcagagaggtggcaggataagtaaatgaggggtaagtgacacaggtttccaggaggctatttgaatggggctgtgggtgcgggagtgttaaggttactgaagtgtaaagctagggtctttgcagcatggtggctagggttttgcttgtcagagggtggtatttcctctccaccattactatattggctcatgtaggttcctggggaagcaaactgggagggctaggagttgatggtgaatggggcaggatttaacaggtcagggggagcattcccagggaaagggatctttgacaaagagcaggcatagatgaagaagagagtgatggggagatctgcagatccaggagagaagggtcagtgtgggtgtcctgaggtgagtgtgctggatatgtacagggtcagcaaggagtcttgtgtggttggagtgacatgactggaagggagagaacaggaggaaggtcagacggggctagctggcttgtgcgcttacgacatggtgaaggttggctcttcctcttagtgtagaggaagccagagggtgttgggagcagaggagagacattgctgttaggacttaagaggatgtcttagatggctgaatatggaatagggggtagaacatgggatggagaccaaccagggggaggtgactacagtagtccaggggactgggactggtgctggtcctgttgatggagtggtagtgaaaaggtggatttgggatttaaaaaaaatgatgctagagatggggcccatgcactttctaggaagtggtttttaccgctgagctacacttaaccctttttattttttagacaaggtcacacttgtagcctaggcttggaattccgtgattctcctgcctcagccccttgagtgctgggattacaggcatacatcaccatatcctgcttggaaaatgcgttgggtagataacctgcaggatttgctgaagaatgagactctgaggcaagaccggggcacagttgatacccaaaatgggcagataggatggagtcctgagagcacttgctgccttgaactttcagatgagaaaaaaaagttctaccttcattatgccattattcttctgctacttgtagctggacatattcctttcatgaccctggacacagacaggaggagcagagagactgtgggggccttcctgttaggggtcttatgagggttagataaaagcactccctgaacctggcatatggcaaacactaagtcttactaagttagtaaatgggagtgggggatatgtgaatgaacacgatggcaaagtccaggtcattcccataggaggtgccatctcagagggagaatggaaagaattcactagatgaaagaaacagatgggacagcactctaagcagaggagattgggaaagtgggggggggggagaagaaagccactgtggggtgcaaagtgtcaaaatgagcaagaagggcaggactctgatttgaatgtacattagctgataagcttgtgatgacatactatcagtcaatgtgtgctaagtgtgagttggaaaaagctaattcttccaaaaaggttctatttcctattttgcgattgattcatgcaatagtgccaagtcctgaagaacatcaatgctcaactggggactttaaggaacagttaagaacgttcatggctagttgcattggtcacaataaggctgggaggtgtgtgtggtggtgtggggccagcaggacacacccagtaactgatagaactgttttgctttggtctcacaatccggtgcagtctgggcttttaggggctctgggtattcgtggagccatggggagtcatggaagattagggaaaggtaaagccattccccagaggtccgatcttactggttgaatgaattctgattctgcgctcaatcactcaatagctcaggctcagcctatgcaccttcttccaactcagcctatttattggctactcatgctttccttcacagcacctacactaccatccgtgggtatgagttcccatcttgcctccaaagtttccttctggctacatttctctagtttcagctttggttaatcccatactggcactgtcctttgagatataacagccttcaccctggatccccatttctttctcgctcccaccttcactcctcacatgccttagtgctcccccccccccccgcccgctacagccccgcctccatgtctgctcacacacagccttcccgtctctgttcagtctctgtattggctagatctaccttgttaccacctcttgaagccatagtgtgcgctcactagactcctccattggctcattgcaactattatcgtcattctgtctctacatcattcgcgtgcagttctccattggctgttcattttatctgtcttacgtctcaccgcctacgcaacctgcggatctcccagtttttggacctctgggttcgctccccgttgcccccattgcttgtagccatttcatcttcccgccgcctaccatgcccttcgtgctcagactttcccactaattgtcatactcctgctgctacatcttcgggcccgcattaaccctactcaggcctctccattgattccgttatcatcccgccttccatcccgcccacgcgcgggcgtcctcattggttgctagcttctcctgcttgtcaatcacctgtacgtcactcccgcgtggctgtccattggctgttggccgtacctgtctctagctcaccgcctacgctccactggagccccacccccctgttctggctttctcattggctgcccgccttttcaggccctgcccccgccggtcccaccgccggtgccgtcggtgccgccgccgccgccgccgatatggcgcgcacggcccctgtggagccaccgctgcggcatcccgcgcccccgtcgccggctgcgggagagccccgcgcctcggctgaggcggcggtggccccgcggagggtgctgttcgctgacgaggccctggggctgcctctggcgcagctacgccgctaccggccgtggggcgggcccggggcgggcaagatggcggcggcgaccgggcaagatggcggcggtggcggggctgatgaggaagacgatggcgaggatggggatgaaggggaggaggaagaggaggcttttcccgatccctctccgccgtgccccgttcccgctggcggggggttttacctggtgcccacattttcgttgccgcccgcgctgggccgtctggagcggttggggcgcgtgatggtggagttggaggcgctgctgccgcctcctggagcggttcccgggggttccggggtgtgggtgcctgggggacgcccgccagtggtgcgcgggttggtgcgcgtgctgaaccgctccttcgagaaggcggtgcacgtgcgggcctcacacgacggttgggctaccttctgcgaccacccagcccgctatgtcccacgcagcccgcctggggcaggagtgggaggaacaggagcaggagatcccctcctggatcccgggctaggcctgggccctggccagatgtcagcctcctcacccgacgacggtggctgcactgaccgctttgccttccagctgccctttgctgagggcgcgagcgatggggcgcgcctcgacttcgtggtgcgctatgagacccccgagggcactttctgggccaacaaccatggccgcaactacactgtcctgctccggatcgcacccgctcccacacccactgatgccgaagggctgccccagcagcagcagctgcagcagctggagccacagcctgagtgccagggtcctgtggaggctgaggccaggcagctgaagagctgcatgaagccggtgaggcgcaggtaatgtctgccagcgccacctccaccaacacagggctggatgtagaagcctcccatcccagcacttccccctcccccaggcctgctctccaggacaggcaggagggtgcattcggtcaaagagtagtgcaggccaaacatgtgctaggcactgttttaaattctggggtatcatccatttattgagttccactataaggccctgaacaagacagacaccttccctgtccccaaccatcccgcaaaggctcctctgggaaacagaatgcaaaagcaaacaagcagataagataaatagggctaaggttagtgctgagaggaaaatactgtaaggctctggagggagtggctgctgcagacgtgttgagggtgagctcttgtgaagagtcccagacggtgataacgaagagttatggacgagcgagttggtagagtttggaccaggtaggactctttctgaggaggtggcatttaaacttgagtccagagtggtacggagcagtgatgcacatacaggggaggtagatgtagatagtggggacagcaaagtcctgaggtggttctgggtttcgtatgactgtcagccagtgtgctggagtggagagaacatgacgtgcgaaggtgtggactaagggtctcccggcgtggggagtcagtctgattcctatctgccacagcaggaagccagagttagagaaactggttgaggaagtggtggtacttggctttttagtttcaaccatttctggctttgaagtctatgcatccttttttttaaaaactgttcctctggtagtctgaggcctccagtggagtttagggagcgaggctctattctcacataaaaacattagccttggcagaggcggaaacagatgagaagcggacttgaaggtcacatcgctcttctttttttttttttttgcacacctcttgtaaactgactgatataatgcttttctaggtctttaccagggctatacgtttgtcaagggctccagctaggcctaatgcccggggtcagttagagcccctatgaaatgcatacattttcctgctcctatgagaaatgggaaggggaggttgcccttttgtcccttcgaagctgcatgatggagcagggtgctgtgggatctgctggttgtggtaagggcttaggctgtgaaaggtttagctcttcgtggatggaccttgaagcatttagattctgccattcgattacctgggttcaaaccctaagcctgccactttttagtgtgaccgtatccaattcttagctgcatcgtgccgtagataaacaccctcatctgtaaaacaggaagttatggcacagacctcacgggatgagcagaagcactcaggatcgagcctagttccaagtagtgccatagtgctggtaattagcatcgaagcttagatgctcactacagtccatgtatcctttcccaaactcagctttgttgtgtactcttgtctcagtttcctcattggtcagagaggaatggctttcccattgtgtggttgaattggatgcagtacccgtagggaaggtaactgaggcataattgtagctgtaaaaggtctggtgggcagcatttcttaatctctgttaagagtggtagggacattctcctcttgaggtcagctgaatgtgctgttgactgtaggcactatattgagtcctagttcatgggaaatggggtggggtggggggctcggagaggtgctcgagcttgctcagagtcactcagctagtaaatagccaggccagggaggaaatgttagggatgctagtttaaaaacaaagtccgcatttcactgttggcgctcttagttcttcctttcccccctgtacctgttacgtgtgcttcgtgttttattgagatatacacaagtggacggtactgacccccgagggcatggctcggaagaattgcacatgtatgtgtatgtagccgccacccagttccagtgcccccagaatcgcctgcatttcaatcacttcttattccatcggcagttgtgggagccctttctggaagataagacagttgagtactgaagtttggtcattttcaagaatgtgaaaggaagggaacagacaaatcaaaaccttgccgtgccaaggtgggtggagagggtgtttttcttttaaaatacatgggtggttttaaggagaaattgaagtagttcatttagacaattgttttggtagctggccccatgtttgtggttcccaacgtgacttgagatgttattttaagtgggcagatggctttttgatagcttctttatcttttgatctcagctcttgcaaaggggaggctggtgtgcgctgctagatcagcgataaggttttctttgtaggtcggtgactttcctagcaaatacatttcaacttattattgttttaaggcctgtgtgctgctgctgatttgaagtgctgttgaagaatagctaccccccgtgatccagccctctggggaaatggtggtggacctcaggggatcccttttcttatctgtgggaggcctgctgtagagggcttcagaatcgttggccacaggcccactgtgcagctggcccttggcaggtagggtcagaagagatgattggcagccatgaggatgtagtccagaggctgagctggctgctttccctagcttgcaggaccaggtttgcagtactcagtaggtttagagagaatccatcagcagcatttttggtagagcctgttatgtgctgagcacagtgctaggaacaagcagagaagacacagactggtcctaagactcccaggagcttggggtagagccagggggcaagggttatgtgagaccctaccaagtgatatgtggccaagccccctttccttgctgggcactttgctgagtatttttgtatagtttcatttgtgctcaacagcgttttctgtgagctagattcctttaaatccctcttctgggtgagcacagaggttttgagtcctcagtgattggactgatatgggaaggagcccttctggtgtgtcttggctttatactctgaggaagtatcctattcctcttaaaaataaagaccaacaaaaatctggctggcccttacacaccctcaccgatgcctgcttcagcctctgttagcatctagtctggctttatattggtttctgctcccgagctcttgtcgccacatcccttctgttactcctgctttggggttgtcgctcatactgtttgcttcaccaagaatgtgtttacccctcagattctcctcatggagactcctcagttctaagagggtttccttagggaaggaagcttgcgcagcttagcctccttaagtccccagttttattcatagcactgatcagcaagtcaagttggaaaatgccacataggccagcatgtgagccttcccccaagttaaggaccatcttccatcctgccccattgtcctgtgtgtcctttgatccaccctcggctcctctttcatgggatcccgtcaagtgttctttatcattacactctgccttttgcttcttcaaacacaatagaaaccataagaatggaatgcctgctccttagagcccccacgtctgaacaccaacacccctcacattgtacatgaggagggggtcccttgttcccatttcaggccagtttctgttcttgactccagagcttcattttctgccatttgtccagaggctgcaaccataagccccatttgtctttcatcaggctttttttccaggtctgtctcacctggtcctctgttgacctagcctcaggccagggtctctctcttaattgctgagccaccttgccctttgcctctggtcagtacttgatgatcacccttgtccccctcccctgaagagtcaacagcacttgctttgtctgcagttttattagtccctggctttggccacactgaaaggctccgttgttttcttcttgaaagggctaactgctcctactcggtcccctctggctttgggaccgccctctacttgctttcttcaaaatctctggccctttctcctgttctgtcagcctcaactactaaacttggtgtctgcttgactgaatccttagtcttctcaagcttggctgtctcccactcagtgcccccaaacaacctcttattccatacccatgcacttgctttctaagcatccttaagcccttgctgattctagtctgtgccagggcctagtgttctagcatgttccttccttttctaaaggcactggcttccgtctgtagtaaggcctttattaggggattaatgggtgactgcaatgctagactgtaagctccgtgaggggtagggacatgctctgcattggtgaccactgtattttcacaggcctgccttagtgcatggcacttagtaggtgctcaataaatatttgttgaaagaacgagtttgagtattttttcaaatgtctccacatcaaattctaaatttcattgctgggtttgctcaccagtgtgtctcctgtcactatccctgatgcacaggttttaggtatacctgtaactgaatgaatgggtagctattggcagcctcacagaaatgagaacaatagagttgaaatgggtggggtgggaatcatctaagtggtctggagagaggatttcatgagaaagtgtccctttgttctacagacaactggtaggccatcatggttaaggttgtgggctggaggctgcacagcaaagtggcagagcagggatgtgagcctgtgtagttctgctagtgctccagttgagaactgcagcgctaggctgctggatggggcctacagctgggaatggccggacaagttgcttccttttttcagagccccagcgctattccaaaagacttagttttaagcactttattggtgctttgcatgtttcctcagtccatcgaaaagctccctgaagtattactaccatttcttccttatagatgaggagactagggcacaagagatgaggaaatttgtcccgggtcacagctgatttgtggtagagctgggactattcaacattgcattttctgggcatttattgagatgcaagatcagtttgctggcttccaacaaacattggcaaatggtataggagatagcccagcgcagtttgacatgcagtagaggtgagtattactttgaagagcaagtgtttcagttctcagtgtgtctgtgtctgtatttactcgtgaatgtgctggcttatgaggtgaaatggttttctcaccctgggctgtggccacgggagtgtcagttagatgaagcttgaagcatgcatggtaagctgccctccaatgcacacaagtcctagagttgaggctgacactcagagaaagcagggcagagtcctacataacttgatgatgtcacagcctcctcacctcacccccccaaagcacacgacttaagctgaccagaattccaagtatcttgaagccacgccccccccccccccccccagacagcatcatcagattgtctccatgggagctgggctgtgcgtgtttccctttggggctcagcacatgacccagttcgggcaagcacagttctttgaaacttggcgtgctcacgtaggacccagacgatgattgtggccgtggtattgagtctactttgcatttctcttgggggcttgttggccctcattcactcactcattctttatctctgctaactgatctttctgttctgtcttggctggcctgggctggggccgctgccaccactttctcaagtcttatcccttggtctccaggtactatctgaagtcaagtagctgttgactttctttatggtgggaagaactttcactcccagtagagtggtccattctaggtaagatgggctggactcattcacaagtactcaagtaaggcatgccaacacattcccagcactgtgtgtcctggcccactgtgtgttcactgccccccagagagactgcatggcatttgtgggacaggtgccaaaaggttttattctcgaaaatgaacaggcacaccgtatgtacagttttgttcttgatttccttccatttttctaagaactgttaactgatcggtaagtctgtacacttacactcgcctcattttgattgcagccacagctacttccaaaattttactgtgaaagacgattcaaagatttctccccaccacctctctctttcactctctctctccctcccccccccctctctctctctcacacacacacacacagacacacacacctctctgcctactgtctaagacactgtcttcaaagtggggccagttttggatgttatcagtatgcagtgtagttatcggggatagagacagttccttaaatcatactttctatatttggaagaaggaaaggttgctgtttgaaaggatacatgtaaacttttcaaatgactttgatgtagtaacaaaaaggcccatggtggaggcaatgagcaaccgtctcccctgcccccagcttttctttccaactcttggagcttgggaagacaacttgctgactttgtggatcttgagttgggctgatacttgaatggcttcagctgtggagggctgtggcagccgaagaacactgtggactgtatttcctttccttcatctgattagaagtctcttttcctgctaggggctgcagcctgagttctcttcactcgcatctatgacttaatagaagcttggttggtacgcacggccgggttgagtcagattacgggcaagcttgcataggctgtctctgggaggaagggctggctttctatccagttgagagtgttcttgaaaactaaagatttttttttttactactttagttttactttagaagataacaataaagtagggtttttgttttgttttgttttgttttgttttgtttttcgacagagtctcactgtataaccttggctgtccctggagctctttctgtagatcaggctggccccgacctaacagagatctgattgcttctgcctctcaagtgctggtttaaaggtgtgtgccatcactgcccagctttagtaagacaattaaaaaagaaaacaaacataaaaagttatccctgctaggtaaaagtcaaatgagctgtagattcaaaggtctggattttagacccactgaagacactggttcagtctcaggtaatttttcctgaatcttcttttttcatctgtgttgtgctgaggttgctggctgggctcctagagtcacctgtcccaggctctataatattcagactgaaatacctctggtgggatgcaggagtcctagactatagaggaagactgagggccccttgcaaagattccagactctaggtccttatatacagtgttaaatttcttcctccaaagtgctgctcagaggttcgcatagccactctggtagtgatctagccacgtgtactatggaactgcacacacagtgaatatgagagtaaagaacaggtaaaaagcctttgtgaaagggagtggggagggagtgtatgtgtctgttataggttctttcctctctttctagatagagctggagattgagttgggtacagtcacatagactcttatctaaacagcatcagcttgttggttaaaagtccgggttttgatcctacctgcataatcttgagtcatttccttagcctgtgcttcatcatccataagatggggatagtagaactggccccacttgaaaggatgtagaagcgcctccctcgcagtcacagtggggattaaatcagtccatgtagacatgtagaccattggctaataccatagcataggcctgctagcaacattctggttttgggaaggtgattctcagtaggtattttctcaaagttgcaactttttttttttttttaaataagtgtcaaccgtgtcctgtcacctcttaggaagaaaagttgtgattgtttcagtttccctcaggtctctggatcttgtaatcattgcttccgccctctgcctcatttgtgaacatttgatattcactagtaagaataagaacagtgatcggtccacgataaaggcacgctcctgggaggatctggctgaagtacttggtttatgtcactcggggatctaccttggctggcagaggagcagttgggccaatagatttctcccattgatttacttactgctctgttccaggccagagagctggcttttgatccttattcctcttgactccactatacactctatattgcctacaagggggttatgggtcctggcaggctggtatggggaccaaggaggggtggagtagaggacacaggccgctctgactaccttcttgatctccatttgccttctctcctcccctttgctgcttcctgtgtccctcagtcttttctgtctgcccttcttaaaaaaaaaaaaaaaaggcttctgtgatagccagaaacaaaccctagagaagtgatccaaaagtgcctgttgatatttggtttgtaactataaaggaaagaagctagctactcagtcggaagggaatggctatatcaataatgtcaaggccatttgatagaagcacaaagcagccgttttttcaatgtttgcaaaagtctataatgatgtttcatactgtttaatggacaaagccagctgtgaaagtatgtttgcagaatctaaatggtttcagggaatgtctggaatgaaattttccaaatagtaacagtggttgcctctggctcatatgtgattgttttgtttcctggatccttatgtttttctgtctttcgtaaaatttctaccatgattgcgtagggctctcatgaccaaaaggactgagaagcaggggggagaagaaatagcagctgtcaggtgaagatgggtcatcacagaggcccggaaggtgcctctgtgggtggtgcgactgacctctcagggtgtcatatttacctgctgtcttgtctgccccacaggccttttgaagaagagccaaggatgaggagtgcggacgataataccctagcaggtaagcaccgggctggtgttgagagttctagcctttgtaatactttgtttttcatggtgctggggctcgatgtgtgctaggcaagtgctctgctcctgagctatgtctcctaacctttctagtggccttttaccacttctttctgccttgtttctatataaaaaggaaaaaggtcacctcttccttagactgtcacaaaaagcttctaatgtgaacttccagttaatgtcagagagaagcagaattaggctgcttgtacctgtcttgcttcaacattgcctttctctctcgcagaacatcctgatgttcgagagtcactaggtcccctgttggcccctacccctctccgtccatggccccagatgacacttcaggtgagcaggccctggtaaccttggtgcgagcagccagataggaagctcatagtgtgaccacaattggacctactcttgcctatcctagaagtaggggtggaggtggggagtgaaagcacaaaaaccagaatttaatgggggggtggcggtaagggaaagatgaaattattcacttgggtttaactgttaattagcaaacatttaagggaaggcttgttgtgtgtgatagacattggaaacccagcccaaatggcatctgtatggggattacatgttagggcagagacatattgtaataatggtttaaaggtgagacatttgagctgaagatgaatgcttaggcaaaatggagggagggagagagggagggagggagggagggaaggagagaggaatggagggagaggcctgagaagtgaggcttcagaaaagagcattccaagtcccaaaggccgggcctcagctactgtctgttagaaacaagactcatgtggcaggagcaggaacttctcagagtgagggcaagtagagagtgaggggaagtagagagagctgaggtcagggaagtgctagggaacagatggggtggggccacggggatgaaggggaagacctaggctttactcttagtgaggaggagtcaagggacagaggcaggagcagaagaggaatgtgacctgctgtgagagggtggggacaggggcaccagggaggagaaagctgctgaaccctggtaccctgatgctcttagctgggaggaaacatttaaagtggctctgctttaacgtctgtctataagaactttaagcacatttataaaagagactagtataatgaacctgcatcacccggcttcagtgcatattggcatgtgtccattcctacttacattatccccttcccatttcctacggaagtattttggaataaagagagccagatactggtcagctcatgaaggttatagtttatttcttagaaagataatcctaaaaggagacaaaacaaaaactaccgatgatttatcataatcatagctccaaaaattaacagtattccttcatatcatcaaatgattagattagtgatacggtttttttataactattcccaggactcaaagtgatctgttgtcctctcctctcctctcctctcctctcctctcctctcctctcctctcctctcctctcctctcctctcctctcctctcctctcctctcctcttctctctcttctcttctttctttctttttttttgtcttttgcttttttgagacagggcttctctgtgtatcgatggttgtcctagaacttgctctgtagaccaggctggccccaaaatcagagctttgacctgcctctgcctcccaagtgcagggattaaaggcgtggggcacctctgtcaggctgatacactgtatctcatggatatgtctcttaactttttaatagtccctcagtttcttcattccactttaattactaatccctgtttgtcaagtacagtttgacagagtctgagtttgcttgattagattcaggttaaaatccgtttcttactctattaaacaaagtttaaattacatttattgagtgtgtgtgtgtgtatctggtgtatgtacatgtcatggtatgtgtgtttgtgtgtgtgtgtgtgtgtatgtatgtgtatatgtgtgtgtaagttgaggtcaaaggacaacttgtgggagttagttctctccttttgttgtgtaggtcctgggtgtcagactcaagctgtgcggcttggtagcaagtgccttccctactgagctgtctgactggcgctcttcctctgtttccattcattcattaatcttatttaccttagtgttttactaaattaaatttactaaaccattaagtttgctaaacatatttattaaatattgtctatcattttaaaattgacttaaacagaactaattccattagttaatagaacttaagttctattaaattctagattaaattttaggctggacttgagagagagagagagagagagagagagagagagagagagaggtctagtttgtacagaaaagtgttgtaaatatttcatccccttctgatttgtcaatatgcattaaaatgttgttttctccaaaggtcatcagaaaggctttgagttttgtgtgtcactcagattccaaacataatagttgattttgagttcactgtatttgtttattttgatgcttgcattgaaatattgctctctgtggccaggaggatttttttttctctcatcgtctccttttatctactaacattccccgttattctgtgagcctgttctcacatcttgctatggcagtctatcatggccttgtactttacctgctctaaaactgtagaagacgatctcattaagaaaccttgcttcttttcagtgtctagagactcagaggctccatgtgagtgttgctgcaagattgagcactgttttagaagacaattagggagtaaacattaacattttattatatttgtgtgtgtgtgtgtgtgtgtgtgtgtaggtcaaagtacagcttgtaggaattggcattttcctttccaacacatgtatgggtcctggggatcaaactcaggtcatcaggtttggcagcaagtgctgttaccctctgagccatcctgccagacccgaaatcagtctttttaaaagaggattcatttgttactaaccgtcatctgctgagcgctgatgtccagtgaatcacttagcattgtcacctgcaaaaggaagccactctgtacttgtttgagctctgctctttgcgaatacaggaccaagtctttggtggtgagagaattacatggggttcttgagcagatttttgctgagaaaacgctagagactgggtgtggctatactgcttcttactatgtcttcttgttccccctcttctgctttattctattctgtccatctcccatccacgtaatggaagcaggtgcccgaagttatgttgaccagcaaccctcaagaagaaggtgacatccccagaagcaacccacctgtggcttttacagaggtccgccaggcacctgccatcaggattcttccagcaacctgtggcctgggtggccccccaagggaccaggcctcagggcccgatgcaagtgatagagctgctggctccttcctggaacccacccagcagcaggtggaggctgcgtgggaaagtggagggggtcgaaaggcccctatggtaggggctctgacagatgagcccgccaggggtctggagattgtgagtggcttggatgagttgcttggtgaagacaccattgaccaggagttggagcagctctacctgtctcacctgagccgcttgagagctgtggcagcggcgggtggcggggaaggcacttcccccactcatgccctgggcatactcacagaccgtgacctgatcttgaagtggcctggccccgagagggccctgaacagtgctctggccgaggagatcacgctgcactatgcgcgcctgggctgtggcgtggagctcatcaaggacactgaagacccagatgacgagggggagggtgaagatgggctctccatcactccttctagccctgaagggggcagccctaaggaatcgcctccagaaatcctctctggagcccgctctgtgatagctactatgggagatgtgtgggttccatgggcagagcgctctagctctagatgtgatagcccagtggttctgggaacacagggtcagttcactgagaatccagagaaagggatgggcaaggacaccaagtctctgcacctgaatagggtaatagttgggatgagcaagtcccctggggaggctgggacggaaagccagatggaggagctacctactgagcgggaaagcagctgggtacctagttctgagaaagagctgcctctaccagtccagcaagagcagagtcctgccctccttggtcccacagggactgaagtctgtctgtctagtgtagccaagcctcatgtgaactcccaggaagaagagggtggaagcctgaatcttgagtccccaaagaggtctcccatgccagcggcccctgcagaatgtgcgtgtgggttggctcctcagctctgggggcccttgacccaaactttgggtgtactggctgggctcgttatggtccccgtggctttgaacagcggtgtgtcccttctggtgctggtgctgtgcctctctctggcctggttctcgtaggggctgccgggagggttaggttccaacagcaggtttcctcctctctgggatctggagattgacagtccctctgtcaccccagagtgttgagatgagacccagggcctgtggagtgagggactttgattttgagagtgcttgactggagagaggccttcccatctctgagctctccagccagaagcaggcttcctgcagtagtatttgtggagtggaatacaatggtggatggtgtgagaaattttagaatggaaccaggcatgccccccccccacctacccaacccaagcctgtatttatttttgtataattctctggatgagggagagtggtcatgagctggtcttggggcacaattacccagagatatatttattaacaaccaacctgtgcaacctgctggagctttatttttaatttaatttatatagagtacatattattatatgccacaatagagctctatgagaaatgatgtgtcttgctgtgctggtctcctgtttgggcctgagtgtatagggtagtcacattctggggaatggctgtggtccatgttgggagagaagatggccacggccatacctactgctgcctcttcaatgtgtccttgaggatctgtatctctttgccttgtggtcctaatatatgtggtcctttggtcgtgcatattttgtctgggagcctgtgtctgtgtatatgggtggtttcggtgggagccgagaggaaggattggttttagtcatgcggctgaggtggtggctatgctcagctgtaggtatggaggcatggattagcgacaaggtttggaggtgactgcagcttttgacactagcagggagacccctgaaacccctaaatggggaaggccccagaaaggagttaatgtactgtgaaaaaatttgtatcaggtttgttgtccccagacattgcatttctactccaaacaggatacccagaagctttaaaagaaaggttagatacatttattgcatgcaaataaaaactcttggcatagcaaaataaaacacaatatatttatttacttccctttacagcagaactttttaaaaagtgataattgttttggtgattttcttcttttagcaaggtctcagactgactgggaacgcccagtccccctgatgcaccctgggcgtgcactagcatgtattcctacaggtgccacaaactccttacaggaacgattgtaggagctttttccattttccccattcttccaataccccgtgcctttctgaaacggcaccaatctgtatttttttccagcaatgttaaaacatcctggtgctgttgctgcaacagataaacccatatgtcttcaatggcttcctggcagcatttgacagttggtcatctctggtccaagccatttcttcacttggtttccaggatgccacgctcactgttcctcatttcatactgtgcccatcaactagatttgcccaggaacagcccattggatgaaacacatggaacattaagtgacagtaagaatgcctcttgaccaaggtacaaaagtgacattttgggagaagacaatggaagtacctttaactaatgaaggacttaatcctagaatgtatgaaaaatgatagaaaagccagggcctactaggcatacattcaccaaacagaatggtgcgcagcaggaagggacgatctatagctgcatgagctgggggactctcacagctgggatgctgagcaaaaggagccaaagaaaaggtttcacatcatttgaaccacttaaccgaagtttataaacaactaagacgaacacatcatcccatgacagataatgtaaagaaagcaaggagatgatcataaagtcgccaagcatttcctcagtgggagagagggctgtggcccagaacttgggaggacaacatcctgtcatagagtggggaggggctcatggagcccccacaccttcatgaggatgtatatgcagctcattatgggtggaaagggagagacattttcttcatggtgtagccagttattaaggtgtctgtgatccatcatccaatagtgatccctttgggtgtggcttgtgggtgtacagctcgttttattaacttttataatgtgcattagaggctcagtagttaagagtacttgctgctctttcagagggcctgcggtgagttcccagtatctacatcaaacagctccaggggatccgatgcctctggcctctgtggtcacctgcatttatttgtatatgagacacatgaacacacacacacacacacacacacacacatatcgacacataattaaaaagtattacatcttaaaa

SEQ ID NO: 639 - DNA, 923 bp, mus musculus
ccgcggggacgtgtgtgagtgtgtctgtgtgtgagtgtgtctgtgtgtgtgtgtgtgcgtgcgtgcgcgcgtgtgtgctgtgtgtgtctccagtgcgatttcccctttctctcgctagcctcggcgcagctctccagcggctcgcgcccccctcctcatcagcgggtgccccccgccgcccttccctcggcgcggcctcccgggaacctcgggactcccgtcgcactgccggcaccctggttcctcttcatccggggcgccgccgtctcacctggggctcgcatctcgctcgccctccaactttgccattggcggcggcggcggcggcggcgggacgtgtgggagaagcccagcgcctcgcccggccgcccgcccgcccggaccagcctgccccggcgccgaggtgagtcacgggcgcgggccggcgggggcaggcgggccccgaggagagcaggagggcgggcgggagggcgggcggcccccggcggccgcgaggacggacccggcgctgcgctcagccgccacttctcctttccgcggcgcccagctcccggcgccgccggccggggccccgatttcgaggtggggggaggagaaggcggtccggcggcccttggggacccgtgtctcgggctctgagacggcgaggggaccacccgccgaccgagatccgaagagcctgggtcaccagacccgcccgggcgaccggaggagcgccggacctcaggtacgtcgatggcgccgcttcttgggacgcggggcgagagctcgaaaagtttgcccgcgtggggcatcaagggtggtggagaccaggaagggtgcgtgtgtctcagcctgggaactgtgaggagtctgagctccagaggtcacaagcagaagtgagcggcggcggcggcggtggtggcggcggcgggcgggaaggc

SEQ ID NO: 640 - DNA, 923 bp, mus musculus; identical to SEQ ID NO: 639

SEQ ID NO: 641 - DNA, 657 bp, mus musculus
tcctgtcccccagaacagcacagcgcggggaacggtcgcaggttgcctttggaaagggcctcccgcgggttccccttccgttctgcctggcgacttccgctctcggcccagcaacatggacgctataacccgccggccgggcggccgctgagcagtcgcggaagcttccccacttgagtggcggccggcccgcctctctgccctcccgccccacgctcgcctccctgcggccggccggcccggccctacatgggggcgggcctccgcagcttgggctcggcttcctgttcagaggcggcctggcgctaggcggcggccactctgcccgcgcccgcctcggtgcggtcaccgagcccgggaggaggctccagggccgcatctcaggcggttgccccgagccgggctgtacgccgccatggccccagtgcagctggacaaccaccagctgatccctcctggcggcggcggtggcagcagcggcggcggaggcagcagcagcggctccgcgtctgccccggctcccccgccgcccgcagccgctgtggcggcggcagctgcggcggcagctagccctggataccggcttagcacgctcatcgaatttctgctccaccgggcctactcggagcttatggtgttgacggacttgtaagtgct

SEQ ID NO: 642 - DNA, 657 bp, mus musculus; identical to SEQ ID NO: 641

SEQ ID NO: 643 - DNA, 46158 bp, mus musculus
ggaataagccagtgccagagacagtggctgtccccaggagaatggtaaactcagcctggctggccccacctggtgggggcttacccagtgggtgcatggaacataggaggcaaagtgggtaagggccagcaggccgaggctcaacagagctattgggataggcagccagagctgttcttcaggctgctcacggtctcccatgtgatacacagacatggtgagatcagcccaaggttttcatcacgttgggggcggtgtagggtttgctttgacttcaactaggagggtgtgggtctgtggttagttctgcgtggctgggggaaggtgggaacttttgggattcccacaagctgtggagctgcaagtcaccagcaagcaatacagccagacattttaagtgttccacagtattgacctctttccctgtccttctcaagagggaaaacttgcctcatgctctccgcctttaggcaccagccttggttgataccacatatattttcagaaggaacccaccctaagtcctcaacagcttctgccttggttctactacattttcttccacgaactgatttgagaaagcaagaggaggttggatatagtgaacacttatggagggtgggtttactaggcaccaggccctgacgtaaaccctgccacctcacttagtcctcaccaccagtgttgtgggggcagctcttagcatcctcaattaacattttaaagatttgttttatttttatgtgtatggatgttttgcctgcatgtatatttgtgcaccacacgagtgactgagaccttcacaggtcagaagaaggcataagacccactggaactggagttacagatggttgtgagccaccatgtgggtgctgggatcgaacctgtgtgctttgcaagagcaacaagtgctcttagctttcagccatcacccagcaccatcccctatgctttaaaagtagggtctctctgtgtagctccgactgacctgaaattgctatttagatcacactggccttgaactcagagatccttctttttctgcctcccaaatgttagaattttaaaggcctgtaccacacccaattcatgctcattaaaaaaaatgtattactttatgtgtagaaatgttttgcctgcaaaactgtgtaccaaatgtgagcctagtgccctcaggggtcataagaagcaatcagagccactgggactgttgtgggccaccattattggtgctgggaaccaaatctgggtcctctacaagagcaattcatctcttaactactgaaccatctctctagccaggtagtgtgtggttttgttttgttttgtttttgagacccggggtagggtgggaatgtctcactatgcagctctggccaacctggaatttactataactgtaaaccaggcaggccttactcttagctacccacctgcctctgcctccccagttttgggattaaagacctgaaacactatgtgaggcttactgttttagtttttgtacccactttggccttggtgagcttcgaagctgtctgagacctgccccaaactagaaaggagagcctcagaggctggagtccaacagaaagctgtgtttttccagaatctagactctcctaaagagaatgtgctcacttgtaaaagaaaaagaagtggaaatttgctcttggtccttgcttccaggacttgtctgtctatgagtaacaaggaggtttcaggagccaggaccctagtgcagcctctagatcttttactgttaacctgtgatccacacccgtttttgatgatgccacccactacccaagccctgagccaggatcatcttttccaaagctgatgaagcaggcttttggaggtggttgagtagatcctgacctgaagcccctttggccatctctcaaagggccctcctcccccggagctccccacccccagcggctttctgccaaggtcatgtctctctgctttcccaccacgccccgccccctgcgtgcctctcccgcagccctccccaccctcgctttagtcagcatagagctgtgagaaatgacaatttccagaagacaccttcccaggaccttagctgtggtaccagatggggactggtgtggatacggagaaaaagtgcaaatgggttgaagtgggcagctcaaggacagccattgcttgactttatatcgaaaatgtggggtgtaggctctctccctgaaccccagttctggctgactgtacacctgctgtgttggcccccccaagcggtcagactttcctgcaactctctggtcacaccaatccaggaaatctctgttcagagactccaaggggtggggtggggtgggggtggggtggacattgtttgcaaaatgtaccctctgtccatctcttcccatcattgctaagctgcctggttgccacagtgcatgcttggtactgtggagtgctggtgtggtggggggcagccgaggtagcaagccatcggagtaccgccttccagaatccccaggatagctccacgggatattgtgtgggacttcccgccgagaagcgcccagtcagagccgagggccccgggccccgccaattatgagtagagtgtgggaggggggtgctcgctagggaagcagctcgtgcgacgtgagctcgggaggggctctgccttctctgacctctccgcggaggtggggggccgcgaggctcgcggggcaggagagcctgcgcgggcccctggcaaggctccccctgccgtgctggcgaccgtggcggggttggggtggaggggcgctgtttccaccccggtgcctggttcctcccagcctcccttctccaccccgcccgctagcccgtggtccctcccgtcggtccctccctcccgctcttcagtccctcctcgccctgcctcctgcgcgcccagcccagcctccgcccgcggggacgtgtgtgagtgtgtctgtgtgtgagtgtgtctgtgtgtgtgtgtgtgcgtgcgtgcgcgcgtgtgtgctgtgtgtgtctccagtgcgatttcccctttctctcgctagcctcggcgcagctctccagcggctcgcgcccccctcctcatcagcgggtgccccccgccgcccttccctcggcgcggcctcccgggaacctcgggactcccgtcgcactgccggcaccctggttcctcttcatccggggcgccgccgtctcacctggggctcgcatctcgctcgccctccaactttgccattggcggcggcggcggcggcggcgggacgtgtgggagaagcccagcgcctcgcccggccgcccgcccgcccggaccagcctgccccggcgccgaggtgagtcacgggcgcgggccggcgggggcaggcgggccccgaggagagcaggagggcgggcgggagggcgggcggcccccggcggccgcgaggacggacccggcgctgcgctcagccgccacttctcctttccgcggcgcccagctcccggcgccgccggccggggccccgatttcgaggtggggggaggagaaggcggtccggcggcccttggggacccgtgtctcgggctctgagacggcgaggggaccacccgccgaccgagatccgaagagcctgggtcaccagacccgcccgggcgaccggaggagcgccggacctcaggtacgtcgatggcgccgcttcttgggacgcggggcgagagctcgaaaagtttgcccgcgtggggcatcaagggtggtggagaccaggaagggtgcgtgtgtctcagcctgggaactgtgaggagtctgagctccagaggtcacaagcagaagtgagcggcggcggcggcggtggtggcggcggcgggcgggaaggcgctttcggtcagccccggccagcttagcctcagtggagaggccgttagtgactgcggcgccgcccccaccccgtgccgatcggcgatcgcaacgccgctgggcaggaggctctgcggactcaggcgactccgaccaggttgaaccagtggcccctagggcttccacagccagacactggagacacgcacactcacagtcgcgatcacacacacacacacacacacacacacacacacacacacacgcccgccagcccgcccgttcgcacgtaaacctacgacttggagacctgaactgccaaaatagagacctcttggcaggggctggagtttccgtgtcagccagccgccaggcttcccgctcccgtgttcccgctctccacggctctcccgcctcttggcttcctcccctgctacttcggaggggacccaacaaccgcacagcgcaaagctccccccccatgccagagtctgccttaggcggttcagacattgctgagctggcaaccgctttaggaattcctgccccctccacggtacccctaaactttgatgccctttccttgggagtaggcctgggacttagacgtcctgatgtaagagttacctcctgaccccttagcatctcagcttagtgggactcccttgggtacccccaaccaccaccgcagaggagctgggtggggggggggtttgataaccctttgatttctgcccctcatccctctgcctgagatagaggcctgtctggtcctgcagcttcttctagttaatgtttgacagttcattgtagctaatcattttaattagctcttaaagtggggaggaacagttaaccttggacttctcgattttggtctggtggggcctcaaatgggaggagttctgaggaggtaagaacggaagtgaggtcaccacccctggcctgagccaccacagctggctccaacagctggtgggcacacccattagggattcaactcctgtgagctgacccttgcttggcctgagaatgccaggatgaaagaaggtgaaaagaacctatctttctccccctcgttctggggaagcagggctcgttggcatcaaaaatggccaggaaactcatagagcaagtaaaaatgtcagtcagccctaggatttccccagataaaaagtgcttcttgacccagtgcagagaaaacatggagttgagcaggcaggaagagccctctctaggtgtgtgacaataatcgacagcaaacctgagctttaagaagctgcctcgaatatgggcgtctctggagctgggttcaaagcctatgatctcttgtggtgtgtgtgtgtgtgggggggtggctgtgaagcagacaccaccattgccacccctcaccccagcctctctgtgagctgaaggagtggcttgtttgcaactatgcctggcattcccccctccatggtactgtttgctggctactcagaaactagtgcccacccctggtcaagtccggggcccccccaatccagccttcttcacacagtactgagtggcagtgcaatagcttcagccgtctctgctattatgttgggacctaaaaataagggccctgtggcccatcatgggactggttgataacatactcaaaatgcctctaatgctgcaaacatttagggctttggccccagataggtccaaattagccacttgctaagagtatggcttttctagggagccctttactcctggccttggcctccacaacttcctcacttgctcccagtcatgagagccagcctgtcagggttaaaagcccagctttgccatttactagttttatggccccagtcagctgtatgcgttagtctcactaagtggcaaaagaatcaagtaactaagttggagaggaacaaatgtgttcttacctataggctgttgattagaagactgtgtggtacagggcccatatggaactggcattgtgatattgtctaatacagagcctaaaactcaggtccaactcagcaaatgcagaaatttactgggagctggtcctagtactaggctggccccaatgaagtgttggccgagaaaataggaggaagaagacagcactggccttctagggttgtatgttggctgaaatgggtggtaggatgtaggaagcgtgcaggtagattgggtatgttgtctgtataaataatagactttaaaaacaaactcgaggatttgaagagatggctcagcaattaagaacactgcctgtttttgtagaggacctgggtttgattcctcacacccacatggtggctcacaaccatctataactccagtccctgggattctgacatccttttctgacctccttgggcaccaagtatgcacagacatacatgcagtcaaaacacacatacacaaaataaatttacaaaataaaaaataaaataaagggctggagagatggctcagaggttaagagcactgactgctcttccagaggtcctgagttcaactcccagcaaccacatggtggctcataaccatctataatgggacccaataccctcttctcatgtgtccaactcatatacataaaataaataattcttaaaaataaaataaagccaaattcaaattcctgggctaggatgaggagccaagtgccccaaactgaaggcttctccttgcttggagatgatggctgggttctggtttgaatgctatctgtctctcaagtctgccctaagattttggtgaaggagggggaagggaaactagtctcgtgcgtaggctgaaagtgacaggcattttggactgtgattttctgcgtgccagggtcagggtggcattacttatggtccctcccactcctaaagccctctgaaatggcagagatcacacctggcgtgcctcctccacatccctggatcccctgctgaattaggaagagccttgggcaacccttgctcctctgttctgggcctgaccccaacctgaccttggttatcactcctggttttctaaactgcaaaaaggattctggcttcactgccaatttattccctttgtggttctcagactgaaaagtagttctgcaggggagaaaagaaacccatgaaaggtacccagaatcccatgggcgctttcctgggggtcaggggcttttctcatcaacaccaacctgcctgcaaatctctggctgctgagcctcgtgtgtcctgtaatagcggctgcgcagctaatgccctgtagcttgggccccagcgctggttgccaagaaactgctagtcggggtgcttatgagggttctgacctcataggggctgctgagtttcaattcagcagacatttattaacacctactgtgtgcccaacctgtgctatgagctgtgggggagccgagggaaggacgtggtggggcagagatgactaagacactgaaacaatcagaggcgaagacaagcagccaggccaggggctggtcaggtgctaattgtacttcttggagcagaggccagcgtggccaggactctgaggtcagcagcagctagaggagggagggaaggctttgtgagggattcgggtgagagctagaccttgaaagggggcggggacagcgagggggagatgtggctccagcagaaaggggagaaaagacgcctttctctctattccctggccacggactgaccttcgaagcctggatgattgtttggtaaatgcatgtcacataaaagagcaggtcagtgagtgtgggtggcttcatgcaaacctcgatctccacttcaggacgtacaaaatgcttggccgagacagtgagcccagtctgtattgataatacacaaagggtagccaggcttccccgccacccaagctgagagcatttcattatggactgcacccttcaacacaggccagctaggagaggagggagggagggaggcaagtgggggaagagagaggtagaggacatcaaagctgacatatcacaattgttcaccagagagatctgctgcctaggttccaccttgccccctcccccccgcccccctggggtttgaggcttttttgggaccctggtggtagagagcagagattttctttttcttttttgggggggggggttattttgttgtttgtttgtttgtttgtttgttttgagacagggtttctctgtgtagccctggcaatcctggaactcactctgtagaccaggctggcctggaactcagaaatttgcctgcctctgcctcccaagtgctgggagagaacagagattttagacttcaattcccagctggctgggtggtgggctgtgatgagagcagagattttcatcacagcccatcacccagccagctggggattaaagtctagagaggttctgcctggacacagaaaaaaatcatcgtgggtgtgttctacttttgagccctccatggctggatgggaggtgagcttttggcttttattaggttcaattggataaaaacacctagactacaccccccctcatctccccccccacccccaacatcttcttgctatttttgggctttgcttctcttcggtaaacacctaaagagcatactagaatgtcctgacttgggctgggaaactatcttatggtgaatttcttgacaaagagcctgttcccagaggaacaagatgagtgtttcaggcagtagggtctataaggaaagtgctgaaacatttctcaaagcagctaacaagaaacaaagtagcccagcagtggctatggttggcactgtaggaggcagaggtaggtggatctctttaagtttgaggccatcctggtctacagaacaggtactaggacaaccagagctacacagagaaacactgtctcaaaagagagaccgagccgggcgtggttgtgcatgcctttaatcccagcacttgggaggcagaggcaggcagatttctgagttcaaggacagcctggtctacagagtgagttccaggacagctagggctacacagagaaaccctgtcttgaaaaaccaaaagagagagtgagggggggtattaagtggctggtccgagttgaacaagcttcgccttaaggtcttaattttgaatgagtcgtttctttcccagtgctgatatttcatgcctcttagtctacctaccattctggaagcttcctgccttcttctagtctgacccaatatccttctcaagaagacagaaatgcttcagactagaagaaagcaggaagggagcacggtctgtctgcattcatatctcagacctaccaggccaggctctggctgtctgacattgacttaacctctctgggtctcactgtatgcttcacagggatagagtgacgaatgggataatgtatataaaacattgagcatagtgcttttcgcagtgtacccacccagtaagtgttcctcggattaggtttagtccttgctaagattgttgctggtcatagcatcttttcaccattcacgtaccctaagctttgccaagatcccagaattaaacaccttgccagaagtgctggcagggcatgccagcccattcctgaaaatacctggctgatttttacagattttttttctgctaaggtctttttgttgttgttgttgttaactgtgccatcatgaaggatacagaggggatatggaagaagcgctatgtgcgcacatgtgcgtacgtgcaggggtctgtgtgttatctacaaagccattctgagtgttagacagttctggagttaatagtggtgcttgaggggctggagagatggctctatggataagagcttccttgctctttgaggtggccaaagctgcagtccccagaactcgtgttaggcagcttgcacctgcctatgacttcagcttgaggggatctgacatctttctggctccgcaggcaccctccccccaccccacatgcacagaggcatgcacacagcacacctaaatgactaacaaatcttttttaaagactggaacctgagccatcaaggtagttcagtgggtgaaggtgctcgctgccaagcactacaacctggtctcagtccttggagctcaaaatggtgaaaaaagagaaccatccttgcaagctgccctctgacctccacatataagccgtcgcaccctccccgatcctacccccacatgcattgagtgcatacaggctctcgtgtgtgtgtgtgtgtgtgtgtgtgtgtgtgtgcgcgcgcgcgtgcgcgtgtgtgcactctcgtgtgtgttgaaataaaaatgtaaaaacagtttaaaggtggggattaagtttttaatatttgtattaatattaccatggttttttttttgtctgcgttattttcactttgaatatccactgaagaaaccagaagtgagctgggtgtgatggcacacagctgtcagttcagcacttcagtggctgaggctggaaaatggagagttctaggcttgcctggccaacatagcaagttccaggtcagcctgggctataagcaaaaccttgtcttaaaaaaaaattaaaaaataaaaagaagaggagaaaaatcagaggaagtttgttcctttaagaaaaggcataccgttctacccctggggactacttagcaatcatcagtttgctgtttgcctcctgagggtaaagctctggaagccagttggccaactctggactcatcacagcttgccttgcttttctgatctttccgatcctttcagtttacagtgatgttgggtccctgctgagcaaatgtccaaaggccttttttgaggctggggcactgcctttggccagcagctctcaggatctgggaacttttgccaaaggcccctcagaagattttgaggtcccatctgctgtagctgcagttgtgtttaggtgagcccaagataagaggtatcctgtatggactacacctaaatggatcatgctagtggatcatgtgatccttgcccatcaaattaagaaagctaggccttgagcaatgaaagagtggacaattagttgtttttttttttaaaggggatttatttattatatgtaagtacactgtagctgtcttcaaacatctcagaagagggcatcagatctcattgcagatggttgttagccaccatgtggttgctgggatttgaactctggatcttcagaagagcagtcagtgcccttaactgctgagccatctatccaacccagacaattagtcttaatctccctaaatacctgataacggggaggtactcaagtgtggactgaggtggtactctgtgtctttccagtgttttctaggataacagtcattagtccaactcttctgagtctataaaaatcaacgtgcagaaagcaagtaccatagacgctttcaaggtgaccagtttaataccacagtaataagaaagaaagaaagaaagaaagaaagaaagaaagagagagagagagagagagagagagggagggagggagggagggagggagggagggaggaaggaaggaaggaaggaaggaaggagaagaaaggcagaaagaagagaagagaagacaagacaagacaagacccagatctattcttggagactccaagccgcattctagagtgtcagggacatgtatatatttatctgttagcaggtaggggatcttcatatttctaaattgcatgatgtggggctaatggcttacacagagaaaaatcattttccttccttggcttcattagggaagacttcctggaggtgaaagggcagatggcctttcaaaagaggaaagagagaccattggccatgttctaggggcattctagactgggtgagagggtaacattggcaagccagaggtacaacagtgtaagtcccccacaattggcatgtgtgataagttccaggctcagaatctgactctactgtagcatcaaagaatgggtattctagggaagtgggagactattgcctctttttggccttcactactactgcaaagcaacatgatacagcaaactcacatagtaatgccatgtaatgacaaaaccatagtcaatgttgtacaatccagggccccctccctttctttcatgtggcttaataactttactaaaaccatatcaatgtacaataaatggcacatattttttaagtgtacaatttggtcctatttgacgtatgtatgtatatacccagtgaaagcatcaccacatttaagagacagctagcgtatgtggggctcctgggaagtttccttgcaccctttggcagttccacctcccatcctaaggcagccactgctctggtttctgtcactatagattagtttgcattttctaaagtttcgtataattggaatcatgcagtcctgtctggcctggcttctctctggatatttatgttaaaactcttccttgtttttgtatatatcagtgtttcttctccctcactccctctccctctctccctcacttcctcttttgagacagggtctcacattgtagctctggttgttcctgcaactcaactatgcagaccacaccgctctcagccactgatagctgcctacctctgcctcaagatttctgagattaaaagacttgctccatcatgcctggcagatgtttcgatctttttttattgcaaagtagctttccattgtatggacaaaacaaccgttgtttatctgttcaacagcctttggacttctgatggttttttcctagtttttttttttaactgttggaaacaaagctgctctgatcatctgtgagcaaatccttttatggctatatttttccttttctcttggttaaatacctgaaagaaaagtaactgggtcctaacaatagcgaaggttcaacttttttgtttgtttgtttggagacagggtttctctgtattgccctggctgtcctggaactcactgtgtagaccaggctggcctcgaactcagaaatctgcctgcctctgccttccaagtgctgagattaaaggtgtgtgccaccactgcccagtgaaggttcaacttttaaagaaagtattacactgttttccaaatgcctttatcattttacatctgctcctcgcaaaggataagaatcccaagttgtttgctcatcttcactagcactggtgggtggccattcttattggtgcgccatcgggttgcactgtaattgcctttcccttaatgactcactattttaatcattttcccatgtgcttctttgttatctctggatctttctttttgtgaaatatctgctcaggtctgttgcccagagtcctttatagactctagatacaagacctctatcatagtcctgcttgacaatcattgtttctttcctggtccttctgcctccacctcccaagtgctaagattacagtcgcaagccagtgtctagttctagaagtctttagttttgcattcaatcttagccaaaatgcaaccaatcactgtgtttctttctcggctgacctggggattgaacctcagaccttttgcctattaagcaagcgccttgccattgagctatgttcttggccttcacttttcccttttttagatcaagtcttcagtcctacattacatctaaggaatctttgcctaaatcataacaatttcatcatatgttttcttttataattttagcctttgcattctggtctgtgatatatttgcccgttgttttacactctaatttcagtgtgcatttcttttggtgactcactattttaatgatttttccatgtgcttacttgttatctatatacctttttttaaaagtaaaatgtctgcttattaatttttcagtaccgaggtccagagctttgtgtgggctaggaaagcacttgtctaggcttattttaccaagtcatctaaaatttttagtgtgtctgcaaatgcatgtgtgtgttacagatatgagagtggacatgaacacacaccacacatacatgtggtggtcaaaggacaggttttgggagttagctttcgccagtgaatgaactttctcctgctctaccaccttgctggcccagattttggctactttaagttctttgcaacatcatatgaaatttaaaactgtttgtataattttcttttaatatttagatataccttattcgcatcaatcattaagacagttattcctggctttgtttttgactcttgtaatcaggtgtgtgtttgatatcactgttattttagatggtgcttagaattgttgttttatggcttaaatttactgtgcattagtagaataggacattgttcagttatagtgaataaatccaacatttctttcatgcatccctgtgtacatgcctcacctatcccctttcaaccacatctgccaagaaaacagatctccttaaccaaagtttagctgggcatggtggcacatgcttgtagccctaactattggtatactgaggcagagagtgatgagtttgaggtcagcctgagctatagagcaagaccttgttacccctccctctacaaaaaccaaaacaagaatatttgactcagacagtttttctcctatctcattctctcaagtaattttgtatcttagacctgatacagcatcatgacatcattccaagggtacagtgacgtgactagaacccaatattctcagggcaggactgtggttttatgcaaaaagttaatgcttttgatgataacttgattatcaactgtctcctcaatgctacttgggggaagaactcgatctggcatttgtcacctctgacagaggcttgcagcaaaagaggaaaagtaatacctgagtccctagaactctttgtctcccaactgcaggctagccgtactactagactgtaacccgttcgaacctgtaagttgacaatttaccggagtttaattcatggatgcttagatataggttggaggaagaagagatacaacagaaagaaagcagcagttcaagaccacatgtgccaaaagaccttgtgacagaattgaaaggctctggagagtttatgggaggcggggctctgtggatatgaactgtaattactagaacataaacagctctgtggggttaggggacttgttggagaccttgctcgatgggtactgtttgattagaccaaaaagatctcgaaaggatggcaagcctgagaaattccatgaatgaggctggaatgttccctcaggggaccatgaggagaccactgggcttgaagcccagcttgagttgggaaatcatgggaacgaggctgagtaggtagggtggggtcagactgctaaggaccttcagaaaccaagttagatgagtcgagactctagggctctggcgagtcggagtccacggccacagatctcaatgtgtgtgtcctgaagaagctggcaccagctcagaggctaagggaggagttaggtggaggcaggaccaaggctggaaaaaggaacacagtttttagctctttctcaggttttcacaccccatccctacaggatcataacctagatcattggcaaggggcgttgatggtgggacaagagataaccaacacgcactttgtagctcgcctgctgactggtccaccccactgcttaccctgacagcttaggtgaaatcctagtaggtctagatggtgtttgaaagtgaaaatgcaggctgagtgcagcggggcatgcctgtgtgtctagctatgcaggaggctgagaagggaggtttgtttgcgccttgcttcgggagactgaggccaacatgggcaacaacactagatgctctctcaaaagaacaaaggaaaaaagaaagaagaagagaagagcaagcacagcagtactgacagtctttccccttgggaagctgaggcagtaagattgcaagttcaaagccagcctgggctccatagtgagacagcttgtcaagaaaaaacaaaaaacaaaaaacaaaaaaacaaacaaacacaaaaaaacaatgtggggctggagagatggctcagtggttaagagtactgactgctcttccagaaatcctgagttcaaatcccagcaagtaggtagggtggttcactatgggatttgatgtcttcttctggtgtgtctgaagacagcttcagtgtactcatataaataaaataaatagatctttaaaaaaaggaaaggaaagtaaaaagcaaagtgctaaggagagaaatgaccttttaactcagtatcagttatcaatatatcaacactaattgatttgtgattttttccctttatgtgtcactacttttttgttttgtttttgttttgtttttgtttttgtttttatttagctttctctcatacagtactccccaactgcagtttcctctctgtccacttcccactggtaggaaaggctgctttgagagagatggtattttggcctaatattttagtagaagaaatgtggcatggacagcaagcctgtaaggagctctgagtgacatgcaatctgtccacttggagaatgggcacctgagagttcaagaaccaggtgacattaatagcaaaattgttttaccagagttctgttaccacccaagtcccccacactattaaattatatatatatatatataagttgatatagggtctaactatgtagtcctgtctgaccgtgcactcaacagggatccacctgcctctatgcccccaccccaaatgctgagactaaaaactccaagtatgccgtggtaaaggcttacattggattcttgagttagataacatttctttccaatgtaacatttgttgtccgtccccagcccccttttttttttggagacagcgtctcatgtagcccaaattggtttcaaattcattatgtaacagaatgggtttgaacttctgatcctcctgcttctgccctacctgggattgcaggtgtgcaccacaggatagtttatgtgatgcttggagtggaactcaagactccgtgaacgctggccgagcattctctcaactcaacagcaatcctagctctgaagtatagcattcactcgttttgagacacggtctctctgtgtagtcttaactggcctagaactcaaaaagatccacctgtctctgcctcccaggtgccaagggtctcacgcctgtctagtattcacttttaagtgggactgttttcatttattacctaaaatgtaatttttgctaacttgtcaagacaaaaagaaacaaaacaaaaaagtgagatgggtttgaactgtacctttgactccctagtctgaggcttggtcagatctagtgaaagggtcctaccctcgtgggacctctctactgaaccttagcttttgagatttttgaaaaggagagtggaagggaaatcctatcacctgcagcatcatcttcatttgcttgccacccttgccacccctttctccttgccttagaatacatttgaaagcaaatgactaggtccttttgctctggggagaggtcctttgacttgctcagtggttagctctgtctcatcttcaaagtttcgggtatgaacagatcttgaagttggtatggagagacctatgaggctctggagcctggttgtaaatcaagactgttcaaaaagattactgaacttcacctctgctatcataccatacctgtgtcctttccctttggctccatctttggttttgattattcatagtagagtgttagtatcgttccagtttggaaacactctgcttacactctgcctggacttatcagagccttcaagtctagtgctgctctggctaagtcttggtggctaagtcactgaaggctaaggtgaatctccttagcactccagtcgtttgatttactgtccccatagcttacagatagggatgccaactggagaaagaatgcctgccctctgcagcctggtcaagctggataaagcactctgaataggcaggttttaacccaccaggcagggcctcaggcatcaagggcctgtgccaggcagcaagccttcttccacaccccttgcctgtcagggggcttggggcaggagaaagagcaggtagggctctgggcaggctgtctgggctgggcggggccctggttgggtgaggcccagattccccaagctgataaagcagcctgtaaacacccagcaagttgcgggtgggggtgggcagagggcaggctaccagatggcaagagaaggagggaaactggagcccaggccgagctacaggaagtggggcttgatgtagaaacatcctgtccagcaggggctagagaggtagccaccagtgattgctcctccactatggtggcaaattcagtacaaggtggggctgcatgcctgggcagcgggccaggttcttggttcctggcatctcagagggacatgatcaatcggtctctgttatgggttgctcatgggtctctgttagggtttgctgtaccatctaccaacgccgagaaggcgggggaggtggtttagagccaaactacccccgtggagaaactctccagagtgattgtctgagagaatttgtttcttacgggaaaaatcatcgccttcactgtctgtgaggagcattgattggaacacaggattgtgtcaattgtgtcaaaggcctcctgcggccctctgcgaagaacagtcatatggccgatgctctttcagctcgatcttgcggtgccttttaattagaacctcagagggtcagatctggtgcagcctttagcagagatcagcagacctgtccatttcactttacaggtggggaaactgggaatcagaggcacagaggctgagtcacctacacgggagacccaaaattcaagcccttgctctgcaaagcttcccaccatcttccctggtgtgggaggtcccccactagcacccagccctcccacataggcctggatatgtcctgcatactcactggacctgtatgtacttaaccttgctgaaggctacaggatgcctggaaggaggaaagagcctcagagtcataaatcaaaaggcctctgcttgtaagtggccttgagtagaccctttgggccacagagattcctaaaaaatttacaaaggtaataattttcagcaggcatggtgatgtgtgtctgtactctcagctgagaggtagaagcagaagaatattgaagagtgagctacatagtgagcttgaggccaacctgaactacacggaaccctctttcaaatcaaacagaagacaaagaaaagcaattctcttaagagcgttaaccctggtagaggaccacacatccaagaatatttgggcagcataaattggtcttgatgtttttgtttaaacaaaacaaacaaacaaacacaaaaaaaccaaagttgggtggatggtagtagatttgggaagaattaggttagggatcattatggtcaaaacagatcatatgaaaatctcaactgataactacttttttttttttggtttttcaagatagggctcattaaaacatttgtcgttatacccctggactctgggtaaagatggaagaagataacaagcttcacagagttgtcctttgccctccacacttaaatcacaataaggagaaatgttttaaaaaataataacagaaaaataataatatttaattattttaagaaattataaatttcacacactagaaacatctacttcagtgagatttttatcttattttattttattttttagcattcacagaattgcacagctatcagtaggatccactttagagtattttcatcttcctccaaagaaataccaaataccacatacatcccttagagccagtcccaatttccctccagccccagggcctcggttctaaagggatgcttactatagatagatgctctaggtgttttgaggtgaaacccacccttgttgatcaagatgtgctagctcagtttactggggcctttgatccagagaccccactagaaaaccacgaacaaacaaacaaaaccagggaaggcctgatgatcaagcccctggctgtgggcctggcatatgtgaggtacttagagctgtatttccataaatatttgaataaacacatgaaccaacaccctaagataagaacctcaacttcacagtatgtatgagctgagagtaactgtatatttatggggcagggaccatgccatgactactctaggtctagagcctaaattctctggtaagagcaggtcactgaagtacagaagctgagcagagcttgaagcaagccattgaagctcatattgctgccattttgataaagatttggtctgggaagttgaggattgatttattagaatgatctccagttgaaattaaggccttaagaggtatggggcctgggcctgggtagcttccatagaagaggcccctcgggctctgagccttcagtcccaacagatggccagcaatatgtgtagagacagtacagactttgagatcaaggtcacataagcctggatttgagttctgcctctattcttgacaagtaacatgaccttggtcttgttacctaatctcttcggagcttttctgcagtttgtaaagtgggtctgttaggcaggttgatggtgcaggcctgtaatcccagcacgcaggaagcagagtccggagaggatcaccacaagtttgagatgaagctggataatgtagtgagcttgaggctgggcatgcagggccagaccttgtatacataaataaatagaattgttaaagtaagattatcaccaaaacagatttcactaaaagcagagttcaaacagaatagcagctgtaaaaagaacttggctcccacctctaaccctacctacgattgcctagcaactttgtaagaatgaaggagaaaaaaactgaaaagaaacctgggccgggtctcgaaaaatcaaaaaaaaaaaaaaagaagaaaaaagaaagaaagaaaaaagaaacctgggctggcggtggtggcgcatgcctttaatcccagcacttgggaggcagaggcagacggatttctgagttcgaggccagcctggtctacagagtgagttccaggacagccaaggctatacagagaaaccctgtctcgaaaaaccaaaaaaaaaaaaaaaaaaaaaaaaaagggaaacctgggcatggtgacacacccctgtatttcaagcaagtgtgggagaggccaacagtggagaatccttagttctagaccagcctgagctacatatggagtccctctcatgaaaccaagcccagccaggcaaggcggggcacatctttagcctgagcacttggaaggcagatctctgtacgtttgaggctggcctggaagaacacttacttgcctagcatgtggaaggccctgggttcagtctgcagcagtgcaaagggagaagaaaggaatggaaggaggtggtgttcatagattgctcaggataacaacagccccacagcccagagcccagactgcaaatccctaccacctgccattgtgtcctaccctgtcattctgtagtctttaccgtctggcctctctccccagaagcaggggaaacaacttgaagtgctatcagagagtgcagaagaaaatcttgcccacatttaaacaagcacccacacccctctgcccctcctccaatcgccataactgtgactgaggccacagtcaccacacccgcagcagcccaggccccaggccttgctctcctgccaactccacaagcgctcgacttgagctggcattggcctcagttgcttccaccgtcctctccagtcacgtgcctccagcttcgagtcggctcataaccaaaccctggccctgggtttgtactgcagatggagggtggggctggcaggggcccaggtgcacatccagatgttgcccctgagactttcttggcatccccgagccagctgtaaagtagtattcactgaaaaacacaggaatgaggaagtatttgccccaccccacccccaaggataatgaattagtatacttggtctcagggagtacgtagagaagaaaagcagggctctacttgctataaattatttttttaattatatttgtttattttagcttttgacattagatttattgatttatgtaatgtgtacatgtgttgtgcatgtatgactgtgttctacttgcagacctggtatatgatggggccagaaggcagcattggccaagtgccatgtgggtgctgggaatcaagcccatgtcctccacagcctgcgctcttaaccttagagttgtctatcccatccctagactttaatccttaattctgtgtatatgtatgtgtttgtgtatgggtatatgtgcacatgggtactggaacctctggaggccagatgtgccagatcctcctagagctggagctataggcagttatttgtaagctgcccaacacgggtgctggcacccaaactccgatcctctgcaagatcagtacatgctcttaaccactgagccacttactctttatgtcatatgtgtatgaatgtgtgtgggcatgtgtgtgccatggtgtacatgtggccatcagaagacaacttacactgtgatgtttcaggattccagggactattcaagtcatcagtgttggtggcaggtgtctttacctgctgcacccactcatgggttcaaagggccctgctcttttgacaagaggcctggtctgggtaggattcttggcaaacagtggaggaagatgccctgtcggagctgagctggggtttcaggattgtccctttgtgtgtttttgctggtccttgataagtatcacctctaggggcctccaaagcttttcttgatgctacttaaacctcactgagcagtgttatcctgggcaagattcaggtagtgagtggtatctgcctactgctaggcactcagaccaggcgccagtgcttctgggaccatcatactctagtactagcctgaaggtctggcagctgtgcagaatccaggaccttgggctgctaatgttttccctgacctacagccttggggatatctcatggagtgggtcatctgcttaaaggactggctacaggtatacagctctattactagggagccccaccttgcatggactcctgggaggtacttaggtataagttaccagtaaagcagcagccactgtggaattctagagtccactgttccttatcccagaaaaggctgctgtcctttgacccaaagacaatgtagtatttcttcatcattacctctgcccattggcactaaggataaacccctgacaccttaggaagtcacattgatttcagtgtcacctgctcttctaaatgaacccaacccccagccttggtctagtttcctcagatcctctcctttcaacctgtccctccatctgtagccactgttaagagtctatgcaaggcattggccttgctcggcactaatggtccaggttttaatcctcgccctcaaagaccaggcgtaccctgctggtccctgaagggtagtctaggtgcagtgatgagagaggttgtggaaacagttgtcccctcatcaggtagcacttctctgtttggccccctcccaccacaaggcaggctggtggaattgctgccagcaccccccttgtgtagacagctgtctcctctgccttcctgtgagggatcctccctgtgcactttctgacctgtgcagagcaggggcggggctgcaagggccaccaggccccgaaggggaaactgccgaaacccctgggacaggaagtggtacacaggggctgcttcctctcacagagcaggggtgcggggcggagagagccgcctgtgtcctggcccctgcctgcctactatgagccctgggaggctagggagaggtgacagtccttttccctacctcccttctctccaaaagatgaggcttttcctgcagcgcactggagaggtggaggtgggtaaaggggagagcttcttcagagaagccaccatcccttagcaattagagaccagagccggcagatcaacggaaaggcaaggcacagggtaggtgagtgtggggtgaggcacctgccccacctgccaggacagcagaaagccacagctggttagaggaaccctttgtccttgagcctgagttctgggagcaaacgattaggaccacacctgcttagcagcaggttggagtctgtggatgcctgacttgtagcccacagacaggaatggcctcagatgagcagctccaacccctcatggtgcagccgaggaaaccaaggcacacaaagcagaagtgtcctgtttgaggtcacatcgtgggcagagcagaagccaaggctctaatccagaggctctctttctgatgaaaatgtgctgagttggtatttagcgtcccacacctcccacaggcacctccccccatcccccacacaacagggttctgggacattcttctcagaaatgagcttgatgaattgattcacacggaagggaggtggagtgtttagtccagggatcatcgaaggtttctgtaaaggatcagatagcaagtatgtcaggctttggggcttatatgaatgagcactaataacctataagcatgtgttccaatacagctccgtcgataggcacggaaacttgaatttcagaacatttgcatgtgtcgtaaacttccatccttgtggcccttctttgataagttcttcaagccctactgagagccaagaagtaaagctctaggctgtcaagagcagaggctgctaggtgggaggaagatgatgaggacaacccttgaaggatgtgagggaactaaagtcacaaaagtcgagagcgggcatggctggcctaagggacagtgtgaacaacggtgtggcagtggggagtcactgtaaaggttaaccgtgctccgcacatgtgtggcttcattgttatttgccagccactgttgctctttttttttttttaaacttttgagacagggtctcactgtgtagccctggctggcttggaacgccctatgtaaaccaggctgcctttaaacacacagatatctgccttgccttggcctcccccagtgccggggttcaagaccaccactgttctcactggaggaaagggttagctttgttgaggatgcagcgagaccatgagaagaggaggagggttactgcagagagaacttgagtaactcaactctcactctcctggccccccccccaaactctcgggtaagagagacgggagggaccttttaggttcttttgaactttctgctttctggagatgtttcagtagtgccaggagggagagagggagaaaaggcaaaccccagggtaggtgttctccatgattcctgaagccaaagctgtctgtggtctccccaggccccgacggattgcttcttaccccagcctttgtggcatcatcccttctgagtagggattccggtgcactgtgcctctgcttggattcctgcactttgttttggatggtcagtagaggaaggggtcatctgggaaggatactccctacagcccctcttactcatggtgggggcagagctgagccaggagcctctgtatcagtttctaggacacacactgccaggggcctcgacaaagaacactgacccctcaataaaaagttatctgacttaatatcctgttgtgcggagtcacagattgccccagcttcgaaaaaatccactaatgaatttaattagtctttggcccatgcttctcttcttctcttccttcctcccccctacaatggaagccagcaggactttctagggactgggcccggtgtgctaagtcaccatccactcagtgtgtgtgactccctgccacttggtcctctgcaccaggtcaggagactctgatgcccactgagcacctgcgtaggctcctgccctgtgccctaactagacaagatagaatctcagaggtgacatgaaaccctctcgcccataagtggaagccgaggcaggaggatggtcagtttgcagccaggactccaaagcaaaaatctcaaaactcaaacagaaagacagaagcttcaaaaatgcccatctgcatcttttctcccattaactttggtatttttttttttccaaaacagtccctgtttcaaagggtccaggctgaattcttgtccagcctcatttcttgccttgatcactccatatctttgaacattgttgttattgttactactactgtgtgtctgagtttgtccagccatgcacgcagagtacaacttttggaactcagttttctccttgcattcgtgagttgcatggacgggacacagacttttgtggcaaaagcttttatcaccctgagccatctccctggtctcatgtcttttaacattgtctcagggtctctgtatggccccctcaatctgtccctctttttccatgaggtggttctggcatccctctcctgggttcagttgcccaacctggtcatcttccatctccccacttcggggactgttttgtaaccagaccaaatgactcttctcaaggaactgcttttccttgccctggggatcagcaggatgtcctaggcgctctccacagcagttcagatcctactgtctggatctagatcttgtcgacttccctaacttccaaccaatacccccctcctcttctcccaggtcaaactacttaccttacttttttatttatttatttttccagtcagggtttctttgtgtagccttggctgtcctggaactctttgtagatcaggctggcctcgaattcacagagatctgcctgcctctctctgccttcagagtgctgagattaaaggcatgtaccactatggcctggctcaaccatacattttctttattattttttatctggggggtcaacaagatcttgctgatgtttctgaacatctcgacacagatcttccttcctgcctccgcttcccaagtagcagggaccacaggtaggtatgtcactgtgcctggcttttccatgaatttagtagttaatggccttggctcccatggctttcctttcctttcctttctctccatctaggtgaaacattctgaatacttaacaagcagaatggccaagccccacaaataataaatcagaccaggaaattggaaaatacatttagagccaggtattgtgcccatgcctgtgatcctaatactggggaagctgaagcaggaggatggatttgaatatgaggccaacctggactacacagtgatacctcatatccaaaattcaaatgaaagggagaggggaaaagagaaaggcatagcagggagcctttgcctatagtaactcatttagcccttggcagcagcccctaggactggtcacataggcccattttgtacaggatagtgacttgcctaagttccaaggcagatctaggtcttcttcctgaaaggtccacactcggggtctgcagggacctctgttggccattctaggctgtagggtctgtagggatctccactgcgcaaaccttcgaggttgtgataggtaacaggaccatgttctggaggtcagaagttaccaggacctagccttgctccctccctgcgtctgttttctcttccgggcctctttttcccttaggcactagggaagaggatgtggtagccccaggcccctctagagggtgctcagtgagctttctcagcgtgactgaggaaatcggttccttttgtcagccccccctccctctacccctccccttcctctcctatattaggacttctctggtgcttttcttgctacataaccacaacccaaagggctgggcggagtgacacaggcggaggacagaacactccaccccacagggaccccaacccaggagaggacttccttctcagctcccacaatcctggggtcagggagcccaccccccacccccacccccccttgccctgtgagaggtcacctgacgcttatgctctgtgtgagtgctgtctagtttttatacttaatgcctccctgggttgtcttggttttgtttttttaatttggttctccatcatttttttttgattgatttgtttgttgtttgtctttttgaggaagccttaactttgaacttctgatttttctatctcagcctaccatgttcagggagaaaatgagtcatcacatctgtttttttattcagcattggggattatagccccagccttttttttttttttttttttttttttagccctggccctggtgtagacctggctggcttggagattcaccttgcatgctaggcaaacactgtaccaactgagctacatccctagctcttgggggtttttgattgtttgtttgtttgttttgttttgttttggagacagggtttctctgtatagccctggctgtcctggaactcactttgtagaccaggctggcctcgaactcagaaatccgcctgcctctgcctcccaagtgctgggattaaaggcgtgcaccaccactaagacaagatcttgttacgtaaccgaggctggctttgtactggggatcctgaagatacaacctcttaagtatggcgattaaaggcaagccccacaacacttggtttaggaacctagagttttggttgttttttttttttgcaaataagcatagagaaaccccagccttgcaaaacctcgccccccttcctgatttcatcgccagtggagggggcaggggacagaggaggaggagctgatgacagagctgtggctggagtcactttactgggtacttgctcaagaaggaggatttggttggctgattggagttgagccttaaactgggacaaggctctgggtttgagttctgctgatggcttaggtctgctctgtctaggactgcgaattccatcctgatgcctaaatacaggctactggtcacgtggtacagcaggcgcaactccacactcttagccagaggaaagacttttttttttttttttttgcatagaggggacagctgttctgttcctggggcagcttccattttgtctctggctgttgggggaggggtggtgcaggagtgggaaatgacatgaaggaaattgtcatttcctttccaaagaattccagaaaggtttcatgagagaacgaggtatttcaggagtgacagtcgcctcttgagaggacagggaactagagaattgcaccgggtggcccagctgactatctggcccccatgtttggcatgtgcaaagaatgccttgggtgttaccagcaattcggcgagccattgactgagctgatcaagcctagatttaaacccacttggtagagattgtggacgtggctctcccattaaagctgcctcctctggtaggggagggctgtatgggtgggtgctggatgctgcttggtgtgtcccagtaacagtcccaggaaggaagggtctgtacccctgagctggggagcctagttgtggttatgcagaatcagtccaaactacctcgctgttgccttggcttggaaagtgtactcagaacctcagaggcccagggtgtgtgttgacaggcagcccggcctttttgctccgtctagtggtgcacactcctgcaatgtgtatctgcttttcggtgtatcaaccaggcatcacttccccatcccagagagacttgggaatagactttgcctggaggcacgtgtgtcctctgacctcctctctctagcaaggcagtgtgcagggggacaaaaggccactgaagctgtggcctagccaaagggctttgagaggagcctggagacaagaaccttccatgtgtttcttgcctgcctcctatagggtgtgccttctgtggtggtggtgtctttggtttcaagttcctgggagaggggggttattttgagggcctggaggagagtaagtgaacatgcaaatgagcctttctccacctctcactttcaaatcctcaaacttttgaagggggaggggaaatttctggactgaaaagttccaagaggtaggtttcttaaaccttaccaagagagtagggcagccacatccccacctctccatccctttgctttagcttcagacagaaccagatctctggagatagttttcgaagatctcccagctagaaggagcttagacacatataatatacgggcacatataagaacattactggaattactcctttctgccttcgaccatgatggccaaaggttcagtgcatttcaacacacagatccggggggacctttcttacctcctagttccttagcagagtggacctagggaaggggatcactcacctgaggacccataagtctcatacctgtgttggagttgtcttttttcccctggggagcacacagtcaaagagccttgctaaccagcagaaccctgacctgctcagcccccccacccccacccccgcccattgtctcctaagcacttgaaccaaggcagctcagtctgcttgccctaaaggagcgggaggaggaacctatgattgagctccgtaagctggccagaccagggtagccctttgacacacagaggctctcacgaacatgtccccacacttggcacacatacacacaccctgaatatgtatatatacctgtggtctgtttgtacactcacagcagacagatagtgcacctgtgtaactagcaatgcaaagaataatatcaatgtagcctctgagcttgcacatctctcctcacacgcagtcaaggtacatgtagctctatactgctcaaaaaaaaaaaaaaaaaaacacagatgcccatagaccagtattggtcattcactcatttgttccttctttcttttttcctgttttaaatttattttgtttagtttggttttatgtgtgtgggggggggggaggagtgtgttcatgtgggtgcatgtgacgctagtgcgcatgcctggatatcatgcctatggagacccagaggtcagcctgtcaggaattgtccaccctggtgttcgtttgagagtgggtcttttgttaccctgaagcccacagtctaggccagctaactagcagatcccaccgatctgcccaacacactgccccagctctgggattctaagtatgcttcattgtgcctggcttttaaaaacaaaacaaaacaaaaacccatgttttctaggcactgaactcaagtgctcacgttttcatagaaagtactttaaagactgagctgtctccccaaacctggattttatagcccaggctaacctcgacaccacagtgatctgtccatcacaactctcaaatactggcattgcaggcttgaatcaccatgccgattgctgctcccccccccctttttgcatttatttcataaaccaaacacaaggcaaggtgtcgatgtcttatcaatgatccacagttatccctacggtcaaggaagccagtgtctgacttgggaggtcaggacaatgcatagaggtttcctaagcaaatagtaccagcagaacttttgaaaatgaaacactggcttaggaagagaaagcaagaagacaaagataccttgaacggaagggccccagtgaatgacctggggcaggagcagatgcagactcttggacctggtgggtttagatgaaagtgatcacctttcatatgactactatgagaatgttccccaagggcagacaccctggctggtgggagagcaggaactatggaatgcttgccttaagggcacttaggctaggggagccagatgcaagtggtcctgcaagattttgcaggccatgagggataaggtcacatgcagggttgggtgaggcaagatgaaaggatggagccagaataaggctgttagccctactgctcctcactccccagcccctgtagttccacaagtgatagacctaaccgcgttctctcttccatctaaagggaaattcaactctggtggataaaacagcctagcaacttctccaggctgtttgatggagtaggtggaaaggtgtgggggtggagactgggcggggctaaccctgtgggctaacggaaaggaagtgggagaggcttgggtgtctcctccagtggaggagagcggtcatcagagaggtcacttgtggcacccttcttttacccctctttaagtctcacccggagttcctcgtttatttcccagccaggataagagtttgccatcctggcactacagatggaatgtcaaggcgtttcgatgtgtgctctagtgggtagcctgggttctagcctgtctctggtggttgagtcagcctgcttgtcgttattgcacacattgaaaacacatcacgagttcaggaacctgaagggcaaaagaccaggtacctggacaggtgcaaaggccagtagggtccaggtggaaagagcagagaagtcggtcagaaggagtctggaaaccagagctttgggagttggccccaggtgatcttgctagaagcagcctggggctctggtaattgaggagtagatcccggggaaactacaggcagctgcagtgcctggctagcttgggaggcactggggaaagactcgtgtgggtttcagcagacagagacttcctggaatatgggggatgagccagccatagaagatgaggaaggttctgctggcccctcccccagccagggctctcctcacaagttcccagggtgatagctcagtcctgaaactgaaagcaaagctcagccgagaacacaaacccacaggcagcacagtgcagaggccaccctgtggtgggcaatgggggtagggttgctaacaagcatgcaaggcatgtgacctaccagcccagacacccctccccgcaaccccaagtgagacatttcttcctctgtagactgttccttgagtcagctggtcctcacttctaaggtaaactgagcccatgaacaccctgtgtcccctctaagccacacgtacatgagtctttctcaagccaggatagttagttacagatttttcctcctagtgccccgcgtcaggcctggtcccttcctactctgtctctgctggaagtctgtctaggcacagcagagcctcttggcttcactagctgattagggcacggagctcagggaaattggcttactgtttccatctctcccttctctgtaggttgctcttgtggttggcatagcccagcatgcaatcttgagcctggcatagtccacacccactccaactctggttatcctccccagaggctcagagaaggcactagattgatcctaacatacctgaataacttctgttcgacaacaaaccaccgcagctccagggagccgggggagtctcattgtcagctctggcagaagccagtatggctattgctctgcagcccagtgatctggtcttcgagtttgcaagcaacgggatggatgatatccaccaggtatatggtctctgggagtaaaacagtcagtcagtatgggcaattagggagacatagccgtgaacagccagcctgtgagtccaaggggtgggggaacttgacagataactagtcagcaaatacccatcaggcaccagctactccctaggagtcactggatggtcactcagggagctggttggctacatgccattataatacatgtagtcactaggctagccaagcagttattaagcaaaccagctgggctgtgagtcaactggcaaatggaactacacagacagttgcatacaactgaacatcatgtaggatgtctgctacttccctttagccccagtgtcacagtgagcaaactgctgggacaactccatagcaaagagggcactgccagctgcatttaaagcacagcattggagtcttagcatcttcacactcagggctccaaaccagtcgatgggctcgctcataaatgtcttctcggcctaaggattcaggacatgccaggaatggggtctttgggcaggaggatgttggaaactacggtaggatcagatcttggtaccctggtcatgtttgctttatcacttgtgttgcactgaagccaggaggatgccttttctgtgctggtaagtgttccacagcttccactctgctccttcagaaagaaaggagaaagatgaggcaggcaagtgtggaagtacggaagggagagtagaaattaaaactgttgggttttaatctcagttgagacaagatgtcacctagccaagtctttcccttaacctatctggctgctatctcccaaagcttgtccaagagaagatccagctgaatatttccaaaaccttctctgaggaagtcagatgctctatctatgggagggtagaaaaccctcatactggtcctaccaaagcctgccctctagtggcctttgagtgcattgcactttctggcttgctggttcttggacaaaataaatcagcttgcttgtcggttccagggcataaagacttgtggaaggcatcagataagaagggaagaaagggtgacccttacctggattcttagtgctaattcaccgtctttcgcttgtttccaagcctccagcagctattcctattctctatactccccagcatctctgtatgctcagcacacagactctcctctgatcgagagatactccaagccaaggctgcctgcaatttccctgtcttctcccacttatctctaacatcccctgttcttattcccttcccactgacttaggggaactcctaccctttcagagcatctgtttacacctacctccttcaagatctcaaaaaagtcacctcttctctcccaccttttctccatttttcctttctgctttcttctatcctttctgcctccctctttccctctatattctctctctctctctccctctctctctctccctttctctctctctctctctctctctctcacacacacacacacacacacacagagagagagagagagagagagagagagagagagagagagagctttcacacctctcatatataacccctaaggtgtccctagccctaaaagtaacccttcccttccttctgccttcctacttcagaataccagcttgttggcttccccacagaccccatactttttccattctcggctgccttttcctcctcatagaaagcagtctttgctgttaaatgtcacaaatataaaagaattcagagccgggcatggtggcacacgcctttaatgccagcactagggaggcagaggcaggcagatttctgagttcgaggccagcctggtctacagagtgagtaccaggacagccagggctacacagagaaaccctgtctcgaaaaacaaaaacaaacaaacaataaaaaagaattcataaatcataagcatacatacagacagacaaaggaacgtgagtgtgctctggttaagtaggaaagcatgggacttaaaagatggatcagcagttaagagcacttctggctcttgtagaggacccaggttaagttcctggcatccatttctgacaggtcacaactgttataactccggtcccaagcaaccctcttctgacgtctatgggtaccagacatacacttacattttgcacatagatacgtgtaggcaaaaccctgacattttaaaaagaaaaaaaaaaacccaaccatttgtttcccagaagctccaggtacctaatgataacgtactctatgccaggccctgttgtgaatgcatcatgcttactgatctgtttaaacaatctatggggtccatcatatgagtaacctggtttcatgactaaggaaactgatacacagaaaggttggaaaactttcctagggtcctcgtgctaggaaatagcagatattagtttaaaatccaagcaatctgtctcttggtcagtgcaattcaatcacattttttaaaggtttattatttattttatgcatgtgagtacaccattgctctcttcagacacattagaagaaggcatcagatcccattacagatggttgtgagacaccatgtggttgctgggaattgaactcaggacttctggaagagcagccggtgctcttaaccactgagccatctctccaggcccccttcaatcacgttttatggaattctagaatgtcctgtatttgtctagtgcaatgtaggaccactagtcaacatgcagcttcagagtccttgcaaaatgtttgcccaggttggggctttaggtcagtggtggagtgcgtgtttagcatgtacaaggccttgagttccatctctagcactgtgcatacataaagcacatggctgactgcaagtcctgctaagctaagccatctatctctgttcatcaagatctcacttaaagcatcacctagggtgagaggcctgacaagatggcctagcaattcaaggtgcctgctgcaaagcctaatgacctgacttccatccccaggacccacatgagtgaagaagaaaaccaactctagcaagttgtcctctgaccatccccacacacatgcggtggtatgccccacctcaaaaatgactaagatttaaacaaaaaaatgtgatttttaaaaagtatcacttagtgaggttggccgtggcatctggtagggtgggcttctcaggaggaggggaaccctgactcagatctctttcttctccatagctggaagacccttcagtgttcccagccgtgatcgtggaacaggtcccctatcctgaattagtgcatctgtgctcaggactggatctggatgaggtccacaatggcatcataagggacaggaccttgtgcatgacacaggatcagattttagaaggcagtattttgctgacaggtctgttcttttttctggtcgggtaaggtgtatggtccgagaaagggcagcagccttcagggaaaagcaactccccgtggctgctgatagccccacataacaaccaatgcttcccacaaaagaggaaggaatcatcttagcccatccataaactcctcagaccgggtagcgcccacaatggaaaccagtttggggaggggggtcggtgggaggagctctgatatctgcctagctgtaccatagcccatctcccctggggttggcccttttattaactattctgaagcctgatgaagctctcctttctcctcccacttcatggaacttggaaccagatgatgatgtatccacctcaaataacgtgtcatccactgaagtcctattcaatgtggcaactcccagtgatgtcctggatgagaagcagatctgtaagtttgaacttgaatacctgaattcaaggtgataaaacagcccacgttgcttccacatgctgggttctcaggcacatgtgcatttgctctcagtcctcacatccctcagtggaaacgtgaaaagactcaaacagaaacatctcacagcccctgttgcctgttcctgaaggccagattctttttttttccattttttattaggtatttagctcatttacatttccaatgctataccaaaagtccccccatacccacccacccccactcccctacccacccactccccctttttggccctggcgttcccctgtactggggcatataaagtttgcctgtccaatgggcctctctttccagtgatggctgactaggccatctggccttcaggaactaaacagggtcctgaaggccagattctaagagggcatagatgcctattgatctgccatggctccaagttccttagaagacctccaaggtagctccccttagttccttccctagaaggtactctactgctcaagacagtcccccagtcagttgcccttacccaagagggtactatggcatattaaaggaaaaaaaagtctccgaggctaaaagaaatgtctccccttgcctctcactaatattcaacaaatattgaccgagtgccaacaatgtcccactgttgctgtgtgaccatggcacatgacttgccatttttcagtttccttatcaggaaagcagaggaattgggattaatgatttctggagtccttttgacttgtcagatgcgtgaatgactaaatcattcaagtcctttatccgaatgcaacctggcccttccccactaccagcagtgagagataaatgtagcctttgtggttagggctgatcacacctataactaactctgcagatgtgggacaagacccctgaggcagctttagatgtagtctgtgtgtgtggcttttgagaacggcatctgcaccctccctgtgtgctacccattttactctggagttacaagagagaggaggatggctctccttgccctcagctctgcccatcaccggcctttcttcttgcagtcagctcaccggaagtgctttcagactccaactctgttcaggccatcaatctacccaacttcctgctctctacccctgaacctgatgacctgaagaagacaagtgatgctggtgaccagaaggagcattctgaggaggagaaggtctccagagaggaaaatcttaggaagatggggaaggcacggaagagaagtaaggatgagggggaatatatgtgcatcttctgtgtggggagccttggggggactgggaggccccaagcctgagtggttcgaggcttgcagatacattaaggtgctatctctttggtccagcagggatggacaaaaggttcctcttctgaacgtcttggcttccttaggtgttcttcccaaagccagccttcctctcacactgcttctatctatccagagcattcataaactcctctagctatgccagtattcccagttgattggattctagggtaggtgttgggacagcaggcatagactcctggctagttcctggactttgggggccctcccttataaaaatgagtcatgctgtatgcttatctagcttctattgcgtttatgaacaaggccatctatgcaaggactttggactttcccaagctcctgtgttattgatttacttaggagatggctgcttgatgctgccttaccagcatgcctcctcatatctctgtaccacactgatcgactccacagcaacacctttaggctatctcccatttcaaaagttagatcaagaatgtctggcctagctgttcacctgaactttggaatctaaaggtctctcatttgcaaatctctcatctcctcatgtggtagccttgatgtggtatagatacttcttggctgttgccgtggggaaggattagactcccagcttactgatctggcttgcctagctaactttgacttcagctttctgcttacctgccttttcttcacagaccgaaagaccaagaacaaccgaagtacctcacctgtcactgaccctagcatgcctatacggaagaaatccaaagatggcaaaggtatagctggctttcaggtgaggtgggcagggtgcccccttaatttaatttcagaagcctaagcagcccttcactacctctccctctgcaggcagcaccatttatctgtgggagttcctcctggctcttctgcaagacagaaacacctgccccaagtacattaagtggacgcagagagagaagggcatcttcaagttggtggactccaaggctgtgtccaagctgtggggcaagcagaaaaacaaacctgacatgaactacgagaccatggggcgagccctgaggtaggagttgctgggacacagaatttcttccccaagggatcactaagatcttcctgtgcccaaggaggctctcccacttgaaggaagacctgattggtcccctctaggaaatggctctaacatttcccttttctttcacaagccctctttagcatctctttgttgaagggtagtttagctccacagacacccaaaacatttctacagagggcttttgtcacatttttggaagccagagatggcgttgagttgtccccgagatgcatccttgggcctctaccctctgtccctgcacgcccttttcttttcttttctttctttctttctttctttctttctttctttctttctttctttctttctttctttctttctatttatgagcacactgtagctgtttccagacacaccagaagagggcatcagatcccattacagaaggctgtgagccaccatgtggttgctaggaattgaactctggacctccagaagagcagtcagtgctcttaaccgctgagccatctctccagcctgcttacaccccttttcactcttcacctactactcactgtccttagtcccaaagcaatatgggattgacattgaataccccttttttgtacatctgatagactgtagtaacttttaaaatgtcataaatggccctttgtgtctgagagttggctattttttcccagccccaccgtctcctggactgtccctgttcagtccacctgagtcccgtgcttgcccagccttagaaagtagcatattgaacaaatggaacgacagagcctccttactcaacctctgataaacccaccaatccccttcttgtccctccagatattattatcaaagaggaatcctggccaaagtggaagggcagaggctggtataccagttcaaggagatgcctaaggacttggtggtgattgatgatgaagaagagagccctgagacaccagaagactcttcccaggcctcgacttcctccacaccctcgaccagtaccatccggagagccagctccagggtcggaaccagagcctcccccgaggacaaggataaccctccctgggagaagccaaaagtccaacacactggtctccagccatctgcaagcctggagttaggattgtctgtggatgaggaggttcccaccacctccaccatgcttgccagcccactacagagccaggccaggctcaccaaaactgtgaggtaggagcatcctagcaatcgcagtcttcctttagtccttcctgttgactatagggggtcagtggtcaggttcctgtgaagctctgctgcatttccagttttgtggggtcttcacagaacccctaagaagcaagcagggcacttgttggtcaagaggaaagatggggctggggaagtggctcagtggttagagagcatggcttgcccttgcagaagagtccgggttgattcccagcacataaattgggcagctcataaccacctgtaactccagctccagaggatctggcaccctcttctagataccaacagacatgtctgtctgtctatctgtctctctctctccctcctctctctgttctggataccaacagacatctctctctctctctctctctctctctctctctctctctctctcacacacacacacacacacacacacacacaaataaataaaaacaaactttatcaaaataaaatctgaaaagaatagaactaaaaaataaatctctttcaaaaagagaagcatggcttgcctgacagagtaagccagcacttcccttgggcggggggtgggggcttctgctacaagatatggctgtctgtctgtctgtctgtcatccctatgctactacagcatgtcctcaggagccatctggggcttctccatctggtcccatgccatgaagtcccttccacttcacaacagggcacttaggttacagacattaacaccaccttccaggtgtcttaggaatcacactctgctctttgatgctaagggacctgcagttttctctaaaaagattggttttggggtcatgttggcatgtccgaccacattggtttgggtcacagggacactcttcagaggaggggaagagttgaagaacagcgaggagcacaaactctaggcttcacaaggcttccatgcaacatccccacttccacctttgctagttctgggggccctgggccgtgtgcctcagtttcctcaaactctacaattcatgggcagttttgaagcttgaatagtgtcagacttctagaataacctctgacctatacaaatgaatacatactagctagagcaataaagacacaacaaaactacaactccatttctcttacgccttcctttctagccagttagggtacctcctgccttaaccagctctgttttctgtcttttttcagttcttctccagcacccagtaacatccacctaggagtagcccctgtggggcctggctccactgtcaccctgcagaccatcccgctgactacggtgctgaccaatgggcctcctgccagtactactgctccaactcaactcgttcttcagagtgtcccgcaggtgtcaacattcaaggacaccttcactttgcagacctccttccccctgaacaccaatttgcaagagaaccaggtggcaacccaaggggccccactgatcctcagtggtctcccccaacttctggctggggccaaccctcagagcaacccagctccatcccaggtcataggtgctgggtcagcagggcctagctctcagccccctgggactgtgattgctgcctttatcaggacttccagtggcacatcagtgcctgtggtaaaggaggggcccttgaggtcctcttcatatgtgcagggtgtggttactggggcacccgtggaggggctgttggttcctgaagagaccctgagagagctcctgagagatcagggtcatcttcagccacttccgagtcaggtgctctcaaggggttcccataacctgagccttgtggggaaccagactctctctccccctagccaccccactgttgggctaaccccagtggctgagctcgagctctcgtcaggctcagggcccctgttcgtaactgagcctagtgtgaccagatccccaacccaggcccctttctccccattcaatcccacttccctcattaagatggaaccccaagatatataaacaaagggatcaaaagtatgacccaccgggcaaaattgtgaagcattttcatgtggacttaagtaagagtacccacccttctatctcgtggggtgtgagaacatttgattccaagttccccaggcctatttgacatcgctctgaccaaagtgtgcccagttcaagcatctggcaccagaccagggccttcaagagcactagggagtagatgtgctcttggaatgaaaatgagctgacttggtgatggagggaaatccacaagccaggaagcagcttgtggccagatctggtcagcagcttcacaggacgagttaggcctggtcatacttcgttatctgtattccttacacagggaatttaccatccaatatgtgaatatcttcgtatgcatctgtgtgcacttgtgggtctgtatcttcatttctttgggaaggataggatgtagatgtcaggtcttgtctgtgtttgtgtgtgtgtccgtctgtccgtccgtccctccctaggtcagccacagagatgaggcagttttaagagaaagcactctgtaactttttcttgttgttgttggcaagcaacaatgcctttctgagactggaaggaactggtggaatgcccctcctcccagtctatagaggtgtcacagagctggaaaaggtctaggtaggagaacttcaatgggtgcatatgctgagaggacactgctaagggacaagaggccatgtatgttaaaaccatagtgggagagagaaggaacacacttagtcctgggagcacttgcttgtcatagtcaccttgccaccaggctggaacccggagtgctctactgaaggttgtgaggcaaagcacttatctctaggcagccctgattataaagtccctagccaggcctgagtgcattgaatggttgtggccagggcttttggctgtttgtataaaatcagccctatgcttgacaataacagccctttgtgatccagtactcttccttccctatcttgggttccctcttcactctgtctgcgctgagaaattccacctgtcctcagttgctgaggctagtggggtggcaaggctagctccagccatacagtctcactcactctcccaccctctcgctctcacagtggctctttgctttttatttctgcccatcacatctaacccgattctcgcttcactgagatgacaggagcgagcacacatgggttcctacagctcctgtcagcccatgagtctgcttttctcttttctgtttctggaaagagctctcctgatcttagtctctcagcagagggtctccatctcccttttttgaatctgcttgcctctttcctaccaggtttaggaacaatgtgtggagatgtcacacccagaaccaagtctagctagcctctggcgactttggttaatgtgaatcagtgctccaggaccttctctatgtcctctatgccaaaaacacccacttgacctaactacctccctggccggtcatcctcctccctactgttccctctccttccctggaggaaggagccatctgtggctctatgcaggtgtgtttgctacattcccagcaattggcgctgaaatgtctgttctaataaaattggctgatgatgtcaatctctggatggatggatggaaggaaggaaggaaggaaggaagcatctagagaaaaggtcaccattgttggcgttagtgtttgctgttcttgttgtgtttgggttttagttttttggggtttttgaacttgctctgttggttaagatgaccttgaacttccggttctcacccccccccttccttgttctcacatgtggatcaccatgtggttctgtggaccaaagccaggactctgtgcaggcgtgacgagtactcctagcaactgtgctaccttccaagctcaatcatttttttttcaatcagttttaatgagcacaaagggacagtatgagttgccatcagcctgggacctaatctctccatacaccattgtgctttctgttttcgtgcgggctcctcctctctgtgtgtgggtgttctccaagggtctccattttgtcatgggccagttctttcacatgagttctggaacctacttctctaagttcctggctctcgctcagccctagtgatctgcttctgttcatgatgccaccattctgctgaccttctagactggaaatctcagagctgtctggtgggctctgtgcacttgaccctgcccctctccctcatctcctgttatctggcctgtcttcatttccagagcctccagcctagcccatgcctcttaacgtcccacttcccaatgtgacttctcagcacttctctctggcaggctacttgctctggccttcctctgctaaaaagccttcagcgagtcctggcctgcagactaggccagtccttaaactgctgatccccacccactcaggattttctagctggtctaggcctagctttagttccccaatcgtggcagggcccaagaagttggggagcacttggagagtaaatcttgaaagatttgaagtttgataacaacccaccagggaaaagagctcgaagtcggtggcatttcactagtgggtcctctctgatattccccactcaccccatgccaaggtactcttcgaggagtccatggtctttgaacttgttcccacttaatgccttttctttcctgggttccatctaaccaatatgctctatcctcttactaacaatggaaaactgtgtctcaagatggaattgagtgggaacagccagttcttacctttaattcttaaacttgtaactgccacttgatggacaggtgactagaaacagcctgtgacatctctgttgtaatcacaaactgttacttagactgtaagtttagtaccttttatctcctgtgtgtgttaccttctgaggggtaggcaccaccgtgtcacccacaacactgggcatactataacgcagatgagcatccctgaccagttactgtttgatctgatgagagctgggaagcaaacttttgaggtagctgaccgccgtcctcccctctcgcttaggcagttactccaggtgcttcactgcccagtgctgccccccccccccacaggaccacctcaccctctatcttaacatcaaaaatttgtattactttcaacatccctctgatcctaaagacaacttcttgttcagtttcttccttacccagagtgttaaactagctaaccggttaactaacccttgctgacaagcgttctgcaagaggcttacaggagaacctcaggagacagatttccttgaaccagagtcaggtggcagcaatccccctgcttttgtgatggcctgcctaatggagtcaggagtcaagtgatggtcctcacgtcccagcggctgatatgtgactccctcctcctggctcccacagcactttgtatatacctcttattgtagcacattgtatgtagttctttgattgtgttcatgtacggtttcccttcaacagactgtgagctcctccagagcaggagctgtgtgctagtcagtgatgtatccccagcacctagccacagtgcctgatacacagtaggtgctcaataaatgtttattgaaaggctgaa

SEQ ID NO: 644 - DNA, 7094 bp, mus musculus; identical to SEQ ID NO: 12

SEQ ID NO: 645 - DNA, 3247 bp, mus musculus; identical to SEQ ID NO: 38

SEQ ID NO: 646 - DNA, 5427 bp, mus musculus; identical to SEQ ID NO: 103

SEQ ID NO: 647 - DNA, 31256 bp, mus musculus
gacagcaggagggtttgtggctagaagtatactggcaaagggtcattattaaaatagccatcttagaaaatatgtacagaacagagggacatccagtttgctggccagtttataccacagctcctgtggctggacagctcattgggtctcactgcctccttttggctccctgcacaggtaccaatgccattctcccctccttaatgtgtgagcagcaagcaagtggacagaatgagaaggacacacactgattattaaatgtctggacttgtgtttttaatataggggtgacagtccaaagattgacttggcaggcagcgcactctctggcatcctggataaggacctctcagaccgcagcaatgatattggtgagtgaagacttaacttgttctgcttctctttgcattgttaggaaagaacttcagggcctggcttgcctcttcaagcaatgtgatgggctctattgtggccactgaaacgctaggctctcagcctccgctgagttttaaactgtcactgtttgacaggggaagtaaatgatttgatttctacctgaaaacgaagtacctgggtttttttggtttttttgttgttgttgttgttgtttttgtgcctccctggccttagcagaagtcctcagaagtgctagtgaagagcaataatgatgaatgaaagttgttgtagaagtaggcacagacacttagttcatgttttccagcctggaaaagggtacaaatgcaaaatgccaggggtcactgtagaaatggcactaagtactttgactttaagttaaaaggagctttttgtgtatggtaattgccacttgccacaaagcaggaggaacttgctttcccaaggtcaaaccagcactgtgtgataaatgggggtgggaggtgcgaaagtcactctgactaaacaaaagtcaaaggtccttggggcccattttggatggatgtgaggtggctggcagtgtgatcttggtaacaacccttttaggatgctaagtctcaaatccagatgttttttaagtgcagtgtctttttatttgtacctattgtcataaggtagcattctcctgcattctactttagagggttacattttgaaattgcccttattttaattaatgtttggttgtgagttcattacagattcacagtcagaagttagaaatgagacatatcttcctcctgcacatcccactgtaacatcaagattgtaatgttctatgacattgatgtattgcatctcactagtcttttcaactttgcccagttttactggtatgtgtgtatgtgtatgtctctctgcaattttattctgtgtgtatctgctaacatagtcaagattcataatatctctgtcactaccaggattcttcatgttacatatttctttttctttgtttttgtttttctaaatgtattttgtttcagcccttttgttttttgctttttttttttttttttttttttttttttttttttttttttttggactgggtctctttatagggccctggcatcctatttttcctttccacttgctatgataaaataaccctggcaaaaagcagcttaggagagaagggtcacaaggttaggtcacaatgctgggctatagtccatcattgagatgaaaccaaggcagcaagaagcttgaagcagccaatcatgtccactaataagagcaaagggaataaatgtagtttgtgttctctactacaatacagtccaggatctcctgcctagagatggatgccatctacaatgggtgacttttgccacctcaagtgtaatcaagataatcccccatagatatgccataagacaacgtgatctaaccaatcccttaagacactcttcttgggagattctagacgttttcccattgataattactactaaccatcatacttgggtagcctagaacttattataataatgtaacactaataatatattagtaagtgtaatcattattgtctcaaactcacactactcctgccttcacttcccaaatcctaggattacaagccaccatgtcaggctgtgttgctcatttctagccacacccaccttcctccaatccactcactcccaacatctggcagttattagtgggattgatttgacatagaagatagatttccataattatctgtgtttgccacttaatttagaaataaatgcccaacagttgacaggcccttagaagagcagcagaggggctggtgagatggctcagtgggtaagagcacccgactgcttttccgaaggtccggagttcaaatcccagcaaccacatggtggctcacaaccatccgtaacgagatctgacgccctcttctggagtgtctgaagacagctacagtgtacttacatataatgaataaataaatctttaaaaaaaaaaaaaaaagaagagcagcagaatgcctgacatgagcctgcctaatgtcaccccaaaggttggacactgatttttttgtttttgtttttgtttttctgaatctgctaataggataacatctttgcaaactgctgaccgaagtctctgacctgaccttgtaaggccttgtctgtaggatacttggttgtgactgtaaatgccaaaaaatatattcaccgcttccagaagttggtttctatccttatccagcctttgagaatctgtcatgaagcataatctcacagttaaaactggctagctctgggttttcgttgggttaaagaacaggaacgagcagagcagtgaatactgattgaaaggctagactaaattatggttctcccaccacactttggtattcagtctgtgttttcagctagaacaactgattggtgaaataccggtaaaggtcttgtgtgggacctcacacaggaatataaagtgtttttctttctctagaatacatagtgctaagtatctggctttttgaagagcactggcctttgacccttgctttcgctgggtctggagttgtctaggatggctattgaagatgtatgactagcacattttttaatctagttcagaaatattggtggcatgggtaggagaagaattcctccaagtgcttttcctactgtggaaactaagtcctagttgtatttagaaacctggagagatggtgctgaagagcatcaatgcacaagttgacaacccaaggtttaggttctttgacttttaagaaatgctgctgggcagctatgttaccaaccaggaaatcctggaatattcacaacccaaacacccttatacacatgtctgcttctatggacttagaagatgttggataacaaatgagatgaccctcgaggtgtgagtgacaacaaagtagtagaatgtaatactgaccaggatgttcctttgtggcagcaggcggggacaagctctacaaaagagcacagagttatatctgtatcatggctttccttaggcggaggtgggggcaggcagggaaatcacatggggaagtgctgaaagcttagctagagcagcctgactgtagtagaatgtttatgctgagtagaggaattgacttggaaatataagcagggttcaaattgagtttaaggggggtggatttgtaatttattgtagagacagtagaagccattgatgggaacactggagtgctatatcagacttcaaaattagtataaggaaatgctgaagagcttgatgggaccaatcagttaaaggaaagctagatatcaataaattggatgggtttagttaatcacattggctttgagatttgtccagacgccccatgtcagtgctgcctggagtctgagagcagaggttcaagggtttagagataggcagggattagaggtagacgttgaattttgcataagcactgctggggaagggaatgtgggattggtggctccaagcctgagtgctggggctgttgtctctggcctgggtagctttcctggcttagtgatcacctcagtcgacttccttaccttgtctcccagaattatgtcaaaattcttggtggtcagcaaaaagatagagatgtttatattaatattgtttgcttagaggtgtcttctgggctaggaagataaaaatcaaaatttaccataaagaaaggagatcaaaaatagtttaaacagggtgctggagaaatgcctctgggtaaagaggacctgagtgaacacacataatggacatactaggaagcatctataattctagtgctcctccagcaagatgggaggtgaagacaggagaatctcctgaagttgaagctgcttttgtagatatctatatgaggtcatgcctaaaacaaagtagactgtgacagcaaggaccagcatgcaaggttgtcctttaaccttccaatgtgtcatgcagtgtgtacaaccacctaaatcctcatgcatgtatgcttgtgcatgcacacagtatgaacacctaccaccctgccacaccaccaggatatttaaaaggggtgagatgcacctaggggtgaaggccataccctgacaaaatccacattcaaggagaacaaaaaagaatcttgccactttacagaagccaagggagaagcagatttttaagcagaatgtctttaaacccaaagacagaaatgctcttgctaggtagattggtcaaggagaaaaggagattgcagaggaaggtggctctctctgggactgctttttcaaaggattccattgctttgaaccaaggaggacattatttgtaccagaatggtttttttgttagtgattctaacaattgaagctgtccaaatgtgggctgcagtgaatagcataatgtagccccgagcatcattagaaaccatcagtgttcggtataaataaatctgtttcctcttaataaagctgtaatttaaaattattataatattaaattagagaacatggctttttcagatcttgtgtgggcagctctcagcatctgtcagccaacgataatttagaatgaaatcaattggtccaaaactaagctgttgatgtcagattgagatattgtttgtatcaaactatgcagccatttttcaaataccataatagaaaatatggaagcactccaacacaggcttgtgcatgaatagaaacgaaaattaaattgtccagttctgtcttggtggtggaagaatctctgttctgattgactgggagattataggccatgaagtgaagtgccagaacgttgacttttactattccttatattctaactcccactgcatggtgagatttattgttacacttcaatacaatcaggagattttcagttattttccttctgaagcacatagcaatggacctccagatgggaagcgacctatgaactaagccaccaagcttcaatgaattgactttgagcaattatcattcattccttcccagttgcttggcatctttgtttttgttctattctgttcaaatccacttaagcttctggttgccactcctttatgccaccaccaccctcttcacttaaggaaggtgacatttttctctcggtcttgactttgacacaccagacacatcacatcgtagtcaatttgggggccaagagttgcagactttcaagtcagcagacttgattaaaaggatttgaaggctaacttcaacttatcctcagattgttcctggatgaatctctcatggatgcctggtgactatgattcctttggaccagggaatggaaaagtattttcctatgtgttaggaatactgttaagagccaatcaatctcaggatcagttagaaacacttgaaaactcaatcatggtgatatatagctctgtaaatttactacaaattattgttgtgtaattaaaatggatggctttatggtttataatttatacttcagtaaagctgttaaacaagaagtgaattgatttgcattaaaatcccagtggtttttttttttttaagttataggacctgagtttaatctgaaggacccatgtttttaaaatgtggtaccaagtgcttgtaatttcagcacaggggaggtggagacagagggatggatccccctggttcactggctagccagcctagtcttttcagtgagttccaggccagtaagagtctccaaagcatcaaaagctaggcagatcccgaggaacagcacccaagatttcaagatcttcctttggcctccacacacatgtgcacatgcacacacatgaacacagacatatgtacaaaaacacatatatactactcatatgtaagtattgtgttagaaatctctctctcccatacttttaaaaataaccaactatgtagaacaataccaacaatactgtcctggggcttctgacttacgtgtcaaccaatctgttgacatagaactatttttgagctttcttgaaatctccctaaaaccctctacagggtttggggggtggggaagtcatctcttaggcagtgaaatctgcacatttttcgcaggaaataaagcatgtccttactgtccttcatccctctctgaggtgcagtgcaggtggttgcctctagggaaatatagctctatatgtgtataaaggtgttgctacactcatttctccagtacagatggaggatagacctttcctttcttgttctcccttctacctagtgttgaaattgtagctgtgggagcaagcaagcaggaggagagaaggaaatggcaggtgctgagtgcctaccacctgtcttacatattttttctcatcagcatccctgaggaacaatatggtgattatatggttttggagcaaagaactagtgaatagagatggccaagtgttttggcaaagttaactagttagctcggaagaagcagctgggagcccaatgatcaaaactgttctatccaaaggacaggtggtagtggtgtctggggatggtttctgtcatgtcacaggagtagaagtgattcttacttgtagtgagtaaaggccaggaacaccagtgaatatcctatagtatatagaacaaccacataaatgaccaggaacaacaccatctcacatatcagtatcacagaggtcagctcagaagctgaatgggaaactgagaactggactaaggagacagcaccccccccacacacacacacatacctcaaatgtagccttgcatttcttagagttttccaattttcctgagaatctccataaaatgtattttaagagcaatttcaaagcttttggaagctggtgactatctacacacacacaaagtaaataaatattggaatactgtatttaaacatcaaccagtaatgtggttacaagggaagggagagaggaagacagaaggtaagtggggagggaggaagagagagagagaaagatacagagacagagagacagagagagcactcgtgtgtgttctctctttctctttctcaggcttgtgacaagttatgtaccctagaaaaagtgatacatttgacaccttgtttttacatagagagaaaacattatttttgagattcagtatgattgtctgttgatttgctatctaatgtccaaaatattcaataaaacagacatcaaatttaatcagtattagattctaaatctccaggaaagctatgtaaggcatacataaagcaacttaatagcaacctttaacacaattctttttttgtatctttggccaataagtgattaaattcttgcctcattttgcaatagctaccttttcctataagaaatcattttttaaagcttttgtaggcggaggctgagaaaagacttagatcatttggctttgaaccattggcctttcaatcccctatctactaaagacttcctactgtatacattcacattaagatttcttcagaactgcagcgctagttattagtcattgtagcatttcaggtcttgtcctgccatagacaagtccatgactgacatttggagacttctaggtagtctcctggctgagagttatgtgtgaacattgaaccacacctcccagctttctcggggttagttgctcagacatgagaactttcatctgagaggcacagcttgctcatcctgacaccttggcagtgaccttcagacatccttcaggatcatggatatgtttggtattacccgagccaaagactagcaggtgcagttgtggtttttcactcagttaaatagtatgtgggacaatatgggttacacatgtatatgtgtgccactctggctctcatttagggtcacgagtcaagatgaaatagaaattgctatcatgggtatttgagaagcactctgcatttctcagtgtgtgccaaaaacaaaagaggttggtctgagggtcaaacattctattccacaatgcaaaagaggctgcactgcctatgtctgctagatttccccttagcctgcacttaaccatttacattgctgcctggtgcttctgaagatgagtttaattccaaagagctaatctaggcctggccctcccctgcctcactctgagcctttcccaagtgcctccccttccagctcatagcatagggtatcacatagtaagccaggtcagcctgagcactggcactcatttcaaaaggcatctttacgttctacaggaagtagaccaatgatggggttcctcttggttcttcaaagggctgttaactaactggttccatttacagacctttactcttactgggtcacattagaaacaaggtattcactccacctgtgcacccctgatagggcactcctggctttgacaacacatctagttatgattagatttttttctcattaattaatttatttcttcattttacatcctgatagaagccccccactcccagtctcccacacactcagctgcttcccccatcccaccctccccttcttgtggggaatgtggagcctgaagtggctacttcctatagccaagcaggatcaagagtcctagtagagggacaaggacaccaacccactcataaaaccttcgacctaaaatgagattagttttttattgttgtttttaggctggtactagtttcccttatttatttgtaaatttcatacacgtgtacagtagtcagtcattttcactaagcttggaaaagattcacagtgcctccttgccatattggatttgcagatagacccagaattcctctccaggtatttctatcacttctcatctataggcagggtatttctagtctacatctcgcctggtgccttaagtgtctctgtctttgccgtgtatagagatcctctcatcctcaacattacattacaaatttgggggcacaaaggcatcttttacagcagacttctatcataacctttgctacatcctcagaagtcattgagctgaagatggatgtgagagcaagcagggaagagacgttgctcagctctcagacttcatgtagcatttatttggcttgagacaaccccactttctacctactgcttgtaggttcatagatagggagcgactgactctggctttcattttgcctataaatatctgaagagatgtgtgggcagaggagcaaatgggtttgtgcatgaaccatggagttggtgggatagtggtaaatggatttaaacatgtttcctcttggcagctgtggcatggcagcctcacacctggattataaatgccaacagaatagctaatccttatggattctggagatgcagatgttaatgactgctcagtgttcccttggtgtctcagctgccacaggtgttaatttgagctcttaaattggcccctgtttgtcatttgcacagattttcccaacagccatcaaatggctgagatgtggggtgagatttgcttttgcccaccatgtcttgtgatgttgtttcattgcagagaaagcatctgcagtcctgtgggcttagcattttcccatctaagccttgtaaaaccaaggaagggagtttagaccaccagccttgttcttaggtccctgtcctcaaatcctataccttcattaatagcatctaaaaacaaaattccatctgtgtggtataatcacataacctctccctcacattatggaagaataaccccgtgaagctgaaggcccaaataatgcattgttattctccttccctgtcccctccccttcctcctccctttctttcttcctttctgtctttcctctacccttcccttctctctctagaaagcatagctatcaaggttgtttgtcaaacagttaaacaaccatttattgaacgctcattcacaagccaggaatgatgtgaggcctgggaaaacagataaaaggcacaaaagtcaattcagggtgctaaatactgagaagggagtcatgtataagtgggagagagcagctaatccaggccttgaggcacagtctgaccaattaaaaagggaccaagtcattggtattgagcctctacaacacataaggaaggagccaggcagataatctcaggccctttgcacatttttctctggtggcaacatgtggaatggcagaggacttaaagtgaaaaatgcatttaccaggattccaggccagagttccagcggcctttaatggtaagtgagggatatgcagataggttggcttctaaagataccaagagatggcactttaaaccttagcagactcccattgtcaagtggggagcaacttgagcagccgcagtagtgaataaacagagcccatgtatgggctgcacagctcggttagtaacagctgacctgtctccaacttttggctattttccctgttttccagtggctgtgcttttaggtcacctgtggtcactgggaccattcctctcatccatggaatatgaggctccatgttctaattgagctaaatagggcatgactgaagttcatggaaaatgggcagttcctggtgccacaaaaaggctcagcccttgccaagctgactccatcgtgtccaatatgaatcacccactgatgtccacagagggttcctcttccagttgtctcaaaagccaagagcctcttacccttatgaaacttaaaaagaaaggaaaaaaaaaaccctaacctcagtgctagccagcttaatcgttttggactagcttatgtgcatttaaacccttttcatttggaggaaaaatttcccagctaggctgagaaagcacatatcatgtttcagcttgattcacttcaaaaccgccatgaaaattgggacattttcttcacaccacaatgagttagtcatggaaatttttccttaatcacatctaccctggccacagtcatgaggagcataccctaggccgctgagaatttacgtgacaatattaaagagtgtgtccccttcccaatcagaaagcagaagtatgtggcagttttcactctgtggaaagacacaaagataacctgaggttccctttgcagcaagtaacctcatctttgggatatcttcctttgtggtagtttggttccattagtattcataagaatgttctttataagataaaactgtagaaaatgaaacttggctgaaatgtgcattaagagggctaaaagtggctctccatgagggactctgaccctcctcttactgatgagtgacataaacgaggcagacttcttggccatctgtcatggagatgcttgctgtgcgtggctaggctccagcatgcctaggtctttttagtacaaacctcagccaatagagctaagggagctggccaagctccttcactgctgccatggcacacaatgttgccttctgccctgcagctgccacgctgcagcccactaggagctacctctcaagtaggagtgttccttgagatagttaattcattcatttgcttcttcttagtgcaacagaataccaagcgtgtccctcccccaccctaggaatgaggtaaacgttgacgacaaggtcctgctttcctgtgtctcacagtccaaacagaggcagtagacgccacgtttccaagtcattctaagaccatcagagcctgttatatgaacttatccctgggaaagatggggggaaaaaaagtaccctctctcagatagggcaccaaaggcagagtggagtatgattcttgatagcatccaacttgggggccaatgggtttgttggccttatacagcatggatgaggggttacttttagaagcatgaatgatcctacagaagccatgctgccaaaatatctcaccctctatagttgtgtaggtggagccctccttgattaatcttttgctctgtacatactctagttcttccagataggaggtcatatgttattagggcagaatcccatacagtgggctaggaggtgcattcgggcagagtgggaatcttggggcaggggcctattgactctcaaatccctctgtctatgaagggatgaggtagtttcttagcatgaactatctagcatggcctcaagcacctgcaatagaaatagactccttttcctggtgtgaacttagttgtatctgtatgctatgtccatcccatggtgagcccaaggtggcccatcttcggcttatagttccagcacccgtctcctattgcattcttcatgctgcatcactgaacctccctccacctcttgtttccagcccgaagggtgtctgtctgatctgctgtcaactatttgagcctgtaaccgaatgcttttggcaagagcttcaacatctctgtagctttttgcttgtcaggctaacactccttcaccaggtgctagaggagccactttactgatgacatttacttcgtacacttgccttggcagactgtgtactcccagggaatcccctagaacagcgcagtatgggaggtagaaacaggagcctcagttagcctgccagactagctcaatctgtgatctccaggtttagcgagagaccctctctcaagaaataaggtaggaggcaacatcttcttggcctccatgtgtatctgtgtctgccccctcaccccacactctcttttgctctccctacccattttctctatctccttctgtgaactctctctcctcttctcctggctccccacttctgataaaagaattgtctacaggaatcagctccagctacccagcagagaactggagtcaattggcctttaattgatctttaatcacttcaccctgctcaggtttcgcctccagagcttgttttggtttcctggacaaggtgatgatatacattgggcagctcagtccccccggagctcccagtccttggcaatggcttgttccttggacctttcaacagccttctcttccattccctctccttgctgtctactcagcatgtgctcctctgttttgtttccttgctttgctcgctgaggcttcctctgtccttcattgtgccttctgccctccccagccagatctcacccccaccaccagcaaactaccctgtctgaggccccattccctttttccagagcagcccagcatcttcttggctaacctgctgaaagcattgcccatggagcacatactggggatgtttgtgtggagtttttctataatagcaacaaataggaggaggaaggatttaaagacaatttatccaacagtaggaaatagaataggtgataaattgcagcaccaccaaagattatataaagtatgaagaatgtttagagacatgacatccaaggttaaatgaaataagcagagtacaatatgatagataacatgagttataatgtcttattttcaaaaagcctggaggaaaatatactgaaatactaactggttgtctcaatgtggtaagattatcattgactttctttttgctttcatataaaaacctgtgtgaaatgtgtattacttttgtttctggagaaaaacggattttaaaaagatgatttgatatgttaatgtacataatggcttttttttccccacatcaatccagcagtgtaatagggaatttctatttcagacaacacatactttgtagcattaagtcctgtggtagtgcccagagaggaacctgttaagataatcataatattatctaaaggaaaagcgccagtcagccacctctggacaaatatgttccagcagtgcgcatctgtgtcttcccttatcctactggttccctgctgagtcagctggagaagtaagaccttttatgagctcctctcaggtgccagatgccgatgggctcctgactgtggcctcaaagctctgctgattggttctctctttatgatccctgaaggtgttgctctcatcgaggcaataatggtcctcagtcccttcccgctgctcattcctccgagcctctcatttccacacttggtttggaaatccccgaaggctataaaataccaggaccctttgccatgatcacttactgactgtcaaagtaaaggcagaggctttcctcctgacatatgaggacatatgtgactttccgtttatctgattgtccatcactacaatataagcacatttgctggtgtcatcttagcaacttttactctgtgtggcacagagtagttgttcaataacagttgtccagagtgatatttcttgccaagaatcccagtgttgcacaggccagtgctgttcagtgctgctcagtgctgcggagaggcccagtggtgcagaggccatagcttacgttttttttaaatgtggtatatttcagatgtttaaatatggaatgaatggatggatggacagatagatgactgctgacaataatgtcaccaccgaatgatgattctggaaataggacagaattagactcagtgagttatctgagcctgatgcccttgcctaggagctttgtctaacggggtgacacctgatggcctaaccactgtagtccaaacagatgaggcagctctgacatcttatcctttagaatcaactagcattcacaactagcattcacatggccatggctgttatgccttgcggtaactatcttttgtgttgagacttcaagaccgttttgtctactaaaatggttagatttgtaaagagagaagaatcctccttgaattcctcttctgtaccttttgaaagatttatcaatgtgactgttgaagggaaaaaggcaagagctgtttttctcttgcttgctagcatactaagcttgctaagctgagagaaaatggttattgcgttccattctagtcctttattgaatgacccaagggtattaatggcctttgtaaaagacaaagcatactctagattgacaggaggcttattaagggaaagaagcgtgtatatcatactatcagaaccctttgtctttcttcctttctttttcaaaacctgtttcattttgttttagacttagaaggttttgactctgtgatatcatctactgagaaactcagccacccaaccacaagcagaccaaaagctacaggaagacggcctccatcccagtcactcacatctgtaagtgtctctttacttctctatagctgaaaggcaaaaaaggactggagattctggctaaggactcttctgcaagcagatgatgggagacacccagaagaggggaagggaggaagccaccagataaactgccagctaaaaatcctttcgaatcaagcagtatcactttctgtttgctctttgtgtttctgccagcaaggtgtcactccctgtttcccactttccttctgtctccttctaaaccagttcttgtttaaatgtgaagtgaaattggtaaacaaaatatagaaaaagagaccgagccttgtttggtctattaaaaagataaagctttactcaataaagatctgccattatgcactgtgagatccctatttccctatataagtgacctatatctatccaaaccccattatcagcatgcctacagagaaacccatgcagacctccaggaggttgtatttactcatataaaatacatggtttataggcgagaccactgagaacactcagtgataacccacaaatggttgtttttatttgggtagttttaaataacttcttattacaaacctgctatattcgttgtgccaaacttgagcagtgtgatacagaaggaagaaggtaaattttctgtagttgtgccacaagaacaaagaagcaccgtaacgtcttgttgtatccttcacttttccgaaactttgatttgttttttttgtttgtttgtttgtttcaaaactgggatcatgcaatacacatggttttggattaactgcatagcattctcccaagtcattaccaattctcaacatactcaatgactgcctactatgctacagtgtgaggatatgagagtttatctagtgattggactattattgggttttgatgatgattccaagttgttgttataagccatactgacatgaatgtatgaggggagaaaaaaacagcaaaacttaatgtttgttaggtgcaagttttctaaatgtgggccattgggaagtgcattgctttgctgttacccttagttgcagaggtcccctccacgaggtcgtttcccgtccacaagcagtgtgcatgtgttcatctgtctactgatcatctatcagtctgtctgtcatgttgctttgtcctttatagttctacggccttataatctccatccagatataccaagggatttaaccatttgcggatttctcgggttgtttctctttccacctcatcactagtctcacctgtgcttttatcatggcgggcggaggggggcggggagcggggatgccactcccttcgagctctcccatctaatgagtctggaagcatagcttgaattgtcctatttttcttccttgtatgaacgacacctaactttgtattgatactttttctttttttgagatgaagacttgaagaagtggcctccttaaactcttttagaattctgtggtaacttgccttcttttatttctcctgtgttgactctacccaccccagccttcacatacacacccagcctatccagctgcttcttggcatgtttgcattcctactagtcaattctaccactagtgtcttctctataaacccttcctcatttttgttttccttcctaggcttcatcagtcttttaaggtataaggagccttgtgtctttccagaactaaatattaagtggttcaaattgttcccctcttgttgagacagcctgtgttgagagatttgtgtattttcgagaccaagtaatggtagctgatctccaccctccttttaggctgtacaagttgtttaatatcttggtcaacatatattcatagacatctgtcccctgaggacagggcactatgccaggtgccaaggatacacatggtaatgagaaggcttcttttggtgacttaaagcctaacatcttatggagagtgattttatttggacttaaaaccttggtgctttaatgatgtatagtgtgcagatttttgtctctcattcttatccatccccatttggatgtacactcggaatttcttcttcactcttaaaagtagcacctgtcggggttttcctaacaaatgggattagtggataaggaaggctagtgggggaataattgaagaaacactagttatggttccctggcctgggtgctttcttactaattggatctggttatgtttataaaccctaaagggcaagctcatgcaacatgcattgtatagaaggaagctttttaaatcttgaaaggatctgtgtattgcatcctggttgagtaggtaagcctatattaataagaatgcttggtgtgagaggccatatttttggtaattggattttcagattaagtgaagattaacaaataagacctcttgaaacaaaaccttgacttaaaaatccctccccatattttttttaagtttctgtcttagtaagcaggataaaaggaagaaaaaatatttgtgagcataatttttcattttcaaatggtaattctttattaccgttagaaccatttattacctcagggtagaaagcaaagctgaatttaagcttgctgcaatgtatttctagaagacaatttattttataaagaatccttgcaacaggaactcttgatttcatttgttttgttctaaacttgaagcattgtagcaaaggaattacttgtgaccaagagaattctgctgacttgctccccattcagtttttgggtctttatagtgatttcacagtgaggcagaaagggcatgggtgtagaaccacattttacccaatggtactgcctttctataaataaatataccttagcaaatacacaccagaatgggtgtttactgtccataataatgagggcagagattagtagcaaataccaaaggagagagagcatatgctagtgggtagggctatgcactttactcatgatcccctgcctctagaaatggccccctctcagatgcatccttcaagggacgtgtatgtgtaccacgtgtagggtcaaggaataggaaggatccagaggagggtgaaggagaggaggctatgaggcagtctcctattggccatgggctatttcctaccatactgctagcccccaagagctgggaccacttatcacatgttaaggtacatagtaacaaatgtttggagaatagagagactaggaaaagctatacaacagatggttacatggttaaagtgattgatgggcatcaggggcagctcctagattagcttcttctggcttggtccaagtcctgctgctaggtagccatatggttatctgttataagaagataacagcatactttctgcctcacagggttttagaggcagatcaaatagaaatgatgagtgccttgagaagctaacagcatcacataaacaaagctgtgtcagctaaggtatgattctgacgaaggcattttcttttggctttatccagtcttccctttcaagccccgatatctttgactccccaagtcccgaagaagataaagaggaacacatttcgcttgcgcacagaggaatagacgtgtcaaagaagacttccaagactgttaccatatcccaagtgagtgaccagccagggtgaagtgtccctgcccttccatgggtgtactaacaatgggttagaaaccaagcaagacagataaacagacaatgggtatggatgtttgtcattctttagtgacagtgattactgtagtcatcacaattcctgagacacgccggcggtggtggcgtatgccttttatcccagcacttgggaggcagaggcaggcggacttctgagttcgaggccagcctggtctaccgagtgagttcccggacagccagggctatacagagaaaccctgtctcgaaaaagaaaaaaaaaagacaaaaacaaaaaacagaattcctaagacatgctgcagagtctctgagttgtgcatacaggtgtttattttctagtttcacttatagtcagcgttcttcatcctgtcacatttataaaaaaaaaaagccttcagacacccctgtcacctgatcaacttaaaaagctgtggagtatctagatagactacattacatgttgtgctctctgctcataggccttgtcttttatattcaaaactggcaaaaaaattatatatatgtatttaattttatacttacattatctcttaaggaaaagttgacttgaattcatgctttagagtaaatttggcctctaaagcattttaatttcactcggggcccaggaaatggtaaagctgatttaagttgcttgtttctgagaaacaaagaaaacattgttgtgctagcaagcacccacagtcccgcctgctcagcaggttgaagtgggagcaatcacttgatttggggaatttgagcctagatagcatagtaaatgaataatctccatctcaagaaagaaagagacgcagagagacgtacacacgcagggagacacaggcagagacgcagagagacacacgcagagacgcagagagacacacgcagagagacgtacacacgcagggattagagggtagagacagagacaccaagggagagaagcgggtgaccagcagaagtgtgtctcagtggaagaatagttgcctagtgtgtgcaaggccctgggtgagagtcccaccacaaaagagcattgttcagccagtgcatgcagctttgtagaggaagcctctcctgcgcgctcagatcttcctagaaataaatgacgacttttaaattccatcttcttctaagaaaatcgtcaggtcggattgggttttttttggaattttagcaacattttaatgtctagaagcacaaaaacagtagtcatttgaagcagtcatcagcacaaagaaatcaaaggttggatgggatttttctcctcataggtttgagtgtttgcattgcggattttcttgaaaatctgatacagtaagcagaacatgatcctataaaacagatcaattttaattacccacaaagccaaggcagtcttccttttcaaaggattctgtttactgaaattggattcaggccagtttcattgtttagttttctgatgaccataggcataacttcagtttcctgttctctgttatctcaatgatgtctctacagtgacacctactggctgatagtggcttttcaagtttctgatcggcacggctctattccattagcctatttcagttccctggagttgtcaggctgtatatttcactccttcaggaaattccacgtgaactaatttgatcaaggactgtggtgacctagactgtgtgagggactaaaagcatacttgttagctgcagtgggctagtccgagagcccatcagacagaaaatggtgaaagaactattgatctaagaagtatcctgaagcctgtattatgggcgctggtggctcatgagaggtaagagaggaagggaaacggaagaaggagcgagtcctggagtctataatataagcagcaaagaaaacaagagaagagcacagatatttgagctccatcagccacagtcacagtgctggactgaggatccaactggtaaagggggaattgaatgtcagttcggctggttattagttccaagactcagggagtttgccctataggcctcagtttcctgcttcatacagtgtgtgtgcaggctgatcagtttactttgcaagctgatgtccatggtgcagccacagctctgtaactgtcagttctttcccccaccccccatactgtaactcggagtaacaacaaagcccaggctggcggagtactctccctggcagcagacagtgcttttcctcaatggtaacttggcagagaaaaggctaacagcgagactaggaacgatggcccatctgcttttggcacgctctgcccagtctctgcctctagcacagcctgaatctagactctacctccttgctgccgtgccagctgaaccccttcttggcgctttccctgggatggccggctgagcgtctgctgctggaggaaatcccatggttgctgggccaagcttcaccaccagcctcggtctccaccctctcacccacctcctctgctcccaaagtcctagcccactgctttgccttttccacactcgcctatccactcactttcccttgctagtgtttcttctctgggcctgccaggcacttgtagtccctctcacccaaggctgattcccagcctgtgtgttcctgtcttcctcaccacacctctccatcaggcctttcccacctctccatcttcacctgtccatctcccctaacatctcacacagcccggggtctcactcatcggtgaaagcaaacaaaaccttcttccccttctatctcctcgtgaagctgctgcatgcatttgcacgcacgctcctccatagccctacctcacccacatctgtggaaagaatcttcagtttgccagccatatctctcagtgcccattcatcaactggtctctcatctttgggtcactgtctccatagttgtactaccaaatgggttctgttttcctctcaaccccgctgacacacttatccagcctttcttttcctctggggatttccatcagctcagcccttccactgctctttcttcattctttctctcactacttctcaattgtcaagagctctctcccttctcttcttgcctcattgatttataaccccccagcttctaccctgggcatctttgcctctctctgacccacacccatgacttccatttcctttggccaatcttattatatgagttacttgctctgcctactaggtataccctctcagctatctctctgattcctaatattcaaaaccaaaacaattatctgggccctcctcaatgaaaggtaccacctttactcatttcttccctcccctcctatgtttctctctgtgtgtctctctgtctctctcgttccctctctctgtctctctgtctctctccctctcctcacctctctccctagtctgtccaggcctcatctccctgacagtgggtagtgtgatctatgaaggcagggatgccattaaccttacccagtcaccactgcagtcccaggagtgatacctaatggcctttgttacccacatctctcgccatagtcttcattctagaccaccacctgtttctagtgtgcattgtgtcagagtctcagaagctctatctagatccaggcctgccaactctccagcctttctacccccacagcagccatgagcggggtgtgcagccatttgaacccgccccttctcttctcactgccagccttactttctcctcctccctttatctgattcccactgtgttttccttcctcgtctctaggccattgtctaggccctctcctcccctcctccttcgtccaccttcttttcttctatagtcttttccctctgaaaagagggaccattggctgcttgcttcttccatcctggaatgtggttgcttgggtgtgtttctgaggctctctatgcttcctccctcttgtccagtcttcctcctgtgccacagtgtattgcttgtctgtctccactgcccccagtgagttctaaggacctaagtaccatgcaaatgtcttgcttacttcagggtttgtagggcctgccaagcagttttgcatctctgtgtatatgaaaccaatctgggattgtcttgtctagaaagaagatgaaattgaaaatatatacaggtagcccttgggcagtggtctgtctggaccaagcaggccatagatggtttatgaatgagggaataaatgattagagtgtgtggagacaggtatggggttgggtataaaaggaaggtttgacttcccaggacaggaaggcaatccctgcacagatcccaggctctgaagcctctccactttcccttttcacaggtgtctgataacaagacatccctgccacccaagccagggaccatggcagctgccagcagtgggccagcttctctctcttcagtggcatcctcacccatgtcatcctctttgggaacagctggacagagagccagttctccatctctgttcagcacagaaggaaagccaaagatggagccagcagtgagcagccaggctgctatcgaggagcttaagatgcaagtccgtgagctgaggaccatcattgagaccatgaaggaccagcagaagtgagtgctgtttccaggtggctctccattgggtaaccatggcctagttctgaaagcttggctctcactctgcccagagggtgggctaggccttcccattgacaatggcagaagtgctgcaagtaggtatggactacacatccctggctcagaagcctctccaccttcccttttcacaggtgtctgataccatccctgccatccaagccagggatgtgtgtgtgtgtgtgtgtgtgtgtgtgtgtgtgtgtgtgtgtgttcagcctacggtgtgccaaagagcacagaatattcagtggtgagtcagttgcaaggagagtctcagaagacttctaaaaagaaaataaaatttcatagaaatatatatcatttctatgtcaatcagcttcttaaaatcgtttccaattacatttagttagtgtgtgtgtgtgtgtgtgtgtgtgtgtgtgtgtgtgtgtgtgtgtgtgtgtgtgtagggaatagagggcagacgatagcttgcaggacttggttctgtcctcccacaatgttaggtctcagagattgaactcaggtcatcaggcttagcaaccttcacctgcttagctacctcaccagattgtcaccactgtggcaggattttgagaaaatcaacttttaataagggaaggctcagagctagagagagagcttagagggttatgatcacttgcttctcttctagagaactaggggttcgtttcccagcacccacgtagcagctcacaactgtgtataactccaatttcaagggatctattgtcctcttctggcctatatgggtgccaagcatgtacatgctacacacatatacatgcatacaaacatacatacaaaagaaaagcaaaattgaaaagggagtgggtgtgtgggctcatggtttcagttcatggaaattgagcatttgggttggagcagcatatcatggcaaggaacatgttaaggggaaaactcctcaccttatggtagctaggaagcaaaaaggtgacagcgagggggtaggtgtcataatatcccttatatacctaataatctaaaagttcacaacttctcagtagtaccacaggcctttaacctatgaactcttggggaacattcaacagccaaaacaataccagtacatatacaaattcatttgattttgctttcagttacgtgtgtgtttcagggaggaggcattgtgcacttgtgtatagggaccacagagagtctagaggtggacagtcccctaggactggaattagaggtggctgtgaaccatccaacatggctactagaatcagaactcacatcctctggaagagcaatatgcactcttaacctgtgagacacatctctagcaccatctatatcactaactttttctctagtgttggggaaaaatagagcttcttaatttagatgacagataaaacaactggcttgcatcaaggggctataacataggcagaagatgtagggaatctttaaacccaagatttcgctgtcagaaagatgtcttcatcatgagactcaggggtctttcctcatgcatgcccacatacatactttcacatctcttatcctcagggagcacttgaatgagaagaaaagcctgtgaacaaaaataaaatatcctgccgccggattgcctgggatgctccttactgtgagaaagctggtagaaggattagcagcaggcggcacttaaagaaactgagggtcagagactatgaattgagagctccttgtggaaagaatcttaagatacttctcagggaagcatttcatgagcattttgaaaactgacctagaatgaccgggagcagggaactttggcagagagaatagcaggcagctcatgagcaactgaacagcctggtgggtcattgcctccctgggctcctggccaccttggttcagaaggtgcatagggggtgatggtgagagctgtggcctaaatcctgcagcctgggggaggggttctggagctgctgttgactgacatttgcctctcttaaggatggaggaccctgatgtattttgtagtcagacaccttggggaacaattgggttaagcaaagttagtttatcctctgaaggactttttgaagtcttcacctcacattgagaggataaagaagacaacatatgcagttttgcaaatgcatgtaaccacagaactctttaacgtgttctaggaagacggttccaaggaactaactttgaacagtgtaggtgtaggcaggttctgtttcactcaggataggcaatggggaaaattgggcttcctcaagtcacttcctgactggaagagattcatcacataaatatgcagaactggtgaaatgacattggaaagagtttccttaggtcacccaggctcccccaaactccttaaagttcctggttcttgtatggctctagaaccaataggtttgggtaaccaaaggccatctctatccagttgagcacatgtcatttgccaagacagtgactccatgattccatgacatccagctttctggacaggacctgacttgcctagatccaggtctttagaactttacactcgggatgggggagttggggtggggggtgcaaagcaggctggaagctacccacaactctgatagcctgaccttgtctctgagtccacaggcagctgtgccttaataaagcctgtaattggccacaacactcctctcccagccagcatcttatttaatcagtaactcaggatgttaatcacctcttcaaatccttgtgtctcatagccttccttagcctggccatcctgcccaaggtcagtgagttccctccagtcttctaccttctcccctggtgacactttccctgtagcattcaatccatgtctatcctcctcctcaaatgtgccttgctttcagaagcaggctcaccgccctgctctgccttgtataccccccccacacacttccccatctcccttttttcccctgtagacagatacccgtattccctagctcaagacatagtggctttctttacaccatcttccccaactgacttccttttcctagaccacagcccacttaaggccatgcctgccaggttttcctgggggttgggtgctggtttaggacttcactgttgatggctttcctaagccctaagtggtagccacacagatatggatgtacaatgtgagcttaaatgactatgctaaatcactgctcaccagtctcagataaccagtaatcagataaccagtgtcgacagcagtgctaggacagtctcaagtatagaggaccatcactggattcatctgcacttgaactagtgtgcagttgctggttctgtattcaccatgctgtttctgaagccttctgtctgttgttgttgtttcatttcacaaatgtacacatgtctaatacctcccaacaaaagaaatgcagatcttagaccagtccaaagaacagagccccagcttttcagaataagtagctacaatcaactttattacttcaagttggaaaatgcattaggctgtcggtcctatgtttgtcttctttcagacttcatttctatactgttaactcatatgtttaaggtccagttagtctatctttttttttaaagatttatttatttatttaatgtaagtacactgtagctgtcttcagacacaccagaagagggcatcagatctcattacaggtggttgtgaaccaccatgtggttgctgggatttgaacttcggaccttcggaagagcagtcgggtgccactgagccatctctccagccctagttagtctatcttaaggtaatgtcagtctgtaagattttgtgagaattactgaaaacataccagtggcttgttcttaacttaagttctgtataaaagtgaagtatatagagagtggtaaaaatttctgcaatgggtctagggagatggctcagtaagaaagtacttaccacacaaacatggagacctgagttcaaatctcaagcatccacgtataaagtatctgtaattccagcactgcagaggcattaatgaggctctcaggtcttcactggtcaggcagtctgcctgaatcagcaagcatcaggttcagtgagaaccggcctcaaacaacaaggtagaaagaaattgagagtgacacgtgatattatcaacctatggcctctacatgaaaatgcacatacaaggacctgcacatacccatgaacatggaaaaaaacacacaaaaaagtctacaatgaaaattttctataagcacccagtgtcctgttataaaaaagaagttagaggaaagatgacagactatgagcttcagtgctttgactctcattatttgggaaaccaggccaccactctgtgccttagcttccctatcttctcctattggaagaaagctaacctagatcatactaggtcatctccagacctaacagttgaaagctacatattttggtgacgccttcccaaataatggcagacttttctgtccaaaagaaatcttcagacgtcatagtgcaaagtaagtgtgtttgggtgtggtgacatggttcagtgagtaaaggggcttgccaccacctattttagatagctttctcttgctgtaataaagaccatgacaaaatctaacttaggaaaaagatttgtttgggttataggttacagactatcgtcaagagaaaccaaggcaggaatttggagtcaggaactaaggcagaaagcatagactgttgcttactggcttgctccctgtgacttgctcagcctgttatataacaaaggacccacttgacaggggcagcagccgcagtgggctgggccctcgggctgggccctcccacatcaatcattaatcaaaaacactccacagactttgcccacaggccaatctaatggtggcattttctcaattgaagttctttgcacatgactctgtcttgtatgaaggtgaccaaaacttaattaaccagcacaccacccaacagtgcaaaccagggatgacctgagttccatcatcaggggaacccatgtaaaggtggaaggagaaccagctctactaaagttgttctctgacctttacacaatgtagactgcatgctctcccctcccacattatgcatgcatagagagggagagggaaggagagaggaagagagctacagaggaggaggaggaggaggaggaagaggaggaggaggaggaggaggaggaggaggaggaggaggaggaggaggaggaggaggaggaaataaattatgtttggtccatactctctttggaaaaaggtcagatggatttcatattgatacaagactttcttatctctcattgggaaactctgggctttgatttgattccattggcatttgcttttcagacgtgagattaagcagttactgtcagaattggatgaagagaaaaagatccggctccggttgcaggtaggtccctcagcactcgtccatgaggcctgggttcagttgggaatggaggcaaagtcagggcttcaggttgaaaagaaatgatcgctgttgggcatggtgcctcaggctttttaattccagccctggggaggttgaggaaggaggatcacaggatccagacaaacctgggctatcaagagatgtgcatagcagcctgagctaccaagtgacatcctgtctgaaaagaggggaaacaatgaaaaaaaaatgattgctgccacaagaatgtctcagaatcgttatattctgtccttacctgagttccagaaggtcccagggaaggaagagatgaatcagcatactcagttaggctttctttattttaaacacatctactgtgaagcatcccctccggttagtttttaggatgatgatacaggatgcctcatctatattaagtaccagaggacatggcatgcaggagactgctgctgctgctgctgctgctgctgctgctgctgctgctgctgctgctgctgctgctgctgctgctgctgctgctgagttccatcatgtggtccctccagggatgacagatatacacactggtgtttcatctcaactttttacttttccccaaaggccttgttgtttcttccaagccatctaagctctgtcccccacctcgagctgctgatggagatcttgtgggggatcactccagatgaccaaaaactaacttttactgtctattcagtttggacccaacctacttaaaaagaggatagaaatggttcaaaatcctggtgggactgtggaacccaccttttggggtcacccaaagctgccttttatcacacccagatggtcctatttgcctgccctgtcctctggcaaggaatctagaatcattgctgcttctcataaacttgggagcctaggaatctgggaatgactaggcacaccacttgtcagggtaccacttgtcagggtaccacttgtcagggtactatacctatgtgcctgtctttatgtttattttgtttttggcattgttatcaattcttcattcagatgtcattttgacagttttactgctcaatttgtcagcgtgagtcttttcattgcattggtaaaggtatattatctttcagcttctctaaatgcagccatttcataatgtctatatttgctgctttccccccccctctgtatagatggaagtgaacgacataaagaaagctcttcaatcaaagtgattacttgataattgagacatcacattattcatcctgtgtccaagactcagatattctgccccagtcaaaatcatcttgtgccaaaaaattagaggtttgattcatcgtgtccctgtttgaacgtttagcacaaaagtcttaatagcacaacacaaattccatccaagaggagactctttcccatggtgttgtcctgggtctggcagtggttgtgatttatagccaattgtgctaaaggatttttctaccttgagatctcccgagaaatgaaaactcaggcagtttagtccatagtagtactattttgatgatattttccattaacaaaatgtaatttcagattattcgtttataggctttataattttatggtttttttttaaaatcgtgttttgtcacagatgcccctagtgtttgtgctaacctagtcagaagcaagtgtctcactcacttgctgcagatggaacaaatgccgcctggctttgtattcccctttaggattctattacatatgcaatttgaggtctaacttgtccctttccctgccagccaacccccaccactctaagagaaattttagcttatatatgacggtatatttgcaaaaagagaaagaaaaatctggtatttgcaatgatctgtgccttctttctaccaccctcttgattggagcttttgtgatgcagctaccatgattccaaataagtaaaaatcagccacttctccctgtccactagaggtcgctgtcttcacagcttctctcaccctagccaaaggtcctaagaggagacccgctgtgaagtctggcctgctctttggtaccagctgtgacttttcagtttctcctgctttgaggttgttcacgaaactagaaatgtcattccagcttgattgttttatcatcagccaagttaaacccctgcttcctgccttttacacctattgcgtgaacagaatatgcattattaaagcaaaaataaataaaaaataaaatgcaagtg

SEQ ID NO: 648 - DNA, 292 bp, mus musculus; identical to SEQ ID NO: 84

SEQ ID NO: 649 - DNA, 292 bp, mus musculus; identical to SEQ ID NO: 84

SEQ ID NO: 650 - DNA, 15559 bp, mus musculus
cacaggttgcccccccccaaccccagccgcctcgcttgcccccggccagttggtaggcatcgtccccgggggccgtccccactctgaagcagagaagatggctggaggacgtctgttgctggggggcgacttcctgtcgccgccgccgctgccccccctcccgccgccgccgctgccgcccctcccgccgcccccgcctgagccagtgctggagcagtggcgctatagccacgaaagtgactggcagtgggctctgcggcggagcttcatctgccggcacctgcacagctatcccggggctgccctggaccagctcctcgcgctctccgccgcctggacaaaccacgttttcctgggctgcaggtgaggatggtgttgggaggttgagttagggacagggtgggagatgggtgatgcgggtcggctgagtgatggaggtgaagaacagatgacggatggtggagtttgggttatggacagaccaaggcaaggagagagtcagtaaaggtggtccagatgggaaccggggcaggatgcggattatggcttggaggcttaagatttgaaattttgctagaggacatggagacgcttcactagtcgttgcggggtggggtgggcgatcgcggttgcaggcgatgacatgacagcccatgagggcacagagatgcccctccaggaccagagatggagataaagtagatcctggaagagggtcattgagaggtagtcgttgcgattggtgataaagagcagaacctcagacccgcataggggcttccaaggatgcgacatctgcagaggctatttgatggagcttccgaggggaagacaaggaactccgcagttctaatcctagtctccagaccactctcttcttctacctccatgaaataaagcaaccccctctccttgcagccccccagccaggtcttatcatcttctcctggggaggcggtatgtgtcgggtctttgagccgcagtgtcagacttgcttgtagatttgcgcataatgtactcaaacaaagaaatggatctatctgctggaaagatggattgccatcttttcaccttaaatgggataggaggaattaacatttggcctctgtgtgaggttttagggctgtatgtctctctctctctgtgtttcctcctttcctagaacctggtggcttctgaacaggcctcttggaaagcactttgcgttctatggagactgcagtatggttccaacgcaggtttttttttttttttttttgaaacaggatgtttggatccgctgtccttcagaacctcaaatttggctttatcctagactaattacttcagtagactggaaagattctttatattcctgtctagcagtcagtttgtttttattaggaagaatgagaaattctggaagatgatcagatttggttcagccagatcagttctaggaatgactgtaaacaatgcagaagaaattgtgtactcctaccttaattgttgaacatggcagccagtgtgaaacttcgctttgccctatcacagaattttatatttttctatcttctctaagttaacataatttctacttttagagataatggctatttgcttggaggagctggttgctactgggaaagtctcagcaattagtcctcagataaatctaatttacataataatgttattcttgcagtaaaaaggtacctttatcttacaatccttggtcttaataccacaggaagctacaaagtatcgaaatcttaaaacatctttaataggggaaagtaaccgtcctttgtgttcataactaaacttaccttcccgctggaatggaaaactgggagttgattttactgtttttcatattcatacctttgtcttcaaggcctagaagaaaccttacgcattattctactttagcataatagctgctcagtaaatgtctggggagtgatagatgtaaatacctttgtaatagatagcgtattttcaacactttttatcttataacaaccaccctaggggttaggagggaggcatctcctttttacagcaaagtcaatggaggccaagaagttaagttactatgcaaggtctcacaattgtttccagtctgattccctttccactgaaatacagctgccatgtgtggaaatgatggaccagaaacaaaagcaagtaactgacataagtcaaatctctaaatgccaggcttacatcctgagaacagcagcttcatgcataaccagggtctgaacacaaaccaagctaatagtagttggccttaaagctcaagcacccaggatgttatgggtggatattggcaaatcctttgtttagaatagtcgttgtgttgcagtattacctatatcactacaacaattactataagattatgagatagatgaactgaaaaagcaatgttttgtattatatttgatcattagacgtaggagaatgggacgatcccaagagagctttggcagtttgcaactccatgtggttctcacattagatatccttggttagctcactctttgggtacataaaatctacattctcaaagttggcagcgttcttgttttgtgttacagactgttcttctaaattgcagaaacatggttatacagccctttgtaaactcaaattattaacttgttgttcaggagattccatttgagtagaaactgagataagagaaaatctgaaattgagattcagagtatgttttgttccttttggtgatactaaccatttccatggaacaaatttgagtttgttcgtgcgcacacgcacacacacactcgcatatgtgtgttcatgcatgcatgtctctctttgtgtctctgtctctctctctgtatatttaataatatgtttatgtgggtgagttccttgactataaggccaggccagaggtctgcatctctatcactctctacctattgtttgagacaacttcacagactctaatctaaagcttaccagttaggttagactgtctggcctctgagcctctgagatctgcctgcatcgtctctaccagcacttgggttgcagactgtgtagtgtgtcaccatgctctggtcttacatgtgtgttggggattaaaactaaacttaggtacttttctgtagcaagcactgaactacctccccagccttgaatatcttcttgactctataattgtggggtttacacatacacatgcatcaaatcacctgttttggatactgcatatggtggcccaagacttccatcctagcactcaggacttgaaactgtagcaagtgggtggtgagtttagagcttgcctgaactatataaggataccctgtctaaaaattaacaacaatagtaatcacctgttaggtttactaagcaccagtttcctgggcctctgctctaagtcttccaaatcagaagatgtgagaagggcctcaaaacttttatttctcttaggttaccagatactgatatcgctaatttgaggaccagtagaataaagtgatagttttgtttttaagatttatttattggggggctggtgagatggctcagtgggtaagagcacccgactgctcttccgaaggtcctgaattcaaatcccagcaaccacatggtggctcacaaccatccataacgagatctgactccctcttctgtcgtgtctgaagacagctacagtgtacttatatataatcaatcaatcaatcaatcaatcaatcttttaaaaaaagatttatttattgggctggcgaaatggctcagtagacttcttccagaggtctgagttcaattcccagcaaccacatggtggctcacaaccatctataatgaaatctgatgccctcttctggtgtgtctgaagatggccacagtgtcctcataaaataaataaataaataaataaataaataaataaatctttttattatgtatgcagtgttctgcctacatgtatgcctaaaggccagaagagggcgccagatcccattacagatggttgtgagccaccatgtggttgctggggattgaactcagaacttctagaagagcagccagtgctcttaacctctatgccatctttccagcccaaagtgatagtttttaatttacttttttaaaaagatgggtctcatgtagcccagactgtccttgaagttgagagtagctgaggatgatctgaaagttctgattttcctgcctcccgtctcctgagtgctgagatcatggggtacactaccatgtccatctttatctgatgcttgaacctagggcttcaggagtgctagacaagtactctatctattgagctatgtccccgaccctcctgtctacttttaaatactctttcctcattgtcctggcaacaaagaaactcagaaaactttcccttcgctttttctgttttataaaagtaagcaacctgtcaagaagttttgctagatatgatgtggttaatgcccagaatcccatcccttaggagtctgggacgggaagaattttctgagaaatttctaaaacagtttcaaaacattagtcttgtggctaatgaaaacttattatagtcttctgatcaactacatacatgagaggtaaataattttatacatatgaatacctagggtgtctgcagtgtttacttacagattgtagctagtgtgtttgctgctgtatttgttttgcaggacttgagtgtagaagctagaatctcaaggatggtagccaaaaaataaagaaataacacaaaaccaacatagctactttgactccttttcgtcaatataattcttttttttttctttttaagtgagtttttattcgtcaatataattcttaagagtttggaagctagattttgtgtgtgtgtgtgtgtgtttgtgtgttgtgaaacataactttgcacgtaggctaaggaagtgggagacttttgaaaaattcacctccaatctgtacgtatattattaccttagaccattaagcatcttgtaagtagttttgaatgaatcattttgtatttttgtattttgttttgtttgtttctttttctttctactctctctttatttttatttttctttgtttgtttttgaaaccgagtgccactgtgtagccttggctgttctggaactcattctgtagatcaggctgacctccagctcccagagttctgtctctgcctctgcctctgcctctgcctctgcctctgcctctgcctctgcctcctcttgactcctggggttaactagagagttggctcagtagttaagggcacatgttgttgttacaaaggataaacattttattcccagcacccacatggaggttcaccaccttgggcaccagatatgaatgtgatacacagacataatatgcaggcaaaacactcatacataaaataataattttaaaaagacatgtgccactacatctgacttttaagtttctaatctcagcgttttgatttaaaatttagtaaagctgtttactgtatttgtaaagaatttataaccacctattactgaatacttactaaatttcatatgccattgtatataatgatctatgtttctcttgtagccatgcacatagatgtaacttgtcttgtgaccaagactatgatatatatgaagaaaaatctgttgcctattataagccatcttttaatcatgtgctagacatggtaggtgagttgaagaccaccctgctttctagaagcttggtgcgttataaactacataaagaactttaacagatttaaactgttacattctgttacagttacagttctgtggttttcccttaagtatttacagccaaatgtgtgacctaatggacacataaatgtgtaatgtgcatgcatttaaaaatgatagtagacctgccttagtgatattttacatcgtattctataatacagaactgtgtgaccactaaaacccatatggtagtaggctgtggaatatagctcagtggtagaatctttgcctggaatgctcaagtctgtgaattgagttttcagcatggcaaaaccaaaatagaatagatgtggtagtagcatgaggaaaactcttacaatagataacagttcaaaacaggttattagttagtaatgggggggcatagaaaataaacaagaagaatataaagtaacactttagatgatactgcagttatcatagctgagatgtgaaaattttcttcattagttttctttggagttaaaggtattgtttttaatgtattatgaaaaatcactatgggagatagcaatgacttgacctttatccttcagtgggtagatatttaggtaattttagcaattttaattttaggttagaattctagtgatcttattaaagactctaaaatttctgcattgtattttgactagtcaaacattagataacatgatggtctttccattcttatgtaagcttgctgggcttcttttgtatcattacttcctaataaaggccagagtctgactgtgttggcagcctacgcaagagtttatttttatagcctctggaagatggcaaattctgcagcaattgtaatgaatagggagcaataaataggtacaataattactggtgctggaagaaacttgtgagacaagtgaatgtgaatggtgggagccctaggtattcccttcatggccatcattatggtctgtgtaccattttcagttatactgcacattcagagtcaggttctaattgaaggtctagagaattttgactggacccaaggcaaatggcttggttgtaccaccaatttttgcaaatgtgagatcagtggttttaaaagttgtggactttggactagaaatgtggctcggtgcttaagagcactggctgctctttcagaggacctgggttcagttcccatcacccatatagcagcctacaaactatctgtaactccagttccagagcattggacatcctctctgatctttatgaataccaggcacatacatggtacgcagatagtataatatatatgtagataaaacacacacacatatatattagtatatatattaatatatgttagtatatataagtatatattagtgtatataaactaatttttatagtaatgaataaaaaatgtttttaagctgtgaacatcacctgatttcatagtctttgttttcatcctgtactttggaaattggactccccacatccaagaggaagtgatgggtacaatgtctgatgctttagataccttttctgatgaccagataagagtaaagaaaaataggattactctgcatattcaagtactgatgctagctgtaatagcaattgtctgtaagaaacgaaggttatagctagcttcccataatctgtctacaaggttttgatttatgctctacaagaaaatctatctgatgggtatggaacctactgtactggatggggaagatgttaatctttaacttcactactcatgaaaagccgtgtgtgttactcattttcagactttcttcccagatactaccagttagaaaaaaaaaggaaggattagcaggtgctaaaacttcacttgaggtcattttttaattgccatgcagcaaaattatgttatcaaaaagccaatctagcctgttgtggtggtacacacctgtaataccagcactcaggaggctgagatacatatgacttgtatagtgagaccctgtctgcaaacagatgaagtgggtagaagaaaacaatgaaaagaaacccaagaaacataaggctagtaagatgcttcaggcatttgccactaagcctgatccccaggtctcacatggtggaaggagaaacccaattcccttaagtgattatctgacctccttatgcacaatgtgattgacacatgtgcaacccctccctcaatgattataaaatactacagttaggataatggcattgttattatcagcagaccttactcagagtcctctagttttgctgtttgtatttcctcatgtatagtggttgcggggggggggggggggagtagatgaaatggatcagtgggtaaagagtgtttgccacacaagactgatgacctaactttgataatctggaactcacattaagatggagggagagaactgacgccagggttgttctctgaccaccacatgaggcaggcaccatggtgtttacaatttacaattgcaatatgtttttacagaagacctttactaggcccaataccacaaagatcccacctattgttcttttaaaataactaaacccgcacagtcccactcactgtgacatgtatcactgggttggtcctttttcttgctatatagttctctgttgtctgtttatacctgagttttaacctttcaccttttgaaagctatctgggctgattatagttagacctataagactcttgtgagcactcatatacaagtttttgtatgaatgtaagttttcttttctttaggataaatgcccaagagtacagttcatgtggtaattgatgtttagtttaattagaaaatgccaaattgccgggcatggtggcgcacgcctttaatcccagcactcgggaggcagaggcaggcagatttctgagttcaaggccagcctggtctacaaagtgagttccaggacagccagggctacacagagaaaccctgtctcgaaaagcaaaacaaaacaaaaaacaaaatgccaaattgttttctagaataactatatcattttatagtcctacctgcagtgcctaagtaatccagtttctctgtattcttggcagcattggatgtcatccctaggatatattttgaccatcttgacatgtcgataatgtcttccaattacgttttcctggtggctgatagtgctgaatgtcttttgttcatttgcaatctgtctgtactctccagtgataatggcctttagggtatgtgtgtgtacatatgtacatgacagacatgtatgtaggtgaatgaactcacagaagccagagtagaatgctaaatgtcttccttagttgttctttttttaacttttttttttttgaaacagggtctgtcactgaacccaaagctcaccattttggctacattggctggccaacaagctgtggcatccacttctgtctgtccctcaattcagaggttaccgacatatatggccatgcccagcttttacataggtgctgggaatttgaatctgggggcctcctgtttatatagcaagtgctgctttacccactgagccatctctccagctcttcttgtgaatttgaaagctttattttgttcttcttgagtttggagccaacgagttcttgtgaagtacatggctcacaaattttttctcccagtctgtagtgtatcttctttgtggagtcttctaagaagacaagatttaaattctgattaagtccttttaccactttttttctttttttaaatttttatttattttatgtgtatgcatgtttagctcacacatttgtttgtatcatgtgcatcctggaagttctgacgttatggatggtcgtgaactggttctgaagttattgtttgttgttagctgctatgtgggtgccaggaactgaacctgggtcttctaccagaacaagtgctcttaactgctgagccatctctccagcctacactgtttcctttatagatcatgctctaagaactgcttggatagcttagatcttggagggtttctcctactatttttaaaatgaaagttttatagttttacacttttattatgtatatagttcatatgcttttgtaaagcgagggttaggtttgcctgtttggtttttacatataggtgctcatttgttatagaggttcttcctctttggggttatatttgtaatcttgtcaactgctaagcttgtattatttacacgagtccatttctgggttcttcccctgccaacacttgaccagtaaacttcttgtgccttgcagagtgctagtaggctatcatttctttcttacttagctgtaacgccttggtaaaagacttgcctgggctggagagttgatgttcttgctgttggtgaagaggagtggagttttgttcccagtacccacatgaggcagatcccaactctagttctagttctaagagtctgatgcctctggcctcccatgggcacctacctacacatgtgcacacaattcccgaatgaacactcataactgaaactaagtctctcttttattttttttttttttggttttttgagacagggtttctctgtgtagccctggctgtcctggaactcactttgtagaccaggctggcctcaaactcagaaatccacctgcctctgcctcccgagtactgggattaaaggcgtgcaccaccacgcccggccgaaactaagtctttaagagccattttccttgacaacactttggtggttctgaggtacagtttgtacaggaaaatgcaacataaatacttgcattcttcctttaatatttacttgtttatagaataatgatacctttcatcccccaaaagttaccaataatgggtttgtaagtattatgtactaatagattttaaatatatttgatatatttaaaagtcactgttcctgtaatctttgacagtttctttgttgtaggcccaagaactgggctcttcttggacatttcctgccccagacttggaagcatgcatttctctgaggaacatggatccttttcatgagaaatgatagcagctacaatttggatgttagtaacatagctgtccttaacattcttagtatttttgtaaacatataaatttaattgtttacatgcagtacatatttgaaagagatcatgagtatataggtatattttcaattaatgtgttaaaaataaggttttggctagaaactatgtctgtatgtcttttttaattatttatttttatgtacatgacttttttttcccctgcatatatgtctgtacacaacacacatgcctattgcccacagagtccagaagagagtgttgtatgctctagaacaggaattataaatagttgtaagcagccatgtgggtgctaggaatcaagtctgtgtcctggaagagccttaagtgctcttagatgataaaccatctctccagcccctgtgtttgtatatgttttatgcagaaatcttgatcttaatgcctagtgaataaaactactcattctacaggtaaatattttaggtctgattctttgttttcataacaaaattgccctgctgattaagttctttggaagcaatgataagactatctcacttagaagcattttaaaaaggatatctataactattttaattgtagattatattaatttataggtatagcccacacttgatggaaaaaattcttcacatggctgaaggtattgatattggggagatgccgtcatatgatctaatgctgcccaaaccttccaaaggccaaaaacgctacctttcaacctacgatggtgagtataccttgtttctgtaaagtgggatgtgaaaagtctggcttcttgaaatgtgtcacatggcttcaaataacactggtagcgttggattctatgcaaagataaatgatttttttgttaagtttcttttattattttgattttgagacagagtctgtctgggtagccctggctgtcctagaacccacacggtacactaaagtggccttcctgcttctgcttcctgagtgctgggattaatggtgtgttcctccatgcccagataaatggtttctaactcacatacaacttttgatggtgctaaaaagaacggaaagtacagaagtcccagtataatgctgtccttgaaatctatgccatggagcctgcctctaaatagaagagtctcattcggagaccatatgagcatctgagtaattaaatattcttggataggtccagatggactgaggagtgctatagggaagaagccctagtctctggtatagccttagtagtgggtttccatggcttcaaatgtggtgtcccctattaatcatcagttacagcttttggctgttctagaaatacaggtgacagcattttgtgcaggacaagtcagaactaaggttttggttgaaacctgattttgatactgtagttacactgatagaaagctgtgtaatagttactcacctcgggtacagaagcgaaggatgaagtaaatgcatctggtcatttatcattcctgtttccttcagagtcatctgtagttctggggaccatttagcacaggtggtaaaagattgtcgtagcacatctctccagtataggcgaagagtacatttcactgtgctttagcgcttctgctgaaaagtccttcttttcaacagcctacatacttgtttgattcaatgaattgtctcctgataagagtttttctttatgcatggagggaggggagcatcaaccttattaggtagagtcccacattgctctgaatccctttgcccaagtgactgtacaggccttgtcccagcagtacagctttctgattgctgctattttcctgcttggttcttttgaagtattcccattttaatgaattgtaaatttcactcattctataggtcagaatcctcctaaaaagcaagccggttccaaattccatgtgagagctcgttttgagcctgtacattttgtagctagtagttcaaaagctgaaagacaggaagatccgtatggccctcaaacaaaagacgtaaatggacgaacacattttgccagcatgccaagaaacttctaccaagattatactcaagactctttcagtatccaggatggaaattctcaatattgtaattcatcaggatttattttcacaaaagaccagcctgtagcaaccaacatgtattttgacagtgggaaccctgccccaagcagcacatcccagcaggcaaactgtcagccagctcccgagcctcctccttcacagatgtaccctgagtccttggttgccgagaagcagtattttattgaaaagttaacagcaactatctggaagaacctttctaatccagagatgacttctggatctgataagattaattatacctatatgctaactcgttgtattcaggcatgtaagacaaatcctgagtatatatatgctcctttaaaagaaattcctcctgctgacatccccaaaaataaaaaacttctcacggatggttatgcttgtgaagttagatgccaaaatatctacctaactacaggttatgcaggtagcaagaatgggtccagagatcgagctactgagctagctgtaaaactcttgcagaagaggattgaggttagagttgtccgacggaaattcaagcacataatcggagaggaccttgtggtgtgtcagattggtatgctttcatatgaatttcccccagctctgaaaccaccagaagacctggtagtactgggaaaggatgcttctgggcagcctatttttaatagttctgccaaacactggaccaattttgtcattacagaaaatgcaaatgatgcaattggcatccttaacaattccgcctcattcaacaaaatgtcaattgagtacaaatacgagatgatgccaaaccgcacatggcggtgtcgagtattcctgcaagatcactgcttagctgaaggttatggaaccaagaaaacaagcaaacatgcagctgctgatgaggctttgaaagttcttcaaaaaacacaacccacttatccatctgtcaaaagttcccagtgtcactcaggctcttcacccaaaggatccggaaagaagaaagatatcaaagatcttgtagtttatgagaattcttccaatcctgtgtgcacattgaatgatacggctcagtttaaccgaatgacggttgaatatgtctatgaaaggatgacaggtctccgctggaaatgcaaggtgattctagagagcgaagtcattgcagaagcagttggtgtgaagaaaagtgtcaaatacgaagctgctggagaagctgtaaagaccctcaaaaagacccagccgactgtcattaacaacttgaagaaagggactgttgaagatgtgatttcaagaaatgaaatccagggccgctcagcagaagaagcttacaaacagcaaatcaaagaagacaacatagggaatcaactgctgagaaagatgggctggacgggtggtggtttagggaaatctggtgagggcatacgggagcctatctcagttaaagagcagcataagcgagaaggccttggtctagatgtagagagggtcaataaaattgctaagagggatatagaacaaattatcagaaactatgcccgctctgaaagccactcagatttgaccttctccacggagctgaccaatgatgaacggaagcaaatccatcagattgctcagaagtatggcctgaagagtaagtctcatggggtgggccatgataggtacctggtggtaggtcgaaaacggcggaaggaagacctactagatcaactcaaacaggagggccaagtgggacattatgagcttgttatgccccaagcaaactaagattttactaagttgtcttataaatgcctcatgaggtagatacacaaataacaaaaaaagctatatgttctggttgaagagtattcattcttaagatgtttcaccttgttcatttcatatagtgctttattaggtattggaacctagagaattctgtccacttgtattcttagcttaatccagcagatgatattgtgcagttactgtttgtgtctttgatatggctctgttccctcagattttagtagtttgtacaagtaaaaacacccatctaagtgcaatttcaccctgaggcaaatacttcacattataaagggcatagcacagccatctgcaacaatatgtaaagtcaatgctgactcttaactacgctaattccagatttacttaacatgtcaggtcattttgtatcaccaattttcatctttgtgagaagccagttgtagagcatttaacaataaattgtgctgtacgtgtaaatgtctttatcaactaaatgatgtaaaattttctttaaagtaattttagtgtgtgtttgtttataacttctaccctgtgatttccaggatattggaagtgatttactgtatcttgtgacatatgacttttaaacaaattctagtcttcatgctgagagagcactactgagagagatgtcgaaaagtttccaaaaagccttgattcaatcagaagaaagaaagcttgaactgtttgttcttggtgccttgcagagagactcagagcaactctccattgtagctttcacatggtttgtgcaccacacccaaggcaaccatagctgtggtagagcttggtaaaagactgaagatacactggtgctttgatgaaaaaggtcagttggctggttcccctctcaaaaagcttattactcccaaagccaactttgtaacatacttaaaactgctattttcgcttatttctggaatgtaaaaatgtataaaaataagagttagtgtatgcttcctgaataaaaaggagccaaagttgatcaaaa

SEQ ID NO: 651 - DNA, 237595 bp, mus musculus
ccattgctccgttttcttgtccattaagcaccatccctccgcctctctttccttcttttcttttttcccccttctccttccccctccctctccccctctctccagctccgtgtcatttcctcctagagctcacaagctgcctgagagtctccagccgggagagtaggcggagcggggcggggcggcgcggcgcggcgcaggaggacgatggtggctgagctgctgggggcggaggctccgtagcccccgcggaaaaggagcccggcggcgcctgcccagcccgagccgaggatggagagccggccggggtccttccagtacgtcccggtgcagctgcaagggggggcgccctggggcttcaccctcaaggggggcttggagcactgcgagccgctcacggtgtcgaaggtaaggagcggtggctcgctcctcacggcgtccaacttttgaatgggctagcgggtgcgcagagtgcgcggggtgcgggcctcagccccacttggcgacttggccagccggagcccgaggggctgcagccacacggaggggaggtcctgcggccgaagcagactgcagccaagtgtgcggccggaggatgggagccgaggcgcccggcccccgccggagctttgcgtgcagtcacactcccggggcaccggggcagcctcgctccccccccccccccacggcgaggcggccactcacctccgtgtgggctgcaggaaatggcggctgctgggggttctccttgctttggaggcccctgagcccggcaggacagcgaggggctgagggcacgggcgggggcgctccgggcgggctctcccggctctccctgtggctgtcccgcccgaggcaggttgctgggctggggtctggcgcggagctgctggcgaggcatcgctgggttttccgcaacctctcttcccacagcccggacgcgtacactcgggttcagagctgaggcgttgctgctgccggttccccctcggcctttccctccctcccgagtcgtgccccgcgccagagagatttcttgcacgctgcgaagtgtggagggaacttttgtgccttggagcacagctgtgctgaagcggccactagagtcgctttgatttaagagcctgtgatcagctggaactaagttgcagcgaagaggccaggggagagaagcactcctaagagttctgggaccccaaacccaggcttctccagtgagcgtgagggtggaggatgggggcgggggcggtgggggggaacagttggagatgttactgggaagagtggcttgtaaggctgctcaccttggagcacaagattgccaggtggagggacttcatgaactttaacccacttttcttacttctcttacaaactcagttcgctagtgagccattgcaatgcgtggggaaagcagttgcgattgtagatggagattctggctggggggggtggttggaaaagatctagctttttaaagtacaagtgaagctataggggttctttttgtttcccatgttaacatagcagctgagctctgaaagttactcccctcccctcacccaccccccaccgcataacaatctatgctatggaactccatgctctggaatggctttgctagctaacttgtgtgtctttaaggtgttgggacaacgcgttgctcatgtgtgaaccagtcagctcagactgtctgaaggtgtattgaggcaacattttgaggggattggccgggacctcgaagaggagctttggcctccccaaaccaggcgatcttcaaccagtataaccagattgagatagctggttttgtgatctaccttcacatcctgcccgttaacacccttcctgtgatattctctggagcaaaccactttttaaacaaacaaacaaacaacaacgacaacaacctattaaacagcccctttggggagggaattcttagctctgaagaatttctactaatcaagctctatactctgtctttccatcaaggtcataataggatatgtagccctgtctggcagccgcacccccacccccacccccaccggctttcgtttcctcctcaggtggcccacagactttccagtctgcctagaccctgaagaggtcatttcttcagctttgtccaggcaaacctaacctgccaggcacctctcagagggcttggtgctgtggtccaggattattttgtatgcacataggagcatggcagggcacggtgttactaagtacggggcaacagcaacttgtggtctggctgggggattatttgaggatatatgaaggttttcttggccacagtgctaaggaagtgcctcgtgtgtggagaggcagggtgccttttaatgagtccctttctgctgaatatacacttggcccctattatatgaaagtttattattgtatacatgaatatgcaggaataaatgtataactgggttggccaggacatcacataaaggttttgtgtgtgtgtgtgtgtgtgtgtgtgtgtgtgtgtgtgtgtgtatgtgtgtgtgtgtgtaatgctttgagtctcctcctcttcacaaaatactatttgggatatttcatttttctaccttagtgtgtatctttttatgcttcagaacaatatagcttcctcccctcccctccctttttaagtatgtatgtatgtatccaatggtgagaatggactagaaattgaattggtaaatgaaaaacaaccaaccaaccctctgtttctctggattctaactcttaccctgtcattttttttactggaatcctgcaaatatcccttgcctttcctgggccttgacacccctagatctaaaatgaacttgaagtgggcagtctttaaatggtactatgatggtttggtagtgaatccatcgccataaggccggcattctccatatagtgaggaaggaagatggctgtttcatttgcatcctatgctactgtgtgcacagtgtgcttctcaccccttactctgtcaccctatcccagctacactgtgagaccacagacagtcagggaaggttccagaactgctgatgaagaaactgactctggtgcatttagtggcttgcttcagtctgttgtgaagtaaatcaaaggcgggctctcagcctctttattttcggtggcctagagagtactacaagctgagagggagaattgactaataactttgagggccatctctagtctgctcagcctctaactccggtaatgctttccctgctgagaagtcatccagggccactgtgttttaggtgtacagtaatgaagtctgggctgttttggtaactgagtaacttgggctcctgaaagagagactagccaagagtcttgatgcaaaatggcagcaaacctcctttgcccagaacgggaaatacaaaggcagtttgaattcaggttgatgttgctgtatagacagggagatggaggcatttgagaaaaagtgaatagtaggaggagaaggcgtggaagaggaaagctaactttgcatttgtcgtggacagacctttaagaccaggaaatggtcgggttaggaaaattgtcagtggaactagccaatacagttttctggatgtgtagaattcagctgcctgatttatccagagttgtagagctatgtgttgatgatcaagtggccaaaaaggacaatatgttaaagtccatcctgttgattagcacaagttttagggagtagcttgtgatttttccgtatgttatggtagtactacggaagtgatgataaatgagagaagaagaccgtaagggcgtggttccacgatctgaaaatgacttgtttctttggctagcttcccacactaggccagggcaggtattgtctgaatgaaatggggattttcttcaaatcatatgtgtctgtcttagtgtagtgtccttgtctacagtacagacagtcattcatggagttgactctctgaataaaatgatttcttttcggggaggggataagtgaacttttgcaaagttctggcaccaatgaatttgaggcctcagagactcaagcagtgtttgtgggtatgggggcatggaagagagagaaggatggagaaaatggaactgcagcctaaggttcctgtgttaatgtctagttctcctcctcctcctgctcctcctcctgctcctgctcctcctcctcctcctcctcctgctcctcctcctgctcctcctcctcctcctcctgctcctcctcctgctcctgctcctcctcctcctcctcctcctgctcctcctgctcctcctcctgctcctgctcctcctcctcctcctcctgctcctgctcctcctcctgctcctcctcctgctcctgctcctcctgctcctgctcctcctcctcctcctcctcctgctcctcctcctgctcctcctcctcctcctcctcctcctcctcctcctcctcttcttcttcttcttcttcttcttcttttttcaagacaactgtttctctgtgtagccctggctgtcctggaacttgctctgtagaccaggctggcctcgaactcagaaatctgcctgctcagctttccaagtgctgggattaaaggcatgtgccaccactgcccagctcatgtctagttcttaaaaatgtgcttcgaagttaaataagcatatggaaaagaaaggatcagggaccagtggtcaggatgcagggaaaggatggggataactagggtaaaaagcacaggttagaaaactgtgcttacctacatatatactttttttctggcctgtttttggtaggtgtctcaatttggcacagtgaggcaagtgggagctagttgctattctttaacaaagtagggtggagtagaagcacagtctaaaggcaatggattgtacacaaatatccctctgtcatttttacccctgttagatataagtcactgtttacaaagtgccagtaggcatacctgtcccatcttcattatcacagaggatgtgaggagatttggtaaaccctttgctatccttgaccttatagaaaggcagggcctgccctttaagttctttgtcagctccagtggtgctctctctccgatcttagttctggatgtacaaaaagaagcagttgaaactgggccgaatgatcagatattttcttgtggctggaagtaaatttggctgtgacttttgagttcttgttagatgtagaggttgtgtaaacagtgatatacctttcaaatctttccagctatgttataggtcagacctagctccagcctcagtcccagccccagcccctgcccaagtcaagggcctgcagtcccaagggtatttttacaggatatgttgataggagatgaatgcagcctgattacttatatggatccctccctgatctttcccactagaatccacaaagacaccttcttcagtttcatggcttctgccttccagaaaggacaccgcatggaacaggaatctatctaaggggtataagatgggggtagaacaaaaagactgtatggtatgtctcataaagccttgtcctaagtaatttacatacatagcattttaggtccatcttacatacctagtaccctgctgataaccatgtttgttccacgaaggaaaaaggttcatgcctgttgtagggttttccctcttcagaacctcaaagacaatacttttaactccatctggaagacacttgagcattgttctttaaacagttaaaacatttctcccttgcttctcccagaacactccctaggaatttctttaaagagaaaaagacagtttcggacagagactactagttatggggtaattatcatgagagaacacgattatgtttatggttaggcttcttccaaaccagaggaaaatgtgctgacccatctgggagacgttaatggagagcagcagagattgcaggaaggtgcgctctcagtgcccactgccccctgtgccaaagggcaggcttaactaagggttgctgtactgctggtagggacctagaaacagagtttcagagtctttacaagtcacctagtttaagatcatttaaggaacctgctgtggagagtctctgattatgttcttcactggtcatgggggatcatgtgtatatttaagcctgccttcgtcgttgttgtcaggtttaatctgtggacagtttttttttttaatctatgctgaattgcaaacatttctctttacctcttatccatggggctaagccctgcagtcttggagcacagagaacaatggcgcttcctctgttttagaacaaaatggcatgcttcttcaacttttccttatggggtctgcggttcagcctctctctccccccctgtgctttcttaatgcttatgagatctgaggttgctcctttcactctgaattcactacatcttgtccattgttctctctcctcccctcccctctcctcttcaaatttctggtgctcaagatcaaacctagggcagtagacaagtgttctactactgagctaaacgtccctattccttggggctctcttaagttatggagtccatacacaatatagccatctcctggaggcagttatgaaaattaagtgagacctttttttttgtgctgagaattgttatctagctacagaccattcttttaaaaacatatatctgaagggggctggctcagtagttaaaagggcttatagctcttgcagatgaccgtggtttgattcccattatccacatagcaacaaatccatatcacaggtccagatctgttgcccttcttttgacctcatcaggctcctgtatatacatgtgttcatgtgcatgctcatacacactcatgtgattttttttggtagcaatgtcataagacactgtctctgtgtcctttaagtaagcactgaggaaagtcatatgatgaagtgtgtgtgtgtgtgtgtgtgtgtgtgtgtgtgtgtgtgtgtgtgtgcatgcgtgcttgcctgtgcttgcaagtgcccatccacacttttatatgtatgttgggcagaggcagatgttgtatgtcttcctgttgctttccactatattttttgagacagggtctctgaacctagagctctttcattgcttggactacttggcctttgagtgtctgggatctgcctatgcctgaccctaccccagtgcttggattataggtatgcaccagcacacctggcttctttgtgggtgctgaggatctgaacctggctccttatggttacacaaccaacactttttctactgaactatcttcccagtgacatctaatacatttttgagtgacacttttcatctcctactatttatatggaattccccctgcccctatcccagagcagctttgagaaagacaactccagggaagatgagagagggcttaggacttgccttcatgaagtgtatatgtctaaacaaagacattgttaagttaacagagtaggaagtggtatttaatgcatgttgctagaatcaaaattccattttttttacctctctgaacttttcttctaggaaaagtaatcaactccaaaattgaaaataccaaccatatgccatatgtgatatgtaagtagtctttaacacacacacacacacacacacacacacatgcatacaattatgtgtgtgggggtgtacatgtgtacgtgtgtatgtgtgtatgtatagcactgattacagtggctcctgcagctctgggtttctagggtctagattcttttttttagagttgaaatagccacagaagtcactcctgctggaggtctctattcacaggcttttaaaagtctatcttcccatgtttgcccacttctcactggagctgggaaatgcttttctttactcctaaagtctagaccagggagaagattggagcagggcttaattttccttgttggagcctgagggttctaagggaagggaaattcaagtctagagaccatgtccatgctgacacttgacaattaatagttgttcggttcactcagaacaattctagagaggctatttaatccatagtgtatgagcaacgacattactcaacatacccttactgtgtggtgttgatttgtaggaaatggtcttctgagctccacgatgcttacttacacaaggtattcttggaaaacacttcatctataactgatggcaaagtactctagagagttctaggacatagatctgggcgactttggggtttctcttgtcatcagtgcttaatgtgttcataccctcactactgggaccaggtgtgtgttacagtttcctggataccgaactggtaggtctacctgcaagttatcttggaactgtttattctgggtgtgttggtaatgagatcatttttgcttagcatctataaaaccaaatattttattttctggtgctccctgaagtatttattactgacattctttaattatgttgtcgatgagtaaatggggatacaatttctcctagctaaggaccaaggactcgggtgaagtaaactttgtctcttcatgtcccttaggcaccttcagtgttactaggcgagtggaaacattgtcgtgtatattagctttgcacgagatgacctgttccttcctcacaccacactggcatgtttatttgggcagagccatcttgctggggcaccgaagtggcaaggatcaagatgacttgagctctcaaagtaatttctaacccctcccatggctcttcacttccacacccccctgtttcagtgtaagtctgtgcctatgctatggggcagaatgatgacttcctcagaggaagagacccatttttccttcttctagctgttcatctttatttcatgtccagtccttgattttcagcctgcacccacaagcactggttgtttaaggcctccatcttggactctcactcaagtgccattggctctttgcttctttgttcattggctgccctgcctgctatctaaaacccattttctccttttggttacagtgagtacttctactttgctatagcagctttgtctgtcgtggcttaggcatgctctggtaggtgatgagagaggctaattgaggccagtaagtttgaaatcgttcagtaaattaaagtagaaacagagggaagatttctcacacttcatctttttctgtcctgtttgagttaaggacaagtcttttgtcaccttccgttacttggaaatgcttagcaatttcctgagtaatcttggcatggtcctttcacctctttgccatcttttttttttttttttttggtaagaactttcagggtgtaagtctctactttatggaaggacttgagtgttctttcttgttctggctgtggcaatgtgaaggatgcctgacagcaggcagctcttatagaacaccacgtttctctacactcctgcttcctatctttacagaagtggctatttcctggtgtgttctcagagacgggcatggtctgttaactttcactcaagtcttttaatgttacctctcaaagaatgtgggaggtaggagtcatttgacaggaccaagggttaagcccactgaagaacagattctttgaggtatcttctggccctcattctaacgccacccaacagatttctagctgttttgtttttctcttcctgtaagcccccggcaggaaagtttcgaacggttctcctatatttattgcctttcatggtctatcagaaactgatctttcttttgagaagagggggttggaggtaggagctagaagcaaagctggtttgactagtcattcaggaaaagggttagatactcaaggctacagcctcatctttgcttatgacaagctaaagccttgtctttattgggctgtcttactgttttccttttctgtttgtgtgtgtgtttaggtaaaagtcccccctccccaaacttccacaggcaagtagcttttaatggcctctttctctaattgaaagtctgagtgttgatgttttgactacagagcagggagtgtgtgtcagacctgactcatggtctttggagaaattgactgtgactctggggctttcttaatttaaattgttaattaagaaaggtcaagaccataggctgaaacctggatcaggcaaggagctggatccttccaggtatttacagagtggacgacctgtagtttgggctggagtttagcaatctgttggatgtaaagggtggttagagcctacacaagaggggcattacaaaccttgagaatctgctgtgggtcaattatgtttgtttcaggtattgtgcatgtgttctcctttaatatttatagcaggtctttgaggcggatattgatctcagttatgcaaatgaagggattgagacccaagagaagttaagtgacagatttgaaattctatgctaagtgggagagctagtattgaaacttaatttgggaagcagaggtgtagtttcagtctacagtaccaccacagtgttattttatttttaatcatttattttgatttttttttcagtgttctggatagaactcaggcctttgtatatgctacgaacgctctaccactgagctaaacctctggcattcaaacttctggcttattccgagtctcattttcttttttccaatgccacacttatgtatcttaaaaatcaggagaattgggtgggagaaagaagaggaatgagacatgaaatttaatgaagtttggtagtgttgtcaatattgtacctcaggggttagggttaaaggaaactttgtgttttaaattttttcgtgtgtgtgtgtgtgggtgtgtgtcctagcagtgctgtggatagaaacacacacacacacacacacacacacacacatgcttggggcatgctaagggatcagtcaaccgatctacaaactgagtcatcccaggtctgtttttttttttttttttcaaaaccagttcttttctgagctacagctacatctgtagccttcagaagatcagaatcttagtcttatggctgcccctcatctgtgagtcttttaagcaagtcatattccttgttgtatctagatttttataattctcaaataaaagttaacaaatttgtatggtccaagaacaagaagtcaaaaaaagtagccaggaatttgagagcagggagtgatatacggaagggctgaagggggggggaatataattaaattgtaatctcaaaagtaaaataaaatgaactggtatggttgttccactagagatgattccctgtatcttttagttcatataaataccagaggtatatgtgattgacgaaggaaatagaatacttcctaggtgtccttattaagctaaaattcttgtcaaagaattctgaacttaaacaataaaatgtttgaggttgccagatgtgcatgaaatgacaggacaattttagtgcgatgtctgtaactgccagagatagaaagacaagacatgatttctgcctcatgtctaaatagctggagctttaaaaggctgtgttaaaccttgcttggttgtcctgaaacctctcaattaagacttcaatcaatcaatcagtcaatcaatcagtcaatcagtcaatcaaccagtcaaccagtctacagatcaatcagtcaacacagatttgttgaacactttgcagagtgcctagtcctgaactacagaattcaagagatgaccaccagagtagacctgatctttggattctcaaagagatgacaagtttattgaagtttatttatatattgtttcctggacataactatttgctgtatatccagggaacaaaaagctttgggtgctgagactatagaataaaatctaataagatctgttcatggatcagtgttggaagctttgtgggaaaaataaaaattgaagctggaccagtggggtacttaggtaatcttgggtggtagaagagtgttcattctagttggatgaatgccttaaaagattcaggaagaattaatgtatttaaaccaggcatccaatgtagtaccagtcacataactgcttgcctgaggagagacctaaagtgagcaatagataggaagagtgggtatgaaacaacctggcaatatgctgacagtgtgttagatgttatcaggggttagtgatatcgtataccactgaaaggatgaagcacaagttagtaggtattggaggtgatgcctctatttcaaatgtagaagatggggattggaaaagggaagcagtttgtgttttagttttggatcttctgatactgtttatggggcaatcaagctagggagcctagtaggcagatggggacaaggagaaaggggtttgtttatatttgtttatttaggggtttggtaaattggaatcgcaagtccttctgttaggaactctattgtcaacacacaattttctaatctattgatctgtaaattagttaattgcctggcagtccatgccccaaagacataggaaactggctgctttgtgatttaatgagcattcctacctttgtcttgttagtgtctctgatctgcaggaggcctagtccttagaggtgttgcttgctggaatacttttttatataaatagaacactcaatgttctatagtaggaaaaaagcaaacaaacaaaaattccaaacctcagatggacctcataaagtggatcgaggcttctaaaatatatcagttgactttgccaagatgtttaaggattgttttctgtatatgtaaaacaaaatgtggtggcttggtgaggcaaacctcaaaccaccggagtttcaagtttctgttcgattttgattgttagaagcattctcctctctgcctggcatgagctattattaatctgtgaatgtcactgtttatgttttcggaatagtaagtgttctccaatatgacctttaaaaatactgttcaacttctgtgtgggatttcattgcctaggtggtatctttaccgccctaaaataaaagaggagatgggggttcatttcacaacctcttttgctgtaaatctggctggaaaaacgttttagcattgaaatttttacaagttgggagtgattaactattgcactgatgttccttatctttatacttaatagaacgccttagaaagattcaatttgtgtgtagatgtacctgccaatttgaagaccatcctacatcttctgcttcccgccccttcatgaattgactttctagctcattactactcttctgcaatatcaattgcttttcttcactgtatgaaactaaattcagaactttgtaaagatgcttgtactatggcaataggtctaaacccattcccaactctgtagctgaaacaacactgtttgctctaaggttaatgggcatgtaggttctttaatttgcctcctttctctgaccaggtaaaataacttgtaatttatatttgaaatccattcaaatacctagctgctggggagactttttttttttttttttttgtggcaaagcttgcttgagtgctaggctcttacaagagctagtttgctgactgctctgcagagtgagctggggtgggagggtaacttttttcttctgcatggaaagggctcaatatgtaatttttgagttttctccatgcccttggctggagaaatgtgcagtgttctgaaagctgctcgctcaggctttgtacatactggatctgcttaaaggaaggttttggctcttagccctgttcagctgcaatagggtttgagttacagactttccctttccaacccctaataacaaccaaagggatgaagggcagaaccagagagagttaatttccactgcaaagacccaggtaaggcgcttctatctcccatacgctaggctggagtcctaatttaaggctgaactctacttagagactgtaagtgatggtgatctgggacaggcccctgataatcaagttttgtcctacactgcatcttcttttcctctttcttgtttctctttccatctttttctccctgctctgttcgcagcttagaggaggctgagattctagcaaccaagtcaactggtactactggagaagaagaaacagtccaccgtccttcctttcttctaaactgggcgttttacagaagcttctcccaccccaccctgccagttcacaaagccaacctcaggacaaaatctaggaggctcaatctgagtaaagggtattattgatatctctttcaactcaaaagagaggcatggtaatgagctttgagatggtgagctcagatgggaaaaggcagccttgaaagatcttgagaaaactagactagcagaacgggcccttcttctggaggaacaactacaatagtatatttgcttcctcaaatgctattccactctttgaccatcctcatccccttgaaaatatttactcgttttctgctgccagtagactgaagcccagactacttttactgggtattacagaccattttcctctgactctagtcttactttttatttctactagattccaggttttcagggagaatggtatcatctcttttcttcttcttcttttttttaagatttatttttttattacatgttttcttcatttacatttcaaatgttatcccctttcctagtttcctctctgaaaatcccctataccctcctcctccccctgctccccagcccacccactcctgcttcctggccctggcattcccctgtactggggcatgtaaagtttgcaagaccaaggggcctctcctcctactgatggctggctacgctatcttctgctacatatgcagctagagacacaaactctgggaggtactggttagttcatattgttcctcctatagggctgcaaaccccttcagctccttgggtacttactctagctcctccattgggggccctgtgttccatccaacagctgactgtgagcatccacttctgtatttgccaggcactggcatagcctcacaagagacagctataccagggtcttgtcatctttgttctattcttaagctcctccctgggaaactctgccttttgccatctctaccctgccatctccttctgaggccatgctttacactgtaatcctctcttctctgcattgctctgtggggtccaaccactgtgagcaccagctctccaggacatcatccagatggctccaggtggaaaggaccaacttcccctagaaactgtggtgaacctcaaatccacatgttagctacaaatggagggaacacgtgataatgatgatggttggggaagttaagaaggacccctcatgtgcaacctgaggtgtgaagaggggtgacagtagtggggaatcagggtgtctgtaggctgactggtttgctgaatatgtaaattgtgttccccaggttggcaatgaggagtgaggactatagcattcattaaaatgttggggaatgttgtgagacttgtaacacaacagccattctgcgtgttactctgtgttcagagtgggtatagtaatttttgtgcttgattcaagcacttcagcactatctgagatttgaagacattaaatcagtgtgagtatgtgtgtatgcatatatgtgtgtgagtgtgtgcacgtgcgtgtgtatgtgtgtgtttgtgcacgcgcatgcatgcacgtgtttttttacctttgcttaaacaagtccaaacgtgttctatttcactggccttggttgtgagtcactgtctggtatttatacataatgccttaagtgtcttcgttatttgaccatgacattccttttctcattgtttcactcaaagccgagaacaccaagaaaggaaaaaaggaactgactaatgaggtttaatgtcattggtgcttgtctgtatgacggtcaggttatctcagggcagtaaggggacaggttaagaatcagtgtttaaagagccagggacagcacagtaaccccgggagtgcgagtttgctactgaccagtctactgctgctgagcgtgttttacaggcgcggactttcagagctggtctgtcaagggatcccaggaagcatatatccttatccgaatctcttgtaagtatgaatgaagtatgaataattagaggcattcttaactaggaaatgatcggatagttgcatatattgaggggagatttggataatattaccatgctccttacttctacatttgtatggaagcggatctctaagggtgcgagaatggtaaaccccatctgagggcaccttagttgtcaaagggacagagcagtggataggaaggacattgctgttagcatggtcatttagaggccagacagccagtaaatcatttaagaaggaattaaaggttcaaagggcaggcgagaattctttgggtgacctcataggtgcttgaaaaatcaaagggctagctgatgtgcttttatgtattgaaggctggtttgaaagggcaagggaatagaaacgcacaaaaggaaattggcattgcagcttttaatgtgctcaggagccttaactctgggctggggatgatcaaagttcccgttaagtaagtatcttttgtgttcttgagattatgcctgcatattcattataatgtcatcactgccatgaattaagtcatagtggcgcagatgaaaaaagtgaggtccagagaggcaaagcattgttcttccagtagagctagaatcggaacccacctgtaaccgactgcaaatcacatgcttgtcttatgataccttacagttttgtttcagagatcccatttttatacttaatattatcgttttgatcccactgttcactatggtgagactgtgttgtttgcattgtaacatcatacgaagttgagtttcacagacaagtcatttcaaaactttcctgggaagctcaattaggacacaaattacaatgcatgggaaattcgtagtaatgtcccttttcatagacatggggcagaaaagtctcattaccttgccaaaattcatccaatcagtaattggctcagtattcaaaattttgatttttctctttgttccagttcttcccagtgctcctggtgtttctcaaagtgggaaggtaattagtaaacaacactgggtttggccttcttgtgccctctgggtcttttttttttctttttttttttctttttctttactttttctatctttgccaacaaatttaaaatactggtagcctcctcctttctttcccttgcttccttcctcttccttcccagtcttcttactggggcagtttaaattatcttagaggtgtgataaatgttcatggagcaaaattaacagtgtataaacagacatgtcttacttcatctctgtccctaaaccacctacgatttcttcccagaggcaactgctgatatcaattccctatgtcccctgtgtgggctcccacacatacgtgtgtgttcagtgcttccattttcttcttgcctgtgtcttccttattccctttccatgtgactgatgcctacgtgaagactaactttcctgacatttccccagactccattcttgatttccttgtacattacttgaagactgcttaccatgaaaaagcaggcaaggaaaagtttcctgctcgttttgatctcctatctctagttttagttcccccaactgcatttatttttattgtgctttttcatagtatctctctatatatccaggcaaatgttacacacacacacacacacacacacacacacacacactcttgcttcttccacaaaagggaatatattgaaacagtcttctgtgcctttttttcccacttgcacatttgcacatcctggaggtttttcattatcagtatacagagagctatcctccatttaaaacagccattatctgtaattgtttagccaacccttaatgtcttttatcatttgtattgtttccattatactatattgacttgattgtcccccagatcctgttgctagcatagcttctgtggcactggatggccttggttctccaccttctcactgtgtgcattcctctgtttagcccctatatgctgtctctgtgtctctgcccctcctgcctcagcctcgtccatcctaaagttaccattaattatactttgtacttttagaatcactcagtgaagaaatctcgtgactcccaagtcctttttcagttatctggtgggcaatgtttgcttggatattatttcttttctttcccccctgtaagctttaaaatgtttaaaacggaacttgttattttcttcttgcagaagtgccgtagtccttggcctcttcacctcccacttggttagattgaaatcttggagtcaccacttactcatccctgtatcaggttaattatcacatcctgtcaggtctttcttcctttaaaatagccgtttcagttcttgctcctcccactctcccgcaagcccttgttactttatgtctggagttttggactgcaggctagcttccttgcttccaggctcaccccctttaaatgtatcctataggtcatttcctgtatttgagacatgcagtaacccttgtctgtacagggaagctgaactcagtggttgatctctgaagttcttcctgcctctgacgtttccttcagaaattgttgaaatcgagtaactcagcctcccactgctgccaagccttttctttctctttagtgcttgctggaattacattcttcctagaattggtacctaaatcaactcccatagaaaagtcttagaggaaaggccagccacactgacccctgtctgagtgttcctggcattccagttttgcttggctgtgtttttcttgcatactccgctaacacgtagcactctacaaccagccagggctttggcttgtcatgtagctataatttgaatacatcttctaaagctaacgatgcctagtgatctgccttgacagtacctcattagtatttcccacagtcattgttttatacatgccccacaggtgacagctcacaatttcctggacctgctgagggctctgctcttgcgctctctctctctctctctctctctctctctctctctctctctctctctctctctctctctctctctctttctctctctttcttcccctgcttgctttgtgggactgaactgctagatccttggacttccattcacagctgctgctgaccattgttgggagttggactacagactgtaagtcatcaacaaattcccttactatatagagactccccatacgttctgtgactctagagaaccctgaagtatagaagttggtacctcaaacacattcctaatcccacctgcctaacgacattcagcctaacgtgaggccatcatttgattctttcttccactacccctgctttctttacttttcctcagatactcgccgtgtactttttcaatccattttgtatttcataaaggatgttggttttttttttttttatggtgccagaggtggaacccagggcttatatacccagagctaaatgaggaacaatggaaaaaaggaaatgttttattgcgttgtttatctgcactctgatcttctctctcctttgctcttaacatttattactactctttacagatacaaattctgtgtttttgatggtataaatgtttctttactcaatctacagactagagcgacagagatagagacagatatgcaaactgacagatgtgtgaagtggtgtggtggtatcttttggagaagtaaacttttttaaggcaaataaagaaaaccctttaaaattctgtatcctacagaatattttccttttcctctcctactcttcatcccttgtctttctcgtttccatgtttctctcccacacatgcataatttcacagtgactgtggcttcccatgagtattttgtaaatggcttctatctgaagttggccagtctcttaggttgaatgagatatgcttatctagtgtgttcgtcaaaaacatcctttactccccagacagacaggccaattcagttagtaacatatccttctgtaaaaggaccaggatgctgctgttaattccctgtatgtaccagtttaattacatttcagaagtcaagaaatatttaagtagttccagttgcagcattccatttccctaagtattaaccataaatcactagtgggtccttaaaaattcctctggatgtactgaggttggtattttacatcaatataagaaacgtgcataaaggtgtctagttcggtccagcagagtaaaattgtcctcttgatttttctctctgggtccatgtttttgtcaacctcaacccccacccccacccccacacacaccctgtgcaattttcacatggcccccttttcttctccctttacatatttcaccaggttctttaagggactggttgtgattattaccaaaccatatgggaaccacacattttagtttttcctctactgtctggagtagaaaagctcaaagattactttttaactattgaaaggcttaggagcaggtagcccgtccgtcttaatttcaccatccaagacagccaaagctagtaaccttttttcttttcattcagctgacacctgaatccatttctccaaacaggtgatactagttactgaggtatatattcttatgcagcctttatgacccagtatgtttttaactaacaatattctgtattaaaggggtctagggtcgttatgcatagttgcctcttcaagactggattgtgccttctggttacaatccttttgagtacaaaataaggacagtgatgttgttcaacctttactttttacatttgacacttcagaaagtatatttgtggtaatcagcttttgtaagaaatatatgagaaaatgggattacagagagcaaatatttattttggtcacagttttaggggtttaatccatgattcgttggtcctgttgctttaacccattggtgacacaccacagacgtagctcttggtggattcaatccattcatctcatggctagagtgtatgtctttgtgtatgtgtgtgttgtctgaatgtataagaaggagagagggaagtggattggaagaatgagagaaagtaaaagagaccagggtcccataaccctcttttggcatcccttcaatggtataaggacctcccaccagaccctacctcttaaagttttcaccaccttctaatagcaccaaaccggagaataattctctagcacataggcctttgggggacacttaaggtccaaaccatggcaatattaatatgtcttgttaaatttttacattcatctaactttttattgcagtgagaacacttaagatgtatactatgaacaaatttaagtggaaaatatagaaacaacaggcattatgtatagtggacctccagaaaggtattcattgtatacagctacaatattgtactcatggaactgaagctcctcaccccacccccccatccctgacagttaccattatataccatttctctagctttggctgttttagataccttgtgtaaatggaatcacgtagcatttcctcttgcatgactggattattatttcacctagcttaaggtcttccataatcatctaggtcaatttctttcagaaaaacattccattgtgtagtgtatagaattctccttatctatatatacatcgatgagcatttacattgtttccacatctggtttatcatgaatagtgctgtagtgaacatgggaaagcaaatatctctttcaaggtcttaagttcttctaaatgaatacctgaaaggtgaatttctggatcctatttagttatcgtctatgatataccactatgttgtattctgctttgtattctctccaacagtgtacaagggtctggcttctctattttcttaccagtgcttattttctattttttaaactgataagtcatctcctccatgttttcatattcttgtataccttctttggagaaatgtctgctcagattcttagcttgtatggttttttggtggggtggtggtggggacagggtttttctgtgtagccctggctgtcctagacattgttctgtagatcagactggccttgaactcgcagagatcctcctgcctttgtcttcatgagtgctgggattaaaagcgtgtgctaccactgtccagctagcccatttaaaaaaaaaagatgtattttatgtatttgaatacagtgtctctgtcttcagacacaccagaagagggcatcagatctcattacagatggtcattgctgggaattgaactcaggacctctggaagagcagtcagtgctcttaactgctgagccgtctctccagcccatagcccatgtttttaatgacaaaagatcttggtagttgctcacactggcctggaattttacctttactatcatccaagtttggctcatttcaagtcaaggtatttggtgttaagctctgtatatattttggatatcaatcccataacagagaaagtgcttgcattctgttcactgccctttccttctgtttcttttgttatgcagaagatttatagtttttcatgttccacttgaaagaggagactttcattttttcagagtgtcttttttttttttttttttttttttttggttttttgagacagggtttctctgtgtagccctgtctgtcctggaactcactctgtagaccaggctggcctcgaactcagaaatccgcctgcctctgcctgtgctgggattaaaggcatacgccaccacactcgtcttcaaagtgtcctcttgataccattgtcaaagaacaagattttctttctgggcttctaaattagttcattgctgtgaaccagaaatgagggtttatttttgggcttctatattggttcattgctccgcatgtctgcttttatgctgctaccattgcaaaaaactactgttttttgtagtgtaacttgaagccaaggtacgtatgtttccagctttggttttttttcatcttttatattattagcatatattcattgtacacagtgatgggttatatgataacattttcattcaggtatatcatgttttacttaacctaactccattttcatatattttcctgcagattatatgaatttgtttttatttatggctaaataaaaagtatatcatgtatatgtaccacattttcttagttcatttatctgctgatgaccacctagtataattctataatttgattattatgaatagtgccctacaaaactgagtgtgggttctttttcttttttaagatttcttattttttttgtattcatggccctaggcaagtcattatgaattttatctatctattttctatttctataaaatatgctattgaaagtttaacagattgaaagcccttgctttgttagtgttgattagttttctttttcaacttgacacaagttagagaacttcagctgagaaaatggctccctcacattgccctgtgggcaagcctgtagggcattttcttgattattgattattggtgtgagagagcacagctcactgtaggtcattgtcactcctaagctggttgtcctgggttctataataaagcaagcgaagcaagcaagcaagcaagccagtaagcagcatcccttcatggccccgacttcagttcctgcctccaggttcctgccctgagttcctttgatcatggcttgtgattgggacaacagaatgtaagctgaaatataataaaccctttgaccctaagttgcttttggttgtgatgttgtcacagttatcaaaaacacactagagtagctagtagagtcattttgacagcattctatgtattagcatggaatgttttaccatagaatgcttttaccatttacttgtagcttcttttatcaatatttttgtattctttagggtataactctcacttttattttattttgttttttcaaaggcagatgtgttttctatgtagccttgaactcactctgtagaccaggctagcctcaaagtcagagatctgactgcctctccctcctgagcgctaggactaaaggcgtgtgccacaaccacctacaatacatttcatttgcttatttatattttgtctttaaatattttgttcttgacatcaattcaaactagatggacttactttcttttctatatgtccttgttagtatgtagaaaaagcattcatttagcatgttgaattttatttatttgacttttttgagacaagatctcactgtgtagcccagactgtcctgaaactcattgtgtatctcagcttgtctgcaggcttgtggccatccttctgtctcaccctcccaagtactgagattacaggcatgcacttccatgtccagacatatattacattttataacttttgtaactttacagattttatttttttctatgatttctctgtatgtgtgggtagtagttagaattttctacatttgtgatctcctattatctgtaaagagaggtggttttatttttttcttttaaatttccttttcttgcctggcaatctagtacaggatatctactactgtattggctaggagtggtagaaacagatagccttgccttacatgaaaaacattcaccattttcaacattcaccatgatctaagttgtagacttactaagattttattatgtcaaagtaatttccttctattcctagtttgttgagagatttactcatgaaagcctattaaatattatgtaactttgcaggtattaacatcataatataatttttatacttcattctattaatgtacatcatgtttattgctttgtatattttgagtcacccatggtcatggtgtaccattctttcaatgtgctatttattgacttgttgagaagttttacatctttattaactgggaatattgtctgtgttttgttgctatttattttatattaccattgattggttggcatcagtaattctaacctcatgaattgaatttgtaattgctccttctgcttcagtttttaggaagagtttcagaaagatcagcatcaattgtttttaaaagtatggtagaattaaccagtagatccatttggctctgggattttgcagtgctttaggtttgtaattatttctaaatattaaaacaaaacaaaacaaaacaaaacactgtttttctttacccagccattgtggtgcacgcctttaatcccagcacttgggagacagaggcaagctgatcttgtgagttcaaggccagcatggtctacaaagtgagtcaaggacagttagggctagttacactgagaaaccctgtctcaaacaaaacaaaacaaaacaaaacaaaacaaaacaaaacaaaacaaaacaaaacaaaacaaaacaaaacgttcttctttgagggcctagagcgattgcttagaggtcaagagcgcttgttgctcttccagaagacctggctggctttggttctcagcacctacttgacagctaacaactgtctgtaactccagttccagaagatctgtcgccctcttttggcctccaaggtgaatagacacacattcaagcaaaatacctatataaataacaaagaactcttaaaaataatttattctttaacccattggtccaagaatgtgcttctttgtaaattatttataaaatttctagttatgtttctgctatttatttcaaattttaacacattattcttgaaaacataattagtgtaattttaatcttctttaactagtacttactttgtgacctggaatgttgtcaatcctggggaatgttctaatgggcacttgaggagaatgtgggatctgatgatgtgagtggaatggctgtatttccattaagtctgtttagtctgtagtattgttcaagtctactatttatgtcttgagcatctatgtcaacattctatcccttgctgagtgtgcgttattgaagcctcatgctatggcaatattgctatttctccatttggggcctctcttatgcatatatatttatcatcactaaatcatcccaattaattgacatccctccctcaccccctttctgttttctgacagtttgaggcctaaagtctgttttgtttgatgtaagtacagtcatttctggatcattctttttctgtctcatcattttcagcttatgtattttcttaaatcaacagcaagtcatttatagatggcatatgtaggtagccatccacatatatgggtgtgacacccacagattcaaccaagcaaggcttgaaaatattcacaagaaacttaatctgtaataaatatgtcttagtttcatttttctcattgttcttaaccattaccatttaacaaattgtatttgcataatgtttatatcatattacacattataaataatctggagatgatttatagtgatgatgtacataggtcatacattgatactgtattcttctttaacattttgagcatctgtagattttggtatatatgtatgtatacatgtgtagaggaggggaatattctggaataaagtggctgtagacaccatgggattactttagtgaatctgcttttttatactttcagccattctgcatattttgattggggaataagtgatttcttttctttttttattaattaggtatttccttcatttacatttcaaatgctaccccataagtcccccaaaccctccccccactcttggccctggcattcccctgtactgaggcatatagagtttgcaagaccaaggggccctctcttcccaatgatggccgactaggccttgttctgatacatatgcaactacagacacgagctctggggggtactggttagttcatattgttgttccacctatagagttgcagacccctttagctccttgggtactttctctagctcctccattgggggccctgtgatccatccaatagcttactgtgagcatccacttctgtgtttgctaggccccagcatagcctcacaagagacatctatatcagggtcctttcagcaaaatcttgctggtgtatgcaatggtgtcagcgtttggaggctgattatgggatggatccccgggtatggcagtctctagatggtccatcgaataggtgatttctatttagagtaattattggtaggaaatgatgtaacattgctatttcatgttcattacattcattccatcttatagattgtctctattttttgttttgttttgtttgtttttcccttttggtaacctccattgtattttatttgttattcttttagtattaatggcattttcttcttttttccttttgtgcatttttataagtatgttctttgttattggcataggtttatataaactaccttgcaattttaacctatataacttctgtcttaatgttttcattggtgtgaagagacaccatgaccaaggcagctcttataaaggcaaacatttaaatggggctggcttacaggttcataggctcagtcaattatcatcatggccggaagtatggcagaatgcagacagacattgtgctggagaaggagctgagaggtctacatcttgatctgaaggcagccaagaagagactggcttccacaggaagccaacaggagggtctcttctgcattgggcagagcttgagtactgagatcttaaagcccaccccacagtgtggcacacttcctccaacaagaccacacctactctaacaaggccacacctcctaatagtgccactccccatgacccaagcatattcagaccaccacagatgataacaacttagttgaatcacttataaaaactacacacacacacacacacacacacacacacatacacacacacacacacacatatatgtatggtttaatgattgacatatttttaatgtttctcttagtgtttatactaggattcaaagtgacctgcctaataatttcataatattacagattctctttatgtatctttaccagtgactttcatgtatttctgtatttctgcttgttgttcttacattttgcctactcttttaatatgtaaggcagatctttcaatagtccattctcattcatatctgtattcttcacgcagttctcaccctccccgccttcctccaaccctgtcttttcctcttctgtattgcctttattttaccaggtagagtatttttttttccattttttattaggtatttaactcatttacatttccaatgctataccaaaagtcccccatatccacccacccccactcccctgcccacccactccccctttttggccctggtgttcccctgtactggggcatataaagtttgcaagtccaatgggcctctctttccagtgatggtcgactaggccatcttttgatatatatgcagctagagtcaagagctccggggtactggttagttcataatgttgttccacctatagggttgcagatccctttagctccttggctactttctctagctcctctccattaggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacaggtagagtattcttatttggcagtttttttttttttttaaatcatgccatactttgaatctgtatggcacattcctttttgacctgtaaagtctttcttctgaaatcaactgatggtctaatggaagttgccaagtataagatacgttgtttctctttcaaacttatctcttcattttgtttggataataattaaaatgtgtcttggtgaggacttcttcacatttattctatctgccctgcattgacactctagatatgaatttctttttctacatttgggaagttgtggatcattagtttttaatgtgtttgggggaaacctttccatcttctcatggaacttctgtaatgtatatagtgttctcattaatggtgtcccatgagtgccttaatctctctctgctctttcttttattcttttgcttccccgatggattcagttgggataattaactttgagtttgataattatttcttttgattgatctagtctattgtcaaacttttctagtgaatctctcagtttagctaccattcttcagccccaatatttctgcttatttttcccatttttttgttgaaaatttgactttgtatatgtatcctgaccatttcctgtatctttatgctggttattttgatgctgatgggtaaatcaggtatccctacttcatttggtttatttgtgcaaattcattttgttcttttgtttaaaatttatgttcctagaatttttgtgttaatctctggtcgtcagatagacaattacttcttgtaatatagtcattatgcatcaattagctcaactttagattctgatggctttcaagcatttgtattaatctaactgtattctttgctgttagtgtcttcaaggatttatgcatacaccaagtccagttagcagcttggcataatgagatagagcctagtgttctaggacaacctcccgaaaaactgcatcaatagacagtattcatctcttttccagctaaaagagaaactccagtttttgttttgttttgttttttcctgtttgctctgtgttatgcctgttggtagcactatggcaactgccagcataaactgtcatctaggatcacagtgaacctggcagttaaagagtactctaggttctgttagctcttcagactgaagaatattatcactgaactacaagatgcattagaagagtagtagaatcaatagaagatgtgtctcctaaagaagttgggacattgggtaggtggtcacactctttccttaagggagaagctttgtttttttcatctgttggccccagtactctctgaggggaatgcttgagacgactatccttaactactgtctctagtctcactgatcacaaagtagctacagtgcccgttcccaccagcactgtaatataaagctaagctgttctttaaaacagctccctggaaaaggtgcagtgttagatacatgctcccattttgtcttcttggggagaaattataaactgggaacttttctatcaaatatataatatagtgcaataggtaatgattatgagaggatgtttcagattctctgccagctttgaggtagccattctcatagccacttcctcatagccatttcgtccaggagtggctcaattatttatggctttttttctttacgtttgtttgtttgtttgtttggtgtgttgtataagtgtgtgtgcatttacatgtgcacctattgcaggcagggaggtcaggaggactcatggagttgttcattccttctgtcatgcagttggctgggattaagctcccattctcagacttggtggcaagagcccctgcccattgagccatcttgttattccttcctggatttcttgtgaagaagtttgttgctattttgctgttgaattggggtgaagatgaggatgagaaagttaagggctccctattctgttgtcttcttgatactattctgtatattgatctctagtgggtggatagtagaagtgttttcaatattactagcatattcagtagtattgtccaaggggtattgaggaagcaacttgattttgtattttatgccttgattgaggaataagtaatatacaataaaatattttcaaatgcacatagaatttcattacatttaacaattcctatgaaactattattgtaattcaggtatctatgagattccaaagttttcttctgcccttgtataatctggaatttttgatatatttttctcctttctaacagtgcaatcaaacctagagccctgagcaccctgagcatgctactgtacagctgaacattcttgattccctccatttgattctagaagttctataatttcagttctttagcttaagtttgggggctgtaacttttgtatgttgctttgctttgctttgtttttgaacgttggggactgagtatatgggactcacacatgctaggtgagtaccctaccactgagctgaatccctgcctcctagatttctgacacagggcctcactactttgcccaggcaggtctctcaatttaactgtctggcctcctcactattgaaattagaggttgtgtgtcattgtgtccagttgtgcgtgcctcacatctagtaattttagtagtatttgttcaagtgattaacttgtctccatttattttcattggtcctattcccaagcaaggttttttttttttttttttttttttttttttttttggcttttcaagacagggtttctctgtgtagccccggctgtcctggaactcactttgtagaccaggctggcctcgaactcagaaatcctcctgcctctgcctcccaaatgctgggattaaaggcgtgcgccaccacgcccggcccaagcaaggttttattttggaaatgttacatcttagtaacttacatgtttatctttatgttgataccattctatcattaaatcaagtactcttccaatgttgtctttaaaggtgattcgtttactctcagttgtttgattctccatataaacttaagaatcagtcttttgatctttattttaaaagattgttggtattatgattagggctgtgttttgtcagtagatcaagttgagagagtttccatcttaatgatcctgactctccatgtctaatgattgatagctttatatttgcttagatcctatgttgttagtcacagccatgcttcatagttttttcctactgggctcaggcatattttgttaaatttcttcctaaatatgttcatatttgatgctattatcagtgacctatatttaaattttcacttactgtttattcccactatgtagaaatatattcaactaatcttacttatttcacttattagtcctggtatcattttcatagattccttggagtattttttaacataaattgttcgtatcatgtccaaacaaagacagatttacttcctttctaatctatatctaaatggggtccatttagccatcagtgtatgatttgatggcacatagcatctcatttcatatcattttcatttcattttctgggaacacttagcatgatatttaagtatacaatatgatattgttatctgtaagtacaatgaaatctagaactgatttctagaaaacaccctgcttgtataactgatattttatgccagttgattagcaccttgctagcccctaaccttcctattcttcatttctgtgtgtttgactattttagtatctcacggaagtgaaatcactgtgactgatttattaatgtcttcaatgtttctccatgttgtcatgttgcagaattcctttttcaaaacttttttgatgaaaaaaaaaacaactcatgtatatgggtgttttgcctacatatctgtgcgatacttgcatacctggtgcctgtggaggccagaagagagtgttgggtcccctggaactgaagttaccaatggttgttagtcactacatgcatgctggaaactgaatgcaggtcctctagaagaacaaatatttttagtggcctaaccatccttcaatccccttgttatatttctgcttactcatttatttttgttgagagggggtacgtgccacagcaagtgtggaagtgcgaggacaatgtgccctgtccttctactatgtggacagtggattaaatgtaagtagtcaggcttctcagcgactgcctgtccccactgcaccatccttcttacaggacaaatactagttaatctcttgtatgtgtgtgtacatttaggtgtgtggtgacattttaaattctgcttacctgttcatggatgcttgtttatactgtttaacttgtcttagacatcaagttcctcagcagtagtatgaggatcatggtagtacaaatttatagttcttgtgatgattacatgagattgtacatacagtttttttctagaaaaggactcggcaggatgaatatatgcatctctctctctctctctctctctctctctatatatatatatatatatatatatatatatatatatcaattcttcattttatgagccttgttcttttaaaaaaagtcatccctgttttggtttctgccatcaaacaatttatctatattttaaaaagggaaatatattaatatagttaagcttttctctatcttagatttgatatattctctaagtttactaattcaataaaattgatatttattggattcattataaatttatcattgtaaacattttttgagcttattcagctcattgcgatcatccctggaatatagtaatcagaactacaatgagccaatgatgaaagacttgaggggagagagggaaaatagcatacatttcccctggtttttacaatttctgacttgtctagagcaataattgttttagttcaaatagcattcggtgcttttttttttctttaggagacagcgtaggatgacttccaaatctctttcctgtttagaactgatagcttggaacccatggagatcctgaccctatccaaacatagaatgttattacctcatatttgtgcccactgagccactgacactatagctagagtatttgggcaggctcttgtttgtctctcagcacataattgtaaggatctagggttatagaagagtccgactacccctcatccactgcactctcatctctgcttctcttagtaagcatcctcactagaaatatatgcatatttagaggattgtgtgccagtctttcccctgcccatacctgacctgcagtggagtccagatatgaattgtcttagtgtgtgttacttctgcattttatgtaggaatgagtaatttatagagcaaagagctttctttctttttcataggtgtggaatcttgggagtccagggtccacagggtccatctgctgatagctttcttgtggcagtggagagaatcatatatgctaggttctttatttttcctgtcattgttactactacaaagaaccagagaacaacaactgaaaaagaaaaaatgattgttgctttccagagttctgagcctgattttaggtagtaagtatgtcattttaagaaacaagaacagcaacaacaagaagcaaaacaagaacaacaaaaacctgtttactctgtgaaagtcagaggaggatgaaagggaggatgcagggagggagacacagagcaacaggaatcctggacactagttacctactttcttgagctaggccccatctcctaatttttttagaatgtccctaaataccaccaccagcacctatagggtcagtccttgaacagtgagcctgtgtgggggtggagggtagagggtggcggggagagggggtatttcagattcaaatcatgagggataatgttaaaaatggaagcttaggcctcctcttcagaaagccactaatctcaccataggggacccctagggtcatgacctcttctaactaaagtacctcctagaagcctcatcttcaaatgccatgagatattaattggggggctaaattcccgacatatgaattgggagagggcatttaaaccatagcatgtatagaacaaaaagtatgtatttttgctatgcaaaatgaaaataaacagcttatagcaggtcatacttctgcgttaggcttgctattattttactgcaacttggaagatgtgtaatgaaagtaattttgcagcttaatgtggtgataaatttaaatatcagctgccaccagaaaaaagaaaggaatttaccaatgaatctcaaaatagcttggtagatggaggtagggcagagataagggagaggcttgtgtccatgtatgagttccatgtgagaatttaggatgagaggacaagaaacaccctagtggcattgcttttaaattgtcccagtgttcctgtacacacagggccctaaatgtctcctaactgattttctcccaagctgcatgtgcatttggtaaatattctaggacactggtcacacgtgaaaattacatttctgagcttccttttggcgttggttggcagattgactatttggggcagttgttcagttcttctcagatgtagaattgaaatacaaaggatgcatggtctctgacctcagggaatcttagcatgcatcacctggtcaagtttttaattcatagaagacagggaagacgtcatatactgcactcattacttgaatcctaatctgaaccattaccaaccccacacactgtggcttctattaagaacagagatttgccctaactggtggtgattggcaatggttgctgggtgactctgctaaaacaggaaggaagaaccaaagatagcaaagtcccgtagttgagggttggaggcacattgtacgagactctcctccttcctgtgtgttccagactcactggttccatcacagaaatatctgtatctatttcctgaccaggggcagtctagatagctggggatccaaagtttccattaaccctctctggtctggagtacttaaggagaaaatcccaagtgcccaattgattactattactttgctttatacaatacctgtgatactattttgattatctctattagtctgtttatgagttcttataaaactaaatcttgagttacaaaacctaagcattccaaataattgaaagtcattagctttcatctgattctatattgtctataaaccaactattctcttctctattactgataaaaacccattgctttgaaatgttgacaacatggaatttgaagcccttcacatttgaattaaagtgtactgtattttaccttctgtaaaaataagggtggactttggtaaagaagttgctgagaatgttgatatcctagtgaacaaacaccggacaaatcctgggtgtggtggcttgcatctgtaatctcagtatttggaaggctggcacagcaagactgttaagaatttgaggttgtcctgggatatatagtgaattccaagccaacccaggaaatagtgtgaggtagtcttaatacacccccacccctgatataacaaagattactatacatctttctgagggactgtgagaattcagtgagaccttctgtatgttaacttttagtacacagtgtatcataaacacagttctgacatgatcattaatggcctacattttgaaatatggttgccagattgttgaaataatttcctatctcttcatatatttaacttgcaacagctttttgaggtggatataaataatacctccacttcacagatgaaaaacgtaaggtacatactgattaatgtacatgcctaaggtcacacagttggaaagggttagaaaatgacgtttgatctcaggctggaaacttccaggttccttagtctaatgactatgttgaaattaaatcagtttatgccatcttagttatttttatgatttgattcttcagctgagacagaagaagaaagtatgttatgtgttacatttagtcacaacaagatcacgattattccagaatgccacacatacaaggaaagggtcaagttgggattattttggacacaagcaaggtgtatcttttagacattgtcttggtgcttagatagtgacagaagttctatatttattgggagacaaattttaaacagtaatatgaacttccataattttctgatgtcctcagtcacagataacctctatttctgctcttttggttccagtggatgcacaaactagtaacctagtttccttggacttcttcctcatcctctatttagcttcagcctacctgttcacttcttcttccagttgcgtgtcagggctcagatgtttctaagaagatggctttctgatcaatggggctaaggctagtttttttttttttggtttttcgagacagggtttctctgtatagccttggctgtcctggagttcactttgtagaccaggctggcctcgaactcagaaatccgcctgcctctgcctcacgagtgctgggattaaaggcgagcgccaccacgcccggctataaggctacttttaaatatggtctttgaaattattcttagttgcttaacagtcagtgccttcttcattggtagcatttggaatagaacaagagaaagatcctttgaatgatctaatagacagacatccatgagcgccataagaacaacttagaaaaattgaatctgccagttgattccttcatgaaccaactttaggaccctctagatcattgcttccaaaactttgctgtgcatttagcccacctaggggagggatattcaaatgtagaccttgataaagtctagatggaaccatgtagcctaacacatttctaggtgaagttagtggtactggttcagagatgattctttgagtataaatggcacatgccatggatgatgtcctatatagtacaatactttctggttaagaaattaacatattgaaagtttttgatttgattatatatagtccagaattattgctggacaacatcatagaaaaatcagttagaaattgggatgctgggaattcagaatcctctgtgggagtctgtgtaacacattagtatgaccagaaaggtggttcttagtgcagggtggagggtgagcataggcagcaaaaacaaaaggagatctggttccaagactgctttgggatctgggcaatgagagggtcatgacctggagtgtgactgtgtcagtagaaatgggcaataaggcctgggtggaagataggtcagttacgaaaaacctccaaataatgcagcactttcatgtcccgcaatagtcctgaggtgaagggcactctagtggctgagggcactttccctgtgcaccattttgtttcatcagcacagcaaatctgggagattggtggtcactttcacccacccctgctttacaaatgtcaattgccgaggaaagcccagcctaactgcaattgacaaggcatgggataagatggtaaaactgttcattttgatctttgtaattttcctcattaacatagtaaaatatttgacacaaaaggtgacttacatttgagattatacttcgcaggcatattatctttaatatggcttaaggaggctatatatttatccttccctccagttatcctctttatgggaggtggcgctgcacacctttaatcccagtcattgggaagtacaggcaggccaatctcttgagtttaacatcagcctggtctacagagtgagttccaggacagccagggctacacagagaaaccctgtttcaaaaaacaaaacaaaacaaacaacaaaaacaaaaaccagaccaccaaataacctgcccccccaaaagcaattcttcttgctattcttttaaaacttttaaatagcccatcatgtagatgcatcatactttaatttactaattccatgaaatcagtcatttatgtttccttattttttgttttgatatcagaataaaaatgtggagaacatctttaagtatatatcctacccaagcattgaataatttatctgaagccttagcaagtcttttcaaagtctttttactcatttacaatggactgatttaatgcttcagtaaaggatcagatcagctaaggacttaaggaggggtacccaagcatctcttgcctggattagcaaatgatctctcagtggggctcctagttcagactgtcacctcttggaacattcatctgcattgatctcaccttgactactaaataaaagatgtgactgtccattgggctctcaatcagggtagaggtacaatgcaagaaaaaaagaaaaaagaaaaagcccaggtactgcatgtgaaaggtttattggttctttggggaaagagaccagaaacatggggaaattaaggaaaaagttgaaccaaaaccctggctggtctgtggggggaaaatggatatattgctgatataatgaaggatgttattgtgtcttttttgctaatcaatcttttctgtggttatttgtatctggaggtagagagggtagagagagttcaagtaattaatttctcatgggaccttgggattcatattcatctgttaattgaagataatagtgtggatgccaacaagtgcttgctgacaggagccttatatagctggctcctgagaggctctgcccctgacatgtacagagaagaaggatgcttgcagccatccattggacagagcacagggtccccaatggaggagctagagaaagtacccaaggagctgaaggggtttgcagccccataggaggaacaacaataaatatgagccagccagtgtctccagagctcccagggactaaaccaccaaccaaagagtacacacgtagagactcatggctccaactgtatatgtatgtagcagaggatggccttgtcagtcatcaatgggaggagaggcccttgatcttgtgaaggctctatgccctagtgtaggggaatgtcaggacagggaagtgggagtgggtggattggtaagcagggggagaggggatggaatggggggttggagtggaaatgatgaagggataaaatttgaaatgtaaataaagcaaatatctaataaataaaaattaaaaaaaagaaaaaatagtatggattatatggagacattctgatttgcacaattgattcaagacactaagtacttggtgctatatgtaacatagtcatgttcagtaagaactacatagcaatgttatgaatatcatatacttgaataaaaggctaagttttatatatatatataattatatatagctatattatacatacaatatttatattatgttatggtaaatataaatgatactataatcatatactattcaatgaatttatagaaatatatataatatagagtgatatttataaatgtataatgttaggtgatggcccaggacttgaaggggtcatgcaaaggagttgaggtttggcactataaagagagcctgtgagaggatattggtgaagcctagttacagaagaagacagcagtgttttggagatgccagcaccatgagatgaccaccaagaacagcagcagcagtggagtacaggcatctggagcctagaggatgaggtgtgtgctacaaagggcagagctggagaagtgacccaagcccttggaggaatctggaagatcgtgaatggatcccagacattggacggttggagtgtgattttgcttttgactgtgccctgatgtttttccctcttgaaggaagtattttagtggagcccacagtcaagagacttttcattgtaaaaagactttagattttaaaagagattggaattttaaagggattgacattttaagaattttcaaagagtgtgggacctttaaagttatttagatctttaaagtgaataaaatttgaaatgtaaagaaaatatctaataaaaaataaaaatttaataaaataaaaaatagtatggattatatggagacattctgatttgcacaattgatcccagccactaagtacttagtgctatatgtaacatatagtcatgttcagtaagaattacatagtaatgttatgaataccattatatatttgaataaaaggttaagttatatatatataattatatatagttatattataacatataatatttacattatgataaatataaatgatactataatcatatgctattcaataaatttatagaaatatatacaatatagagtgatatttatagatgtataatgttatataagatttgtgttatagtatatattctatacatttagttatatgtttatatacacatataaacttaccttttatttaaatacataatagtcacacttacatatataatatgggaaagatacatttagtctaaaataggtagaaacataataaagtataaaaattcaattctgcgctggctctactattagaaagatttgtttctctggcactgatctgttctgctctcctctcccttccatatccagtgttcagggtctgctacctatagtactcatactattgagggtctgcttcctatagtactcatactattgagggtctgcttcctatagtactcatactattgagcagtgcaagtgaaagatgacaagctctgaagccacagcacctgggctcaggggcacacccttgaaacaccttcctgtgtctctgtctcctttctcatcaaatagcttttacacttaggtttcaaaattattggatggacagtcagggaaaataattcagtctccgtttctatttggcccatgattgaggataatgtgacttgcctttcttctctgactggcatttctgttccttttcctctaccacaccctgcagtgcttcccctacctgagcaagggaccaggcttctcctatctcatactccaagacccggttcttagtagttcttttgccttcttatccaagccagctgttgctctcttagtaagtaagcaaaaacatgcagaattttcctctccagacattctagttttcctacttttctttcaccttgtctccagagcttggcatctctttttgtttgctagcctctaaaactgccccctacctctttggtaagctggagtaggacttggagactttttgtgacaaagctcaatatttctctgagctttggagttcttgttccgccactgttcctatttactggttaccactctctgaaatacctcttcttttttgtttaaactcacacttattcttctctgttgactatcagttttttgtttgtttctggggataggacctagggcttcatgtatactaggcatgaactatattgctgaactatatgcctagaacattagctcaaggaaacccatggaagtagaggcagagagaatgtaagagccagagggggtggaggataccaggagaacaaggctggctaaatcaacatgaacaaagcacatatgaacccagagactgaggcagcaagtacagagtctacatgagtctgtacaacgtcctctatgcttatattatggcttccactttagtatttttatgggattcctgagtgtgtgaatgagtgtgtctctgatttttgtgccttctgttgtcttgtccaacttcaatgtgaagtgtttgtttgtttcatcttattatattttgttgttttatggagaatgaatggatggatggatgaacaaataagtgcatgaataccacgacactgtggtaaaggctatcagctaaactgtcatttatacctgctcagagagtgaaaaatctgttttctccagtggaatgacactgggtatatcaaccactttaggacaggcctcatgtttaggaatagttgagcaacgtgtaacagactccaaagttgtttgtgtgtttttacttggttgtagtttagaattttttgttttctttttgggtgttcttttatttatttatttatttattttttgatttgggggaatttattattgtatttttttgtaatttgagaaaggagttaaagttgggtgggtagggatggggagaggatctggaaggacttgggggagggaaccagtatgatcaaaatatatatgaagttgaaaactgttttaaataataaaaaatagacgaaaaaaattaaatccttttgaattaaaaatcttccaaatttgtttggaaatctttttggccacctggtaggtctggaattggttataaatatggaagaatctggacaggcaaatggttgtctgacttttcctgggaagacatcaacatatgtcaattcaacccagatagggtaccagtgacagactgaaggagttactctacccaagtatagcttagtgaactgatgagtgagtttatcagggtcccttttaggagcatggaggagtcaaaggcagctgcagcatgggaaagcccacatgagcatgggtaccaactcacaaaaaacacaatttgtgtgcttcctacaagattggcccacatagcttggcctgtgggagactcacctttcccctacaattattactgcttttataacactggcaaaggagccttgagaatcttttaagagttttgagcttcctgggacttttagatttcatttcctgagccttaaagaagtctcccctcaggaaagagtgttccaagtaggaaataccaacccaacagccccaggccttgggggaagtacttccacaacctaccttgggttgtggggagtggacattactctacatggcctctggtgttttttgttatgcaaagttctattctcaagtcctaagatggccttttctgagattcaggtgaaattcatcacctttcagacatgtcaacaagaacactgttagttgacaacattctgagactgtaaggaggtcgaaatgtttgctcttgtgtaaagtgtagttagcaacagggacccagacctctagcaccacatatcttctctaagaatgtagttttaaaattttgagactgggcatccaaggagacagctgaacttcatgtggacactgtgcactttaaaggcctccatcaggccaaaagacattctcttctaaactttgccttcttgcctttttgtttggaggagcttaatttcctcatgcttagctttgataatgtcacttttaggttaactccttttccttagactatccttcaagctcattacctatgactcattgtaacctgtctattgctttagctaaaatataattatttaccagagtggaagtgtctttcactgaagcagtagggtcctcagttctctgaactgttacctggaaaatgggtacctccctgatagggagggctattttaaatctcaagacaatgtgtatcatttattagacatgtgctatattatcaatatctgataatatcttaagttagttactgaaattagcatgtaaagcaacatttattaaatttttttaaatttgtgagtggcttaaggaaaggccaaaaggaagaatgtatgcaggtacttaagtaatggaacatttttacctttaagatcaacttcccagtgggaaataggggatctggggaattctaaagactttgaccattagatttgctgttttggttccatattaatccttacctttaacagatttatagttgtacaaattgtattatatataaagcacttacctggtgtcttgtcacagccttagtggctgtgacattaactaccttttttttttttttgtattcagagtactaacagtagtagtaacagtggtactttaagatatggaacagtacctaacataggacacacacacacacacacggcagattattatttaccagacattgtgcattttggtgtgtgtgtgtttgtgtgtgtgtgtgtgtgtgtgtgtgtgtgtgtgtgtgtgtgtgtagcttgtaaagtttaagaaggaagaatttggccatgtattttcaatcaccatgtttcttgcagtgtgccagtgagcctttggtcagcagacacattttattgcagattttgctctcaggtcagtgttacaggagagaaggcctgttgtactacaccgctggagacgagattccatagtgtatggaatctatactacaccgctggagacgagactccatagtgtatggaggcagggaggtggccttactcacctttgtgtttctgcatttcctggcacatgatgggtatgggtacttagtgagagaatggatggctagaagaagaaaagagctcaataaaaccgggagaaaccttacatacctaacagtgttgtaatgcgatcaatttaaaattaattaaaataatagtacttaatacttaaaataataataattaataattacttagtaagtattggtttcgcttgtgcctgtatatctctgcttcttttcaaaatgaatatagttttatttttgagagaagtaatgtttgttgttctgatataaactgagataattcatgaaaatttaaaggaagttggccacacccctattccttacaatcatatttagtagtatgtatctattacatactttactcctacatgcatacatatatgttataaaataacaagataatatgaagtacattgttttatagttcatgatgtttcacttaacagtgtatttcagaataactttctggctaattctatgcaatcatttcaaggaattcacagtagtgtcacattataaatgctataattggcatttaacataatctaatgtttggttactataaacagtgcttaaattaccatttgtatacatacatattcatatacttactgggttgtcttactagaaaaaagtcgaaggcttaattgcttcaattctaatgaaatgcatgcttttggcaccaacctgccaaaatgaagaaacacttgttaaagagaaacagttgatttccttctagttttacaactggtcttattagaaaatggttttccttcagctgttaccatgggtatttgatgttctgtcttcttgccttgattacaagcggtttgtgactctgaccaaaataaagccatgggctttctaatgttaattcatggatggctgagcagtgagaaacaattgcttttaaatatggctgcttccatgcaaatgttcaaacttgttttcaagcaacatcaaattctagggaaactgaagtatcgggtctctagagctccttataggcctgagttgtgctaagctgtaagtggccactgctaaattgtagggtcagaaacgacaagttaaacctgtatgactggccactttctttctgtgtgtactagtgggaacagtgttgcagaatttgatttatttgtgtgtgtgcgtgtgtgtgtgtgtgtgtgtgtgtgtgtgtgtgtgtgtgtgtgtgtatgttttattctgaggtagggtctcaggtagcccagctgagccttaaactcactgtatagctgaggacagtcttgacttcttgatcctaatcctcctgcttccatatcccaagtactgggattacaggctttcacacccctcccagctgagaaaggcattttttttattagatattttcttcacttacatttcaaatgctatcctgaaagtcccccataccctccccccaccctgctccccttcccacccactcccacctcctggccctggcttccccctgtactggggcatataatctttgcaagaccaagggcctctcttcccattgatggccaactaggccatcttctgctacatatgcaactagagacacacattttaagggaagcttgtgggttagtgtcccatttaagaattccttggccacatcttcagtaaagattctcacatttctagggaacctgacaatctttaagtctctggccagcctacagagatttcactccactactcactcttctagcttctgtgtgtttttttttttttcagccaaagtgcctcttgactttaactttctgtaagaatggctgaggaagggaagtggatgctgaggagtcttgaatctggatctcctcatctaaccggctgcattctctctgacttcaaaggctgggcattggtccaggaatgatgctcttggcctctgctggaaggtggggccaggtgtgggaatgcaaacagactgtggggcctatatgaggcaaataggcagaatatgtgaccacagagggctgcagatgcctgtgtgcttggcaaggctccaccttacaaagggtactcctggcaggaatgttttctctgatttctgtcagggagtaggagtgtttaaatgtctaagcctaaattgggtgatgttctccataagcaataataagcatggaagtaatttactctgggacctcgactgtattactgtcaaatcaccagtggcattctatactgatggagcctgttgatctttaaacagtttcctgagttctctctgaatccattttctgccgtcctagcagattacctgtcactggccaatagctacgtgcatgctgtctgccttttgctctgtggagatttcagacttatttttttctcctctttactcaattctccagctcactggcctgtgaaatttcaccaggcttctgcagtgtgcttaccttctcttctgtttgtaagtaaactaacatgcataccttttcatgtgtgtgcgtgcatatctaggtacacattctcggcttcctggggctatctggaagtctttggctacagtctatgggtatgcatgtgtaaaggcatgtattttgtgtgtgctttgtcaggaagtttgattggagcgcagtggggcagaccttggggcagggaggtaccatgctggaggacagtaattaagcttctgtttacataggcagggtcccataaagctttaattgaattgtgagttccaagagcaggaagctcatcttccattggtagaaggaaaaaaaaaaaggggggattgtcttcatcacccccttcttctctctcaaagtgtgaggggtatactcagaaaagtaattcagtgtccagattctaaaaggacttcctagttaggaaatgttggagtttgaagtgtgcaaatgaacgcaagtaaagcaaagacaaaaactttaaaattttatggtaattaatttttaaagttatgataacttcatttccccacttcccttacctccctccaacctctctcgtgcactgcttttctctctctctttctctctttcaaattcatggtcttttaaaaatggttactctacacacatacacacacacacacacacacacacacacacacagaaaaaaacaaatacatccttaaatgaataagtatgaccttctcattttgtttaatgttacatatatgtatataatttcaggactgatctcctgacactggacaactgattcttagtctctaagccctttgaaagaactttcttctcgagatttccatcctagatccatagagcccagagacacaatgactgtcgagggggacattaaagcaggggagcagcagccaggcttgttgagtttgttgatggccctgcaaagtcccaagtaacaccccaggaaggaaggcttcggaggggaggttttgtgttcagaactgccctccccactcatgaacaagtgaatgattgtgccataattagtttctgacccgaggccatgccagctgtagccctgccagtctgcgagctgccaccaggacagatatgcctcataaaagcccaagcaacaaggctagattctgtgggcccgcaaagccagatgactcaggcctatgaactgtgagtgactgagctagtgtgttaacatttcctgaactggccttttctattttcattttatgcaaaagtaacctttatagttattacaattgttaatccttgctttgacttaattgaagggagttttcctcctttctttcatcatttcccaggaccactgttcttctgttttctcctctcctctcctctcctctcctctcctctcctctcctctcctctcctctcctctcctctcctctcctctcctctcctctcctctcctctcctctcctctcctctcctctcccctcccctcccctcccctcccctcccctcccctcccctcccctcccctcccctcccctcccctcccctcccctcccctcccctcccctcctcttcttttcttctttcttcccctcccatctctatcctccccctccatctgtcccatagttttcttttcctgcactcttctctttccctcttctccctcctttttcctttgttttgggagaacagactagggttcatctggcccattgtgtgacaataattgaaagcattcccttccgatctgctcaggaaatggctgaaccaacatcctcaggtctcactcccctgccctgttgctggtatgcttgctgtccaaatattctcttccactttttggagagttcaagaaacctaactttgtaataagaaatctatcaacctgccaacctaattcatacaaatgtttaccagactgttggtgccagacctcagcagatttggattctggaaagggtttggctgctaaggatctgtgagctctttcctttcctgcccatcaacctgcactgcatgtttatttcagatgctcagcacatgggaatcactgcacagttaaagttgagttaatagtgcagaaactgttgctgatcaaagcactaagcagttcatgctcataggtagaggggaaaagctcgggattaatgaacagtactgtgctatagaataaataaatgcattcacagaatgaccaaattaaagcatcactcttattctgccctttcttttaaagctcgtaagattcttgtttccaacagcaaatagcagtttcaacacccagccctgtctagggagcagatcccaggaagagaatctgtggttgtttttattttttttttaatctccttgccaccaaggccaagtttttcacagtttaaatttcttccaaatgtttgatttttgctggttgtagtattcaaaatgaatatagcattcttttacattcccaccaagaatgaatggtcttctatttgtttcccattgcctttcatgtgtacattgactttaatgtgtacaatggcttttgttttgttttgttttgttttgttttgttttgtttgtttgttttactggtgtccactcttttacaaaaatagctctaaggtgattatgggagagtctatgttctgctttgatttcagtcttgaagcaactctaattaaactaagagtttgttttataaatataagattgagattgggtccccaaagagaatcggtaagatggtgtgatgtgatatatttgtgaaagttaagtgcattattttgacacaataatgagttttaataaataaaccagacatccatttaaatatattttagtttgtaacagacaaatgagcatgaatataataaattaatttattgtggtctgttcctaggcttctctttattcctaacatggccacatcttttcttaatattactaatttatagaggctaatgctgtctttcctgactagaggtgttttcatatgaaaatatttgtattatgaactagaagaatttattaaaatgcttcatgttcatgaaaagcaaacacttttgctaagagcctacaattcaagcaaaccattttcagtaattcctcacttatcttgaagcttctaacacagtttggaccacagtaatagtttttttaaaatgctgtggcattgggaaatagctgccacaacacctctcctacaggaggagtgagaattgtgtcctgactgttgagaaatctactggtccgtccgtacgtccgtacgtccttcctccctccctccctcccttctttccttccttttttccttttttccttccttcctttctttctttcttccttccttccttccttccttccttccttccttccttccttccttccttccttccttccttccttccttccttccctccctccctccctccctccctccctccctccctcctacctccttccttcttttatttcatttttctctctctgtctccctccctcttatctatcccatttcctcattccctaaccttctttccagtctttgagtttttgaaataaggcttgtctctgttgccaagactggctttgaactcctgggcttacgctatcctcccatttcagactccctggtagctgggactgtaggtatgtgccattgaccctcattttcctgggagtctgttactttttcagttatagcagaatcaaatcagggaattagaactaggggtagcaggttgggtaggtttgggaaggtagtatattctagaaataggcacagtcaaagctgagtatggacatctcgtatgaatagaccacaaaagtgaagacagacaatgtagacaaggctaaaattccttgctaaaattcaagactgtgatatttaataagccggccaggttttgctaaggcattttactattactgggcattttaagttatttaaaattttttacacatataaaccatagtattgtgaacagttgccataaaaattgtatttcttttgttgaaggttactgctttctgcaatttcttatgagaaatgtattaagtcagctgaaaggcagaggtgctttcctcttgctggtagatgttgccagactgtatttccaaatgctgtactgtataagagtgtcagcttgcacagaaccccggcaccctgagctaacgttatcattttaacgtctttgctagtttgataggttagtaagtatactgtccatttgttcctttttaaatttatttaacaaggctttgtattttaaatgtcacaatttactgtctctttgttctgacattttctttcatcacttttcaaggaagtctggacattgatcttgtatatttttatctattccttatattttgggcagccagttttatcatttatatctgtagcacatttttccaattttattgttttcatttttctgtgtgctttatcatctttcatatggagaagtgttctcttttacatttatgtattcaaatacatccatcctgcctgtgaggcttctttcatttttcaatattcaaaaatttaccactccaccacagatgggacaaatatgtgattctgtcttccctattcccccagggtgtttttttttcttttttgtgtttaattcctgggcccatctggaatttatttaagtatatggtatgaggtatggatctaaagtaaaatctccatactaatatccaaatgttctagcaattcaatttggcaaatgctgcttgaactccttctgtgtgcttagcattgtaccacaacagtttttttctccttaaatgaagcaaagtctatgctctccatgcctgtgactgtctctgtttcctgtatctgtctctctgtctctcattctctccctccctccttccctattctctctatgccattctctctcttccatctttctcccaagagaagcacagtaaatatatataatgtatatatttatgtaactataataaactacaaagaaacacttgacaggttaggaacaggaagtggatagaatgcttgcttagtatgcatgaagctgtagatttgattcctgctacacctcctaccacatgcacatgtacacacatgcacagtacacaaatgcacacacatgtacacacacatacaaatgttagcatccagaagctgtgggaatataataaactgtgttattctacccaaatgagacaagtaaaagattcacggtagacatgacatttataaagtattctggggtatcaagatttcattcattcagagagaaaaaaaacaagcaatgaattttctactgggacttttactgggaaatcaagataactatgcacaaaacacagtccctgttctaaaggacctttcagattagccagacagagtgattatggtaaggaaacactctcacatcctaagtgaaatcatgctttcaaaggcagggtatgaatttgaataggcatttcttcaaagagcatacgctaatatccagtaagcacatgaatagctcagtaacattagtcattaaggaagtggagtctgagccactataacatttttcacatatttaaaattattataacaaaaaaaccctacagctgggtattgttgataatggtagagtattagaattcaaatgcactcatacattgttggtggacatacgaaatggtatgtttccttggaagagagttggcagctcttcagaatgttaaacacaaagatacagtgctgtggtttgactctgaaatctctctctccaagtcttgaatctttgcttctgggctggtgattctatttcgtaaggtagaggaaacttttgaaggtctgaccgaaatagagaaagttgatcattggaaacagcccttgaaggtttatacccagatctcaacttctttctctcggcctgcttattgtttgccgccatggaagtatcttctgctgcatgctccagtctctatggcgtttttgtttcccattggcctagaatgaatgacaccagagattgtgtcctgtaaccttcagaactgaaagccacaatgaatgtttcccgcctgcaatttggtatggcaggtattttatcaaaacaaacaaacaaacaaacaaacaaacaaaaaaccaaaaatacttaacacagaaatttggtatgaggagtggagttctttctaacctgtgaaagaaatttggcaatgtttggaggaatagactaggggaagacttctatgctcaaagtagagcttaatgagtattctagtgggagcgcagacgatcggagtgctaataagagtgttggcaataaggactgtgctactgtggtttcaaatgggaactataacacaattaggagctggggtaaaagcctcatgttttactctggcacagtaatttgtccacattttgtccttgtcttgagactttgtgtgagactcaattagggaaagatttgaaatacagagtttggacagaaagggaagtggtttaaaattgctaataaggccgtggtgatggagattaggtcagttaaagagaagccaattcttttgcattccgacaatagaaagtatgctcctatgttgttccaagaattattaagactctactttccatcctataccaaataatgcaagcgtgttaattaatttgaaagacttctttgagaaaagggttcctggattccctgattatgcagcagagccacctacagaaattgtcaaccatggtcagtcatgcaagcactcaggtgtcactccaaccattttccaagaccttgttgtttttgtcagtgtcttccatgtatccctccctaccctgctgtggagcctggcctttgaattctgagttccacttttccttctccctatcttgaatgtgttttcctttggagacctttactggtgctgtaatgtaatggaccttctccctctcttcaaaatctgcttctgctgatgctcattttatgcctaaatccagcctttatttctcaaaattctgcttttgtttctttgatgaagtagcaaatagtttttcctgagctcatttatacatctaacagatgtataaaacacatactgtggatttgcctatagtggtacttatgtcttatgatactgagctttatatatgtggaacagtaagacttataatgtgcaacaaaacctctgaggaaatttcgagtagctatatttcatagttgtgtaagctcagcttctaggaaggcctttatttagaaatgatgcatgtataatgcccttttctttgtctttgagttgtccatatgtcttgaggtttcagccaatgctgtgctggtaaatcagctgtccagaaacacaagttaaacattattgcacttatgatttctatagtgcctccagactctaggatttcaggtgtgatccatgatacctgtttttgcttgtttgttttttgtttcttttttcctgtagtactgggaattgaacccaggttttcatgcatgcatgccaggcaaaatctttgccaactttaaattatataattttgggagagaaatattagttcttaaatgctaactctacctaccatttgtgccttttatgtgctcctttccatgaccctaaaatggaaatatatatcttatataatggacacactcacacatccatgatcctaaaatggaaatatgtatcttatataatggacacactcacacacacacacacacacacacacacacacacacacacacacacttatttagcgtggagaactcatggaggttgtcctgtactacatagtatgtagaaacactggaaaccaagactacagttttctgcaactataaatcgcatatgtagtccattctactgccttactttctgtgttgcgatttgtttattgattcaggaaatatttattaagtctttgaaactttcattttcactattttaaactgtgtgcatgtgtgtgtgtttgcatacagacttgtgagtgcaggtgcctgcataggtcagagataagtgcttctggagctggagttagaagcagtcgtgatccgcccagtgtgagtgctgagaaccaaacttggatcctctgcaatagcagtatgtgctcttaaccactgagccatctctccatcccaattaaatcttggatgttggaaacttggatattctgaaagaaaaggggactctcacactcagaaaatatcaagtaaaaacacattttcttattccttttattctcattccttataactacaatgcctggtaatctggaattaccaggatgtgtttaatagcttcacctactaccactgctcaatacaaggtctctggaatgggagtatcttatttagtaccggaagataaatgatgtcctaagcaagtgtctgatgaattccaccatctgttctaagtccgctgagccacagatacatggatatgtttgggttcttctagtgtcaggattagttgaataacaataaatctacaagctgtaatactttaatcttaattactgagatgaacactcagttcacacattatactttatacattgtgtgtgtgtatgtgtgtgtgtttgtgtgtaggttagagtagctaccaaagggttaaaagaggacacaaatactggatccctactatcttcaactcccaaagttttaattttgtccttgaatacttaagatgttttcaataaaatgcttattgtacatgaggtgagtaagggtcatatagacacagcctttaaaaaatattctttaagaactgtgaattctagatgcttccaatggggtaaaggcaggccacaaaggcctaggaccctgggtcaagatgcaagacaaagtccagatggagagaagcatgggtgaacagcaattcaagtgctccacgtttaatactggagactatgttgagctgaagccaggggacatctaaaagttctctactagacattccattggcctacacactaggtgttcagataacagcgataacagttcatatggcgttccagagcacctcttgggggcagggattttcaggttcttgtgtgtctgaacaaggactgtagcagagacacaggggtggaacagagcagacactgtgttaggaaaagatgtactttccatgtaacatgtagggaagagcaaaaggagattagtgactcagttggcacagtcctacaaagagttggggacttcccctagtgagatactttaagcccatttacatagtatggaattttggcttatttcaacagtgtgggctctccactcttgttcagttatgtatagttctacatacaccttctgtgttgtatgtatcagcatctagcatctgcatgcaggactgtgggctgtggtactttaatgggctagaggttatctttggacaatcaggagtgcctgtgcaccagcaccagtgctgctggctagtttccactgggctgaattgttagtatgcagcctttctcattgctaccttagtattttcatgtcctaattctgtaacgttatgaacaaggtcttttctatttctctattcctttctgtaacatcaattctgcaatgagagctggagcccagacgccttttgggcgagctgaatgatgatccatcatgtataacttctatcctgtagtgggctatactccctacctgagaggaaccataaactcttatgtattctgcatatcaattggagaggagctggaatccttgtagcacaagaagctttgtctgggactgctacatcctgttagcctcaactcagcatttctctttgattatgaggcatgctccaccttgaactgctgttttcatatctgaggacatcaggtcttgtcctgcatctgtcctcataagtttaacattctgagtttaggagtaagatctcttgtgctgtaaaacaagcaaacataaacaaacaaacaagctgatgcttatatagagagaatgtgacaaaatagaaaagaatatttctaagaagaaacaaagtggtagaatagacttaaaaaaggataataataagctttaatacagtattgtataatatattagatacaatatcatgctaacatgttaaaaggaaaataaggaaaaaatctaaaactttaagattacaggtactgatatacctataaataaggtatattatctccatatttcaacaagttaagatgcccttttctcttatttgaagagaatttttaagccttaatagaacacagttgtaagattccttgccttcaagatgctcaagactgtgaagaaggcattttggtgtagagaacaaagtcctttctctactgcaggtgaggcaagccttcatctaccccaaacaagtgtcatcagtatcagaagataatgtttatatccttgacagggaaacatttgattatactctaatcattgatcttttacttgaaaaggttaatgaaaggcagtggcttagtgcctcctcgtacatagttataaaaacaacagtctggcctttaccaattttttgtagtgtatactttatagaccctttaccccaaaggcacagctgactaaaacagttaacatcttctttatcaggtaacatgagttacaaggccccttaataatttttctttgatccgcttggaccattagaatcctctatttccctcgaatccactagccatttttcttaagtttcatcttattaaaggcaattgcataacatctgtagcttctaagcctcctagttggatggctcagaatagctggaaaagtaaggtaccgggtataggaaaggcctttgatttttagctgagggttttcaatgttataccttattattagggcctgtaaaaggcagtttttagttctggggctagcaacaactcctttgagttttcaacatttcctacatttcttactacagtattcatttagtaagcgctcttgggttattgattaagccagagaatggaactctagtattaaaaagaaaaattaacaattttccgtgccatgtcaagagctctctgaggcagtttaaaggttgcctgtagttacttgagtggggcttttttactaagaaatctattgcagtttcagtctattaagagtagtcaccattcgagctgaatgcagtactttcttccctctagaaggtgagataccatctcttagagtaatcttcccctttttgcagagggggtgaagctggaggatttagaacatactgaggctatttcctttccagtacactgggttttcacagttgttgaaagcattgcccctgttagagtgctcttctgcaaagtagaagtttctttgaaagtaaagtttctttaaagtagtggggtgagggaattgcctggggaaatgtattgttttgcagagctaaagctaccaactagaattgctcttaggttcatgttaatttcctctgggccttttagactgtctctagtttatctctgttgttcataaccctcaaagccaaagtcaaaagttaatttggactctctgggggcccattgcctgctgttgcagtttccttctaatgcctgcaacatattgacagatgagataaagtatcctgggaggaaaaaagaaaaaaaacctttattatgtcaaattatgtacatataggtatataggtaccaacaccagcagcatcttctccttttcttcctcctgtttttccatctccttctccttcctcctcttctttttctcctgctctctctcttcttccgtttctttcttgtgctcaagagaaggcacaagaatctgagactcaaatgtttcctcttcaggagtcccatagaaaacactaaaattgaagccataatatatattcagaggacctggtgcagacccatgtaggtcctgtgaatgcggcttcagtctctgtgagttcatatgatctctgctcagctgattcagagggccttgttttcctggtatcttctatctcttctggaccccgccccccaacagaatagtttcattgattattttagaatttcacataatacatcccactcacatccacttccaagtcctcccaggcccacccccatcattgtgacctcctctcccccaaaagaagaaaaaggtaatataccaatttgtgttgcccatataatatactcactggaacacggtcaaactgccagtagccagtggtctgcttcaagatttcttgtttcagcagtaccatcgctaagactcataaatcttgctgttgcccagtcagagaattgttgtgactaggcagggcttcatgggtaggttccaggagagcccccaggctaccacatacctccctgccttccattccagccatcccaggctcatttggtgccatctgttgtgattgcagtctgtgggtagccagcaattgctgtgttccataccctccgacggtgagtctctagcttccccattctccgatgaggatgaggttctgctctgccatctctctttccattttagtgagtccattttttaaattttttatttatttaatattttcatgagtcccatttttaaaaaagcattctcccataaagccttctaaaaattgttccatagatactgtgggttctgcagacttgtctatggtctctcagcctctgccattttaaatccttccccattctgactcttaaatgctttctgccttctcttccaaggggttctctgagcgctgaagggagggatttgttgggggcatcctatttagagctgtgtgttccaaggacgctctctgcctataatgtatgactgtagatctctgtatccattcctgtctgctgccagaggaagcctctctgatgatggctgagccaaggcactgatctaggagtagagcagaatagcattaggagctcctttatttctacatttttcaaaatcttttttagaccagtattatttagttttatcctaggtcaatgagttttccagtctctggttcttggtcagtgtggaatacagagtggagtggactgtgagtcaaacaagatgttggttggttacttcctcaagatttgtgtcatgattgccctagcacatcttgcagacaggacatcattgtggatcaaacggtttgtggctgtcttggtgtttctcttctggtagcatgcagagtaccttcttgtatcaaagatggtaggaggtagtggctctatgtaggcagcagcttgacttcttcatattcagtgttttgtgtaggtattgtcttcagcaatggagccttggtgtcagtttgtagtaagcacctatttcatccaaccacaaaagaatacaccttcttctctgcacctcatagacctttgcccagaactgaccacatgttctgacacaaagcaagtctcaccagataaaagggaattgagataacactccgtatcctatctgactggcagggatcaaagacggatatcaacaacaggaacaacagaaagcttacaaactcaaagaaactgaatgcctgaaaaaatgggtcaagaaaaattaaggactgtgtagaatcaaatgagaataaatacacaacacacccaaacttgagacataatgagagtagttctaagagtcaggtttgtaacattaagtgccaaaaaaaaaaaaaaaaaaaaaaccactggagaggtttcatagaagcaatttaaagctttagaacaaacagaagtcacacccaaaaggagttgatgacaagacataatcaaattcagggctgacatcaataaaatagaaacaacaaaaaaagcaatataaagattcatgaaacaaagagttagttctttgagaaaaatcactaaaatagagtaaccttatgcaaattatctaaaaggcagggaaagaatatccaatttaacaaaattaaaaaagaaagatgaggggcataacagcaggcactgaagaaatccagaaaataataagaacatactttaaaaaccaaattggaaaatctaaaagaaattaataattttatcaatatatccctcttaccaaagttaaatcaagatcaggtaagcaatcgaacagacctatatcccctagtaatatagaagcaatcattaaaagcctcccaaccaaaaaaggacagaggcatggctttagcccagaattctaccaggctttcaaagaagagttaatcccaatactcctcaaattattctataaaatagaagcagaaggagcattgcccaattcaaactaggaggtcccagttaccttgataccaaaactagatacagactcaataaagacccatttacagaccaatttgccttataaacataaagcagaaattctcaataaaatcttaacaaaatgaatctaaggacacatcaaaaacatcatctaccacaatcaagtaggcttcgttccagagatgtagggaaaatttagcgtacatatacaatctgccacataaacaaactgaaagacaaaatctacacgatcatcccataagatgcagagaaggccttagacaaaatccaacacccctttatgataaaattccttgagatacagggatatagggaacatacttcagcataataaaggcaagctcatagaaaaaattaactttactggagagagtctcaaagcaattcctctaaaatcaggaacaagacaaggttgtccactttcaacatacctatttaatataggacttgaagttttagctaaagcaataaaacaattaaaggatatcaaagggatagaaattgtagataaagaaatcaatgcatctttagttacagatgatatgataatatatataagtgacccaaaaaattccactaggaaaaatctcacagttgataaatgttttcagcatcatggagcagtaggataatgacataggacaacctacggattcaatgccatcaccatcaaaattccaatacaattcacagatcttgaaagaacaattttcagcttcatctgaaatgcaaaaaactaaactaaacaaaacaaaaaaccctaaaaaaacaaggatagctaaaacaatcctgaatagtaaaaggaatgctagaatgaggctatgccagtgcctggcaaatacagaagtgaatgctcacagtcatttataagatggaacacagggtccccaatggagaagctagagaaagcacccaaggagctgaagggtctgcaaccctataggtggaacaataatatgaactaaccagtacccgggagctcttgactctagctgcatatgtatcaaaagatggcctagtcggccatcactggaaagagaggcccattggacacgcaaactttatatgccccagtacaggggaatgccagggccaagaggcaggagtgagtgggtaggggagcagggtcgggggaggatatagggaactttcgggatagcatttgaaatgtatataaagaaaacatctaataaaaataaaattaaaataaaataaaattaaaaaaggaatgctagagttatcaccagctccaatttgaagttgtactacagaggcatagtaataaaaatagcctggtattggataattaattctggtctaactagatggctgcatgtagaagaatgcaaatagatccatatttaacaccctgcacaatactcagctggaaatgaatcaaaggcctcaatgtaaaagtcaatacattgaaactgacaaaagagaagccctttctaaacagaacaccaatagctcaggcactaagatgaaaaattaataatgtgacatcatgaacctgcagaacttcagaaaaacaaaggacaccatcatttgaacaaagtggaaacctacaaaatgctaaaagattttttttatgaactacacatgcagtagagggctaatatgaaaaatatgtaaagcacacacacacacacacacacacacacacacacacacacgtaaaaactgacatcaagaaaacaaatatcccaattataaaaatggggtacagatctaaacagagaactctcaataggggaaattcaaatggctaagaaacacttaaagaaacatttaacatccttagccatcagggaaatgcaaagctaatgactctgaaatttcatcttatacctgtcagaatggtgacaactaatgctggcaagcctgtggaataagtaaggggcaatacttacttgcccattgctggtggaagtgcaaaattgtacagccactatagaaaccaacatcagagttcctcagaaagataaaattgatctatcttaagattcagctataccattcttgggcacatacccaaaaggatgctttgtcatactccagagacacttgctaagtcattgctgctctattcataataaccagctgtaatctgtagataatctgtagaaccacagaggataggaatagagtaagaaactagagggtacatagagttctcattaggaaagggaaatagaatagacaattatgaatgggtggagcagctggactaggaaggatcaaatggggaggggaaaggaaagggatttgagggaaataatatggtaagatgtagctaaaagtaaggggcatttgaggagtaatatggaaacctaataccatagaaacttcttacaatatatacatatatgaagatctaaatgaaatcaccaaataatgggagaggcagagtcccaacttgtcaccaaataaaacttctcttaccaggtttgggttacatctaattgagttgttggccaaagaggtgccctggaaatccccagacaactcaggctgttgccaagcattcctttcttaataaaattactaaattggaattaaagtaaaagaaactgtatctgaaacacgagcaaaatattttagtgtctggccattttgtgttttccttgttcataaatggcaagattaaagtctggcatctcctttttcatttgcatgcatctacttccgttgggttaccttttcacataagtaaactttaagattcctttaaggatgctcaattgatggtggcctcagcttcattttgaaatgatacttttttgtttcttcagtgccaaagaacccgggggcaggagaacaaagagcagacaataagtaatataggtcttttatcttaatgccatcatttcaagctaaaaatcatcttgaaaagttcatattcagacacattttataaactagatatgccaggctagaaattttagggccaaagggatggttcagcagttacaagtgcttgctttacaagtcaaacctggaactgcaatggagagagagagaaagagagagagagagagagattgatttgactccctaagttgtcctctgacctccacacaagcaccatgccacttgcatacccattcttatgcatacatatgcacataaaaattgtaacatgcaatgagtgacaaactgaaaattttcctggcctcagaatttgctacagtcattttcaggattctagggatatattgagttttgccacatacagttttagacacagaatgacacagacattaaagtaattctcacgagcaatggacagaattacattaaatgataatatatgctgtagtaaacataatgtaggtaccttatatcaacagacaggcataggatggaagtagaaagtgtcaagagataaagctttattatgcttacttaagttatttatctttctctgttcaaaagataaatggtagaccggggcagccagggcaccttaatatttcaaaaggcttcttcagtagcccagtgagaagtagggcaagatttgtctctctcctgactaatctctctgcttttaccatggttagcaggtttcctaatacaatttttcatccctacacagaggcgctctaccatcagtctatggatccctctaagggttttataattcagtcctagtgtggcagactgcaggcagacagccagtggatttgcatgtgtcctagcttccttccagatcctgtttcctcttaagagtacaacaaataagctgggcgtggtggcgcacgcctttaatcccagcacttgggagacagaggcaggcggatttctgagttcaaggccagcctggtctacaaagtgagttccaggacagccagggctacacagagaaaccctgtctcaaaaaaacaaacaaacaaacaacaaaaaaaaaacaaaaacaaaaaaacaaacagaaaagaaaaaacccaaaaaagtttagatttttgggctggagagatggctcagcggttaagagcaccgactgctcttccaaaggtcctgagttcaattcccagcaaccacatggtggctcacaaccatccgtaacaagatctgtgtctaaagacagctacagtgtacttatataggataaataaataaataaataaataaatctttttttttttttttaaagagtacaacaaataggaccaagtatagatcctttcattttttggccaaacctctctatcactcaagcatatatcacaactggatggtgttatggtaaagtgtttacctattttgattgtcagatcaattttatttaattcttgaagattcagtgtaatggggagtctgaggaaacaataatttctaagaggaaagacagtaacttgaaggcctcttgagttgggatgggtccctctgacccacatatgaagttctccatactttatcagttagggtattccccaggtaagtcatgctaagaactcaagtcctaattcattggaagtgttccacaattgtgtcaaaataacaggcatccctggagaactgaagtgtactagctaattttctagttggtagaacgaaataccagacaaaagcaactgaaggaaggaatggtttattttggctcattgttttaggttatggtccatcatggcctggaagtcacggggcagctagttacattatatctgtacttggaatacagagagataagttcttgtgctaaaaaggttgttttctatttttttttaaattatgtttgggactctaacccatgggatggtactgcatacattcaaggtgagttggccttgctgtgatcagcctttctgaaagcagacagacagacagacagacagtcacacacacacacacacacacacacacacacacacacacacacacacgtccctatggtaattctaaatcttatcaaggagacagtgaagactatccagcacatggatgtaccaagcacaggtttgggcccccaacctttttgtgttcagtcccctctgctgaggtttgaataaatcacttctcttggctttccagggactacatgtgtaatacattccctgagcctcggatatatatcgttggcatgggcatctatgaatttatttattttagcaacttggtttcaaacaaaatcttcctcttaaaatggtccaaaaagttccaagtggatctttaagcagaggaaatgggttgcctgtatgaagacagctctggtcccccaaccaagattgctgtctaggccaaaagtttaaagaggtagcctttcctgtgggccttatgctcaagggagcatcttaccctcagccgacctcagttagttctcagttagttccctttaacttatagaaataaggatgtatcaatctaatctgtgcctcctcctttgtgctggacaggtggtggtgtcttgcacaaagaagatacaaagtcactatgccaccacatttgtattcaaaagggagtcagtcaactgctgcttggcagaattgaatgagttacttgaagacacagcctgaaagctgttacatatgaaatagcttctactagggcacaaccatctccaccggctccaattctcagcgcttgaaatgttatcgaaaatgcttcttttttatcaattgagtaaggatcatattgtacagccttgcctttcaaaaatattttttgaaagaagcacaactttctgctacatgtgaggctgaagtaaaagggtctcttgaaccggagttcaggagcaacacggccagcaagggcccctctttgaaattcaaaagtaaaagccctataaaatccaagctaggactgtagcacggttacctagtatgtttaattctcagtgcaacaaacacaaagcaacggatccactgagaagtaaacatgggctttagagcattatgcaggagtcacagcagtccatagctctgtcccaggcttggaatctcagaaggtatcaaaggtttagcttgcagatgaatacaccattcctttgtactactcttaagcgccttgttatctcgttggctcttttgtaaattcaagcatgtaaagatcataagctgttggagaagcaagatagatgccagagctatgaagtctctttcattcctggtggtgggagagtagctttcttaaaacagggcatcactttcatcctgcaaacattctctgagctaagagaggcccaaacctccacagactgactacaaactaaagcagaaagtgacttaagctaggggcttaagggtctttaaagaactacctgctagtcaattatgtcccttaattcacaggaaagaccaaagaactcacctcttcctgggaatttttttttctccctctcttccctgtccttctccactgtgtcatttctttcttcttctagaacagtggttctcagtctctctctctgtgagagatcagacatatcctgtatatatcagatactacattatgatccatgagtagtaaaattacagttataaaataacaacaaaacaattttatggttgtggtccaaaatatgaggaactctattaaagagttacagcattagaaaggttgagaacgtctgttctggaacagtccatctctctggaattccatctcccctccccagtgtggaggatgtatgagtgcatttgttaagcaggtgaatgtgtgctggtctgtagccgcactagcatgatgactgtcgtgcttcagctatgtaagggatggaggggaaagaaatcattaacaaggttctttgttgtgcttgacctcttggaagaaataatggaacaggattgtaggccctgacttgacctgacagtttttgtgttagactttttgttgttgtacagatagtttaccataaaataggattcagagttagcagtttttcttcgttggaagacagtaatttaaatgtattttctcacataaaagactttaagaattatcttaggctttcagtagtttttccattttcatgacttagaaataagctttgaaatgcaggcccctggggaaggcaggctttcttttcctctctatgtataaaggaaaggtaagacaggagaatcaaggcgtttcaggggaaagccttctcaataggccatatcagtcatccccttaggccgagagagtcattgcaatctggtaaagggctgatctttgcaaagtcaaggccggtggctgccttgctgctccaaaacagacaggacccagaggaaagatgcacacatacatacgttcaggcaaaacatccatacacagaatttttagaaagaagggaaaaaggcacatttcttaggattaggttgtgggtaagatttacccttctctgtcaaacaagaaggttcttaaagaactcatttcccactggcctcagtctgcctcaaagaatcatgtgaatccggggggaagctaagcagggctttcaaatgggaagtcactcaaagattagtgtggtgagcagccccagtcggagacagagacagacacatttatagcttggatttttaaataagtttccaaaggctgtggcaattttggttgttggctttaattctctgttgattccaaatggtaatggtagccattggtaaagacaggttctttgattcctgtcttaattactaatgtgaacccacagccacatgccactattcattctatgatatctgggtaacagaatggctaagactgtgtttaaaagagttaaatatatcacaatgttcaactaggcctccctgaaagcaagagggagggcattatgattttatagtcgtaagatctgggtatagtttctagcaggcatccccataccaagcattcttttcctggaatgatttccagaaggaggctaaggtactgagatgcctgtttatgtgtgttggtgcattatagtcacttcagtgcactcaggaagtttttctgttgttcattggcagccattgtatctctgataactcttaagatacagttgtgatagtggtcatcaaattgctaacattccaatggcaagggcacaaccaagtttgagttagcactggaaatcagttcagggaattagtaattcagtgtttcctacagtaagaataccaagcatgtcctatgagctataaaactaagctgccttccttatgcataccaagatcatcctatctgtgtgcctttgtatatgctctactgctttcaagaatgtctgctcccccttgctacatggaaaatgctcagctcttcttcaaggtccagctcacatggaatgtacactgtttaacacttttctcatttagtcctaaacttcgtgtaggcacagaacctattgtatatatttctattctagaattgatcataccaagaaaaaaaagtctatgggcttgtttctgctaaattgtgaccttttaaaactggaagttatgcccaatttgtatctgctttctgcgttggccaggacagatcctgacatataaaccctcagccaagtaaatgctgatggagtaggagaatcatttgcccatgtatgtttataattccccatccttagattctattatcattaagctttgttattataccttgcatgtgtatatttaagggactctttcgttcatccataaaacatacctctgctggcatggtgttgatcgataagctgacaattgggttctgtttgccactggatataagcattaagtgcctcttttttttatgtgaaccaggtaagggcactgcatcatttattcagaatctggtagctttgataaactcatgcactggtttctctgacattattttggctctagagatcaaaactaggcgagcgtcatcatttcagcccataggctcatgtgcccatgtgttcctggtttagtatggtaagttcataggtgctaatattttatttatcagccttaaccctggtgtttgtgctaggcaaattatagtggctcacttggagaagcaaagggaagggttattttgcctcagtattttctgatttgtaaatggagtcactggagataaggcacggtccaaaaaatgattttctatatatgctgtaacatacagcagggtgcagcttgatctccgcagttgggcacataaagcccagaacaatgttttttactctatttttactcaagatttagtgaatacctgctcagaacatcctgtgctcttttatgatgtgggaacagtacaaaggaaagggcaaggaaaattctatttgcagaaatgtgttcagcccttacatatttttagggcatcctgtgtattgcagttcattccgtccactttacatagataaggagactaaaactcacagatttatgggacttacgtagttactcaagggcaggagcagttcagacttggataggccttattccccagcccattttcccactgacctaagctgctattttaaaccttactgtttagctcaagaaaaaaaccagagaaagtaaactactatgttaattataacgaagcaatgattatgccgtcgagacaacatgcataggcacgatcacaaacagttctgaggtaagaccatttttccctgatggcactggagattgttatgttgatggtagaagagtagacaaaaagctgaccaccattgctaaaagcaatagttactcttcttttaacccactgtagaaacatcctggacccagatctgacaatgagctccagatcgtcctgggtataagattattgttagtgccttagctaacattcttgtactagattggtcgatacttgtcacattagagctgattttctacctctgggtggagaaacactagttctctgctgttttcccaggatggatagccgagggatgaatgtgtgatacttctgaagataaagattccattgttctgatatttttgtcttttatcatatcagcctaggaacaataatttcacagtcattcaaagtggtggtacaacatagatccatacatactgcaaactatctttagcatgactccatgatttcaattagagctagaatccaatgattgcctcacaaactttaaatcaggtggcttgtcaaaatgaacaaagataggtataacttgatactaaattatattcttccatttgtatgtctttatagaaacttgagtgacatattgaagacaagtcttgaaattttataacataccgagtgatgccttgaatggcttgacaagtcttttttttggttttggttttggttttggttttggttttccgagacaggggttctctgtgtagccctggctgtcctggaattcactctgtagaccaggctggcctgcctctgcctcccaagtgctgagattaaagacgtgcaccaccatgcctggctgacttgacaagtcttaatggctggaatctcctagctgcctatttcaggactatctttaaaccatgagagcttttattaaatgccaagagttgtactgctgttctaccattttccagcttcatcatatccttcagaaggatgtgggatgagtattagagataagctttctttccttacagtcatgaaaataattgaggtcaattaagatccactttagaaatagtttggagttttgattgttttagaaaaggcaatggtatgagacagtagctctttgaaccttcttaaaaagatcctactcatatttataagttactccatgacatttatttttctccagtgctggggctgaacctgtggccttatactgtaccactgagctaaaaccccaactctggaagttttcttcttgtggaaaagtctataatgccccaaagtaggatatctgattggagtcctttaaatacctcttgctggaaagaaaaaaatacacaagacatacccaacctttggacactgtgatataatattgtaaactataaagtttacacttgagaactacatagttgaattttcaaaaaaccaaccaaccaaccaaacaaacaaaaaccaatctcataatgttctaagactttgctgattttcagcatgactatgcagccagtggagcacaggtgtgatgagtttggtagtggttgttgactatgaagcctagcaagtatagcattccttttggtttctgggtattatgattttatagtcataagatctgggtatagtttctagcaggcatccccataccaagcattcttttcctggaatgatttccagaaggaggctaaggtactgagatgcctgtttatgtgtgttgttgcattatagtcacttcagtgcactcaggaagtttttctgttgttcattggcagccattatatctctgataactcttaagatacagttgtgatagtggtcatcaaattgctaacattccaatggcaagggcacaaccaagtttgagttagcactggaaatcagttcagggaattagtaattcagtgtttcctacagtaagaataccaagcatgtcctatgagctataaaactaagctgccttccttatgcataccaagatcatcctatctgtgtgcctttgtatatgctctactgctttcaagaatgtctgctcccccttgctacatggaaaatgctcagctcttcttcaaggtccagctcacatggaatgtacactgtttaacacttttctcatttagtcctaaacttcgtgtaggcacagaacctattgtatatatttctattctagaattgatcataccaagaaaaaaaagtctatgggcttgtttctgctaaattgtgaccttttaaaactggaagttatgcccaatttgtatctgctttctgcgttggccaggacagatcctgacatataaaccctcagccaagtaaatgctgatggagtaggagaatcatttgcccatgtatgtttataattccccatccttagattctattatcattaagctttgttattataccttgcatgtgtatatttaagggactctttcgttcactaaggattgaacccgggtatcacacatagtacccacgcttaaacttttgaccatgtgcttttatttctttgaggaaaatgtacatttgtagccttcaagcaaatctgtccaatgcacatgttcaggcgtagaaatctgttagttcagaatccgagcttccaagaggaaataagattcctggagctcatctttctggccaaatctcacaaagcaattcttgctaatttcgagttcctctctattaaggtatatgtttcagaagatcccatcttaatctaccccttgttgtttcaggcctttcgaaccacacaaaactgttcatgcgttaaaaaaaaaaacccaaaacaaaaaaacccacttattttattgttaattttgagaatttcatacatgagttcgttataagtactgcacattagctgattgtatcactggagcgtccatgcatgagttctgtctttacatcattgctatgccagtctctccttttcaacttcatgacttcttcctttcttactattgttataatatatgtatgtatatgtgtgtgtgtatatatatacatatatatatatatataaaacaaatacaagttaaacagtgattatatacaacctattgagtccagttagtgttgcttgtatttagggctgagcgctgggactgggtaagttctttgagggctgatcatttgggactagaaaacttattggaggctcttccctggagaagactgagtctccctcctttagaagtcattaagtacttgcaagtcttcctttagggtggggccttgtgctattaccccacccactttggcatgacaactgattttgttttgttgagcacactgttaagattccatgggtgcaactccctgacatacatagaagacactatgtcacagcagacaatatctggtcttttgctccttataatcttccatcctctcgtctatgctgttccctgagcctcaggtgtagtagggttcctgtgttttagatgtatcagttgggggtgggcactgtacagttcaattgttctttgtatcttggccagttgtggatttctctgatggtcttgataggctgcaaaagaagctgctttgacgagggctgcgagctccacttgcctgtgggcatatagatacatgtttagaatgtagtttgattatactggtttaagaaaatggcagcgagagaatctcctttagggtccatgacctcgtcagctacaggtagttggctgggtttcccagatcaggaacagtttccctcctgttaagaggactttaagtcctattagagggctgttagtaactccccaaaacattgaaccattggagatggcttgtgttgctggctgttgttgtgacagttgattgctgtttcttccttgaaagcttccatagcatctttggatagtctaagagcaagtcctcagggaggaggctttcagctcagttgcagctctattcttttaagcagtgtgtctcaaatgtgtgatgtcttcggcaatacggtcataccttcaagttctgggacagagccaagggcagcagtattaataaatagcctccctttgaatagctaagaccaaatgctaggtttcccttaatatttcttttctccaagaagtgtatgagggccttcttaataccagatgttctggtttgattttctcaggatatttcaactgttacccatatgggaaatggtttagttcttaatcttaactacttctaggcagtttctatcttgttattggctccaaagtttttaccttttgcatgttatctgtgttaaacatttaccattgtcctatgcagctcagatattttaagataacctatatcttatgagggtcctgctctgttctacaggagcctcctttatagttcatatttataagctcccaattagaagactttgcagtttaatagttcttaggaaacagcaatatattgttgaattggagggcaccagatctatgttcccttcatttaatctcttggaggctacattattaatgatctttcccttatgggtaattttcaggattcatgtaatactgtctataaagcttaaagtattgtatttgagcacttagtgggtataccactgcagacaagcttggttatttttactgctagccttaccctgcctaccactgccctctactgagaagagttagtaactgctttgaacctgaattctttctggcttgagtaaaatagacctgttcaatttaattcatttttaggcctttagacaatggttatcctgctcgagatgtagcataaactggaggatggtagcatggtctcacttttgtaaagtgaccctttacaaaaagcatctaagttattgtcactgctcaacagaatttgaggcctttatttataggtatagctttaggtgagaagttaaaaaaaatattacaagatccaaagggattcatcataattttttgggtataatccacgtttcattgtgcactctcatgtaaactgtcagagaatagggctgtctttgaattggttcacaggttttctcgataatattcttgtgacctgtgttctttaaaggaggggtatttaagaaaatagtgctcttaattcctctgacggggcaatgtgtggttgcataagtgcagtacaaatcagaggactctgaaccacattgatgaaaagcaatacttttgggattctcttttatggagggctttggggtgtggaaggagctgccttaggttggcagtcatatatttgagtggataaagggtagtttcagagtcaaataggagctttcagtttctcctctgacaatgtccccagattatatttacttttctatatactaaatgaaacttgaactacttaatatattaagatgaaaacctccactttgcatgctggtgcatgcctttatattattagctattcaggaaactgaggcaatacattcaactctaccttgggcaacatatgaggatctccattcaaacattcttattttttattgatattttctattgcatgtgacattggaactataccgtttactggcccaacaagctttccttaggttttgtgaatatatgatgtcaccttgaaatattttttccctaaatctaacatctagttactgtcacaggattctttttcttttgctcccctccccagtgtatgtgcaatatattttattgttgttgttgtttctttctatcacttgggacattttgtcagaacattttgcctgctggacccttctgaatctgttattttgcataattaatgactagctggagtattttaaagcgtacctccacatactgttccaaatccctgaaagtacccatcagggaaacagcattgcctgtgctctgaaccaccatgggggatacttgtatggctctctatgctttttccttggccacatccagctcccaaatcccaccaattgatgaataattgtttttttttaatatttttattgagtattttcctgatttacatttccaatgctatcccaaaagtcccccataccctccccctccactcccctacccacccaccccacccacccactcccactttttggccctggcattaccctgtactgaggcatataaagtttgcctgaccaatgggcctctctttccagtgatggccgactaggccatcttttgatacatatgcagctaaagacaagagctccggggtactggttagttcataatgttgttccacctatagggttgcagatccctttagctccttgggtactttctctagctcctccattggaggcctgtgatcatccaatagctgactgttagcatccacttctgtgtttgctaggccccggcatagcctcacaagagacagctatatctgagtcctgttgtttatactactgtccttggatttgaagtctgtcagttgaagcagattgtcttatttccaaggagtaatttgggggtcactgattttttctgactccaggaagactcctcccagctctctccccatacaatagcccgtgccccctgctctcacttgtaatgtaatagatgaggtttctttccggttcccttcactataacctccacagttcctagtgtgcttttaggtttactgtttattgagtataaagatggcagctttagcagcaaggctttgtgtttgcctgcgtgctcgtttgctttgcatagtcctagagcctgagcccagatttccaggcgttctattacaatgatggctctcaaccccagcctgttgaaattttaagaagtgggggtgggtgggtgggtggggtggtcagtaggtttcttaggcttgctttgtgcacactctgttgcccaagctagccttgaacctgtgatactctttgtctctgttccttgcatagatagaattacaggtttacatcactaattccagctattatttattcacttttatgagataaaaatcaatatgtagcccaggctggcctagaacttgcagtaatccttctccttctacctcatgggccctgaaattacaagcgtctataaccacactcactggcagcattttttttttttaatggccagtccaaagtttcagaggcaggagctggtgaggaaaatggcactgttttcccccttgcatgacactctcgctataagactaaatgctagattgagagttgtcagtagccagtggtccctttggtttcacctctcctgctgtgagctattcagaggactactaggtctctggtgttctaagtaaaccatggtcaaagtttggtctactttcatggagggtagaaggagggcaggggtctactttctgacctcagttacctggaacttatcctatcctaaacatgcccagatgtgagcaaatgagaatgttacagccctcctgctcccaggaagaaagccaccttctgggagagagtggagaaagggcattgtactctggagagcagctaaatgaaacatggggaaatcaagcaggagaatttgggattgtttctggtgtgtgtgtgtgtgtgtgtgtgtgtgtgtgtgtgtgtgtatgtatgtatgtatggtgtgtgtaactactagcaatgtgtactcatattcatccatccattcattcattcattcattcatccatccatccatccatccatctatctaccagcttagatatattcttgagtccattaagtaactacttcatttgggtagttgtactttgcaactccagaattctgtatggttctctttataatttctgtttctttattggtgtgttttttacttgatttttgcttataatttactgtctcaatatgcattgatttaatgatttttaacatatctagaacagctgctaggcctggggtatagctcagtaagggcacttgcctagcacaggcaaggccctagtttgattcctagcagccagatgcaaaaagaagatataataccttccatataatctttggcaagtccagtatttgagcttctttaaaggctgttttcaatgtctgtgtcttcctgtaaatgggtcggagttttttgtttctttcattatataattgcaaataaacctctacatttaaaataatatatgaattctcttctatatgaatgatatacatagtatttgttttaaaaaaatcatgttttggggtgctagggattgaactcagggctttgtatgcactaaccatatgtttgttttatcactgaaattgtgtactggttttagataatggtcacactatccttaaatatctataacttgttatgtatttagccatctgatttttttttttaattttagagacagggtttctctgtgtagccctggctgtcctggaactcactctgtagaccaggctggcctcgaactcagaaatctacctgcctctgcctcccaaggactgggattaaaggcgtgcgccaccactgcccgctagccatctgatattgttgttgttgttgttgttgttgttgatgatgatgatgatgatgatgatgatgtttggactaattttgtgaagtctgattctcctacagtgtatattctctgatgtccatgcctacatttttatttgtttttatcttttagcctagcttcatagagatcgttcttgggtccacatgaatcatttatccatcaatcatcatgcctagcccccatagcctgttatacttcaactcctcattctcaagcttatgtgtagtttgtagtttgttttcatagttcagtatatttatgaccgccccacccccacccccaatttagtcagatgttctctttcttttttttttttgaccgttgatccccatttattcttttttttacattttttgtttgtttgtttatttatttatttatttatttattattggatatttatttcatttatatttccaatgctatcccaaaagtccccccctcctgcacccactcccccacccacccactctcacctcttggcgctggcgttcccctgtactgaggcacataaagtctgcaagaccaatgggcctctctttccactgatggccaaccaggccatctttgtttgtcctggatttcctggatgttttgagttaggatctttttgcattttgcattgtctttgattgttgtgccgatgttctctatggaatcttctgcacctgagattctctcttccatctcttgtattctgttgctgatgttcgcatctatggttccagatttctttcctagggtttctatctccagtgttgcctcactttgggttttctttattgtgtccacttccctttttaggtctagtatggttttgttcatttccatcacctgtttggatgtgttttcctctttttccttaaggacttgtaactctttagcagtgttttcctgtatttctttaagtgatttattaaagtccttcttgatgtcctctaccatcatcatgagatatgcttttaaatccgggtctagctttttgagtgtgttggtttgcccaggactggctgagatgggagtgctgtgttctgatgatgatgagtggtcttgttttctgttagtaagaatcttacgtctgcttttcaccatctggtaatctctggagtcagttgttatagttgtctctggttagagcttgttcctttcatgattctgttagcctctaccagcagacctgggagactagctctctcctgagtttcagtggtcagagcactctctgcaggcaagctctcctcttgcagagaaggtgcacagatatctgttgattggatttgcctcctggcagaagatgaaggcctgaaacagagcctgtcccagaagctgttagcttctgtagtccacactctcacctgtgcagactattcttggtgggatccggaaaggaagatggctcccgaggatgctccagcaaagccctcccgggctcagtggacacctctcctctggcagggaaggtgtctggatgtctggagcctgtgcagactagtcttggcaggatctgggaaccaagatgtctctggcagatgctctggcaatggcctcccaggccgggcagacacctctcctctggcagggaaggtgcctggatatctggagcgggaaatggggtctgccacagaagctctgtggcttctgcctgtcccagaaactgttagcttctgtagttcacactctcacctgtgcagactagtcttggtgggatctgggaaggaagatggcttccgcggatgctccggtaaagccctccctggcggagtggacacctctcctctggcagggaagctgcctggatgtctggagcccgaaactgggcctgtcttagaagctctgtggctcccgcctgacccagaagctgttagcttctgtagtccacactctcacctgtgcagactagtcttggcatgatccgggaaccaagatgtctccggcagatgttgtggcaatggcttcccgggctgggcggacccctctcctctggcagggaatttgcccagatgtctggagccagatgttctctttctatttgggcttctagggtcaaatgttatttatttttattttttgagacaggagtttctctgtgtagcttgattgtcctagaactcgttctgtagaccacgctggcctcgaagtcacagagttcgcctggcttctgactccagagtgctggggttcaaggtgtgagccaccagcaccaggccaaggtgagttttcttaagatctacattcccatgagcacgtcctggataagagtagcacattgttcaacccatggtttgtcaaggttgtggttaagacccttgatctgctagatttgtgtagttggagactattttacagtctgcctgccttctcactcagattgctcccagataagcacacatgcacacagactttcagactttcagatgttggtgaccccaggaggctctgtttagctgtgtctttgttagacttctggagtgtttgctatttcattagttcctggagcaaagcattcatatgaatggaagtggggaggggaacctgtctcttagcatatttcatctggaatagagctttcataccattggaaaagaggtggcctaggaacaagtcatgttataagtgctactgagccctactgttcttacctagttcagtagatagagttgggtaaccatttctccacttcctgtgtgtcattaggacaattttaagggccttgaaatggttggctttttcatagtttctacaagttaagtgtttgttaatcatcataaatattggtaaaactataaaatggaataggcatgttggaaaacatggaaaacacattggtagttcctttgcttctttcttagcatacattgacctatgatgtatatcatatcttcctagatatcattgaaaagaaatgaaaacacttccatataaaaatttatacatggatgtttatccacaataacaaaacactggagtaactcaaatgtccatcaagatatagagaaacaaaatgtggtatgttccatactatttgtcaataaagagaattgaaatactgatatattttatgatatgcatgaagcttggaagcattatactaagtaaaagaaactagggccagatagagagcaatttccacgtaaacaagtggccctgagtttgatccccagaaccaaggaacaactctggatgcagtaggtgcttgtgatcctactggaaaggcagccaagtggcttcctgaggcctgcaggctagccagtctcctactgggggagctccaggccaataaacaaaagatgtcttgaaaaacaatgttgatagcacctgagaaataaaacctgtggttgacaggctttcatatacacatgcacatgcgcgcacacacacacacacacacacacacacacacacacacacacacacatacacacacgagagagagaaagaggagagagagagaagagaagagaagagaagagaagagaagagaagagaagagaagagaagagatgcacaaatggccatattctgtttataggaaaaggcaaatttattgagccatgatttgtgaaggcatcttaggactggatataggaacacatagacaggttatatgtgagctatatgtgctaaaagttcctttttgggtcataataatgttctaaaatgagatgttgatgatcatcgttgtctcacttggaaaatatagtagcagccattgcattgcatttaaaattaatgaatctttatgataggacaattgcatgatatataaattatatttcaataaagctgttaactaaaaaaaagtcaaagaatctttctcagtctctgtctttctccctctgtatatctttgtttctgtctttgtgtctctcttgtatgtgtatatgtacatgcctgtgtgtgtgtatctgtgtgtgtttgtgtgccttaagggaaatgacagaaatggagagagagagaaaaacaagaaacgttcctttcctcactttttctctgcaattgagatttcagcagtgaaattgctttttgctcatgtacatgaatcctgactgggatatgtatgtatgtatgtatgtatgtatgtatgtatgtatggatatacattttctcacctgagctctagttctaagttacatgtaaagatggaacctaggaggcttttgttatggacatcctgttctttaggagggtgggtttcccacgaatgttttgctgactgctcttatccatgaaatacatgtgactcatttgtatgcttcggtttccttggttaatagagaaagtccacaccttagggattatactagggctctactgggtgcatatgaccagaacgaaatcagctctgcgtgttgattgcaaattcactgagggctaaagctggcctgagtaccaagcaggtagttttgcctgacttctgtgcacttgtgctagctgaaacttcccctatcagtcctaccccgggcagcctcatttccctgttcttttgtgactattgctgtggtctttcatgctggatccccaattcctataaaaacatcttttcagcattgctgtaaactctgcctctgctgttacttaactcaaggacagaggaaatagctatagcccagaaacacacttataaaaaaaaagaagaaagaaaaagcagccccaaactcatcccaatcctttcataaaaccgtcctgtagggtttcgctgtgaattgcagtgcaatgtgaggaatgcgaaccgtgctaatcaaggccctttgtatttggagcctacctgatttctctccgcctgccccagccatctgggctaagctgggcccaggggagctacaaagccttcagcttagaaaatggagacaaatgaggaggccccaaaggaccaaacaaaacttgttagtagtttgtaagtcaaagtaacatatgccgtgtttaaggcaaggctgggaggatagatgctgcgaagcctgcagctttgaaattgaatacgtgtgtgtgtgtgtgtgtgtgtgtgtgtgtgtgtgtgtgtgtgatttcactggcagcagcattttcaaagctgggcctcagattgcctgttgccatacattcttgcccccctgcagaatgctccttagaatcggctgtccttactaccacaatgtcttttctcaactagagagcctttctggttcttctactctatcacatatctcccagcagaaaatccacaccacttaatgtgagataggaacctatttgcaatatggttccatctgtttctgccgcatgttctgtcgcctgtctctccctaagggaagcctttggaggtattcatgatttacttgaatatccttcttctttcttgaatctcctagtcctttagcaagggatgaatggccctgcctgctttttctctgttaagctttgctgcacaatatttaaaaccaagtgtgtcagcatactgcgaagacacagcattaggaaaaatcctattgaatctatgttaaaactataataatgggtaaagttataccagttttgtcatttgtaaaatgagaataataattcatatgggacaaaagaattgatactggaaaaaacagaattgatattgtcactcactatacctggaaaacggtgtatacttgaacagtgatggaatagaaaaagaaaaagaaaacatattccttcacccttggttagaactgtaagaactttctttccaaatgaccaagagtttgatgttctttgtatcgtatttgtctagttggcttctttgagtttactttctttcatctcccttatttctaaagggtattctacaagggtcctgtcttattaagaacaaaatttagctgccttctcatttgtgatcctaagaaatctgtatggacaggcacgagaagagacagatgccattatagcaccttattcttgccatccccacgccctagtcttaccagacatgccacaagccttgatgagattgttttaacaatctttcacaagttgacctaccttcttcctgcaacctgatgccttggttggttggtcagtctctctcttctcctctctccccttctctcctctctcctctccccttctctcccctctctcccccctctcctctctctcctctcccccctctctccccctcccctctctcctatctccctccctctccccctctcttccccctcccctctctcctctctccccctctccccctttctcctccctcccctctccctctccccttttctcccctctccctcttctctctctctcctcccccctctctccccctctcctctctctcctctcttcccctccccctctctcctctcttctctctcctctcatttcacttggggttttagaaatgaaagtgaccatgagcaggaattgaccattcttattattgggatggacatatatatgaactggtttctcatctggactttatttcagaaatgtacacatgatgttaaaaatataccacttggaagaagagaaatatttattttgaacaatgaggggtaagagtttccttgctgagttcctgctggaactgctgtaaaatgactgtgtgctgatgctgcattttgacagcattgagttagtggccctcagggccattggatgagtggtgaatggatcaaaatgcacgtagccctacattccccccaacagtgcacacacacacatgcacatacacatgcacacactcacacatatatacacacacagacacatttgcacgtatatacacacagacacatgcacattcacacatacacctacacacatacttacatactcacacaacatacacatacacacatgtgtgtgcatacacacacacatttagagtgcattgttgacctgggattcagagacactgactttagtgaatcaagccatccattaataacactttagtgttcctttttgtatccagctttgtgctagatgtgaataagaaactagaaactagaaaccagagactgattatcagagcacacagtggtagagaataaagcactaatgtgataacctaagggtaaacatttaagaggcactgggctgagattattgaattggtgtcaacaggggaaatttcttggttggcaatggtgagacctgagcaggactttagggaatagatttggtgtctctgagtcatctgtgtattttaagggttctaattattcctactatatatgcttaagtaatatatttaagcattatcttagaaataatcattaaaatgggtagaataatttctggttcacaggaagagggaagaagaacacttggctgttatatccgaaatagaccatatagtggatgaaaagaatatgaaaccaggatgcagaaggcatttagttcttctaagtgattttgtggaagtcccttctctacgatgctcaatttttttcatatatgtattagagccatatagcaccaactttattgattgcattgggccattattaagagaaaaaaagcaagataattatgtgactgcgtttagaatagtagagtggcccattcaaagcatgggattatgaaagcaattgtctatactaaaaccactctcttacaactggaaatatgttttcctaatttgaatggaattgtcttcgtaggcctgttgcctactatacttatagcctgacaactactagatgagtatgtacattgaagtaaagtctgtcagacaagtgtaaaccccacccctgtgtgcatgcatgcctgtgataatatgtaaggatgcaatgggatggagaatccaaaccagaaagcaaaaggcctgggcaatccttgagaacaacgattatatgtagaattgagtttttgtgtaagcatctttggacctgtatatatacatacatgcttcttgctactgaggtaatttaggctatcatccatcttccatgtgcattcaaagcctttgttactgctgataatctagcccatagtgaatacagtcagtaaggatacttttccgtctacatgacatttccatattcttggatctgcacaagggaactgtcatactcattcaactggcatttaagaactgctgcattctattgggatgtactgatagaatcatggctgttgttttatatgtatatatgtataggcatataggcatatatacatacaggcatatagacatacatgtatatatgtatatacaaacacacacaatactttgataatggctgctcctatgacttcttatgccttcagctgacttcctccctcttcttggagccaccactagtattcagctcaataagggacctggatatggcattgctctatatcttgactggactcactctgcttggttggagctccagttgaactggttttattttgtttgtttgtttgtttggtattttgaaaatcacatctacattcatcccatccatactaagttcttctagtttcattgttaattacttctccccacaggtattagaaacacagaaatcttcatactgccaaactcagctcagatccactcagtaaccactgagtgtgtatgttttactcaccacggtggatatgtgtgactgtcctgttcagtcttgttcataacactataaataactccagacgtggggcctgatggtggtaaaaggcacttttcagatctttatacaaatctaatgactgtgtttcatggctttagtgtacttagacaggacaggcccagccaggctctttgtatgtattctactattgaagaaatggatgtcccaggagcatcttgacaatacagtaagtgtttagtagacaggagatatatagatacttctgcagaactttgccttaatgtgcaaagaaggctttgggactaggaggtgaaacttccatcttaatgcaaggagttcaagactgctatcttgtagagaggagtcaacttgaggtcatctaagggggaatgaagactaattgttggaagtggttcgaatgtaagtgttcttgtttcttcacccctagcactgtcaggagggacaagggtttctagggttagtatgaagaatacattacttttcttccaatctggccctcagctgctgctgttatgggttaacatagctttaataactgatggttattaatcagtagctgtttttggataggtctcactcatagtctaggctgacctggaatttactatgtagcctagtctgtcctcaagcttttgataatcctcagctttccagaggctgtggctataatagaaccatgcactactatcctttccaacttaaatttcgtttcaggaacttcactgtctctcaataaggcctgcctccagtactacgagagcaagcccgagtagcaagcccacagtagcaagccaagctatgagtactatagagaaggccagactcagcagggctaaactccagcctcaagaaataagatttctgagctaggtctggggacacagacctgtaatcctagtaactcaagaggctaaggaaagaagataacaagtgcatgccctgtctgagctacagagcaaattcaaggccagcctgaacaaattagcaggagcctttcataacaagtgcaaacagctgagaaggctggggatgtaacttagttaagaacttgcatagcatgcacaaagcccttgtttcagtgtccactctgtttgtctgtctgtctctcctctccccccttctctccttttctctctgtttctttctccctgcctcccccccccccctctctctctctctctcacacacacacacacacacacacacacacacacacacacacacacacacacacattttgctttgttgggaaccactccacaaataaccaggtaggcttcaagttactaaaacgtaaaagtctaaaggcaggataggtttcagattgattcagatgatcataatgatcgctagtaacaaatgggtaaattattgccttgttcttactgagctgaatagaaaggggtctgacctgtgaagactctatgccctcgtataggggaatgccagagccaggaagcaggagtgggtgggttggggagcagggggagggaggaggggattttgggagaggaaactaggaaaggggataacatttgaaatgtaaataaagaaaatacctaataaaaagaaagaaagggatcctagaactattaagtccaggaaaccattcttgggtctgtcttaatagatagataaacagtgtacacacgagaacagctgcgtactttcagaatacgtgagttcatgttagctgtttggccttgggagactcagttaactcctctgatccaattcagttctttttgttagaaattatgtgtaatgtgctttctagcagcctggtgataggggtcctataagacaataggagaacatataatcacccatataaaatgtcagatacattggaggtcaatatattttacatttttttgagtcaccatctcactttgttgaacaagctggtctcaaacttgtaacccccctgcttcactcctacaagtatctggggcatgtgtttatttgaaaatttaaaacgttatttttagttagccaaaagtataattatggtattcaacagaaatattttaaaatctgttcacattgtggaatggctaacttgagttaatgaacatatataggaccttacatgctagcattttcatggtagactacagggaatgcactctcctagtgattgacagatgccctatcattcctcttctttcttcctcctagatctgttgtgaacctccaaggcttcctgcagctcctaatcagtagtctgcaaacactcctccctggtaaccaagtctcagagcatcactgtgctttgctccttgcgggcagaataggttcctctgaagctgcctcatcatcttctgcagcatatacttaaaaacagcacaggtccatgataactggctggggcttctgtagcagttttcttttctttttctttttctttttttactctcctagatcttatcattaaatattaccactatttatctgatatggctgtcttaacatatggtaaattaaatcatatttgcaaactgttaatgtgcatttaaagtggtaagtaatccttaaatatacagcaatatgttggtgtcttcaagtgtactaagagttctgtatactgtaaacaggttgctggtggctcagggaggacaggtccggtctgtagcctctgattcctaaagcaagcctcaattatatgctaaggcccaatgaccaagacttgcttgatagtgctgccttatggagaccagttcgccggcttctgcctccttaaatgctttaatcatggcctgattggagttgaactatgaaagaattggctgcactttgggggcatggtttcctgtactgcacgctgttgtacagcagtttcataacgtgctcttttgaagtgtttcttgaactgtatgctttactcttaacagtttctgacctctgtaaaaacctgagactgctattcaccagtctgttgttgagttgcttcctgagccccaggagtctggccaggctttcttaggagttcagccagcttccaggttgctctaaaccttccagaggactcactaaagccagagttgatcgtttgcagaggagcataggcttagcctaaaagaggggaatgtttcatctgtctcacactaattaatgaattacattaaaggaaagggtttacattaaaggaacaaattcagggagaatccatgcagaaaatgaactgaaaaggaaaccaacaagggacgagtatgtttttccttttcattgagcaccgtcctggaacgggaaacagtggaggagctatgggtggaatttagaattcaagctaaggtacaaacattaccttagaccatactctagcatcactttttttgctttcaaatttgctcagtagttttttttccacaagctcctttgcaagaagtttgcatgccaatatttgattgaatataagttcagtcatttggtttgtggctcgtacaacataatccaaaggcttgccccaatctgcaaaccatttctacaaaatatattcaatattcaagctgagattgatacaaaagacaacacatggctgaaagcctgtggaaagcatagcagatgaataaggggcattttagtcagagttccttagttaatggagcacttattaagtggacagcaatttacatgctattccaactagaactactctatgagtcccattatccccatttttaaaaacaaataacttaatagttaaataatcaggttccagagaggtaaagtgacttgcccaaggtcacactgttgtactatatgggggagtcaggatttggattagtttatagaacacacacacacacacacacacacacacacagagtttgtgaaataaataaattaatgaaaggtctgttttataattaaaccaataggtcttttgcgtcttttgcatttatttctgatattttatagtggaaaaattcaaatatacaaaaatgaggaaggaattttacattaaattttcaaacaactatcacctagattctgctaaacatcttaccatacttttaaaatatgaattatttttagtctttgagagtttcataaaaacatattttgatcattttttaaagagattacctagtcctgatcctctggctcttataatctttctgttctctattttagaatatttcctgacccttatgtgttaaagttacattataaatgtgttttgacccattgttgctttccgtaatggtccctgtcttctgcaaaatgaagcttccttgaccaaggagtaagaactacacttatctgtggatgtaaggatatgtatttataatatagttagaaattgtcctggtttaggaaagtgatactagtaggttctcctctaagattcatgacctcaaccagccagccaacaacagctttcctcaaccagttggctaagtttacagtgccagagttaaatgcccttatactgaatgggccttgcaccaattaggtgacttttggttacccctgggatacaagtaccactattgtgccttttgggatctctttccaaactggtcactgctgtagtttgtagactttaaagctggatagaactattgatggcttttcttctttggcagcttgcatctctcttaatcctgagggctagtcatcagagaggagatatccaggtcaaattcagaccaattcctcagtgttcatccattgataggaactgccctttaatatctgggaagcagctaaaatacagccaaatcctatattattattgggtctcttgaattctcttgaccaacaacttgagaggaggtttctcctgcctgacactggagtttttgttaaagtctgtgcatagatgtatttctctgtttactccatgtagtagcattattactttgggggcacatttccaggtaagttcccacacactggagtttttgttaaagtctgtgcatagatgtatttctctgtttactccatgtagtagcattattactttggggcacatttccaggtaagttcccacacactggagtttttgttaaagtctgtgcatagatgtatttctctgtttactccatgtagtagcattattactttggggcacatttccaggtaagttcccacaaaagctttagggtctgtattacttaccagtgttcagggttgagaattctcttcttttgaagaaaaatttatatataatgaaatacagaaatctcaaatgtaccaaagtgggagttttgatacatgtgagtaaccccaaatctctactaatatataaaatgttaggttgccccagaaattttcctgtgctgattttttttaaagacaagatctaatggtataatattggctggtctggtatttgctaggaagaccaggctggtctctgcctctcatgcattgatttgaattaactatgctatgtgactttcctgacagaaccagcagcctaactggcagccagaagtagttgattaactacaaggctgtgcacagatctcttttttctttactaactgatactgtaggggagaaccaggtggcccttaataagatttggtgctcagtgcccttccctttgataattaattcacccagaagcatttctttttccagtttaaacagacattatgattaaatttatcagtttagatcaggataaaacaataattgttttatttaattgtaatttaatgttagtacgctttaaggaccagcattaagtggtggttctcttctctatgtatgtttcaaagtaaaacataatgctgctgagcagaaagtattcccggctcagtctgtagggtgagccttagttattatgttcagacccacactgaggctaatggctaatatagtcacaaaatgttccaagagtagtgtgtgcatgtctgagtagcatttagatgagaaaccctttggtttatttgaaaaaggactattagagcaaacaagttaagttatccccttgaatcctagcctctgattacagttgctttgtttgtttgtttgttttgttttgttttgttttaagtgtccatgaaggattggttccagaaatcctccaaacacataccaaaaatcttgggatgctcaagtacctcatatataaaagcatgatgtttgctctgggaagcatttctagttacccaggacacccaatgcactgcccatgctgtgtaaatggttcttatagtgtattatttaagaaatattgtaagagacatctaagaatcctcaaaacagagacagctcctcactctttgaagtatttgttgtcttcaaatgggtgaagttaccgacatggaacctatgcagtttcaagtcgaactacaatgtggtaaaagtcagatgggtctgatcccaggattgtgagagacattataggctagcttgtcagacatactgatggctagtccttgtccttagcaaacatgcctgtggctttcattttcttggttaatagcactgttgctgattatcaatgtaagcatccccaggagaatgcttaatccagggatttttcacactttagcactcatcataatcacccagaggaattaaaacacacattactggctccaccccagaatttgtgattcagtaggcattaggctagggtgatttccatttcctacaagcatccatgagacaataaagctgctggtctagggctgatgctttgagaaccactgctgtcaggaaggaaggaattagtaaatgaacgaattaatgggatggatttcttataccaggttccatttcttcccttcagtaatgtcctgtagagctgctcatggctaacaggcagggcccttttacgaaagttttaaatgggggagaatacacagcaacctacacaggaggaatttttttgtgctggggcttttcacagtcctaactgatcttgtagcagacaaagaaagaatccaggcccaaacaacacagcacagttttaattaactcactcctgtgtcagaaccctcaggaagagataatatgtggctatggaggccatacatcccacatttcccaaggacagctctgatttcacatactctgtccttttgtccccataaatataattgttagaccatgtcctgcttttgggctcagaaactattattcccatatgcatggcctaggggccctggcaagtcaaaagtgagcttttccttctttccctttagattgtgggggctggagtacaggcttggctcatagaaatgtctaaagagtggggatggatttcaacatttggaagcagcagtaagctgcgtgttgctcttgttttccccttgggtacaccagtgacccttctcaagatcttggactgttacagacaggaaaagtctgaagtgtcctgaagtggcactttcatctgtctttcactcttcccctctaccaccggaagaaccactccagagaatagtccacagccgtgatcaactgaccactccacaccatctaagatctacctccgtttccaggcagaaagttcttccttcttcctatcataagacatcttattattatttcattttctcacccccccacccgaccctgttttcaatcaaattgagaacagttggtcttcatccctaaatcctttaaatcctttatgtgcctaaaagtcaccgtacttaaaccatccttcctgggtccagacttaactatccttggagctcctttatcttccctgcacatatctcacttgccaactgtttaatcatctttgccataggaaagtgactcaggcaatctgggcagaaagtgcagcaaagcctaaagctttgcagcttgtcctaataggcatgtgaaatgtttagtggagcctattttcaagcacacaattgtgagcaatttaaggtggactgtacatggaacccatttcctcttgtggctcccccaacagggcctctccttagcagctgaaatgagttagcagcaatcagtgcagagtaggaatcctgtggtttctgcccttccctcctgctggtactatggcagctagtcttttttaaatgagctttctccctggtacagccagtaagtgggactttagaattggttagacaaagcattcaggcctcacctttgccaaagaataggagttactagtcttgaagctcgatggaaagttttaaaagcaactgggggaactgggcttggtggtgagcaggtattggtgagaagagtcaggggaggaaatggtacatctcgagattttaaattgtgtttgcaagtttatcagggccttttttctttcctttttctttttcctttttctttttggcctttgcatacttggcctcttcccactctctcaacccagtcaaagtgatggcaatagtctgtggcacgatcccagcctaaggctcatgaggtttctaaaacagaggatggcaatttgttgcacaatgggattctctttgttaggcagtttacctgcacatggtgggatgtgttcccacaaccatttaaaggttctgatgaggctcaggaggcctgccattgtaggtaatgctgcagtgtggagccagggctcttagccattgggagaattttgatctagcagatggtactactggagaaagggcaggagccaactgatagttcttcttatcttttctctactggctcttctgttttaatcaaatcttaaaagtcttctctttgtaagtgctagccaagcaatgtgtctctgcaaaactgcagaggccattaatttgtcatggtgtacatgtggaggaggagcagcaggaggaggaagaggtgagggtcagggaactcgttggcatttgtgagaggtattaaaggcttcttcacaggcagggacagcgactgtcttgggatgggggtagggagagcactttgattgaagcattagctaccttggctttgggccaaggcaaattgccagagaaccattaaactctgtgtaattccatataattcacagcagccacaggtaatttggatcagacctgacaaaacttcactatcacttattgtccattagtgccgaatgcatactacagatattcaggtattttaagttatatcatggtagccataataaaccccaaaacaggaaacatggcttgataaaggattattttctgacccatgaatttgtttatatgagaatcatgcaaaagcataaatatgtcaatcactaaatgataaaattcttaatctactgaacaaatggcctttaaataggaactagtgtctcatgaagtcagattggggcaaactcttctttaaacattggagaactgtatagacacaacttttaggagtcaaaacgaactagttaagcagtgccccaagttaaaatctggttcatactcatggtctgtatttgcttttagaatctttaagaaatactagactgaaaaagtctgttgtaatgcctgtatgcagtcaggtagaatacaggttattctgaatttccggatgctagggatagttaaatctcccaatgttcatggttattttgtaaaggcttatatatgtgctacattgatattccaaggcttaggatgttaaaaactaaggaaaatcatatcttggcacaaggtatttattgtaaagcacctatgtttccttaaaggcttcattccttacattaaattaggaatctaacagttactttttgtgcaattcatgacaaacaaggaatgttgagttcaaggttaaatatcctggaatattatgagccagcaataactctgtctgtgtgtgtatctttttagcaaaaacttctttgggctactagttaaggatggcaaacagcaacctatccatacaaaacaaatagttttgtcataacttcatcaaaggaaattctttttttccatttttattaggtatttagctcatttacatttccaatgctataccaaaagtcccccatacccacccaaaggaaattcttatacctaatatactctaacttgatcaagtcatgtgatatccctaaacctcaggtagatgatcagcaaagtaaaagtagaattatagtgaagaacgaagaaccaggcaagtaaattggacgatatcctgcagtcacttctattttcaatgaatatttattgactaactgcaagttgctctttacagacattttgttgtcttagatgccagcaatagatatgtaagaagagaatgtctctctctctcactagaatcttgacagaaagttaacctatatagaaataaataacatgatataagctgaggataagctttttggttgagctattatgatggaggttagtatggggaaaatagagaaggtcaagaaggctctctaagaagtcatgacttgagatgatacttgataatgggatttagacaaagaatattttcagcctggtcaacaggaaatgcaaaggtcctaaggctttccttccttccttctctgtagcacagaatgttggcaatgctgtgtgtgtgtgtgtgtgtgtgtgtgtgtgtgtgttcgcgcaggcatgctggatatggatgaaaggatttcagtaaactgcatagtcagatcacattgaacttctgagcttctgctatttaagttgtaagaatcattccttagtctgcctaatttaattagtgaacatgaataccagatattaatggtaagtttaagtttatacaggagacccaggaggcaggactgggacagcagaagagctaggaggataccagggaggactaggcacaccaggcaatctcaaatgccttagcagaggaatgaggagaagtggaggcctgttcaggagtgtttgaatgatgtttctttaggtgtggaacataaaacagcaccatagtgatcttgcctgggaagagcaccctcagtgccaaggggtgtggagtctgctggcaaatgggctccatcataattgggtgaataacaaggctttacttctaaacttaaggttcgagaactacaaataatcaggaataggaatactactactactactactactactaatgactaaagtacttggctcttttttgtctaaacttaacctaaaaaaaaagcagaaagaattgcttctgcattgctgattccccagatctggacatcaaatgcccatcagtttctcccctgccccaaagctaatcctggccttacaaagggaaaatgatatctgctgcaagaataatccatgccttgcacatctcaccgagcaggaagaagatggtgtgtcacttcacagttcctatgtgaacaggaaactcagaactaacagtgtgatggctcacttacttctagatttgcagccctctgtaaaagccacagcaactgtggcagtttaattgaaagatagatctgtcctggggcaaataaagaatattactgttactgccttcacactgtacacatctgccctgctttgtctttctgagcgagccttttgctttggtagcctggcagaggatgcagggaagttaaatgatccctttcttcttcattttccactgaccagagggatacatgtagagcagagattcaaatcactgcttcgaaaagggatcccagacaggagcaatgtttggggcatagaatataaatggctagctctggaaatcagaaagcaagctccatttcatttatgccacatctggtggagcacctcaagtacctactgaaatgatcaagtgggtcccagtgagcccagcaggccaggggtttccatggatggcctttagtctctcccctggagtttattcagtgtggtaatcccttttcggtcagaaatgactaatgctgaatttgtacactctttagctattaaactctatttagctttttttgcatgataggttatgaataatggcttcagagaactaccactgagttattcaatgagcttggcttgtggatggttcagattcaaaatagttaatcatatccttttggatcagaaggttgtttttatttcattcagcaggctattttgaaagtaggtttagatcagatcgatatagaggagctgaaaatgagcttgtatactgaactctaatgataacaacttcttccagaaaataggaggccaaattttagtatttaggtacgcccttccctttggttctgtctatccctgtctgccctatcccttgtctaccacatcaattttgtagattcctttgattgtttgtactactttagtcccaatcataccaagtagccaggaatcatgggcaattaaaacaaaacaaaacaaaacaaaaaacaagcaatgaaggtaactgaaaattacctaactatgattgtaaaggcatgtgaataatttgctgggagtgcttgaaatgttatatatattcatctaactgttgattatagaagacaaacatttcttaacatttattgagactcgtgtgttttactgtatttaaatcagcccttaaacattaaaaatttctagagttgacagcttgcatttctgtaaggcaaaacatttctggtaaatggtcagcttccataacagagctttaatgtatgaactgacacattccaagattctgttttgagacagttttcatccacacctgcacccggggttgacatttttccataggaaattaaaacaaggatcaacgcttcattttctttacctgccaactggtaaagggcaaaggtttggtttggtttttttacagctcttgtcacttctatctcagaatatcctaaatacaggatcactcctcattgagtatgagagtcaattgagtcattgagtattagcatcatttgctgctccccttgtctatcccagatacatctttttcttatggtccaggaaaacacccacctctagcagcttaacctcaccatgtcaagtcacacaggaaaactaaatcttctcacgcatcattactaccctctcatcagattgcccataattcttggctactcagtatgactggaactaaagtagtacaaacaatcaaagttgtgtgaatgtgtgtttttgtgtgagcacattgtataagaagccagataaaggcattggattgccagggcctggagttacagacagttgtgaccaatctaaagtgggtgctgggaaccaattctgtaagactaacgaacactctcaaccactgaccttatctccaccctctccccattgattagcttttactgttcctgatgttcatgtcatatcatatagactcatataatataccgagtctctttcatttaacacaatatgatgtttctgagattcatgtgttgtatagatatatactatactactttgtgtatatattggatatgggggcttctagagtggttgtatagttgtgtactcctgctagcaatgtaaagagttcaagttgctttttattcctttcagtagctagtattttgagtcttttatttatttttttgtcattctagaaggtttacggtgatatttttctgcgatttaagattacatttccatgatcaaaaattatattgagcatgttttataagcttctttagcatttggctctgttgtttagtggagtgaatgttcagaatttgttgccaattgttaattggctgtttgttgcagtttccagtattctaagtgtataatatattctagttttctataatctattacaattttatataatatattttgttcatattttcccctcccccaacctcctcgaaatattttctaccagtcctttgtcagatacatgttgtgaatattttcctagctcgtgctttgtgcttttgctttctgtggtgtcacctttgatgaaatacaagtttttgggttcttttgtgatttctgactttcgcatccttctcaagaagcctctacccacttcaaggtcacaaatactattcctaggaattcttcgaccagtttcactttctaaactctctaggcccatgatctatacgttttagggagtatttatatcagtaaaattgttttcagcatacatacccaataaaatgaattttacttgtggataatagaatgcatgtttaatgactttaatataagcaaaaacctctctcataaacaaatggcttgggttgataaagtgcacccctgctaagagtggaagagaccttccattcattctgatgcagtatggagggagtagaaccatcttctttgacagaaacaaacccagtcttacttttggttgctgagtaagccaccacatttaaatgccttgccctcattcttatcaacacattcctagagctgagcttggctctgggctcactgaggttttggcatggatgctcagattttgacttggcctagtccctggagaaatggaatgactcaaagctttaaatccctttgttatgaggctttgtaaactagatggtgattaagcacttggggaagatggtgtctgtagggatagatgacactatgggccacatcagaattctatttactcacgatcaggggattccttgggacagatccacaggacagctccttgtaggatttgcttaccggcttcttggctggcaaaggacttctcccctggtgtccttttcctcactttagatatatgttcaaattgttgttttaaataggacttattgtatattttaaactggatgtggtttttgaattaacatgtatttaaaagatagatttttgttttctgactttctttatggaataaaatagggaagatgaaattaggtgcagtagaaatctttgtttcgttttgttttctgtcccctagatgtttttagtgactgagagtaatttgagagacaagttaaggtagacagtgtctataaactagaatcagagtgttgacaaccatagcaaggacattgcagaggtttcaaagcccacatccgctcttctcagggcaccctgattaatttctcgtggcatgaagagatctcaacagatagcatcagggatgaggggaaaggtcagaaccagcccacaatctgaggtgtgcttatgatttcacactactgctctgaaggagcaaggactttactcgttcattggtgagtacatttcataatagtcaagcttgccaaagccagcttaccttcatctatacatctcattccactgatatcccataatgggacatgctgatgatattaaagtgctattaaaacttgaaaatctttcaaacatgctataaagttattcagtggtgtgtgtgtgtgtgtgtgtgtgtgagtgtgtgtgtgtgtgagagagagagagagagagagagagtttctgtgtgtgtttctgtatatgtgtatatatacatacatatgggctaatattttctgtttatagaaagaatgcatcaacaaataggtatgattttttttttttactttcttaaaaatagggacaaactggtggagtaaggattatggtctagtaatttggccagaatcttggagaattgactaaaaatgttttttttgtgacacatatgtttaaccataacatatatatgacagaaaatatgttattattaatatgttgttttcaggaaaataggtatgttctggctggttttgtgtgtcaacttgacacaagctggagttatcacagagaaaggagcctcccttgaggaaatgcctccatgagacccatctgtaaggcattttctcaattagtaatgaaggggggaggtcccagcccattgtaggtggtgccatctctgggctggtagtcctgggttctataagaaagcaagctgagaaagccactggaagcaagccagtaaagaaaaatccctccatggcctctgcatcagctcctgcctcctgaccttcctgattcccagtcctgactgtctattgtgatgaacagcaatgtggatgtgtaagctgaataaaccctttcctccccaactggcttcttggtcatgatgtttgtgcaggaatagaaaccgtgactaagataaggtaaaaccagagataatactgagcaaaataagtcagactcacaaatattttctcttcatgactaaataaaactccattgtggatatatattatattaatgcatatataacatagacacatttatgcatatataatataaacacatatatacatatttaataaatgatatgtatatatcatattttcttaatattctcatcccttgatgagcaccaaggcttcctaggctgattctataactttttttgcacatttttattagatattttcttcatatacatttcaaatttcaaatgctaccttgaaagttccctacccatccactcccacttcctggccctggcattctcctgtactggggcataaaaagtttgcaataccaaggggcctcttttcccagtgatggccaaaaaggccatcttctgctacatatgcagctagagacacgagctctggaggtacaggttagttcatattgttgttccacctatatggttgcagacccattcagctccttgggtgctttctctagcttctccattgggggccctgtgttccgtcttatagatgactgtaagcatccacttctgtatttgccagacactggcatagcctcacatgagacaggtataccagggtcccctcatcaaaatcttgctggcatatgtaatagtgtctgggtttggtggctgattatgggatggatccctgggtggagtagtctctggatagtccatcctttcatcttagctccaaactttgtctctgtaactgctttcatgggtattttgttccctattctaaggaggaatgaagtatccactcattggtcttctctcttcttgattttcttgtgttttgcaaattgtatcttgggagttctatgtttctgggctaatatccacttattagtaagtgcatatttaatgacttcttttgtgattgggttacctcactaaggatgatatcctccagatacatccatttgtccaagaatttcataaatccattgttttaaatagctgagtagtactccattgtgtaaatgtaccacattttctgtatccattcctctgtgttgagggacatctgggttctttccagcttctctggctattataaataaggctgctgtgaacatagcagagcatgtgttcttattgccagttggaacttcttctgggtatatgcccaggaaaggttttgctggatcttccagtagtataatgcccaattttctgaggaacctccagactgacttccagagtggttgtacaagcttgcaatcccaccagcaaaggaggagtgttcctctttctccacatcctcaccagcatctgctgtcacctgaatttttgatcttagccattctgattggtatgaggtggaatcttaaggttgtcttgatttgcatttccctgatgattaaggatgttgaacattttttcaggtgcttctcagccattcggtattcctcagttgagaattctttgtttaggtctgagccccattttttaatggggttatttgaatttcttgagtccagcttcttgagctctttgtatatattggattttagtcccctaccagatttaggattggtcaaaatcctttcccaatctgttggtggcctttttgtctttttgactgagtctttttcttttcagaagctttgcaattttatgaggtcccatttgtggattcttgatcttacagaacaagccattgctgttttgtttaggaatttttcccctgtgctcatatcttcaaggcttttccccactttcccctatattaatttcagtgtctctggttttatgtggaggtctttgatccccttagacttgagctttgtacaaggagataagaatggatcaatttgcattcttctacataataaccgccagttgtgccagcaccatttgttgaaaatgctgtcttgattttccactggatggttttagctcccttgtcaaacatcatgtgaccataggtgtgtgggttcatttctgggacttcaattctattccattggtttacttgtctgtcactataaaagtaccatgcagtttttatcacaattgctctgtagtacagctttaggtcaggcatggtgattccaccagaggttcttttattgttaagaatagtttttgctattctaggttttttattattccagattaatttgcagattgccctttctaattcgttgaagaattgagttggaattttgagtgggaattgcactgaatctgtagattgctttcagcaagatagcaatttgtactatattaatcctgccaatccatgagcatgggagatattttcatattctgagatcttcaatttctttcttcagagacttgaagttcttatcatcagatctttcacttctttagagtcacaccaaggtttttttatattattagtgacaattgtgaagggtgttgtttccctaatttcttcctcagtccgtttatcctttgtgtagagaaaggccattgacttgtttgagttaattttatatctagctaatgcactgaagctgtttatcaggtttagaagttctctggtggaattttttggggtcacttatatatactatcatatcatctgaaaatagtgatattttgacttcttcctttccaatgtgtatccccttgatgtccttttgttgtggaattgctctggctagaacttcaagtacgatattgaataagtagggagaaagtgggcagccttgtcaagtccctgattttcgtgggattgcttcgagtttctctccatttagtttgatgttggctactggtttgctgtatattgcttttattatgtttaggtatgggccttgaattcctgatctttccaagtcttttatcctcaaggggtgttagattttgtcaaatgctttctcagcatctaatgagatgatcatgtggtttttttctttaagtctgcttatatagtggattacatagatggatttctgtatattaaaccatccctgcatccctgggatgaagcctacttggtcatgatggatgattgttttgatgtgttattggatgcgttttgcgaggattttattgagtatttttgcatcgatattcataagggaaattggtctgatgttctctttttttgttggatctttgtgtggtttaggtatcagagtaattgtggcttcatagaatgaattgggtagagtactttctgtttctattttgtggaatagtttgagaagagttggaattagatcttctttgaaggtctgatagaactctgtactaaacccatcttgtcgtgggctcttttttggttgggagactattgatgactgcttctatttctttagtgaaaatgggactgtttagatagttattttggtcctgatttaactttggtacctggtatctgtataggaatttgtccatttcatccaggttttctagttttgttgagtatagccttttgtagtagggtctgatgatgttttggatttcctcaggttctgttgttatgtctcctttttcattttcgattttgttaattaggatactgtccctgtgccctctagttagtctggctaagggtttatctatgttgttcattttctcaaagaactagctcctggtttggttgattctttgaatagttcatttgtttccacttggttgattttagccctgagtttgattatttcctgccatctactcctcttggatgaatttccttcctttagttttagaggttctaggtgtgctgtcaggctgctagtgtatgctctctctagtttctttttggagacactcagggctatgagttttcctcttaggactgccttctttgtgtcccataaatttgggtatgtagtggcttcattttcattaaactctaaaaagactttaattcttttctttattttatccttgaccaaggaatcattgagtagagtgttgtttagtttccaggtgaatgttggctttctattatttatgttgttattgaagatcacccttagtccgtggtgatcagataggatgcatgggataatttcaatatttttgtatctggatgcctattttttgaccagttatatggtcaattttggaggagataccatgtggtgctgagaagacggtatatccttttgttttaggataaaatgttctgtagatatctattaaatccattggtttcataacttcggttagtgtccatgtgtctctgtttagtttctgtttccaggatctgtccattggtgagagtggggttttgaagtttcccaatattattgtttgagttgcaatgtgtgctttgagcttcactaaagtatctttaatgaatatggttgcccttgtatttggagcatagatattcagaattgagagttcctcttggtagcttttacctttgatgaatatgaagtgcccctccttgtcttttttgataactttgggttggaagtaaattttattcgatattagaatggctactccagcttgtttcttcggacaatttgcttggaaaattgttttccagcctttcactctgaggaagtatgtgtccttttccctgagatgggtttcctgtaagcagctaatgttgggtcctgtttgtgtagccagtctattagtctatgtctttttgggggtgggggattgagtccattgatgttaagagaagttatagaaaagtaatttttgcttcctgttatttttgttgttaaatttgggtttctgttcttgtgggtgtcttctttaattttgttggaggattactttttgctttttctatggtgtagtttcgtccttgtgcttgtgttttcccttgtcttatcctttgaagggctggattcgtggaaagatattgtgtgaatttggttttatcatagaatactttggtttctccatctatggtaattgagagtttgtctgggtatagtagcctaggcttccatttgtgttctcttagggtctgcataacatctgtccagggtcttctggctttcatagtctggtgagaagtctggagtaattctgataggcctacctttatatgttacttgacctttttcccttactgcttttaatattctatctttatttagtgcatttgttgttctgattattatttgtcaggaggaatttcttttctggtccagtctatttggagttctgtagggttcttgtatattcatgggcatctctttctttaagtttgggaagttttcttctataattttgtcgaagatgtttgctggtcctttgagttgaaaatcttcattctcctctactcctattatccatagatttggtcttctcattgtgtcctggatttcctggatgttttgagtttggttttgcattttctttgattgttgtgcccatgttctctatggaatcttctgcacctgagattctcttttccatctcttgttgctgatgcttgcatctatggttccagatttctttcctagggcttctatctccagtgttgtctcattttggattttctttattgtttctactttcctttttaggtcttggaaggttttgttcagttccatcacctgttttttgtgttttcctttatttctttaaggacttctacctctttagcagtgttcttctgtattttttaagtgagttattgaagcccttcttgatgttctctaccagcatcatgagatatgattttaaatcctagtctttcttttcgggtgtgttggggcatccaggactgactgaggtgggagtgctgggttctgatgatggtaagtgctcttggtttctgttagtaagattcttacatttgcctttcgccatctggtaatctctggagttagttgttatagttgtctctgattggagcttgtttctcctgtgattcggttagcctctgtcagtagacctgggagtccggctctctcctgagtttcagtggtcagagtactctctgcaggcaagctctcctcttgcagggaaggtgcactgatacctgccgttcagacctgcctcctggctgaagaagaaggcccgaaacagggcctgtcccagaagatgtgttgcctctgcagtctgcatgctcacctgcacagactagtctccaagggacactggacacaagatggctctctcacctgctctggtggtcagagccctcccaggcagacacctctcctctggaggggaaggtgaccggatgtctggagcctgaaacggggtctctcccagagctgtgtcgcttttgcctgttccagaagctgtgttgcttctgcagtccgcttgttcacccttcttagtccattagctgacctgtgcagactggtctctgaaggatctgggacccaagatggctccctcacctgctctgaaagatctctcctgggtgacacctcttctctggtggggaaggtgcccggatgtctggagcctgaagcgggggtctatcccagaagctgtgttgcttctgcctgttccagaagctgtgttgcttctgtagtctgcactctcacctgcgcagactagtctctgaaggatccgggacccaagatggctcctgattctataacttgactattataaatagtggtataacaaacatgggcatgcagatacctctgtagtttgctgcctttgattcttttgaatctattcccaggaagggtataactgggtaattcggtagttctatttttagcttatgaagaacatcatactggctgggctaacttagattctagttagaagttccctttccccaaatctataatttgtttaggtgttttgttttgtttgtttttatgattcccattctgactggaataagatggagccttaatataactttaacatttaaatttatttatctgtgtgtgggtatacatgtagagaccagagaataactctcaggagtcagttctcctctctcaccatgttgttggagattgaacttatgttgtcaagcttgcctgcatgcacctttgtctgctgagccatcttgccagcccctaaatctaattttgatttgagtttccctactgcctaaagatatttattatttttacatgtatttattggatatttatatttcttcatatttttatgatgttcttataccattgtcaaaacattcagcatctgttggctattattagaactggtattttttttttcctactgaattaagttttaaaatataaacctaacctatctgtttctttctttggcttttgttatcttctaaaaattattttaaaagatctaatatcttttaaaatatctgctcatatttagctaaaattcatatttaactaaatatccactcatatttagctaaaattcatatttaactaaatatctactcatatttagctaaaattcatatttaactaaatatttgctcatatttagctaaaattcatatttaactaaatatctgttcatatttaactaaaattcatatttatctaaaattcagcaagtcctgctaaacccattttcctctgccttttctctctgaaggggctgaattaccactttgttgtcaactttcaaagaatttttctaaatatttccaaatcacctgctcattagcaaaaagagtgaggtttctgggatcttttttttttccattgtccccactgtgccttattaaccattccaacgttggaagactactccaaaacagaggatgaaaaccgaagagaaccgagagatggatgcaaatcagttttggttgagtagacaactgctaaagccaaagtgcaatgagaacagaagccaagagggtgttagcagaggtattttacctgcccttgataactttacacaggccactgtcttagttactttttttttttaattgctgtgacaaaacaccatgagaaggcaacttacaaaagaaaacatttaatttaggggctcaaggttgcagaaggttaaagtctatgaccattacacaggggaacatggcaacaggcagggaggcatgggactggagcaataagtgagaatttacaacctatccacaagcaagagggagggagagagacagagagaaagacagaaacagacagagggagaaaggtaggagattttcgaagcttcaaagtccacctccattatcacacctccaaggcctcccctcctcctaatccttcccaaagcaattctaccaaccgggaaccaatcattcaaatatatgaggccatgaaggccattgtcattgccattcaaactatcacatcggtaaatgttagatctgtcttagagatgtcatatccaaattgatcaactagtcaggcccccatagtttatcaataaggtaagggaatttacaaagagggaaaaatcactattccaaggtcaatcagctcattctagcattgtagaaactacctggcttttgtttgtatacctttcttttcaattttcagctacatggctattttctactggccaagttataaataaccctgaatgactatataaatggtcatttacactgagttttgtgatgtgtattgataccaacaattgcccaaaactttaaattcacaacgcatcagatattcttctcttttcttatataaactttgtaagaagtttagcatctatgatcattagtgagattgatgtatagttttgttggtagtatcctttcacattctatattgtggaacagattggtgttagctcttcgttaaagatttgataaaattaggcagccaaagcttttatttgtggggagagttttatggttgatttaatctcattgtttgttagagatttgcataagctatttatatagttttgacttaattttggttggctaaatatgtccaggaaaatccttattttctaggtttcctaacttttcaaataaagcttttcaaagcattccctaataatcctgtggttttccatggaatcttttgtaacattcccattcatatcttattttattaatgtgtatattatctgtattttgttagtttggcttaaggggttaatcagtcttacttgttaattaatttaataattaattaataagaaaccaacttgtgatttgaatgtgaaatgccctccatcggcttggggatttgaatacctgtttgaaattgatggcagttggtatagtatacaggtgtggccttgctggaagtggcaggccattgggagacaagtttgagaatttaaatatttgtgccatttccagttcaatctctctgtttcaagcttatgtgtcaagataggagccatatcgtgttcctgctgccatgactttatgcctccatcgagaactctaacccacagataagctctcctctatgtccccttagtcatagtgcttcatcaacactcccccacataatcactgggccccacataatcactgcgcaacattgatgggatggattgttcctttagtctcaatgtcattaatttctgtcctgattgttgttatttcttacaacctactgctctaaggtgtttgccttatgcttatttttctaaaatcctgatttgcatcatcaggatatttatgtgaattatatcttgacttaataaaataaaagtgctcctagctatacacatttcatataaatacacatatagccaagtgtgtttccatttatgataggaatttaaatttttcctccctgacttttgaatggctcattggttattcagtagtatactgctcaatctccaagtatgtatgtagattctgtagcatctggtgttgttgagttcttttatttaaacatgctctgataatccagggagtaatcttgatttctttttttttattagatattttctttatttacatttcaaatgctatcccaaaagttccctataccctccccgtgccctgctcccctacccacccactcccacttcttggccctggctttcccctgtactgaggcatataaagtttgcaagacctaggggcctctcttcccaatgatggatgactaggccatcttctgctacatatgcagccagagacatgagctctgggggtactggttagtttatattgttgttccacctatagggttgcagaccccttcagctccttgaccttttaaagacttgtttgggggctggagacatggctcaggtagttaagagtttgtactacttttgcagggaagtggggtttgatttttagcacctacatttaaacatggcacaactgcctaatactctggctccgttgggctctcacatatacacacattcacataacataattaaaaccataaatcttaataaatctggttttgtgctagaatggtatattttagagaacattccaagaacttctgagaagtatgtgtattgtggttttgttggttgagatattctatagatatttggtaggcctgtttgatttatggtgtagtttaattctgaagtttcttcatttttgtggatgatttttgtgggcgatttttgtgtaagagtgaggttttgaaactgtactattttcaggacttatcatcttttatgttcattggcttttaacaatgaaacattatttacaatagctacatcttaataagctgttgttccctttattaatatgtaatagtctttatctcttctaattttggtttagagtttaccttatcaaatagtccaatagctgtgccagcttatttcagcttctacttacttgatagattgacttccatcctttgagtctcagtcagtaggcatctttgatcctgatgtttctcttacaggcaagagctagttccatctagatttttttagttttgtttttaagtccagagaacctgcctgtgtctccttgatagtgagttaagagcatttataattaaggatattactgggagatgattgtggatttctattattttaatgattgcatttctggttgtctggattattgctttttcctttactttctcatgcattagtattaggggtttctgatttactgtattagatgtgatagatctcttgctacgtttctttttttgttcatgtctttcctatcctattttgaatgagacatttttctcccatatttagtatttcttttggtatcttttgcaatactaccttggttgtcatgaacaaccttgccttagtattgtttctcagtgtccttattttctatcagttttgagtgataaatttgctggatataacaatcttagttgtcaatcatttcatgctcttgtgcttttgttactaacaagagttctgacactattatgctagttctgcttttcttggagagtaagcatttcccccaatgtagcttttactattgcttatttgccttccagtttttaggagatttttaaatttgtttttgagaatttcatacctgagtattgtttttacaccattttcatacctctcttcccacccctctcacgttcccctactccctctcaaattattgaaatcttctctaattattttagttacatatatacacaaatattatctagatccattctgtttatccattctctcccctcccccttctctccgtctctgtctctttctctgctgagtctttagtttctagctgactgctaaggattggataacctatctggaagggttggatgacctatcaggaagctcaccccacaagagcactggttctccctttctctggagtcatttatttcctatagctcttcatctatggacaagggcttgtgagctttctccccgtctgagttggcaggtctactggtgttgttataagcaagtcttgtgtatgtaactttattgttgagattttatgggtgcagcttccctatcatgcttaaaagacattgtctcatcccttggctcttaagatctttctttttcacacatctgtaatgttctctgtgttttagatgtgtcagtttgggatgagcaccacacagtcagttgttctttgtatttgaccagttgtgggtttctataagagtttctacctactgccaaataaaagaaaaagcttcattaatgatgggtgagatctacacacacacacacacacacacacacacacacacacacacacacacacacatttataatagagttagaaattatactgggttagcaagttggcagtagtaaattctctatggtccataacctcgctagttttaagtttacaatgccaggcatggattctctctcgttgagcagaccttaagtccaattaaacagttgctgattatccccaaaatgtaagtgctgttgctgcactattgaggacatcttgccatattggtcattgttgtggttcatgggctttacatgggtaggaattcactgacctacccttttggcagcttgaatagtacctgtggatagtatagaggtcctcctcataagaggcttccacagaagttccatgggttcttaggcttgatcttttgctcttgtcctggatttctgggttgttgtgatcacttttatctggatttgtctagtttgttgcttggctgtagtatttccttgaccttgtactttattactctctcttctgcttggttgagcccatttagttgcttgagcttttcatttccaatgtttctattttttcctactttaatatcaattttcttgctgattctttgatatatactgtctattttctcatccactttgattaatttttcttctgtgttgcttaatttcctctctagtcttcatctttgttattcttcattctttctcttactttttccttagtaagaacatagtccataaaaaaatactgtgttctagctactgacctggaagtctagctgtcagagggatagaagaatccagacatggaacaggcgggaaatatagaagagaggggatgagcattaatgcaaaaagaaaaaaaaacccacaaaagttctgatggataaggagtcagttacacagcccaacaaatagcctgcctctacaaagtgactagtttgaggaatactttagtggctcttcaattaaatggaaccttatttcctaatctggatacacctgggatctggtgtatcacatacacacacacacacacacacacacacacacacacacacacacacacagatcacttgtttcttatccaagcatcctcatacacctgggatctggtgtatcacacacacacacacacacacacacacacacacacacacacacacacagatcacttgtttcttatccaagcatcctcagaattgtattgaacatatctattgtgaggaatattctgctggtgagtgaaaagagatgtggaatgcagaaaggggcaaacaagtggcctacaagcatagttcaaaaagaaatagtctctacctaagtgcagatagtggcagctgacatagcaatagggaaggtttaactgcagcattaattaagcattttaggttaaaaggtttttttatcttgtggcctggaaaaaccagatatcttgttgctataactgaatacttaacaagaggttctacttaacatcaatatacatggaagagacagctttttatgagtagcagtaatatggataattgagttgtatgaatacgaaatgtgtacagtaaattaagactaatgtgcatcagtggagaaaacctattagcattcattagttagtcctgtttatggttattttttaactgacaaaaagcctaaagcatgcctctcatgcaagccagaagaatgagtcattcaaaccaattttctgaaccggcaactacagtactttccttcaatttcccctgccagttctttgttgttgttgatctcggatcttttgaaacagagtttcagattgccaagactgaccttgaactcccaattcttttgccttcccttcactagtatgtgtcattgtatgtggcttagtaggtacttttttaaggcagacagtagtgtctatgaagcaataatgctaataacaagggaacaacgatgtaatcccaattaatttgctaagagttgttccctatttgccattattaggttgttttatattgaatggttgtccatgtattggaaaagtgtgtgtgtgtgtctgtgtgcgcgcgcgtgcgtgtgcgtgggcatttcaattggctagcctttaatttctcagaggttcattttttttaaagaatgttggattagcagcaatatatttaataaatctgcaatttacccagaatttcaatttatttaatagggctttaaaaatcctgaattaatatattttttctttcaactcaaaagatccttcctaactgacagttctcaaaagctgagcaacctaaagcagtattctaactggtgtgggcacaggttcagaggctgtgataaaagactgagggaaaaggttaaaaggaaagaagtataaacatagccacggtaaaagtcagcccctagtgatctcacttagagacttctatcccctaagagttctatcatttaatcattcttacttcccatattccctagaacacttaatgcgggtgggctggatttttatttaaccagatctctcagtgggcatataaactttagacaataattcccttctggggctgggagctgagagcttttttaatttgtgtatctctgccacttagtgtgtttattgttctgtgcatactaaagtacattaagtgcttggggaataggttaacgatggatgagatgtccccattactctagatggaattaatactctaacaggtggaacccacttctgtgctaagtagaacattatgtacaaaattcactagaaagccaggtcttcagggccctgctttgctttgcctatcctagtggctcttcctcctagttttgttttttccagagttccccagcctgaaaacgtcttctgccaagattaccctgctcgaagggaatgtttacattgtgctagattagtaaacacattcctagcttttgcagaatgcccattggcaagtagtatgctaggaatgtgttgaagagatgaagataatatactttgtacttacttcatatgtttaaaattagggatgctgattacagaattttgagctggaagccatcattcaggttttcagcaccaacctccttgttataataatcagaagtcatactgagttaagaacctatgggggacttttggtatagcattggaaatgtaaatgagctaaatacctaataaaaaatgggaaaaaaaataaaaggataaaatggaaaaaaaaaaaaaaaaaaaaaagaacccagagccctcaaacgggtgatgaaacaatcaggcgaggtgggtgcttttgctctctacagtatgcatacaaggaaatttgatgccaccagtgttaggtaaccttctcaggatctcacagctagaaagtagtagagccagaattcaaacacaagtttgtcagatttcaaagcctgtgtaaaggtaggaaaagatttgccgacgtttgatggagctctgatttgtgtgcacagtttgcaatgccatggggctgctttagctgccatatggacttcctttttttttattagatattttctttatatacatttcaaatttcaaatgctatgccaaaagttccctataccctccctgcgtcctgctcccctacccacccactcccacttcttggccctggcattctcctgtactggggcacataaagtttgcaataccaaggggcctctcttcccagtgatggctgactaggccatcttctgctacatacacagctagagacacaagctctggaggtacaggttagttcatattgttgttccacctatagggttgcagacccattcagctccttgggtgctttctctagcttctcctttgggggccctgtgttccatcttatagatgtctgtgagcatccacttctgtagttggcaggcactagcatagcctcacacgagacaactataccagagtcccttcatcaaaatcttgctggcatatgcaatagtgtctgggtttggtggctgattatgggatggatccctgggtggagtagtctctggatagtccatcctttcgtcttcgctccaaactttgtatctgtaactcctttctttcatgggtattttgttccttattctaaggaggaacgaagtgtccacccattggtcttccctcttcttgattttcttgtgttttgcaaattgtatcttgggtattctaagttcctgggctaatatccacttatcagtgagtacatatctagtgatttcttttgtgattgggttacctcactaaggatgatatcctccagatacatccatttgtccaagaatttcataaattcattgttttaaatagctgagtagtactccattgtgtaaatgtaccacattttctgtatccattcctctgtgttgagggacatctgggttctttccagcttctggctattataaataaggctgctatgaacatagtggagcatgtgttcttattgtcagttggaatttcttctgggtatatgcccaggagaggtattgctggatcttctgattttattatgtccaattttctgaggaaccgtctgagtggttgtacaagtgattttcagagtggttgtaccagcttgcaatcccaccagcaatggaggagtgttcctctttctctacatcctcaccagcatctgctgtcacctgaatttttgatgttagccattctgactggtgtgcggtagaatctcagggctgttttgatttgcatttgcctgatgattaaggatgttgaacattttttcaggtacttctcagccatttggtattcctcagttgagaattctttgtttagctctgtatcccattttgtaatggggttaaggacttccttctaagcatccctttctttttcagaagtactgtcttcccaggttcattctttagggaggaattgccttaattctgtctcgtctccttcctcaagagccttcaggaacctgtgatcagctcctcatctcttctttctaaatgaaagtattccccattcctacttgtggctacaaggttgggagaagttaggatgtaaaattatggagcagaagtcagctcaccacctgcttcctgtttttttctctgcaacacagattgaagatggaggcaaggcagccttgtctcagaagatgcggactggtgatgagctggtgaatatcaatggcactccattgtatggctcccgccaagaggccctcatccttatcaaaggctccttcaggatcctcaagctgattgtcaggaggtaaggcacaggcatagaggccattgaaaagtactctatcattatcatcaagaaaacaggtatttcatctgtgcagaatagtgcagacaactaaagaagaatggacaaagggcctttggttcatattttgacactgctgtacactcattgcatgcattcatgtaaatgcttcttcagaactcatttgttcttctgaggactcagtgactcaacacatgcaaggcacttccactctgggctcctggagctcaggcttcccttctcagtggtcgttttcctgtctttatcttatatacataccaaagcttctacatcattgttattattaaaaagtgattattagagtatatctatgatgatataaattatttataatctattattagaggaaaatgtaaattaccttccatgagctttctttctccctctggctactactgttttcctccttttgtttttagtgagtcacaaaaagcagagtctatccttcctgcatatacatttttttccttctcttaactttaggatccctgtggtctgaatttggcacctgtaattcaagtgtaatggctatcaaaggcacaaaatgttgcctcattgtcagagccagtatattattttcagtccttatcatatatgacatcaaaaggacatttgatagttggtccacattatgaaactcttttatgaaaccctgacttttatcatagtctatttatgtcattgactcctacttttgtggttcctattttaactggaccccttcattactaaaccattcctttgaccatcctttaaacattgtctttttggccattctaccttttctaacttcatcataatatagaaatgattatatggaaatttttaccagctcctcctctttcaatttgtatttatatggggatgattctgtgtcttctgtcccagaccagataaccaatttcatcttggacatttacactgaaatgcacatatagcattccaagtacagtatgctgcttcaaacctaacatatcactatattgtccacaaaagcttcctatcttgctaacaccccagcaacaaacccagaaggagagctagcatcaattcttttattgatcacatataataatcaatttatccagtctttttctaaaagagaaaaggtaacagtattggatacaccggaaggattatatagcatcccattggtttactgcatgatcttctgctacttaacattaagccatgcctttccagatataggcatcatggtaaatagtgctgtatactgcataatagctacaactctcactgattccatcttgtatgaatggttccttttttttctattctagggatggaatccaaggccttaagtatgcttgctagtcaagtcttttccactatagataggttggttataatttatattttaagacttcatacaaggaccacttgataagggttcttccttagtatgtgatagactcatggatgttactcctttgttctatcacatggaaattagggttccttgcatagtgttattattgtgaagattaaatgatataacttatacaaaatgccttttacatagtggattttccctcccaagtcctaaccagatctgaatgtgcttagcttctgagatcaaggtggtttggccgtagacacataatgctctatcagggaatttcagttctcttctctgaggtactgaagtagagcataattggggtaggcaaacactgttagtggggatgtatcagaactgcaatgtacactataccctagtctatagaatttgatttgctgggtaaacaattaggggcagccaatatctgagcagaaaacatggcgcttggtgagatgctggttgtagacaggcaaatgcactagtggagtgtgaataccatcagagacgtttgagtttactcccacagatgaatgtgaagatgcagggttttaactgctcaccttgtcttcattctctctactggcactagctgccactacagagcctcacttaggagtggctatagttataaacttggagatagcaggggcctttggttttcatgatatgaaaggcacgatggcttgcagtacctaccttcctttctaccttttcagcacctccacttcagccctttctgcttgaggcattcaatgcataatttatgaagtggtgctgccctcttgtggaaaacttaactttcccttctgacctgctgtgggcagggtgtaggaagctatagttactaattttttagtcacagtttcccctccagtttataaaagaggtctctgttcttcataaattagggcataacagaagtgcgatgtgcttatactttataagtgtccatcttattgacttagacttgagtaacacatggtttaagtaaatcactgacaatgctgggcttcaggtcttgccttaagtcctttgaaattcatgaccattcaaaaagactttagaaaatggcttactttgaaaacccaatccaacttgtatctatctatctatctatctatctatctatctatctatctatctacctatctatccatatcagtcaatcaatcatgtgcacatgtatgtaagtgcagggccttgtatatgctaggcaagcatctatctctgagcctcctcttgtctcaccttcctccaatgtaagtaatttcacgccatgacatgtctaacgtgctctaaacctctcttgttttgtcttaatccaatcactcctggtttctcacctgtactattttgagcgcctacccactggcttctcagcattcagtttcatctatttccaatcactccatgctctgaaaaggcatcttagcaggccacttctctacttgacaaaaataaaaaataagaaccataatgccgtgctgttttcaaaagatttattttatatggatagactatttaaccacattaaagacatcatagtcataagccgatttgaatattttgttatttaaaaattttatgcaatgtattttggtcatactcattttcctccctatctattctcagatctagtatcccagttctatatccacccaactttgtaccttcatggatttttaaaataattaccaatccaattaatgctgtgtatatactcctgactgtgtggtcatctactagaccgttttcatctaccaggggacacactctttaaagaatctaccttttactctcctcgcagctattgagtactgccagctcctcagctagggctaggactctgtgactaagtgatcagtttgaactaaaaatcatgatatttaaatatatgaagtaaactatgttagcactgtataaagaacaattatgaaaatatctgtattgaagacattgatataacttaagttagaaaacaaagaataccaaactggaaacacttggaagaattgaaaaacatgtcattcattctagttaatacaatttataaatattttatagatagtttattattttccagtatttttggaacatctaatctatgattatatgctatgctgcagagaaaatatatgcaaatttttagcagaagtaacattgggtttgtttctgataataatgtacaaagtttacaattttaaacaaaaatctttaaacaaatttaatacatgagaacacatttgcatgcaaatatcagatcagagaaaaatagcaaactaataaaaataatcaaggtggaagcatgacttgtcaaacttcaagattagtattcagaagtgaatttataacagatattttattaaaaatgaagaatacaattacatatctaaggatctattataatattgatgccaagggcttgattttgggaacttgggagatggattcaatagataaacctctatcaaatttaatcaagtaaacaaagatgaatcatgaataaaatttaaataagtgataaataacatcctagaaatagtttctggaattaactacagattacattgactatattttaagaaatcttgaaatcacagagaaatttaacatatctacttcagttttaaatgccagaattattgagaagctgtataataaaaggacctgaaacaacagaaatgtagaaaatgacactaatacccaaacagaaattctcaaaagtaatttgggttcacatactttgaataccttcaaagtttttgcaatagcctaaactctattacagtgttatcaatctgaaagtgttgtagaattattcaggttgcttttaaagctagcattattttgatactagaacccactgcactgcccccacacaggatcctctaattattgagttttggtacataaagtgcataaatatgagtctatgaaatataatttagaaccataggataatagtttaagtgccaaaatagagtttttggaaaaaggtaaaatcttgactcatacagacttagaaatgaacatatgctgcactttatttaactctaatgagcaaactgtaaggtgttggaatcagtttaaaggcaaagtcaaagaaaaacaaatttaatttaaagataacactagacctcaataaccagttaaaagctacagaaagaaagacctccaactcagaacccttaaaaagaaatatgcatgtcatataaaggacatatgtggatgacttttcaaaacaaaatttccactgaaaatgtacactaataattttgattatctgaatagcccaaagacattgcataaaatggtagttacatagctgatgatacagctctgtggtagagcacttgcctgccatatgtgaagccccaggttcagttttccattcccagtaccataaagcataacaaagaaaagcttagtggtagagtgcctacttaagcacaaggcccttgactcagtgcccagtagcaaaaatcaataaacaaacaaacaagcaaacaaaataagcctggagggcaaaggaatgaaagaaaaataatgggtatattatagtgataggtttttgttgttgttgatgatgatttgggattttttgttgttgttgtgttgttgttgtttttatttgttttgttttgttttaccacatgtgccacattagcatatttccgtaatcccagtacttgtggttgtgggacttgggaagaagagacaggagaattagaagttcagggatagccttagatacataatgaagtcaagaacagcctaagcaacatgagaccctttctcaaaaaacaaacaaacaaaacaaaacaaaacaaaaaaacaaaccacaaaccaagaaataatggaatgagcagtatttttacatgcattggcttagttacgcccctattctgttgggatattctttaattttgaaattcaaatcagcctttattattctgttttccttgtaagtgttatcagtcaacctccagattatgtgcccatttgtatgatgtgcttttgcatctagttcgtggtcatcttttctatcacaattcaagatgccatactgagaaattctatcgttcttttagatggacaaacattttatagttttgggtattcgtcttaaggaatacttccttctgtattaacaacttactctcttgattgtgcaatggaccttgccaacctcttccccagccctcttgaaacaaactcttacccaggttggtcttgaactcatgatcatcctgcctcagcctccaaggtcctggtattataggcatgcagcaccatagttagttcttgtaagcatttgagccatcaatatttgttaaatgccaggcttttgcttgagtttgaaaactcaaacatgaagaacatggttgtagtccttgctctcattgacccttgatacctacagtctttcttgtccacgattcctcagtcactgaacagagaatatagtttgtgactattatttcaatttttctaaagaagatacatagatccattagagagattttaattatatgatagatgttttagaactggtgctcattagtgaatatcacgtaggaagttgttacaaatgcattttattggatgctatattgggtctaaatgaatcaaaactcttggttagtgggagttattccagttacgtattttaatcacatttccaaattaaaagccaacagtttgtgaaacactgccttgaggcatcaaggttcaattctccagaatcagtagagaaaaactaaatgcaaccctacagtaactacctcgtctctattcagattcaatttcacacattcagaagaccaatacaaatcatcacagaaaaatccaacaggaaattcaaattctgactttctgagctgcatatgaaccctgttgatgaaaggctggttcaagggagggtgcagcatatgaccagaatccctgcagtggggagtataaatctgcaggtatcctctagtcccgtacccacccccatccccagtagtagttgatagcatcaccatctacttggacattcaagtgagaaacacaatagttctttagtcattgttgtctgtcactgagagctctatttaccctttagacagtcccacaatctgcactctttattctctctgtgactactccagtacagtccctccttgtctcttcttgaactatttatgatcctcttagttgtcttagatctatctgctaaggtgttagtacaaagatgagtccagaatactgatccaattatatccatcccctgccgaaaacctctctgaccttccttgctcagagggcagttaagaagagtgagcgatttatcaccatctctgctcacacttgaacttctagggtaatgaagtttccaagaatcttggatatcattctgattaccaactgtatgattctcgattttctacttcttaccacagctgctctaagttcatctgtgcaacagccatatcgtatccagaggccagcatttcccaacatatctccccatcctctggctcttacattgttttctgccccatcgtttgcaatgtttcctaatctttgggggcagagacactgctgatgtagctctcctgtctatggttgagtacacacagattctgtttcccagcatttcaacagtaatgcgtctctatattaactatgatccatataataagaagcttctctgaccaaggttagaagcagtacaaatctgtggacataaacagaaatatttaaaaggcagtttaacatatagaaaaataacatccatgtgttctgccaaagggcctatgacttcactagacataggttttcatccatgtccagatgtatttcacccatgtatatgttaccaggtatgaattcactcctgtggagcaggtaaaaaccccaaccatgagaatcattagttagtcctcataaacaggcttgcagctatgacaccagtgcatacatcttgcctggcaggttagtactagaacacacagggtccagagctgaataaaatgatgtcttttctcccccagcagcctgcaaaacaccttccaaaactacaaaagctggctaacagagagcatccttgtcagttcaagactgattttctgtgtcctgcagcggatgtgtatgatgccttcagcaaatatggtgttactatctagttatagtgggtgacctaaagctaatggtaatagcctatgttggttgggttgcctctggggcctctctgaccaatacatcataagcacgtataacccatctgacagctaggctacaagaatcatgatagtcattattcattgttgtgtctttatcatgtagtgctagtcatagccacttccctgtagcagactttgttcaaaaaaatccttgagtcttttctatgtccctatagcaggatgtagaaaaaaaaatattcagtctaccttagtttataaaacttaaatgtaaaaatgggcatgtatatcacactcctgttccaaagtttcatgaaccattgtagaagggggacagcaaagaaatcgtaagccagaggtcaggttctgggcatgcccagaacttaacagtatcttctgaatatgacaggaccatatgcagtcatgagctcacagcaactgtgtttgcttgcacagttgctatacaggatcaagttagtcaaccttccagtatggagtggggaggggataatgagccaccacccctagctgagaagctattgacaggtgatgacttctggggactgtagagtcagttttatttcagcgtgtggccctggataggttgagcatgatgctacgtcacccatgatatatgcagtataaaatgggactcaatgcattatagaaaaatgaaggtaaggacttagtagtaggtggtgggatggagggtgaatctgggaagggttggaggtaggagcaggagtaacatgatcaaaatacattgtgtatacacatatgaaatgctcaaagaattaataaaaatattgtattttagaaaatgaatatcaagtatcttatgtatttatacttttataagtatttagtgtctgtccctttacaaaatagaagactttgaggctccatataatggtttaaaaaaaaaaaaacaccaagtggttttgaacatggcaggcactcaataccactgagcctcagaccttcaacttggccatcctttctctttgctatgttgctcctacatctagaaagttttctacatttctttgctaaaccaaagactggccatactccagaatgaagcttcaaccaaaggggccatgtcgttagaagtacttgcaatccctatttcatctgagttttctggactgtagactccataactctactgaggccaataatgaggtaggccttgcctatggccatggaactcaaaatgatgatgtaacactaaaagccacaatttctgtcaaccaattggcctttctactgtttcaggagtttttcaacacctttgctccctcctctaggcagccttcctgcacttgagagatgctactccttcctgtacccacaataagcctgggatcctatcttttaccttaacttagacaactctggatacagaagactgccagatcctttccccagcttttacttcttcctgctgagctccagatttccattccaagatgtgcattgcctctgtcctgatagcccattatactaccaccatggcattgttcccatctctataagtcaaactcacaacgagagagaatctcttcaatttcttttttatactccaagtcctttctgagtttccctctgcagtgtttctaatatccatgccatccatctccttcaccttcttcctactattgcctgggactcattacctcttatctggatgccctccaacccattctttgcacttctgccaaattaatcttcctaaagtacatcaaagtatttatttcaatcagcaataattgttcttcgggtaaacctcatgagttatgagatctccattgtgccagcctgggtcatgtaattccctttctcaaatatgccccaattgtctccagaaataaatacaagtattccgtcttagcatttatgaccctctagagctggctctacaggacttttttttcccatcttatcttcctgaaatccaaaagagtgcaactttccctttgcacattcttttccctgtttagggactcttattgtcctcttcttggaaaatacgtcttcaatttctattctcccttgttgtggtattgccagcctgtcatctttttttgtcccgtttcttttttctctaatgctacaaacctgcatgggttcctcccattttgaaaataggtattcacctttaaatatatttttttaaaaacctgtctcttgtgtacccctacaaacataaatagttcgcagtaaatccagttttctccactctgatttctgtgtttaattggtcaagtcctggtcatttttatctactgaaaagtcttccatttcctctttctcatttgtgttgtgaatcaacaccttagcatgttacctatcttcagtattgtcattctctttacctcctaaatttaatcttctgtcacaaccagagtcatcttttgaaatgcaaatcttgtgatgaactcattgcttgccaaaaccacccaaggctgcccattgtgttcaggataaaatccaaactccttaacatggttgaacaggcctcttaattttctgtatctccaccatctgtgcaaaagcttgcactctaagttacagccactttcaactgcttatacttcttcaactctagcatcatttctcatatgcctttgcctttttcacatctgcttcctctattcaaaatcatgactcttgtctcctttgctttgctttgcttactcttactcaaccattccaaatcaattttaagctttccttagccagtgcagccttgaaatgtattctgttttttcacatagacaacacctctggtttcctgtattgaggactgtgatagcatgcttgcttgtctgatttcccatgtgagttttgggcaaaatttatatgatgataattcttatatcttcatcatggccatcctagtacctagtggattgattgcatgccaagcatctactttattgttaactgagctgaacatatgtgtgccaagcaaggaagatgagagtcactgttatgaaaagtggaagcctagaatatcaggggtgttggatttctaggtatacaaatgcttgaaagttgaggttgtacattcagtaaaggaaagatatgaatcaaaggtaagtccaaaatttcacaacaggctagatggaggtataaggcattaatttcaaatatagtggtatgaacttgaatttactgagcagtgcacttgacacttggttttttccaagacagggcttctctgtgtagccatggctatcctagaactcattctgtagaccaggctagcttcaaactcacagagatcctcttgcctccactttccactttccaagtgctgggattaaaggtgtgcaccattactgcttggcttatatttgttatattaaaaggaaagaaaataattttgaaaatgcaggatttgaaccatctaagaactccaagtagaaattataataggtacttgcaactatggttctagaatatagcaaagatgtttgtactctgtaattacataggaagttattaggatagatggtaatttagggcactgagatggatgggattttccagaaacagaagtaaaagaaaataaatgggaaaagtctagtacttaatgcttggtgacatatatttattagctaagcacagggagaagatcccttcattaattaatatgaggataattattgaattcatattctgtctatgccaagtactgttgtgggaactgaggatacagcattgaacaaactaatctttcctcacacgaatctgatcttctaatggagatagataaacagttactatagggaaacaaatatataccagcagtgataggtgctatgaaggaaaatgaagatgtgtaagaacacagaaattattaatatagagattctacttaccattagcaatagtgttagggtttggtagctgcaaatgggatggattcctaggtggggtggtgtctggatggcctttccttcagtttctgctccatttcccccgctgtgtttcctttggacaggaacatttctgggttaaccatattgagatgggtgggtggccccatccctcaactgggggccatgcctatttacaggaggtggtctctacaggttctctctcccctttgtggcttactttggctaaagtaatccccgtttggtcctgggaacctcttgcttccctggcatctaggactttctagtggctacccccagttccccatcccctactgctacgtatttctagtcaatttcctgactactcctctctagtcccttccaatacctgatcctgctccacctttttttccttcccctcctctctccctccttctacctcctgtgattattttataggattgaagcatctacattttggactttcttcttcttaagttctatatggtttgtgggttgtaccagcacctgaccaatgcagaagcagattctcacagccaaccatcagattgaggccagggacataaaggatgagttaggggaaggactgaagtaactgaaggggattgcaaccacataggaagaatgatatcaactaaccagaccaccaccaaccaaagtatacacatggagggacccatggttccagacacatatgtagcagaggttggccttatctgacatcaatgagaggggaggcccttggttctatggaagcttgatgccccaggatagggggaatgctagagtagtgaggtgggagtaggtgagtgggtagaggagtaccctcatagaggcaagggtggggggaggaagggatgaggagtttgtgaaagggtaaccgggaaggaagatatcatttgaagtgtaaatgaataaaatgattaattaaaaaaagatagagatgctagaggcaacaggaatagaagagactttaactagaccagggatggtccttatgcaggtgtgtggtgtgtgtgtgtgtgtgtgtgtgtgtgtgtgtgtgtgcatgcatgcacgcatacatatgcatggaggccataggttaaaataggcattcctctatcattctccatcttattttttgagataggatctttcactaaactcagagctcaccaattggttagatggtctggccagagggatctacttgtttctacctgcacagtagtattataaacacgctccccggctcacacccctgactttcacatcagtctgagtgagctgaacttggatcctcttgcttgcatgttaggcacattgccaactgagctatcttcccagcctctatctgaagatttgtaagtaaaaaattaaatgatgagaaagatgcagctctatgaaaatctggggagaagaacgtcaagtataaagacctttaaatgtagaaaaacataatatcaccaaagcttaaaacaaacaaacaaaataacaagaaaattgaaactggagtacagtaaccaagtaaatgaaatatgaagacagttgaaattgaggaggtaatcagaaacatacttgcataaggacttacagggtctgatagaatcctaaatgtgttatactttgttgggggagtgttaaagggctccaaacaggacaatgttaagattgttctggctactgtataaaaatagggagcagggagagggaccagcaaacactctcaggagattaattgctgtgaatcagttaggaaatggtggtcaattgacttcaattttgtcaaaaaagatggtgaaaattattagatttacaattggtttcagaggacttattgattggtgaagtgtgatttagacagggttgtggcagagaatgaaaaggtaaaggttagctgggcatggtggtgcacgcctttaatcccagcacttggaaggcagaggcaggcggatttctgagttcgaggccagcctggtctacagagtgagttccaggacagccagggctatacggaaaaaccctgtcttgaaaaaacaaaacaaaaaaacaaacctgaaagataaaggttacaaagtccttccatttaggcttgaataactgtatggtaccagttgctaagacagaaaagactggagaggtcggaaataagtttgagaggggtggggaagttcaacctaattgtttgaatctatgcatattaagtttggcaagtctactaattttaagtaaaagagatatctagagctcaactgaggaagtgggtcaaaattgaatatccaaattttggacttaaccactaatcactaaagatttgagagtagatgatcttgctaatgaattaaatataaacagcaaagaagagacattattgcacatcccttagacagtatgaaaaagagtaacaaaaagagtaagttgagatgtgccagggacgtgctacaaaaacctcatagcagcatgcattagctctagtgaagatatggatttaaaatatggattaagggggagagagaaagagagagagctcaaacgagtcaagcgttggtgagacaccaattctgagaatttactattgattttggcaacatagaggtaattagcaacttgaacaatggaatttggagatagaagcctaaatggattgtttgctaaattaatgggaggtaaagaaatgaagtattagcttaagaggcagttagaagaaatatataaaaattttatttgtcaattattaaaattactcattttactaagagtgttttcttttaaatcacaatcataaagtatctaactactaatgaaactaatttcataaaaacagataaactgatgctttagaaaggaagaaataatgacagtaaggtctttgagaatgttagaacagaagtagaaaagaaaaaccatcggtaaacaagagcacaatttacttcatagcaaggccaggaatcactgacatggtggtggggagagacccctttatatattgcttctaatttttaattaaataaaaggggattccatcagctgagagttgggggagtaaacaagtttaaaatgatagaaaaaaaaggcagttagtcacaaaagaaggaaagtagaagaggctggtatcatgtaagccaagggattgaaaggagtgatccatcaaccgctattgttgaatcaagtattgcagtcaagttagatgaatactgaaaaaatatactattgggttgcggaattcagaggttattagttggttttggcagaaaagctgttgttaacatattaggaactgaaatgtgagttgactgggtgtgtaacttagtggtatatcacttccctaatgcccacaaacccttaattccatccctagcaccctctccaaaaaacgaggcaatcaaaggtgaggaattacacatgtagaaatgttttgtggtatagggggtgttaggcattgggcaagatcggtgagtactgtaccactgagctacatcccagctgaacagtccttctacaagtggaaagtggcagaagtaagctgtggaaaggaatctacttacattatgtactagactgaatttcctgcagaagagtgacctaccaaagtcatatagtcacttgcccaagatatgactctgctggtttccaacagatgttaaatatgagagtgaatacattcacaaatcctgtatccaaataaaatcaacagaatcccttaaagtgtcctatgagaaaactatctgcttgcctcttccaatagatgtatttggaaaaatatctctaaagacatatccctttactgcagaagaacaaaacagtggagatgacaagatacagttcaaatataatctagggtctctaatacctatcttctccctagaaaagatagacatctgctaagtctaacctaagaactccaaggaattatttggtgtttctttgcagagagtagggaatacttactgatacccaaagctgtattatagtttcccctcagagtagcttaacagccacagtggatgggagagggaagtgtgtataataggcttatatctatctgtatttgaatggtataaagtcggccacaaataggaatagcatagaacgagatcagggtagatcagatcatggatagatgaaatcaagacagtcatttaagcttactctcagagaaactgaatcttgacagcaaaataattctgtgccgtgtgctaaactttggaagtaaatactggtactctgccactgagtcattttaactattaataactagacaggacgatgtcattgaaaataatgtagcatgatacaaggagtggttttgccctattcccagagggctagactggatggaacctaatcgctttttcctacactaatttggctgattgtgtcagagaaaaaaaaaaacaggccaatcattttgtttgttttccttctgttgaatgactcacacttgaccacaggcatccatagaaagaattcccattgataggaagataacagaatgtataataagaatccagtagcttgaaaggaagaactccccaaaacttgaaaaatcattcagggacccctaaagtactatagagttagaaccttgagttattgaccatctatctccagaatgtgtagcttcagtgcctggatgacagacagcatttgaagattgaatgagtaaatgaaaggttggttaattaatgaatggtaccttgcgagagaacagctaggaataccaatataataagataatgaactgataggtcagacatgttatctttatgagtcaccttatgatttcattttcaatgatttcttctgaggatgaaattaaagaatttaggtaatatacttggaatccagcatattaagttgtattagctctttttgcccaactcatcctctcatataagtcaaaggtgtttctgtttgctttatcaaatgagagaaaattacgctttgctctttaaaaaagaatcaaagatattgatattaaaaacagcttagtttaacattaaccaatatctgcaagaaattttagggtaatttaaaaatatttattttagttttggagattataattactttctccttttctttccttctctcgaatcctccttgctctcttttaaatccatagtctgtctgtctgtctgtctgtctgtctgtctctctcttgattaaccattgttacctgcatatatgtatgcatgtctataaacaggaccaggaagggtggtctttcaccttgtcttttatcagtctgccacaaatctaaattaaaataaaatgacaaactctcctggcagcataattttattcttggaatctgttcaatatcccaaatactggaggccgcctctcttagtgattaactgtccttcacaccatgttggccacagctgataagctagctgttcccctagccttggctgttggtgctaaccagtgggaaagtccaaatttacatgtttcactgcctcactctcagatttcctccttgagttatttttatcctgccccactagacagaatttctagaaaaaaaaaagaaaagaaaaaaagaatagcttcatttaggaagtgacagcgctaaggataaaaaagtagatttttctgtctttccttaacaggagactttttcagccttttctcttttaaacatcttctcttccttctacttttgagcttttaaagctccagttaagagacaccaccttaatttagatacaataagtgacttaattaacatcccagactggctcacttcctttaacaacagtgtccaacacatttttttcctctgaaatgttttattttcccagagtctcatatcccttgcacagaacagaatgttttgaaaaacagtcaaacagttttatcagacgtaagtggtcctatcacaactctaaagatgggtgcagaaacattttgtgagcaatcatgaaagtgctagaaaattatcaatggatagaaaagccattcaaatgaaagcattgtaaataaatcaagatttttcaacctgaagagataatgtttttgatccttagaaaaatgtagatccttgttcaaatggtttagcaaacacaaacaaagcctgttttgagattgttgtcattttgaaatgtatttggttggatgttttcatgttgtttgcgacgcttccgtttaggacactgtcctattatgtagtctaaactcatctgaaattcacaaacttctttctctctcatcctatctgagtgctaggattccagggtcacaccagtttgttctttatatgtttgtttcataagacaggaagaagtgatttatgagcagcttttaagtactgaaaatattctctagaaaaaaaaatatgcccctttagaatgccaggaattgattctcatggcttcctctatccacccatttttccttgtcacccgaaggcctcctaccagccactttattcttgacaaatctttttcttgaaatccatactggaaacacaattagtgatacctataagagaatgtttgtcttccttttctgttaaagaccacaagaaatcgcaacatttgtagtgaacaagattttagccagatcttctaggggacttgtaagtcactttgtatagtcaatgctaatgcaataaggaaagctatggaattttctttactgacttcagcaaattatttcctccccagggaagtcttactgagacagagtagaaggcagttggcagcaatggcagagaaatgaattaactacagccttttcatctcttctcatttaagccagagttccctctaaatgttgatgcattgaagaaactacttttgtaaagactaactggcaagcagtcagaaaggaactttggacttttctctatcaatttatcaaatgttttgtcagaaagagagacagagacagacacacagatggacagacagacagacagacagactatgctctttgtttttgtcctttgagtgtaaaacataattcactagcatagcttcagctacctgaacactaatgcatcttgcatttacatctctagcctcaaactcttttctgaataccaactgtgtagttcccattttcttaccatagttttatgtagaaacttgaaatacaatatatcctggtatttccccacctctctttctttcatggacttactcacatccagtggtctttttccttaaagtgtgatgtcatgaagcatttcagtttcttccttctctcagctacttacttaattcatctttatgacaccaatggcaacatcctattaatgctacctctactatgtttcgttgtaaatctcattcttttagcctcttttagcatcttaacatgcacccagagctgtgtcctctcaggactctgcctttgcacaaagctattctctctgcttacaatgttctcccacctgtcctttgactagtaaaatccctactgtgttaatggtccaccatttatcactagccactattcccataggataaaaaaattattctcctttgtgttcttatcgcataggcaccagttttggcatccttctgccatgccaaattatgagctccttgaaggccgagaatgaactttcattgtctttgaaatcccagcacctaacatatcatagtcaatggtaaatagtactaaaataatgaattatgtcatttaaaatccaggtgtatcagttcctttaatgaatcttgatatttggttccaagtctaaagattaaaagtttatagctttacacctacataaaatctttgatccattttgaatgtgggtgcgtgtacataattatgagtcttgagatttggttttagatgtatagttgtacaattgtgacaacactgtttcccaaaagggctacctttcctctattgaatttctttgtttattataataatattattattacatattattgtggtgatatattaaatgtattattgtgtgtgcctgcttgtgagtgcacacatgtacatatgcacacacactatatcctttggaggcctgaagagggacaccatggaactacagttaaataggcagttgggagctgtgtgataatgttactagaaactggagtcttttggaagagcagcaaagagccatcttcccagcccttattgaattgattttgcaactttctcagaaataattttcatatacctaagggatctacttgtgtttctgttggtttcatttgtgaaatattattaagtctccaccaataccacccagcctcgattcagtatgattcttaaaatctggtagatggactctacaatactaaatgaaatttcaatagaaattccagtaactatgtacaggagtttgagaaattcatctttttttctactacactgacacttctaatccaggaacacagtgtctctcatttatttggatgtgtgttgacttttttcataagtagtttgtagttttcagcatgtaatcctatacatttgtgttagatgtatatctaagcatattatttttggcagcaagttctaattttgtttctacatgtttattgttagtgctcaaaatatgattacttttaaaatgttgagtctgtatacttcaatctcctgcattattagttctctgagtttcctttatttgttttggatcccttgagattttaacacgtcctctagataagaattttttccctgtcttgtttgtgtttcatcctatttgaaatttccctaatgcatctttatatttgcatcagtgctttgaagaagaatgagtaaaatgtctgtctcccccttgtttctgatcttaagagccaaacagccacttatttattgtaaacactgtaaacatatattgaactttctaaaattagatattttctttatttacatttcaaatgttatcccatttcctagtttcccctctgaagatcccttatcccatcccgcctcctcctgctccccaactcacccactcctgcctcctggccctgacattcccctacactggggcatagagccttcacaggaccaagggtctctcctcccattgatggccgaccaggccatcctctgctacatatgcagctggagccatgagtccctccatgtgtgctctttgattggtggcttagcccaagggagctctggaggtactggttagttcatattgttgttcctctaatggggctgtaaaccccttcagttccttgggtactttctatagctccttcattggggaccctgtgctcagtccaatggatggctgtgagcatccacttttgtatttgccaggctttggcagatcctttccggaaacagctatatcaggctcctgtcagcaagctcttgttggcatccacaagtctgggtttggttagatccccaggtggcacagtctctggatggccattcctttagtctctgctctgaactttctctctgtaactccttccatgggtattttgttccaccttctaagaaggatcgaagtatccacactttggtctttcttctccttgagttttatgtgttttgtgaattgtatcttgggtcagccagccttttactaagtatgatattaatggcagagtttatatgcatgctctttaacatgtaaagaaactccaatctttaaattttttcatttttttttcatttattttgagattataatgtcattacatcacctccccttctttttccctcttgtaaaccctcctttctctctttcaaattcatggccttttttccctattattgtttcatacatatatctttacgtatatgcaaatatattcctaaatacattagtacaacctgatcactctgtataatattacttgcagttatcatacgaagtaacaaattttcttatggcatttttgtatatacttggcttggatgaatttagtcttccctgtcttccacatctcatttctttgccctatccacagccttgtccctgtctcctccttgttatcctgttccaatattcatgttacatgcactgtgttaacctctccactcttctctcttcttccttagagcttcattttaccctagctcatgggcccccttagatttcttcttaattccatgtttgctgaaggttgttgtgtccttcttcatgaagtctcctgaggttttttgtttgttctgtgtctagttttcacatgtaagcaattcttagttcataaagtgaattgggaagagttcttttcctgttcatttctcagaaagattttatatataactggggctaacatttttttaggtaattcacaatctttctaattttcttctactttttagacatagtctaaatatacaagtagcccgagacttgctacacagcccaggttggcctcaaattcacaattcccctgcctctggcaactgtaatttttggcttcgttgaactttactcttacaaactttttgttgttctcgcccttctgcctgtttagttagtttagctttattctttttttcctaaccaagtaattcatgacaataaatttcctgaaagtattgcttcaactgtgccttgcaagttttaatctgctgtattattattttcatttagttaatgaaatatgtgattgcttgggaaactgctactttgactcatatatttcttataatgagttctttaatttctagttgtttttattgctaatttctagttgaatttcattgtggaaggaaaatgtacttacgtgtgatttaaattctttaaaaattgttgatttatctaacggaacaagatataatctattgcagtatatgtctcatgagcacttgaaaacaatctgcattcttttgttatgtaatgttccttataaatctcaattagattgtattggtaaatggtatgattaaatcctactgtttctttattgattttaatcttttctctatccattcttcacagaaatatataagcactgtggacaactgtgggttgatctgtttcttctctgtgttctctttctcttaatgcagttatctaagactggcaagctatgaaaataaagttttcttctggaatattaactaatggagaacttgaattatgttagcaaccaaaagccttcaagtatagaaatgcctctccatttttacaaagatgttaacaatcatatttcagttatagactttttaggtagcttatttaacttgttcaactatcttaataatttttaaaagtttaaaaaaaaccctcaatccaatttttccaattctacttcttaaaattatatgatgttgtttgtgtgtgtgtgtgtgtgtgcacgcgtgcgcgcatgtgcacacatgcaagcttggtgaattgatactattgtgcttcataggcatcatagctgggcatcattaatattttaagtatttcttttcatgtagattgttagtggctgatatatgtgtaatacttatatactatttcttactttgttgatgttattttacaatgctgtctaaggtctaatgcatatattgtcatgttgattctttgagataaccaggattttgtggtcatctccttttcgtttagataactacttttaaccattattttaggatcagtcttccagtaataaattcttagaatttcttcaccccaaaatatcttttgtcaaatacgtaaagttccagcaatttgtgtgtaggggcattatttgtttttcaaggacacttttcagccctgctctctccctttctctccttccagttgaatgatattatgaatgttggctcttttcatgacacgcccaaagattcctgaagctatatattcatctcatagtcacttttcattctgctgttcatactgggtaatttctcatgctatcttaaagtttaattgattccttttgtgttgcctctgaaattgcttctgagaatatttagtgacttttattttatttttaagttgtaaatttcccatttgatgtttctttatatgtatatatttttgtcaagacgtgccatatctcagctgagacttgcttacttgtcattcatttcgtgcacacctgtaattacttactgaagtatctttatgatggatgcttttgttatacacttgtaacatgtcttacttttactgttgctatctattatcttttagttgctgctgttcaacttaagatcttcctggtttatagcaatggtgaatgattttccattaaaatgcacactttggaggattcgattagagattgtgattacatttgaactttccattttatctagtttcctctgataccgcattcttagaggatagggcccatgccatatgaaagcagatgcccaggctctcaacttgacctctgttagcaacacccaagaaagggttgtttgcttctgccagatgtatactcaaatgtcccttgctgctttttgtgtgccctctgataccacctcaacaggaagaaggacaaactctttgctcttgacatgttgaggcagataactccatttttctgaaatgttcattgatactgtgggtcaacgaaggcctgttactactatgtacagaagtcttgattctgtatgtagcctgtattgccaatgcctgagtagtgggtggagtaaggattggattacattgttaaagagtagccaaagtggaaatctaggctcttcattcagcatttgttaacatgagtaaggatagagcctcagatttcctgtggtagttacccagagcagagtagatattttctaggcatccttcatcatactaggatgctgctcttttagagaacgagaatagatgtgtcttaggggtgattttgtctgtgcccaccattggactctcctcagagcaaaaggaaaacccaggaaacttgacactgtgccatgctctagcactcaacctttcctgagtggtctgtctgcttcgtgtaataaaaaccatcttcattacattaagaccgttcaaattagatttcttggtttggtttttacactgtgatttgaatttttacaatgaggttgataatgagttctttttaaatttaaaatactattcttttgtcaggtatatgtttgcaatactttctcttaatgaatggtatcagacaaagatagataagagtgttttagtgattatttttcttgtccaaaaatccaggcaataattatctcattttcccagagcaggagtcttgataatattttagtgccatctcttaagaactatatgcattatttctgtatattgtttataattttcattaataaattatgccttccagtcagggaacctgcatgggtatctgaccttggtcctctgtgtatatgttatgggttgtatagcttggtcttcttggggtacttccatgggacagttggaatggaagctatctctgacacttttgcttgcttttatgacccctttcctcctactcggttgcttcacaagccttaataaggagaggggggtatctagtcatattgcaacttactacactgccacgtttggttgatatccctgggaggcctgaaatgaggaagagtaggggtagaggttgcagggagggactaagaaagggaggaaaactctggttggtcaggatataatctatgagaggaggataggtaaaaaaggaggaaacaaagaaataatgttttcactaaaatagccacatgaaccaaaccttacacattgcaagtgttttgcttcactaaatggaagaagcatataacccctaaagacactgagtatgtggccgtagaatttcacagcctctttaagtcgaaaccttaaagttaggtcctgatgagcttgccaagtctggatctttgagcaagtgtcaagatccctttggggaatttgtctctgagctaccagctttttggacttcaggccagtttctattttgagtggaagctccaatctagcaaaagtgcattgattgctttccagctaatcaaagggaaagcattagttggctgttctggcatctctgtgcagctaaaaatgattatgtctctggctcctaatgcagcaatatattcttaatatattctttcccctttttcttgtgatgaggatgcagaatatttttcaattttcctaagtataaagttaatgtatatctttgaatggtctttgagaagttacatagggtaaattgcttttcccccccttctagggaaagaacagaaaaatccacctcccttctcattatcttagtcataagaatggttaatttacatatagtagaggttctttatatgagattgtccctctgtgcttctagaagagactttcctaaaattccttggactgttggagacaacactttgaaaacaaatttatagactagttttggtagatgcatgtttaaagagattaagaaagttgcatttgtaatttctctctctccttctctcactttccctcctttttctcccctcatcttctccctccctttccctctcccttccccctccattttttgtccactctcctaatcttgcccactactccatggtggagtgctacttactggcttgcttagcctgctttcttgtagagcccaggaccaccaaactagagatgggaccacccacaatgggctgggccctcccacatcagtcactattaagaaactgccctaaaggcttgtctatggtctacttttatggaagcactttctcagttgaggatccctcttctctggtgactctagcctgtgtcaagttaacaaaaacctagccagcacattgccctcacccttctcattttctgtgtatgtgcaattcgttgctgccttgtcttttctggaaaagttgaaggtttgatgataaaggaaagtttaaggatgagtaggagaacgtattcatgaagtgatggggagaatgaatgatcttttatatatgattcagaagacccattagagtgaatcttccagatcaggaagagttataagaagccccttttgtgccacagtaaacatccatcacaaatatttgtgtgccatataaacactgacattggccattagtctgtcatagctggactaaggaagtggctttgtattacctgtgtattatatccaaggataggaaaaagtttgctttatcagagaccttgtaagatcagaacaaaataatgaagctcaaccagggctcagaatggatatcacttgtctaaggccgaacagctaataactactggatctaagattcaaatctaatgcctgtgtgttgtaccatctcttcctcactatatagacactgctgaagttccagttaccaagactaccataattctgtaactcattggaataatgctatatcagtcaaaaaaccaacagttggtccaaaggtattgagaattttgtccttaaacatttgaatgtagaatgaaaggttttttccaaggaactttcccatgtaatattaaagaagattaggcagaactcagatcactttagatttaataggctctctgcaaatgttagctctgtctctctattgcccaattgctatggatcagttatagtgctagtagcttgtagctctcaagtgcatcatgttatttaattgctatacatgtcttttgaggtcaaggggtagatgccgtcctgctttacagacgagattggttccaaaggaatgaatgaggggacatgtccactcccttacagccaaatgtgtctgtcttcatatctagtatgttctctggagacatgtaagttggtatttaacctacttctgtctcagtaatattttcaaaaatttaaaattgaatatttagctgagttctccagaaatccttgtatcaatttacagaggatatgcatgcattctaacttgcctcactgtgggaaggttatcctctgcagtagccttgtatgagcccagagtgaaagtgaaaattagtctgagatgataattgattcctgcatgttgcttaggctttagcttttccttgaccaggagtgccctccagtctccacagaagactgaactgagctaattggcttttggatgaggttagagttaaggttctaggcaagggactgtttaactgaaccagtatgattgctgctgcttacatgatgaggcatctgttgggtgaaggcattttctttttctgaccagaggctaagccagcctccgtcagtagcaaaatgttgttacttatattctgcactccagttgcatctttgagatgtgctctgtttaataatgtgtgcattaggagatactgaaaacatgctttttaatctagtcttttttttcccagtagatttagactaccttcaaagaatgtgtttgtgtacatatgtatattttagaccaagtatcactggaaaaaatgacatctcatcatttgtgggttattacattggtggaacaaaatctccctaaagtgatatatctaatatgtatcataaaaaattaattcatacaatgctttatttttcaggtacctttaatagggagttgtattccaatagattggtttgtaagagtttctaaataataaatcataaataccaataaaggaaaacatctaaattgtgcatatttgagtgtcaattatatgttgattaactttacgtccttttgtcataattcttcctattatcattttccatggatgtcagacaattcatttggaacacaagattcaaaattcataattatgaatgataatatagtaccctacaacatctcatctccagttatttatttcaagaacatagagataaattcccttcttcttcatagtaactgtaattatacactaaacttaagatattgcttgcctattttcttttttcttttttttttcaatttttattaggtatttatttcatttacatttccaatgctatcccaaaagccccccacacgctccaccatgctttatcagcagacctgggagactagctctctcctctgagtttcagtggtcagagcactctctgcaggcaagctcttctcttgcagggaaggtgcacagatatctggtgttcggaccttcctcctggcagaagttgaaggcccaaaacaggacctgtcccagaagctgtgttgcttcagcctgtcacagaagctgttagcttctgtagtccatactctcacctgcacagactagtctcagagggatccgggaaccaagatggctcctccaggtgctcctgcaaagccctcccgggcagggcagacacctctcctctgacagggaaggtgcctggatgtctggagcccaaaacggggtctatctcagaagctgtcctctagagaccttgggggtgtccactgactgcgcccaaggtgagccatgctggctccaccagaaggaaattgtgaccctgttcaagctgggtttcctgcttctctaatgctgtcttaggtcccacgcaattagattggaacagaaattgccttccactcaccagtggtcctaaaatctcatggagagtcctctagaggaccttgggggtgtctgccaactccacgcccaaagtgacccggtgctggcaccgaccagaagggcgactattttcttaatttgagtttttacttcaaatatatgagtaatgttcataagttaataacaattgaaatctctattttgtctcaaataatatattcttttttatttaattagatatttatttcagttacatttccaatgctatcacaaaagtcccccacacacacccccacccactccggcaccctcccactcccacttcttggccctggcgttaccctgtactgagacatataaagttccatgaccaatgggcctctctttcctctgatggccgaataggccatcttctgataatatgcagctagagacacgagctccggggggtactggttagttcatattgttgtgccaactatagggttgcagatccctttaggtccttggttactttctctaactcctccattgggggccctgtgatccatccaatagctgactgtggcatccacttctgtgtttgctaggccccagaatagtctcacaagagacagctatatcggggtcctttcagcaaaatcttgctagtgtatgcaatggtgtcagcgtttggaagctgattatgggatcgatccccagatatggcagtctctaaatggtccattctttcctctcagctccaaactttgtctctgtaactccttccatgggtgttttgttcccaattctaagaaggggcaaagtgtccacactttggtcttcgtttttcttgagtttcatgtgttttgcaaattgtatcttataccttgggtattctaagattctgtgctaatatccacttatcattgagtacatattgtgtgagttcttttgtgattgggttacctcactcaagatgatgccctcctggtccatccatttccctagaaatttcataaattcattcttttttttttctttccattttttattaggtatttagctcatttacatttccaatgctataccaaaagtcccccatacccacccacccccactcccctacccgcccactccccctttttggccctggtgttcccctgttctggggcatataaagtttgtgtgtccaatgggcctctctttccagtgatggccgactaggccatcctttgatacatatgcagctagagtcaagagctccggggtactggttagttcataatgttgatccacctatagggttgcagatccctttagctccttgggtactttctctggctcctccattgggagccctgtgatccatccattagctgactgtgggcatccacttctgtgtttgctaggccccggcatagtctcacaagagacagctacatctgggtcctttcgataaaatcttgctagtgtatgcaatggtgtcagcgtttggatgctgattatggggtggatccctggataaggcagtctctatatggtccatcctttcatctcagctccaaactttgtctctgtaactccttccaagggtgttttgttcccagttctaaggaggggtatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttgcctaggaatttcataaattcattctttttaatagctgagtagtactccattgtgtagatgtaccacattttttgtatccattcctctgttgaggggcatctgggttctttccagcttctggctattataaataaggctgctatgaacatagtggagcatgtgtccttcttaccagttggggcatcttctggatatatgcccaggagaggtattgctggatcctccggtagtactatgtccaattttctgaggaaccgccagacggatttccagagtggttgtacaagcctgcaatcccaccaacaatggagtagtgttcctctttctccacatcctcgccagcatctgctgtcacctgacataaattcattctttttaatagctgagtagtactccactgtgtaaatgtaccacattttctgtatccattcctctgttgaggggcatctgggtactttccagcttctggctattataaataaggctgctatgaacatagtagagcatgtgtccttcttaccagttggaacatcttctggatatatgcccaggagaggtattgtgggatcctccggtagtactatgtccaattttctgaggaaccgccagatgtacaagcttgcaatcctaccaacagtggaggagtgtttctctttctccacatcctcgccagcatctgctgtcacctgaatatttgatcttagccattctgactattgtgtgaggtggaatctcagggttgttttgatttgcatttccctgatgattaaggatgttgaacattttttcaggtgcttctcagccatttggtattccgtaggtgagaattcttcgtttagctctaagccccatttttaatggggttacttgattttctggagtccaccttcttgagttctttatatatatattggatattagtcccctatgtgatttaggagaggtaaagatcctttcccactctgttggtggcctttttgtcttattgacggtgtcttttgccttgcagaagctttgcaattttatgaggtcccatttgtccattctagatcttacagcacatgccattgctgttctattcaggaatgtttccttgtacccatatcttggaggcttttccctactttctcctctataagtttcagtgtttctggttttatgtggagttccttaatccacttagatttgaccttagtacaaggagatagaaatggatcaattcgcattcttctacatgataactgccagttgtgccagcaccatttgttgaagatactgtcttttttccactgtatggtttttgctcccttgtcaagtgaccacaggtgtgtgggttcatttcagggttttcaattctattccattggtctacttgtctgtggctataccagtaccatgcagttttttatcacaattgctctgtagtacagctttatgtcagtcatggtgattccaccagaggttcttttatccttgagaagagtttttgctatcctaggtgttttgttactccagatgaatttacagattgccctttctaattcattgaagaattgagttggaattttgatggggattgcattgaatctgtagattgcttttggcaagatagccatttttactatcttgatcctgccaatccatgagcatgggagatctttccatcttctgatattttctttaatttttttcttcagaaacttgcagttcttatcatacagatctttcacttccttagttagattcacgaaaaggtattttatattatttgtgactatagagaagggtgttgtttccctaatttctctctcagcctgtttatcctttgtgtacagaaaggccattgatttgtttgagttaattttatatccagctacttcattgaagctatttatcaggtttaggagttctctggtagaatttttagggtcatttgtatatactaacttatcatctgcaaaaagtgatattttgacttcttcctttccaatttgtatccccttgatctccttttgttgtcaaattgctctggctaggacttcaagtaaaatgttgaataggtagggagaaagtgggcagcattgtctagtccctgattttagtgggattgcttccagcttctcatgatttactttgatgttggctactggtttgctgtagattgcttttatcatgtttaggtatcggccttgaattcctgatctttccatgacttttatcatgaatgggtgttggattttgtcaaatgctttctccgcatctaatgagatgatcatgtggtttttgtctttgagtttatttatatactggattacgttgatggatttccatatattgaaccatccctgcatccctgggatgaaacctacttggtcaggatggatgattgttttgatgtgttcttggattcggttagcaagaactttattgaggatttttgcattgatattcataagggaaattgttgtctatctttgttgggtctttttgtggtttaggtatcagagtaattgtggcttcatagaatgagttgggtagagtaccttcggcttctattttgtggaatagtttgtgaagaactgggattagatcttctttgaaggtctgatagaactctgcactaaacccatctggtcctgggctttttttggttgggaaactattaatgtccacttctatttctttaggggatgtaggactgtttagatcattaacctgaccttgatttaactttggtacctggtatctgtctagaaacttgtccatttcatccaggttctccagttttgttgagtatagccttttgtagaaggatctaatagtgttttggatttcttcaggatctgttgttatgtctcccttttcatttctgattttgttaattaggatgctgtccctgtgccctctagtgagtctggctaagggtttatctattgtgttgattttctcaaagaactagctcctcttttgttttatttctttgaatatttcttgtttccccttggttgatttcgcccctgagtttgattatttcctctttggtgaattttcttccttttgttctagagcttttaggtgtgttgtcaagctgctaatgtgtgctctctctagtttctttttggaggcactcagagctatgagttttcctcttagaaatgctttcattgtgtcccataagtttgggtatgttgtggcttcattttcattaaactccaaaagtccttaatttctttctttattccttccttgaccaaggtatcattgagaagaatgttgttcagtttccacataaatgttggctttccgttatttattttgaaattgaagatcagtgttagtccatgatgatctgataggatgcatgggacaatttcaatatttttgtatctgttgagtcttgttttgtgaccaattatatggtcaattttggagaaggtactaagaggtgctcaggggaaggtatatccttttgttttaggataaaatgttctgtagatatctgttagactatatctgtcagatccatttgtttcataaattctgttagtttcactgtgtccctgtttagtttctgtttccatgatctgtccattggtgaaagtggtgtgttgaagtctcccactattgtgtgaggtgcaatgtgtgctttgaggtttattaaagtttctttaatgaatgtggttgcccttgtatttggagcatagatattcagaattgatagttcttcttggaggattttacctttgatgaatatgaagtgtccctccttgtcttttttgataactttgggttgaaatctgtttttaaacgtaaaactgaatgaagcaatctgtgttttttggactagaacattgagcttggatttttaagtgcagtctataggcagtgagtagaaatcgtagaattactgtggaaatctttaaacatcacatagttttacctttatgacagttaaaggcaatgtttgtcacctgaagggtatctagtaagcaataaattgtctcgtcatgaaaaagtgctgcacctgatactgagtatccatcccatgaatttataccatattgcattcacgattaagaacaaagtgcgtgttttctaaaaactatttcccaaaagatctctttatcaaaaactaattcccaaaagatctcttattacatgatttctatcttttgagtacttggcacatattttaaacagtgtggtggtaaacaggtgggaatataatgtcctcacactatcttctagttaaaagagaatatgaaataaacaatgggagatgagatgctatagggtaccatatgaatgctcataattatgaatcttgaatcttctgttccaaaatgagttgtttgacaaccatggaaaatgataataggtagacttatgacacgttgtgtgtgtgtgtgtgtgtgtgtgtgtgtgtgtagaacagaaataagagagggtagtgggagagaataatagaatgaattatagacatgtatcagattatataataacaggtgcttaaaaaatgacatagttgctaagtgcactgactgatcttccagagttcagttcccagcttttacattgggtggcccatagcaacctttaactccagtccttgggaatctaatctgaccttctcagacaccgtccatgtcatgtgtatgtgtgtcaagaaagaaagaaatgtcaaagaacaagcaatacaaaataaataatatagctgaacaaagaagttgatgatgattaagatgaataatacctgttttgagtagtttcaaaaatgaaaggaagaaaatagcactattttgcagaaaacaacaaggatgtaggcttaaagggttttttataaaatgtaaagatagaatggagagtaatctaggtttgaggactattaaggaggtcaagcacatgtaaaattaggggagtgagaatcaacttggcactttcagaatagtggaaggaacttgattagatgtaggctgttcatgtattgtggttgcttatgcagagaaaggaatagtgaccattgcagtgtgcaggatgaattaataagtggagatgccttgcaggtaccacctggtgaacaatgcaatgtaagtgctgaagaaaaagaacactcaagagttgtgtgtgtgtgtgtgtgtgtgtgtgtgtgtgtgtgtgtgtgcgcaggcagacaggcaggcaaatagatggatggagagatacaattggaaactgtgagaaaaaaataaatagaaacattataacattatagtgttttggtgagagactagaactaaagattgtactccacccacaagctaaattaatctgaatcccatttaaatatgtacagatgctctttttctccttagaatacaatcttcccttaaaatttcacattctttaactgtctttcccttcacaatgaaacctctttaactctcaaaaaatattcttagatccattgtctctattttctcacttcccattttctcattacccctggtcactcacttaacaccacaacactcttctatgtattgttagctccaagatgaatgagtgtctaccagatagatttaaaacatcaaggcttatctttctttgttttccaaagaataggtttttatcagtatagtaaagtaggggaaggaactttaccacttatgtatattagaatgatgatcaagtcatctatcaattggatgacttttagcaagttattgaagcacaatttctttatctatacaatgagaatgatctgatctaccttactggattatatttaaatgatgttgtgcaggcaccatttagaaacagtactttattcataagtattagtttcttcatttcaacagtggatactttttttgtttcctttctatttaccttgaaccttttccccctttaatttgtctctaatccactgctgtaccctaaagtaataaccctgaagtgcacatttgatcccaccagaggattatgaaatacattttgtcactgtgttctctccagaatttttaattcatagaggcacagtaagttctcaggcaatgttgatatttctgatctgagaacagaaccttaaaacctgttagagtttcatcacagacccaaccttaatatatgaggttatataacttgtgactcccagtcattttcaaccgcatgttgtctccaagacacatcatggtcaagcatgtcctacctgattctaaagtatatatataagatttgtcaggaacagtcaagaatgaaaaaaataataatggagagaaggactagttataaaatacattggtgctaatatgtaaggaaaccgattaataggccataattaagcctggaaattgatctagaaacaccagttaacataaccatctttctgtgtctacaggttccacatttatagattcaaccaatcacagatcaaaagcattctgaaccaggttacattcacactgaatgggcttttttttcttagttatgattctctgaacaatattgtcaaacaactatttatatgctattcatactacattagctactatatataatccagaggtgatttaaaatatctggtaagatgtgtttaggttacatagaaatatgacaccattttatatacttcttgaatacctgtggactttggtatcctagaaccaatcttttacaaattctaaaggacaagtatgacttttagtatataagttcattttaaaatgttttaacatacatctatttatttatttatttaatgtatgtgagtacgccatcttcctcctcagacacaacagaagaaggcatcggatcccatcacagatggttgtgagccaccatgttgttgttgggagttgaactcaggacctctggaagagcagtcagtgctcttaaccgctgagccatctctccagcccccatgtgttaattttataatattaaagatattttaaagaaaaatacaaaacttaggagtcataaaggaaaacagtttatattgtactatgtgatattaaaatttaaagcaccatggaatatataggggtgtctgtgtgtgtgtgtgtgtgtgtgtgtgtgtgtgtgtgtgtgtgtgagagagagagagagagagagactaatacatgaaaacattttgtactttgttccactgtatatatggaaagggactggttttcttgaagaactcttgaaaataaaactaaattaaaaagaaaaataaaacctttttacagagcaaaagcctcagaggaggtagttcaaatcaaaagaaatttggcatataaatataaatataaatgaacagtatttcaccacactcataattttattttgagataagatttcacaatgcagtgtaggcttgcctggaactcattacaattaaataaatctagattaatttaaggaacaagataaaattttcatggatcatggcaaaaatctgaacatttaatatatactttcggcaagaatgccaagaaacatccactctaataccttactattccaagtgtgggccttagactagcaacatctgcatcaaatgagaacttgttagaaaagccacttcagttcagacccattcaaccagaatctgcattttaaagagatggcttggtggtgccctgaggatttaaagggcagcatagatctaacaaactgttggtagaagtgcaaattgcatgacctctttgggttttaatgggcttttattacctcagtcacacagcttaacatccagagctccatgtgcagaactttgtctcaaagatgtaatcagatatatgtttgaagaaatacaaagatattctttgtagtatagtttctattagcagaaacttaggaattacctcaatattcattatttgtattatatggaaatttcaatgaaatactgcacagttattacattttttgaaaaagtattttaaaatatgaaatcatgtccgatacacacacacacacacacaaatatatgtatatgtatatttgtgtgtgtgtgtgtgtgtgtgtgtgtatataatagaaacagcaagaattcaaccagtattaagatatactttccctgttcaattattactttcattttagagataatgtaagagaatggggagctgttaaacagcagagccaaggccatatagttaaccatggtgaattcaactctggacactttggttctagagcttactggttttttttgggggggcggggggttcgagacagggtttctctgtatagccctggctgtcctggaactcactttgtagaccaggctggcctcgaactcagaaatccgcctgcctctgcctcccgatagagcttacttttttttaaccttttatttattctttgtgagcttcacatcatgcatccccatcctgctcatctcctagtctctttatatctgccctttgcccttgtaacctcctccacaaagtaaaacacactcaaacaaccaaaacaaagcatagaaaacatctcatcgtttgaagctatactatgtcaccatgtgtcctgccatgtatccctctgtccacacagctgcacttgcaactgttcattgcaatgagtcattggtctagtttgagatttctagcttctgtgacatggtcaatattggatcttcactgggactcctcccctatatcctgctgttgctctatgtcatggatatcctacaactttgggtaggcaggattgtcccaaacatttgcatgtgatgcatattttggggtgggccaatgcagaaccctggatttgggtctgggtggtagctgagcagatgagcttgcaggctcactcttatctgtaccctgagggggtgagctccctagcactgctgcatctaggccacccaatggcacctgctttcatgcccttgggaccacctcacctgtacctacacctccagagccagctccactgtgctgcccagtcaaggcatgggatctcctctcccaagtgctgtttgagaggatctgggccagctctccttatgttgcaccctaggggctggctcatctgtgcctttgctattaaggccagctccattgcactgcccaggtgagatgcagggcccactttctgattgctacaaccagtgagctaagacgaaaggatggactatccagagactaccccacccggggatccatcccataatcatccaccaaacccagacactattccacatgccagaaagattttgctcacaggaccctgatatagctctctcttgtaaggctatgccagtgcctggcaaatacagaagaggatgctcacagtcatctataagatgaaacacagggcccccaatggagaagctagagaaagcacccaaggagctgggggcatctgcaaccctataggtggaacaacaatatgaactaaccagtaccaccagagctcatatctctagctgcatatgtagcagaagatggcctagtaggccatcactgggaagagaggcaccttggtcttgcaaactttatatacctcagtacaggggtacaccagggccaagaagtgggagtgggtgggtaggggagtgggggggggaggtatgggggacttttgggatagcattttaaatgtaaatgaagaaaatacctaatttttaaaaaaaaagaaaaaaaagatagtttttcatatatgtatatcattttactttgctcatatttatgtcctgattaccatctcttgtcctactggtccctatcctctccacctttccactctcatcatgtgtatgtgtgtgtgtgtgtgtgtgtgtgtatgcatacatatgtatatatgtatatatacacatatgtacatgtatttgtatcacacacatgttgatgttacatattccacatctgagagaatacaggaaatatttgtgtttgtatctttctccatactatgctttctttattgtttcttctcttgtaggattttggatatacaacttgtgtgaataaaagatgactctgcagctagtttcatcaaggttacagtagagactcttcctggtgatccatcaaaatgcttaggtctagtgtaaaaacaattgtttattttcttgctgaactgtgacatgactgctataaaaactctgtttcatttgcacagaggactatgccatgatcagggaaagaacaaccttcatttgcatgaagggttgggccataattggtgcactaataaactttttttcacattgaagggctgacattattggatacacacaatctatttgcataaaggactgtgctatggttggtgcacatgcaatccttcatgaagcgctggcctgtgtttgttataggtataatgcttcatattcatgaaaaactgtactatgcttaatacaaatatctttaccacaacccctccctttggtcatataagctacattattttgacttagctttcaagtcagctaggagacactgtcttgtgcctctccttgctgctgcttccttagtcccatttcccgggtgctctgctgaaatcttttcttattttttaagattaatttttaaaactttatatataaattaattggtttcattgtcatattttatgcatatatatatatatatatataattgactttgctcacattcacttcactgtctgtatttatgttttcattttatacagagtatagatataccatcaaatctaggctctgcatatgaaactatatgatatatgtcctccttttcctttccaattttttattctgattgttttctttccttttctattagtcctttccgtcccccaaataggcttccttcactttagtgtatgtgtgtgtgtgtgtgtgtgtgtgtgtgtgtgtgtgtgtgtgtgttagtctagattccacatttgaaaatgctatatttgtctatctgaatatggattattatcatagtggtctcaagttttatatccgtttcccacatttgtttttattctcttgatatccagtttttcctgcacccttcccttttcatgatgaggctctattttcctaagtgtttgcttttggacctctgtcatatcgcaaatggatgtagctgcgtgggtttatttctacaacttctgctttattacattagtctgtgcatctatttctgtgcagtacattggctgtttgtattacttgatctctgtagtacaacttgaaccaggtattgtaatttcttcatggttccctttctgctctagccagctttgcgattcagatcttttgtgcctccatataaattttaggatgtgtttttctagttgtataaagaatgccattagcatttcagaaggaattgcattaaactctagacaagtttgggtagtatagctattttcacattactcctcatctctttctgaggctgttataaatgggatttgtttccctttgatttctttctcaaaatgcttgttgatatgtagaaaatctactacttttgtataatggctttcattctgatactttcctaaaattatcagatcttaccagacattttttacagagttgttaaggtcttctaaatatagtacaattttatctgcaaacaggtatactttaacttcttccttgtttatgctccatcaatttctttctcttgcctgttttgctgtaactaagatttcatgcatcaattactgattaagagtggagagcgtggtcacccccgacctccttagttttgagaaaacaattcttgttttcctcttcctcacttagaataatgttttctatgtgtttgtcatatctagcctttatgtattgatatatgtcctgtttctagcttctttgggacatggatgaattttattaaagaccttttattatttatttattacaatgttagagacattgttagggagcttttgtatcttttgagataatcctctcattcctttcctcacttatttgctattacatttatttatgtgtgttatattatccatatggccctagaatacaacaaacctgagcaatgatatatttttaaaatgtcacttccaaatattttactgagaatttttgtgttcataagggaatatggtctatagttttcttgttgttatgttcttatattgcatgatatttctggcttcatagaataacttcgatagtgttcaatttctgtttcatgcagcatcattagtgctccttaaaagttctgtagtatttgacaaagagcaagagctgtacatggtgtagctgggagagtgaactggtgtcattatgatatcaaaataattttaaataatttccccagatataaaatattagcggtatatctgtgtgatcctctggatttttgttgtcagttgggaatcctagaagaaagcagacatttttttccagataggatgtggttagtctgaagcttaagaattacctgcaagtcctaagaggaaaactcatagccctgagtgcctccaaaaagaaactagagagagcacacactagcagcctgacagcacacctaaaagctctagaaaaaaaggaagcaaattcacccaagaggagtagatggcaggaaataatcaaactcagggctgaaatcaaccaagtggaaacaaaaagaactattcaaagaatcaaccaaaccaggagctggttctttgagaaaatcaacaagatagataaacccttagccagactaactagagggcacagggacagtatcctaattaacaaaatcgaaaatgaaaaaggagacataacaacaaaacctgaggaaatccaaaatattatcagatcctactacaaaatgctatactcaacaaaactagaaaacctggatgaaatggacaacttcccataatcagtcaccaaacccagacattattgcatatgccagaaagattttgatgaagggaccctgttatagctgtctcgtatgaggctatgccagtgcttggcaaatacagaagtggatactcacagtcatctattggatggagcacagggcccccaatggaggagctagagaaagcaccaaaggagccgaaggggtctacaaccctataagtggaacaacaatgtgaactaaccagtacccccagagatcgcgtctcttgctgcatatgtagcagaagatggcctagtcggccatcactgggaagagaggccccttggtattgcaaactttatatgccccagtacagaggaatgccagggccaagaagagggagttcgtgggtaggggagcagggtgggaggagggttttcagaacttttgggttagcatttgaaatgtatataaagaaaatctctctctcaaaaaaaaaaaaaaaaaaaagaattacctgcgggaatatatgccaccaccaaggcctaagttagatcttcaatgttctcatgacacacatatatgcacgcacatgcacacctacacaaagaaatcaacctgtattatttattatcataatttaagcattactaaatgtttgcatatgtaaatcatcatgaatactataaatttgtaatactataaatgtgtctttatcaagtgaattttataaaggtgaaaaaaagaaaaaagcccacagaaatggaaaacttaatgaaccataagtttgaaaatacttgagacttcaaaaattcccaggggtttacacagaatattattcaaccaggtgaggcctcccagggaaggtttgtatatggaaattgctcgtcagcccatatgtccctctgacaaaaacagttgtgacccagaagttgtttttgtagttctgaaaccttcttcatcaaagagaagtccattcctacccctagaggccaggtacttttcaaacagctgttgcctattatgtgtttagcactgctggcagaagggagactctcagcctaccttagagggcaagactccacatctgtctaagcagaaggagccagtggccatcactagtagtttgaaaggcaatttgaatatttgttccaaaatgtatggtcaagtaaagactctctagcctgagagtgtaaccaaattacactgagatcttgtagaaacccaggttagtgccctcctcttggtttctggatcagggcgtctgaattttatttctgatgcacttccaggacatgctaatgctggtgttttaggaaaacatctgaaaagcagtttatgggagaaacagagaaacttgtataaaagacttatattcaagtcttgtatgaataagtctctgaagcctgactttctcctttctcaagtaggtaattgtagtggtctagtgggaccatgtttctgaaagttcctataggcacaaatacaagtattagcttctggacagctttacacatggcacttgatacagtccttatgatctgttctttatcccacagagcatggcccctaaaatggtctatttattccttactcacatgctctgatcttgcagcgactatcacttttcagtcttagtgctgtgagtaaaatcttatcagagggtgggaaatgaggaattgggcccctggtttgtatgtatgaggccctaggttcaattcctacccctacccccacaaataaaataagcctgtcacatagatttttttttttaattaacaaagtgaagtaatctactaccaagcagaaaaaaaggtattaggaaaggcaatttggtaggctgatactctgtgagcaaaatccagatgtctgaaatggtttaatagttccgagtatatctgtgcaagtatctctgtgatatttttcttaaggtcctttaactatagactcaggaatgatatcattggataatattatagtctatttttctttttttttttttcatttttttttaattaggtatttagctcatttacatttccaatgctataccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaggtgcttctctgccattcgatattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgattgtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatattcttttgttttaggataaaatgttctgtagatatctgtcagatccatttgtttcatcacttctgttagtttcagtgtgtccctgtttagtttctgtttccatgatctgtccattgttgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttgttttctccctctatgataattgaatgtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttctctttgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtctcggaccaagatggcgaccactgctgctgtggcttaggccgcctccccagccgggcgggcacctgtcctccggtccggacggtggctggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtccccagcccacacagggtgctgcctcagcccctctgtgcttctgcctgttccagaggctgtcaggttctctggcctagtctatttttctttattgtggaacctccatactgatttacataatagctggcccaactgatagtctcactagcagtatgtaagggttcacacacacacacacacacacacacacacacccctgcatcagcatttatattttgttttattaatgataactcttctagctgggggctaattctgccagtatcatcattgacagtcatatccactactatagtctgacctctgtggatagtggccacatattcataccctgtccacactatactgtgttgttgttaggcatacatgcctataatattttctagattagtgatgccattctacaattgcttcatagccatctccttctccttctctctagctaatcagtcattcaatcctgctaagtctcatatatctccttcctgcttcatcactacttgttattgttctactttggccattcatcatgtttgttacactagcctacccatgcttgcagcatctctctgcatcaattttcttgtgaatagatgtgagggcaacgtgtctgaatattgctttgctgcatttctttcatgctttggaattttgaaagcctttctcttgcctatgggattatgcaaagccagtgctttcatctgatgctcaaggaattctgcttctgttggcttctcagcattgtcttagtcccctacccaaactggtaaaatctctgtaatccacttgtgtaactactttcttccaaatattttagacaaagaagtatcccatgattttaagattctactatgagagtggaatactagaagcaaaagatcaaatataatgttatcttagtgggtctcttaaaccatggctaaaatcgaccacatattttgacacagagcatctcacaacaaatacagcacaaatgaaacagttccttgtatctaatttgaccccagtggaataagccttgctataaaacaatagaaaccacagaaaatacacattgtcatagagattgaacaacacccttctggataatgaatggataattgaaagttaacaaagaagtttaaattttcctagtgttgaatgaaaaaatgtaaatacaacacacccaaatctgtaggatacaatgaagatagtcctacaaagaaagtctgtaggggaaactagagtggggatgtattgtataagagaataaaaaaaagtctcagggaacccaaataaacaacttcatggagatggctagacaatgttgtccagacgtaacagggcagtcaccgacatgagttcctaggatcacaagacctgtgcaagatcaaaccaaagaaaatgccagcatgaatgtgtgaagacattacaaaagtctgtctctaggtgaaggtctattggcaaatgatggtcaattgagagaataaattttctttagggatgtagtcccaaaaatgctacatgtaactatgtgtagaaccaagtaggctcagtgggtttcagcagaagggaatacatatgattacagcatattatacatgtatgtgatattttcaaagaataagaggaattataaaaattaaatcacagagagagacagagagacagagagagaaacagagacagagactttcctccatttgattgggtctttgataaaggagggtacctggatcaccaggctgcagtgttcctcagtcagctgtctagcagtgaaaggccttcagagctctgtgtccttccatcaggagggtgcctttccccttctctgtcagataaataagccacgtattgttctgcactgcactggcccctcctctccagccatctggaggcttctcttcctgcctgcttggacttcttcacatgtagaaggtgggatgtgctatttgtggggtggctaaaagagccacagaaagtaagcagagccagtccaggacactcttttgtgtttctccttatccaaacactttcaggagaggaagagtccacaactgcattatagcccagaccacaatccccagtaataagggtcacattttctctttgccctgggtgggaaagacccagggttccctttgggattatcacctctgatacactctctttgaaggggtttgctgaaccaagaacaaagacaggaggtgctgtaaacatttatgggcaccacagctcactagggtagctggagattaactccttccagaactattctgtttacctcccctcacccatcacaacagtctttagaaggactcttttgggagacaacttctgaatgatctacatttctccctgcatggaaccctcctactgggttcttgtcttctctgttctcaaaaaggaagcgccttgctccaagtagaggaaattatatcatattatctggtattctactccgctaagcaacttttatcagtcaccatatttcctaacctctagaaaattccaaactggccagactattgcttgaatcttaccttcccttgcccaaagattctatgactatgtgcccacctgctagtccctcacctggggactatctgaactccctactcttgcttcctgcctagcacagccaatgccaagaacacacttctacccctagtcattgtttttccagcctcagctgtcttaccacagggtttgactattgtcaaaataaccgttctttgttttcctcagacctagggctcaataaacatcagataagtacttgcatgggccagggttggaaaggagaaagatgtttggcaactagaagatgaagaaaaactaggtatccaccccagcctgtgttttaaagtgagaataaactgctttttttttttttttttgtaaatgttttggaccagggattatttgccagtatattgctacttatgtggttatcacagatggaagtaggatcacactggagatcccctgctctaaacctactaaatccgagtctgagactccagggcccatatacccagtgaagtttgacacatactgattgagagtgctaggtctaactgggaggcttctcttaactggacctttctcatcatccctgattggattgcagaaacctattgttttgctactaatagactgtgcacattgttggttttggttacacttaatattaataacaaataacatataccatttatcaagtgtctattgcatgccaattgtactttatagacgaggaacttgaaattctgtgtcatccaccaggccaagaaagaccatttgaagtgaagtcaagattccaagtcagacccacatgccctgtaaacttagccatacaatagttctttataaatcgataaacttatgtgaggtacaaggaatgcaagaggaagggactaacttccccagagaggaaaggccctagcatactttttgtcttgagggagcttgcataagtcctcagggggaccgtaaattaccggaattgaagccagaggccaaaggaaattggagtagcgatcaagttaattatgacgggaaaaccctaagttgacatccctaagaaaaaataaattctgatacctgggcctgggcttagaaatataacaaatttctgttatggtgctttgagttctggctggcacattgatctgtaggatattataataatcatcaggcttggataggtgactactacaatatgttatgccataggtgtaagggttgctcttggcaactgagttcatggctcattgttcagagaagaaatagaggcccacagaaagtatggtcaccaaagttcagagaaaattgatggaacatccagggatgttcccaagtgccattctggtattgctaataagctgcttttctagaattggagtgtttagtgtgaaattaagttttttttttcttctggaaatgaacagatgctcagttgcatattagaagtaaaagcctggagtatttataaacttttgtatctcagaagaacctttaccttgaaaaatgtcttagtcagtggtccccagctttaccaaaaatgagctatattgccatttttttcctggacctggaggctgctgagcctcactaagctctcctttcctggggccctgaagacctgcggagatggctgggtggggtcaacccagtccaggaagtgcaggaattcttttaagtgtatgcgtctggggtgtttttctctctcacttacgtgtatttttaaaattctttttagacacccgctttatctctcccaaacatcatttccttactcctttcctgagttcgagcagtagccaggggcccagcttccttattggtctctgagctgtggaggggatgggccagggctcagaggaggtaggagttaggaatggggtgggggaagggttactgctggaactgcctttccttcttccctttgccactggggcgctggctggttcctggagcaacgtctttgctcttatccagcccttaaaacgggctgatattccataaggctgtgaccacaaaaaaacccaagcagcctgatgacagtaccttgcagtctccttgaactccttggatgacatttagggtcttgggctgctggcctcacaccccaggaggtcttaagttgaatattgacagtccccagctaagagaagacactggagtggttgatggtgagaatgtgaactagctggatacgccaatctctcctaagcatctctcctctctgagcaacttccatggtaggtacagccacagtttccaactttgtttttccttctgttgatgtcttgcttcagcaacttggttttctcctgaattcaggcacttgaggatagtggatagtgacttacagaatttgttcagtgacagtgcccaacccagctttagaaaaaaggataaggattctagtcattcctatagtgaggttgggctgcataattggcacttaagcttagtcttgcgctgcttatctctcatcttcctccttctccactagagaatgattttatgtccagaaccgctgagaccttcttttctcactgcttcttgaggaatggttatatcaatccttatgtatataaacctttctgagacagaaccctatgggcaggagaggtcatatagtattctagaaaaagcttgaggatctgaggtagttttttctccaaatttattactcatatgtgagtgtttgtgtaccggggcttgcttgtggaggtcagaagacagacaactttgtatctttggctcttcccttctacttttacgtgtgttctgggaattcaacttaggttatcaggcaggtatggcaaattctttacctacttatccaccttgctagtctgagatctgagttttgatcccaattctaaccttaactctggttattagctgtgtctttctggcaaataatttaagctgccagctactttctttcttcattaataatatgagagtaataatagttcttacacatgatattgaagtgaggattaaaccaactaatacgtatgaggtactgagagcctgacatagtttcagtgtttagtagaggtccttgttttatttttgtaagttaatacaatgtctgtattatgtactatgctaatcagttccacacatgggactgcatcatttataccagaccataactcatgagaaatagatgaccatcatccccattttacatatagagaatatataaccgaggtcccggtgatgttgtagagtacttgtctaacgtacatggccctaaaaggcagcgcctccaaagatgccttggccaaggttacagaactggaatttgaatacaagtgtggactgggtttaggacaattcacaaatgataataggccaggtattgggctctgtagattgtttcttctcttccatatgctaaagttaaatgggattggatctggccccaatcctctttgctgagatttcctaccagtgtttcattttttttttctattgtctccaaagccctcactacattcttcagtctcctctgggattattttctactattggaaaaactctagagagtagggggcctttataagccactgctttaagtgtggcgagggagcactgtagcagaacattgataggagtttctcaagcacacttggttggaagtacccatgagccatgtaaagggacaagtttgagccaatagccaatattatactacatgctatttactgaccactaggtgaaacactaggctatttactggatgctttgagactacttcttctaatgcccacaggaatgtaggcaggtgagaataacggtttctaattttcataacaacctagccaggttaagaaacatttctcaagaaaatggtaattcgaatgggttggctcttgtagagtcacacatgtaaaatgctagagttttattctcatttcctactggtttagtacagctggtagggcagagctaattagacatgaaatgctgacaggcattgcaaaatagcatgttctgatgggctaaattatgagggctagattgcttgagatagtctccccggaggagatggcactagcagtacatgtttatttactttaatttgtataatatttacagcctcatgtccataaagatgtacaagttaatgaccattgggaatatctccattttactgctctggaaatgatagttctgagaagttaacacttaccgacagcaacagcaagtgatagagatgggattcaaagcaaagcagtccaatcactgagataatttctactggaaaatgaacagaaggaaagacaagttggaaaagaacagagctaaccacagagcatgattagaggaaggagactgagccgtgatgtgagctagctttctcagagtttcttcccttctgacatttggttctccttctgtcatctctcctagtttgttgcatctgcttggtctttctacaccctctccctctattctccccccccatctatatgacttccttctcctgcttctgctctcccttccatctgtcctctctctatgtcctagttctaccatgtcctgggttatcttttcctgctaggggtgccatctaatcatgcaaagtatgctggttgacatggatgtatcttgtatgagcaagtcaatgtcagacttgctgtaataggttttagcaccagaatctctagctatgttggaagccttggcctcagacctgtttccagttattcaccgctagcatgctaaccagctgatctcttctgtcatcctaacctatcgcccctcagtccttttcccccttgtaagggtttggactctttgccatgactttgcctacaagttcaagtatctgacttctgtggtctgtgcccatcttaacctttgctttctaggggtatttatgatactctattttaattagctcggtctctttcatgaatgtgtaagctctcaagggtatagactctattcaactcatggctgtacctctagaactgcatgtattttagaagatagagttaacatacaataaatacttatagaatgaatgaagaaaatttaagcaattcacactccaatgctgattcatccaaacattgtaaccacttgcctccttttgctgagaaaaatgggaatattggtcatattgatattcttttcctcaaagacaagtgcagataggcttgcagcagctgctgtgtagtccacaaatatttattgactatctactgtgtgtccttagcattagtgtgcatacttggatatatttgtgaacaaaccatttccattgacactggcattttatgcctccagaaataatccatgggataaaggaaatttgtggattggagacgagggggcatacttacatgtccacactagttccttgtaagataatctagctcattgaatggaaagaaggggtaggtgcggaagttgcttgggaaatgatttcagtactgacttcctggctttttcttgccataggagaaacacccctgtgagtaggccgcactcatggcatgtagccaagctgttggaggggtgccctgacgtggccaccaccatgcatttcccttctgaagccttcagcttgtcctggcattccggttgcaacactaggtgagtctgggactctccccttaaggtgggcttgaggacagagggcctgataacctccctcctctgattgtattcctgcaggatgctttagagctgacgtggtataacagaaaagggatggccatctagagtccctgggttcttcactaactatgtgactagcaggctggcactatgattttgagcatgcatctttacttcttcatggtgtgtcttcaaagtagtttatttgaatcacaaaaacaaccactctgtcctgattcttatcctaatcactagttgttttttattggactcttttcttgattcctgtgagaggcagtcttctctatctatagtcactcaccaggaacttcctctagtgttcattagctctagcacaaagcagaactctccaaagcaggagccttgccaagtcacagggtgtagctcaatgcaaggagcttggtattgtccatttttattgaaacaacgacccaagggacaaaccacttgttatttggtttcttttccccacagttgcagagccagccaaagtacagtccttagctgcatttccccttcaataatcagatcttcccttcaagaatgggttttgttgtgggggctcaaggaggctaaaacccaaggggtgagttttctctagtttagtatttttattttgttttagcattcagggtctcatggcccaggcagaagaatacatagaaatatattctagatttggcttctgtctgagtatgtgtatgcatgcatgcatgtatgtctgcattccagcagaaaatgaggtgaatagcaggctccctttccaacaagaaattaatgtattcctaggtcagcacaaagtgagaagggtggttaagaccatgcactgagcaagaatacgagagaactggtcttagaggtctcatggtatgctgttacagctcagctgtggctctcttctgagctatggcctttttgagatcaaccttcaacctctgaggttctaggcaaggaatgttaatggaacttcttggttcagtctggctatgtgtatgggaaatggggcttaatattcaaaattatgtcttatccttggtcttcctggtgtgattttgctgttggtaggtaagggttgtatggatgaacaaagcccactcttaggtcatgcctactagtagaaggacattgataaccacagcaagaactgagagcaactgctgccatgtagtgatgcctgcactcttgatctttcacctacattgcaacactctagcaaagatagtactactttttcccatttgaaggtgttgcagagaggagctaagactttaggttgagagagacctggattccatttgcagctcagttcagcttctttatcagcttactataattatcagtccgccttacttcatgagttagaaagtgtagaaaacaatctcatttgggcttcaaatggaaggttgtaaagggcctcagtgaatagtcagattttatattatcgagaagtatagtaggttcttggggtatacccaagcaacagagtctttccctagcatgttccaggcctccagtcctaaacaccagtactacaaatgaagtgatgtggaatttccagaataaagaaacatttacactccaattctgactgtgccactagttagaatttgtaaaatttgcctcttcaaagtcactcctcactgtggagcttgcttcattgacaccagaggtttccaaaagtgaggtggggcccagtggcctgcattctcacaagccttccacatgattgtgatgcacactcaggtttgagaatcacgggtttatgaaatggtctggctgaagtcaacatagccccacaggggctccttctgctctaatgctaatgttctggactttcccccctggcagccagccacacactaactcaacagggactcagaagcaatgtcagacttgctgttagcagtgatatagtgcataattgtcatggcgctttccaagtctttggggtgtttgttcattctccttttatataaacttctctttctcattctgccatggtcctgtggtgtccttgtgtcactccttacttatttcactttctttcccttaggccccattgtccttttatttgtaacatatgtggtactggcttgacctgcccttttccatcgcagactggccaaagtagagaaggtgtctgattgcttggctaactaatgcatgtaccctgtgtcttacagtgacgtgagtgtacagtggtgccccctctcccggcattgcagcactgagaagagcagctctattggcagcatggaaagcctggaacagccaggccaacctacctacgaaggccacctcttacccattgaccagaacatgtaccccagccagcgtgactcagcctatagctccttctcagccagctcaaatgcctctgactgtgccctttcccttaagccagaggaaccaccctctacagactgtgtcatgccaggcccagggccgattaaagtcactgatgaccaagctaatgtatctgagaactcaggaagtagccacagtaccagtgaggaccatgtgacctccacttcccatgcatcatcctactcagacgagggccaccactcaggacctgccaagatggcacggggtccaccagagcctccagtgaggagcgacagccttccggcctctagagcccaacttctcaatggagagcagcatcgtgcatctgaaccggtggactccttaccacaaaaggaaaaaccaggcttagagacagtgctgcccccaaggagctctaatcagttctgctgtcttagtgggcaagaccaagtgacagatgaggaccaccagaactgtgagctcagcaagccttctgaatccagccaggatgactgtgagcatctactgatagaggactcctccaaagctcttgattcccccaaagcccatgacaaaggttccaacaaagagtttggcctgcttaaggaggcttcagcagatttggctaacactttgaactttggtgccattccgcacctccgaggaaccatggaacatcgccatagtgctcctgaacagctgttggcatcccacttgcagcaggtgcaccttgattccagaggcagcaaggggatggagttgccaattgggcaggatggacaccagtggactgtgtcccctttgcacaacaaccctaaagggaagaaaagtccaagtcttcccacgggaggcacccaggaccagacccgtaaagaaaggaagaccacgcccctggatgataaactgatggcttctgtacaccagagccaaagtgatgtcctacttggggaggttgatggacacccaaaccgagcaggcagagcaagcagtgacttgactagccagcagccctctgccacttgttcctctgttcaacaaaccagagacttcctttcagcccataaaatagttgatcacacagaagcaagtgaagaaggtgacaatgagcctaaggagtgtggccgattgggtggcagaagaagtggaggcccccggggccgctccatccaaaaccgacggaggagtgagaggtttgctaccaatctacggaatgaaattcagaggaggaaagcccagctccagaaaagtaagggcccgttgtcacaattgtgtgacacgaacgaagccgtggaagagacccaagagcctccagaaagtcctccgctctctgcttctaacgcatctcttctgccttcatataaaaacgtccctagtcctggagacaaggtctttaacaaaagcatgattctcagggctagatcttcagaatgcctcagccaagcctcagagagttccaaagctaggggaggcgtagagggaagaatgagccctggccagaggtctggccagtcttctttggccctgaacacatggtggaaagcatctgactcatccaccttagacactgagaaagcaaatgctcaccatggggtttgtagaggccattggagatggtctccagaacataacgcacagccacaggtggcactatccacagaagcgccttccaacccagatgacagcaaagagttgaagacatctactcctcaagctggggaagaagctgtcctcatgccgtttgcagacagaagaaagttctttgaagagagcagcaaatctttatctacatcacatttgccaggcttaaccactcataacaacaagccatttatccagagacaaaaacctatagatcaaaacttccagtcagtgagctatagggatttaagatgccatcctctggaccaatcatatcattctgcagaccaatcataccatgctgcagaccaatcctatcattccttgtcaccacttcagtcagaaactcctacttacccagaatgctttgctactaaaggccgagacaattccctgtgctgtaagccagtgcatcacggggactgtgattaccacaggacctgttctcatccctgcagtgctcagggaactgtaaggcatgatccttgcatctgttgttctggagaaatctgccctgccttgctaaagagaaacttgttgccaaaatgccacaactgtaggtgtcaccaccaccaatgcatccggtgtacaggttgctgtcacggtcctcagcatagtgcccatgaggacagcagcatggcacctggcaatgcttggaaatccaggaaggcagccatacaggtgaggacttggttcttgggtgagtgacattgattcttctaaaataggattgcacttcctttcaatgatgtagccccttctgtacacaagatgtcagcatacccaggtcactgtagaggttggccaaaggaacttttgctccttcaaattaatagaactggtattgatttgaatggtaaagttagtatctgagtgatctagagcaaaccatgaatgtattatcttttgaagttgcactattttaaaggggaaatatatgttcaccttataaaacagctagtactaatataattaaaaggtagaatccacatatgagctagaaacataccatttgccttcttgagtccgacttattttgcttatttttacttctacccacttttcttttttcaatattttaatattttaattttaattcacttttcatctcaatcacagccccattcctcctctcctctcagtcacacccttccacatttgttttcttaaatttactttctattcactttacatgttttactcattttctacaaatatcatgacttattctttactactaaataaaattatattatgtgtagcaaccagaggactcactaagtcctaccacagatatacttatgcacccttagttatagctacaatacttatagtagctgaggaataaaaccagcatagatgtccatcaatagatgaatgtataacatggctcttctgttggaaaaatcaaagtggagaaccgtgtttgtcagtatgtagtcatatggaagttgaaggcagcaaggcctgcaagcacattaagtagcttgatatagatcagatttacataaggatatattcatcaacagccagcagatttcactaatatttgtacatgtcataggaaacaaattttgcctaaagcagtagaagcaaattgataagtttaaagtgcatgcagaaatatttttgaagtatactaatgcatacaatttaacatttcccacctatgcatcttacacatattttgatttacatattcctagtactctaataggcttcaaggttatggtaaatcatactgttttctgaatagtaaattaaaacactttgttacttctacaaggttgacctttgtacattggctttatagcctaccaccttgctgaactcattgaggcattctagtagctctgtggtggttcatagacaagtttacacagaggcggtcgcttcatcttagaatagaacatccacattctgtatgtgcttccctgggaaagagagcctgactgctctgtctgggatcccccaatacaatgttcagaaggaatgctgagagcaacattgttgctcagttttcagtgtttcactgtgaagtttggtggctacagacagtcttgcagtaactgtccttctgcagtcggcctttattggattgagaaatgccttttttttttttgtcttagcttcagaggggctttctttcttttttaattaagttggactttgggttctttcaaatgttttacctgcatctattgagatgaccatgtagtttattttttgtctaaatttacagtgagctatatcaactggattttgaaataagtatcctcctctcatttccaggataaaacccacttgatcataatatgctaacttttttatgctgctagacctggtttattgacatgttgttaatgccctttgcatctccatttattagagattgtagactgtattgtaaaatcgttgtttttcctaactaggtaatgaggcggcaaacattccctcctcttgtactttcaggaagaatgtatatagcactggtgttatttcttccttaagcatgtggccaaatttatcatcaaaatcatttgggcctgacttttctttctgagaatgtttgaaaatgtacattaatttccccaatagttaacagagttattgaaacaatctgtttcttcatgggtgaactttggtagcttttaaggaattactcaatgtcatttaggttttgacatttatgcagataaaatggttggaacctactttgaagtgcgtctaaaaatttaatatgcactggttgataaatagaagagcaaacaggcacatgataaggtgactctagcacaaacgttatttgtatcatctaggcaggatacgtaaatgttcaccatcaactgctttcctcattttgatatgtttgaaaatattcacaatgctaacaaaaagagaaaagaaaaagtagataatgcccaaaaggcattgaagctgaaactcgacttagctgtgcttcaattccttccccagaatttacagtgcctaatctttcccatcgaaaaaaatgaaggtaatatcagcacctgcttcataagttgcattaaatggcgaacatgtgcaaagcctttagaacagtgactgccagacagtaatcatcttatgagtaagctattttaagatgaagggaaattcggcttaggcttgagaaatcttggctgaaagaagtactcataagcaagtactagggaaaggggcttgaaggtaaaggaaagggtggctacaggggtgtcctctcaggaccagctcctctgaaagacaaggaagttccattgactggtagcagcagctggctgtagcaatatagacaagctgttgcctatgccatatccttccatttgtacttggaggaagggatgcattgggttcctaatgtctgttacactggctaagcctatctgcttagatactaggctttcaggtatgtagatggctatgtacataggaatgtgccatttctacccttgtcacccgaatgctgtattcctgaccctgtgagacatacaccatgctttcagatactccagctctgacaaagtatttactgtggtggctatctgaagaagaggtgagagagcctgttctttctctcatgaagaaggctatggagctaaccagctctggcttagtaaagcctagagaagtgaaatctgcatataccaacaacatacagatttttatgccagttagttttacatacatagccagatgattccactgaatacttacatgggacacctgaggaaactgattcttggaggtcacacatctcacaaggtgcagagccaggatttgaacaacataaaataacttatatgcccagtccactggattctgggtgccttagattatcaatgtattcagtcctctagcaatcaagaagtagatactctggtcatgaatatgctaccatatagcaagtaccatatatttgtggtataatgttatacaaacattcttacgtatggtgtaacatgtatacatacagatatttatacataacatatgtacaggttatatgttatgtatgacatacacatgttatatgtgtataacattctatatatgtgtatcatgtatagtgtgtgtgtatagcataccatgtaactaagttgaagaggattgtaggccatctacttggtgaaggcagatgtggactccaaagcactgcttctagtttcagaggctgtgtgctggcctatgtgtcaactgcctcttcaagagtagagttcaaagcctgggccttctcttatgtagcaaacagggtagcttctagcaatatcacttatacctaagcagcaagttctactattatcttcgactgctatcagttgtgagtattgcttctttggttcaaagagcacagaccagttataggaaactaagtggctgaggcaaaagaataaagtagtactgagaatctgggaaggtcagtgggagttggtggagggtgagaatctgggaaggtcaatgggagttggtggagggtgggaatctgggaaggttggtaggagtggctggagggtgtgaatctgggaaggtcagtgggagttggtggaggatgggaatctgggaaggttggtaggagggttttgttggggtcacccactctattttctaagcactttcatgggactagaccaaacatggagagaaaatcctggtatttgctatggctgaacaagtatggtacctttgtgggcagtgacatctcacaaatatgtcaaggcagatagcctgaagtgtaaattattagaattgctcagtgccctccccatcccccagagactgttctccggttttgtggaagctgaaataaaaaataaacctcacctttttcatagtaacatctccttgaggccagagtttgtattattaaggctggtctcatgcactcaagtagtcttcctgcaatagactccccagtgttgtgactacagaggcttctatgcactgtgccaggcattctctacacatctcatttgatgcgcactagtaagctttatttgccaaatagcaaactcaggttcaaaatggtgacagaatgtcccttacatagcacagataataaatgccttagccactgtaactgataccaaagacctatattcattcttctttgccagctgtttgtccccaaaagagaggcccactggggctaaagcaataagccttggaaaggtctaataatagcagtattagagcaaaatgaatttagcagatcagtgcagcttaggaaaaatgccttctcttacgttaagctctgagtcgccaggtggagggtgatgaatgcaaaagcaggaagaacctgaaaagcaaacatgtattcaggtttaggcagcagtgagaagaaaggaaaatttttacaaatgacacgtatggctgaacaattcaggaaatccatccaaggtagacagtctacttctataacatatgaaccagggcacttaatacttgttcgactggagaagagctcatgtcagcccttgtctgaagatgggtgcacaggagaaagagcaattgcaggatgagagtagctgacatctccactctacatgggagatggtttctgcagcaggaaaacctgctccaggtctctgcttctgtattagaagaagcaggagccgtgaacagttcatcaagtaggacaaaaagaagacctccgtccctcagtgcaagcaggagccagagcaaacatgctaaactggttcttgaatggggttttggaggggtggggaacaagaggaaaattcggcattcttagtcctggtccctgaatgttttatggatttctgcatgagtgcagtaactcagcaggcttcccaaaggaaaggcagccttccaactgagcatttctggagcttgtctgggagcgtccaggctataagctaaggaacctggccagactgctatttttgaaactacctagatacctggctgttcaaagttccctaacttatcagaatttccctttgcaggaatttcctgtggacaagtggaagccaataacaggaaacaggaaaactagtcattctgggaggtaagtgactactcagggatttggggtgactttgtgcctctgaagtttccttagaaattatgatggcttttggtttgcttgattttctttgatgaaactggtatgctgttcacatcatggacttgttgccatatataatctaatgtgccccctacaccatcatctgaatatagactaaatagattatgagaacattttagaatagggaggaatcagcagtgttgtaaaggtatgcctgaagcaactatgtctagatgtgcctgaggacatagcaaaccagactgtgctgaaaccagaggaagacgtgatctgtgcctgtcttcccagtggccacaaacaattggaatcaatagagaagagggactattctctttgtctaacatttttgaaggtacctacttcttgggttctgccaccacacttttaatagagtttattgagaactgaaggactgttaaaaaaaaaaagtttatgctggtgataggttacaactcttggagaaaggcacatgtggcttggaataaagagaaaataactcctttgtgtaggatggagcatctaactcctataattgtggataatggtagccagcactcaaattccctagaaacaaggggctctaagtgaatcagagccagcagtggatagtcaccttccttctctctctctctttctctctctctttctctctctctctctctctctctctctctctctctctcacacacacacacacacacacacacacacacacacacacaccttgatatgctctttcagccagtttttctcaggctgggcagtagaagagggttctccatgattttgagtctgactttcccagaataaaggagacagaaacaaaaggtgcaagctgtgcctgttctccatgtgaaggcactaagagacatgaaaagaatcttggtctgctggcccttaagtagtccagaattctttcaggtggtctatgttatgctccattactttcaattacaatataactatgtcattttccccttccctttctttcaaccaactcccatgttctatccctccagctctttccatgcctccccttattcgtggcctctttttcttttattattattattgtcaaacacacacacacacacacacacacacacacacacacacacacacacaagtataaatgcaccctgctgagtctatttggtgttgcttgcatggatgattttaggcatgaccacttggtattggataaccaatcgggggcttctccctgaggaatgccgttcagaagcttctttgatgagagataagagctacagttagctgtggaggtaatcatcggctttctcattggacttaaggcccaatcaacaagaggaaaaataggccttgaacaggaaacctggccaactatataggaataggaagcttgtgggtcttcgtggaaaacctactatttagaggaaacttttgcatttcccctgcaatgggaaaggggaatgcccaatatgtattaatcatctgtgactatcagtcattggggtgatgagactacatttgaattttcttttttttttttccattttttattaggtatttaactcatttacatttccaatgctataccaaaagtcccccatatccacccacccccactcccctgcccacccactccccctttttggccctggaattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgcgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccaatatgtattaatcatctgtgactatcagtcattggggtgatgagactacatttgaattttcatttcctttctacagtagttcttttgctgccagtcttataggtgctctctagagaagttatataatttaacagatagcaaatggtactattatgtttcagacagtctgactccaaccttcctgtccccccccccactccctcactattttttctgcttaccttaggatccaaaaagggcagactgtaaataggttcctcaatagagtgtttcaggaatccaagttctaggtagagattttgtcttgatcagccttcatcagcctccctccactgcaagctgtgaacttttttatattatatccttggggatataattttaatctagtgacactgtttataattagattgaaacctttaaaagaagataccgtatcttaggcacagccttattctttgtgcttaatacaagtggtatttatcatctggtagccagaaagaagaaatagaatctactcactactacatgggtgaaaagacacaaaaacaataatgccaactaacattttcctgtttttttccctttcattttatttttttcaacactagggaaagaagctatgatcttgtgtacactgggcaagtgctccaccataaagcagcaccccagggcagtaaataactcagctctatgctgtaagcaccatggaatgcattttacaagtcgttatcactgtgaggttgtagagtaggtataatcagtgtaggttccgcttctgttccatgtaattcagagaagcagttgaggcacacacgaaaacattcatttgcctaaaacccctcagctggtaaggtaattctccctaagtagtctcacttcagaaaccactctccaaagtacttctcctactcacttgtccgagaagtaatagtcttactaaaaacttagaaggtggactccctgtagcttagcaaggtgggagctactagtgaaagagcagtgagaagcattatctgcccacagctggagcagaacaagagtagcccacacaaagttcagcaacggtaataatacattattacttgcaaaaacaacctatgtgctaggagttgagttgcacaacttcctaacaattccagcaggtaggtattagattagggtatgagatctcagagttgcgtgtgcaacagaaacttctggacagcttgttgaaacatgagagctagttggacccccagaaaaatctaatttcataggtgtgaagtatggctcaaaaatcagtattgctaactggcatcctcgggtgatgctggcgcagctagtccttggaccacacattgagaattgctaactgaaataaaggatttgaggttcagagagggtgaattatccactcaaggtcagagctggtaagtttttccttaccaaagtttccaaaagaacatagagtttcaacaagaaacactgcgccccagtccatgataattatttattgtgttttgttatcatcagttcataggaggataagagacctgaaggtggtaggagaggagactaagcaagatgtcttggaggaatcaaccctacaactgaagttagggccttggagttaatactgcttgagctgagatccatgttcatgtgcgtcttcctccctacccccctcattgactcttcttgccatctctttcttatctctgtcactgtcttcatcttgtcttttgtgtaagatagaataagagtaacaacatcaaatatttgtgagattcaaatgaataaatataaagaaacccttccagtcaaaactcaacactaggaatgttagtcgtgctgatgaggagaaggcatggaccacactcagcaataagagcagagaaatagaaattaggaagctttagaccaggataggtaagcctggagaactaggtaggatgagcaatgtgagagcaagtcttgttcactcatcaccagtgagaactaagttctgatgggatagcacattgacactctgatgtgctgtgtatgatgcagtgactacagacagcagtaatgaactaactgtacatctgaaaaagcgagaagggggatttgaacattttgccataaagacatgataaatatttgagaagagatgtttaccctgacttaatcattcgatgtaatcgcatcaaatgtatacaattattcaatgtatacatgtatcaagcaatacctggtgccccattaacacacacacacacacacatatatgagaagagagaggagaatgggacctggaaaatgacaaaaattccttatataaaactatgaaactttcaaacacaaataaattcaaattaaaaattattgacagtcagtgacttgataaatgtggcattttaggcaacttggcagcattagcagactggatgagttggagggtaaccaagaggggcagtggtccaggaattaaaatgtgttatggacaagggagtggatgtggaggtgcagtagaaatatagaacaaaagatagataaatgtgtgtggggctttgggagaaaaagaattgtttattatggaaacagcactacagaaaattaaccataagaagaggtagccatgtttctcccaccttaatcctctcattttctgttggctttttctataggtgtgatgattattcctggcagagttgtaataactatgcaaatgaacttttgtatcttgatccactaagcattatttgataaataattttcattcaggcttcctcaataattataattttaacagctataaaatatttcatctgcttatttggtagtaatttgcttaatccttcctaaattgttgaataatccagttgttttcaaggtttttatattataaagctattatctagaacattttgaatagctatagatttttttctcattttgattttctcattagaacaattatctctgaaagaattattaaagaatctactttctggaatttgtatcacaaagtcacaatatatgaatattcttaagaccctttatatatttaacaaactttcctcaggaggcattttacactatcatctgcaatatgctacaatagttctttataccaaatcttgccatcattgaaaaattttcttttcctaacacaacagctatacctgctaatcactttagtttgcttgccttgatcattcaagtttgaacatttttttcatgtgttaatgttagattatttgcttacaactacaagacatctttttgaaggacaagaagagaaaactggttctagagctttgaaacagaggacatgattaaaactagctaaatcctggtagcctgagaagttactgacatagatgggagagtccagaaagagagcaggtttagaggagaagatactagcctagaaccaagatatgttagacatgaagttaatgaggtctgcaggcagattctttaaaggatgcttgccaaatatccagccaggataagatgaggaggagaaaatgataaagcagaagtggtagaaggaattatctgtcaatgtactgccatcatggaagacagcattaatgggctttgacagtttgcagtcttaaggttccttcaggaaagcaaatttagcaaactactgggtatggaaaatacacggcatgattgcctgtaattgagttctgtgaagaagaaatgaaaacatcttcagtcattatgaattcactcattctgagtatacaacttgagtatgtttggtagatgatgtataatcatcgccacaatccagttctagaatgtttctgccatcctgcaatgatcgctcatgcctatttgcagcagtcacttgccattctcccattttcaatgtgatgcaattgctaatttgtttcggttttcatagaattgctcttttctgttcccctcattcaggtagaataacataacacacatgattttgtgtctcatgtctataaattgggatggtgttttagccatgcatccacatggtagcatatttcaggtcttttttttttttttttttttttttttggccaaataccatgatgagttcactttttctttatccagtcatccactaagaaatacttgagctgcttttactttctgttacaagttctgttgttatcaacattcatatataatgttctaggtaggtatgttttcagttcttagcatacttaggagtagattttctgttctatatggtaactttatattgaacttttaaaagaagtatctgtcttctaaaatggctgtacactagtttattatttttgttgatatcattatactgtgtggttaaaatgtttagaaatattttaatattgaaatgttttaaaagaaactggctaggtaaaagaaaagaaactatggacacataaacttaatttagtggttctcaaaacgtggtcacaggcccagtaacctcagtcatccaagactttcttagaaatgcagtctgaggccccacccagccctagtggattagaaagacccctcaggatttttcagccctctatgccattttgacatatgagaagttttgaaagcaagctgtttaagtgatggtttggtagaggtctcagaaactagattaaatttaaaatagaaaaagatgaacaaaaagggtaagaatatcagtactgaaaatgaaagaggcagatcacagttatagatgtcagacaaatatgtaaactagtctggtggttccttaaaagcttacaaacaattaccacatggcccagcgataccataactggttatattcctgaaggactccaagtcagcatgctgccaagatgtttacatacccatattattgctatactagtcacaagagccaagatcagaaaattggacatagaactaccagaagatccagcaatacctctcctgggcatatacccagaagatggtccaaccagtaataagaacacatgctccactatgttcataccatccttatttataatagccagaagctggaaagaacccagatgtccctcaacagaggaatggatacagaaaatgtggtaatttgcacaatggagtaccactcagctattaaaaacaatgaatttatgaaattcttggacaaatggatgtatctggaggatatcatccttagtgaggtaacccaatcacaaaagaagtcactagatatgtactcactgataagtggatattagcccagaaacttagaatacccaagatacaatttgcaaaacacaagaaaatcaagaagaaggaagaccaacatgtgaatacttcattcctccttagaatagggaacaaaatacccatgaaaggagttacagagacaaaatttggagtaagatgaaagaaatcagcatagatgctcaccaacaggtaaacagataaagaaaatacacacacatacagagagagaaggagagagagagagagagaaaatatgagtgtgttaaagttagttttagaactttatttagccctaatgggagaaggttataccatttgtagaaaagtggatggaactagaaatgataatgttaagtgaattaagtcagattcagaaacacaattatgttcactctcatttttaacatatatatatgtgttaacacatatatatgtttatatatatacatatatatgtatatatatgacatgaaagtagaatattatgtagagaaaggaaggtattaaatggagaggcaaagagaacaagagggtaaggggaagaaaaaaacaatactgcgtttcctctcatatgaggactctacatttagcaatatatagatagatgtgaagatagctggagttggcacttcagggagaccagtggtgagggagtgcaaaggaaaatggtaataaagggtagtcttgaagaaactacaattatacatgtatgaaatgccataatgggacatagtaccttatgtgctaactttaaaactgagtaagatacaggaaagggttatttttttttttcagatatgaaggactagaaaagacttagtgagaatatgacatttataaggaaaagtcctgatggagttttcccccgcactttttcttagtaccacacacatacgctttcacatttattatgtcatttctgtcacaactagaatgatgggtgtaggtgggagaatcaaaagtataatcttaagttacactatctgcctcgaagcagataactctaagtagttctattcctagtttctctcagttgttatttgctttacatgcagagagaatgcaaactcattttggtattagtaggagaggaatattaggagtagatatagtgggagaaaaggttacataattgtaggtacttaaaagctaacagatactcttttctggattatctcccttggatttctgtacttgtaatcgcctacctcaattctttcctttttccattttgcatgtaactgcagaatatatatttatcgtatacacagccttagttaactccaacaacattgtataccttatttttcctaattcactctggaggaacctaatactacggaagaaagtaaattaaggaaagtgatcattatactagtaacggcaagaaaaaggtatgatagctaacatttattgagtgcttactatctgtcagaccccatttacataaattgtgtagtcatatgttatggtcttgtgtgtgacatacttttgccaataagataactgactcacaagaagattaaagtcacggtcccaaggtcagacagtcatcttattccagagcccattgcctgtggatttatagtgtatttcacaactttagagctctgtgtagttgtttcaactctctactgagattttcttccttttctcttccctattctaccttgggttgggtgtgggggaatctaggatccacttcctattttctgattaagtagaagaaaatggatagttgaatctgattgcataagaaatagtccatttccaggaagccattcacttacagatcatataccttacttagattgatagcacgttctatccagaaggtaaaacaggggaatattaatgaatttatgaaattcctaggcaaatggatggacctggagggcatcatcctgagtgaggtaactcaatcacaaaggaactcacacaatatgtactcattgataagtggatattagcccagaaatttaggatacccaagatataagttacaatttgcaaagcacatgaaactcaagaagaatgaagaccaaagtctggacactttgccccttcttagaattggaagcaaaacacccatggaaggagttacagagacaaagtttggagctgagacaaaaggatggaccatctagagaccaccatatctggggatccatcccataatcagcttccaaacgctgacaccattgcatacactagcaagattttgctgaaaggaccctgatatagctgtctcttttgagactatgccggggcctagcaaacacagaagtggttgctcacagtcagctattggatggatcacagggctgccaatggaggagctagagaaagtatccaaggagctaaatggatctgcaaccctataggtggaacaataatatgaactaaccagtaccccctggagctcgtgtctctagctgcatatgtatcagaagatggcctagccagccatcagtggaaagagaggcccattggtcttgcaaactttatatgcctcagtacaggggaacaccagggccaagaagtgggagtgggtgggtaggggagtggggggatggtatgggggacttttgggatagcattggaaatgtaaatgaggaaaatacctaataaaaaagttaaaaaaaaacagtggaataacatatttatttcagctgaggatataagataaatctgtggctgttaagttgaagatgtcattagatacaagatggatgggtagaaatataaaaaagttagaataagaaaatttgtacgccaaaatgtaataaaaagctaagctgcagagagagggaaatgccagggaacaacattattgatagcagtggaatgtccaaaatggatgaagaagggatacagatggagaaggtcagattgaagatttagtttgaagatttagctttctaagtggacaaagacttagcaggcagtttactttacacccgaggaaagaaactgtaaaatcattccatggaaaactataacctctagagcaattaaagaaatataaataaaatcaatttcaagatattatagaattcttattaaactgtcaacaatttgcagaagtgctaagtgaaattttaaaatcctacctaggcaaggcatggtcaaatagcagtttttccctggaaacagtatatattagttcacttatcctagaggacattctggaaatatgtgacaagaatgcattactcatcatattctgtcccaatatactttcaagggaataatccaaaagataaaattaatttctcaaaaagtgtttatattacctctacttatggtcattgaaaaggcttagcaatgtattctatcgtaaatgatggactagaatagagcagccactaacaatgacagatgtacaaatactgaatttttcaggatatgtaatcatattaatgtaataattataccttaccccagaaaggtaaacactaatccacgtgttgaatttgaaaggaaattcatgagaaaaaaaatctgattacatgtaattagcttgatttgaaaaagcatagtgtgcattgggtatgtgtcaaaatgttgaaattcataatttaaaaaaaaatttgaagaagtagcagaccacatcagtttgatccagtcctgggaagtttgagatcaaaggctttgcaaacactcctatatcagtaacagatgggttctcaccaggcatgctacaatttggtttgctagaactctccatcagttagtacctctgcttatttaaatccaggagaactttgacatccaaagggatacctaaccaaaccaccatgaacctccacatatgtcaccactaccatgacatagtattctaccctcctcccatataaatacataaaaatattatctgattcattcttataattttcttaagacctttctatttcttttcattcaatcggtgtcctattgggaaagggaaaaccccacatgttctgtctaccagtgtaacttctgtatctttggtatcttcatgtgtagaaatcggagtcatttgggcaagggggtgtagaactaagctttattcatgacaacaatggcagtttgttttcacctcttgggggactgaaagaaggtttagagtaagaacttagcatttgctgttatcaactggaagtttctgtgagctcagggccagggagagatgacaacagcaagatcttcgagtcttttctccttcgtgtcctccttgagtcttgtttcctggatcttgcaaatgtttcctccaataataacctgggagtggctgtttctcttggagcagtcttatctcttgactgtgtggggaagggaaaggcaagaggcattggccctgtatgctctcactaccatgatcctggaatgccaagctattgtggtaagtttaaaaataaaattcccaagcaagaaaacttcaaaagactagaggaagaggcaggaggagatttttccgtctctgacagtactgctcttagttttcaactggatccctgtaatgtttttaacaaagaaggaaaatgtatttgtcagaagaaagggcaacctgtgccaagaagaaaaagagaacagcctaagtcttggcatgccacttgcttttgttttggagatctagccatataacctcctcactagtgtcaacaaaacctttccttaatttcatgtttcctcttttttcttcagtgaggagctaaaaacgtcttcagagatacatggagacaaatgtagtgtcctgccctagcaatcttcgcttaagtgggactgtccctggagcaggataagacagactttgctgtgaacattcttctttctactttctaagaaaatgatttgtccttttatcctcaggattcctagctacaaactggataatgctgccttttttactggctattggaaaaattgattatactgcatatgtgaaaaagctaaactagtgctcagtatgcattgagaagcaagaaactatagtttctgcccatcagtgaataaccctgacttcaaagcagaaaatccttactttgtcccaaagtagcattacagattctgtacaaattataagtcttgtgccttttcagtattaaaccctctataggtcgatagtcccggcttgtgcctaccataattcaatggaagactattagatcaccgtgctgcagtcatgctgagaagaaccctggtctgtgatacttaccagatttgcattctacccctttctctagccaaagccaagaaagaaggcaggggactagagcagaaagtattgtgagagacacttgaatctaaattctaacagactttcaaaatctacttacataaaaaggcgcatgcctttggatgagatatgttacccatcttagtctcagaaatacatgtctcacatagccttcctgaggattaactatataaaatggtatagaaatgctttgtgatacatagaaagattcccagtagatgaccatattatcattattagagtgaagtctccaacttgagccacagcatataactgggcaaaacgcacagtacatgcccatcatagctgtatatattatatgtaggaagttaggcagtgttgcctggtagttaatgttcagctttgcacaacagtcaagaaaccagaacgaggctccaagctcagccaaatgactacatagccaagacaccctagtttgtcaaagattccaattgtagactcatccactcactttttttatccagtaaaaagggaagagatgataaagagaaggttagcccctagtaagttcactacactccagtagagtatacacaatcaagtatatgagagctgcacacattggtggaatttttctaatgacacaaattgggtgggtatgaggtgttaatctggaaagaattgggggagaaaggatataatccaaaaagatgtataaacctctcaaagatcaaaaattatttttaatatatgttaatcaatcagaaagaattgcatcacttcctctctcccagataacatcctcaacccccctcccctgccccaccctcaaatggatagcaaagttgtggtagtagatcatttctagggaccataatctcactagccccaggaaactgactaggtttccagtaacaggcatgagttctctgcaatggaccgactataagtccaactagacagctgttgttgccacaggtatgagtgccatttcttgtaccgttgtgtatgtcttgccatgctagtactcgttgtggttcatagatgctgcagctgggtaggactgtttatctgccttactcccttggaagtttgcatagtattttctgaaaccacaaatctagatcagagaaaagagactttcaggttagatacagatcgaacatctaggtcttgtatcctaagtatagtgtgtcttcattaatagtatctcacccctaagccctgagagataaccaagggctatacagataatctatgttattttgggagcttcttggactacctaaggcaggcaaagggggtttgtaatgcctggtattatggtttttgttagtctgtggttcttactgggaacactgtcatccaagtggcttaacttcctttaaaacacgcacacacacacacacacacacacacacacacacacacacacacagagagagagagagagagagagagagagagagagagagagacagagacagagacagagagacagagacagagagagacagagacagaaagagacagagagacagagagagagtgagagagtcacatataaagagaagataattgaataattttaggtaaatataaaacaatatgattacttgagcctttctcaagcaaaattggtgttatatgttccacatccctccttctccttctagtttgatctctgtctcttcttcgtatttgaagttcccctcattattctatttctgactttatatcctctgattccagctattcctttcccaaagccctcctgactgtgtttatcccttcctggtttctattgttattctatgttgtagactcacatctgagggtgtggagctaggaaataccaatgagagacaacatgcagtgtttgggggattctgcattgcctcacttgttacaatcttttctaggcccatcatttcccctacaaatttcataattttatttttctttacagctgaatagcatgctaaagtgtatatgtaccttatcttcattatttactcattacttgaaggacattgaggtagtccatgtcctagctattgtggataaggcaacaatgaacctggctaagcaagaatctgtatagtagaatatctaatattttgagtacataccaaggagtggtataaagctgggccatggtagatttatttttagctttttgagaattctccacactgattttcatagtggctgaaccagtttgcagtcccaccaacagtgaatgagtgcttctttcccccctatttgttgttagttgttttgtttatctttgtcattcttaactgagtaaggtatatcgaagttgtttttatttgtattttctcaattcctagggatgctgagcattttatttggaggtatttcttaacgattttttttcttcttttaagaactctccatttgggtctccagcccagtttttgagttggtcatttgtttggttttgcctctttgttttttgagttctttatgtattctcaatagtattaatcctctgtcggatgtgtagatgacaaagattctctctcattcttttggcctccagttcacttggttggttgtttccttagccatacacaagtgttttagttttatgggctcccactttgttaactgttggccttcgttctttggctaatggagtcttgttcagaaaaatcctttcctacacctatagcttatagggtactacctgtgttttcttctagcagttttagtatttggggtttgagattgaggtctttgatccacttggacctaattttagattaatagtgatctaatctcatctgtctgcatgagaacattctgttttcccagcaccatttgttgaaaatagtgtatttaatgtatgatggttcctcattatcaaatatcagctccaaatactcatgtttgggtcatctattttattccattagtctccatgtatgctttcatgccatcgccataatttttattattattatagttcatgattataccttaaagtatggaacagcgatccctccaccactattctttttattcatgactgattaagttatctggggtcttttctgtttccatatgatttttagtgagtcgattcctatgaagattattgtaggtgttttgattggtattacactgaacctggaaaatgtttttggtaggatggtcattttcacaatattagttctaccaatgtatgaacatggggtgtctttccatagtgtcgttctcattatctttcttcagaggtttcacattttcatgatagagttctttcatcttcttggttaggtttattccaggatattttattgtctttcatctcaaagacaattttgttgcctgatttaaaaaaaaaatccagtagttgtttaaagcaagtttgagtttaagagcagtctgaagaatcagaggacaaggtatacaacaattgtctatgtcagaaatgaacgaattatttcggtcagctttgtatcatttaaccccctggtaatcaacatcaaaatcagttggaagaaaagagcatgcctttggagggcactctggctgtactaatttatggaaccataactttatctggagacagcatgcttcaaaaagtctacttactggaaattgttgcagtataaatcagccctaatatgaaaagaactggtcttccaatgtttgaggtgtagagagccttcctgagcattaaagaaccacttacatcagaggggaagaaacagatatgcttatagaaaagggacagagtacctacaacgaggtctcatcaaatattgctctatatgatcagtgtgaagaaaaccatacatagtccctgactttccaggttttttgtctgtttgttcatttgttttgcttttttgaaacagggtttctctgtgtaacagaaccttggctgtcctggacttgctttgtcttgctttgtataccaggctagccatgaacttacaaaagatccacctgtgtctccctcctgagtgctggaattaaagatatgcaccaccacccagttagcctttctagttttaataattgaagaaaatgatgaaagtgatatacgttttgtgaaaccactgcattgcataaggtctagattggaaatcaagatggagaagggggagagatagaagcacaggatgtaggaattaccaacttggtgtgtatgatgaagggtagggacagcatgactaatttcacatccatcctaattgaaacaaacaactatacccccaaacaacaaccacaaccctaacaggcttcaccctggctttttgcttctataatgtagttcaggaagtacatgcttagaatcccttgagttgctgtttaaaatttaggtgcctaggatccactgtagagattgaaatcccaattagggacaaggctgtatatatttgcatgtaagcaatctcccccggggaattttgattaggagtcaccttgattaaggactgctgtccaaagctagtagtgtccaacttttggaccatgtcccagaaagttttggagcatgtacctctgacatcaactagcactatagtttactcataaatctcttaggtttacttatattttgattcatagaatcaagaattgtaaacataaatgaaatactatggaacctaacacctgggacttgagaaaatgaggtgacctagacaaaagtaaaatggataagggcttagagtcaagtgctttaaagtgcacctgcagtggaaagatgatttaatttttctgaaaacaacagacctctccatcaaaatgaaggaaaagggacccacaaaagaaccagtgattattaatatctcacaaatcctcaggcattagataccaagtattggaaaataggtaatgttttatttcagctcacagttttgaagatttctaccagtgacccactggctccattgctttgggcctgtgaataaagaacatggtgcagaaggcctgttcacctcatgtttgggtataaaacctcacaggagaagaggcctgaaatttcctctgaggggacatgcccagcaacctaagacttcctactagttaccacttctaaatattttcaccagctcctaatagcactaaggttataaccaaacttataagatgtgagcttttgaggctcattctagatccataccatagcaagtagtttggcagtttgaatagggatatcccacgtagattcgtgtgtttgaatgtttagccatcaggaatatggcactatgaggaggtatagccttgttggagtagaggtctgcttcatctgagtgtcactagtgcatgagctttgagatctcagaagctcaagctaggcttcgtgactcagtctcttcatgcaaccttcagatcaagatgtagaactctcagctccttttccaataacatatctgcctgtactctgccatgataatggactaaacctctgaaactgtaaaccagccccaattaaatgttttcctttataagagttgccatggtcatggtgtctgttcacagcagtgaaaccctaactcagacaagtaggaagtagcatcttgtggaagcatcatattttcgagatgtgtagctaaggccttcactagacttgagtattaataacagcacaggggcttcagccacctcattagaagtaatgtggtgatcctatagtaccatagcagacataagccagtaataaagttagagaacattatgtggttgataaaattaataatttacattagcttatgccacttcaaagaattaaagaatttagcatacttactatgcaaacacagccataagctaaatactactctaccctctaccaccaacatacatacacctcagctagattctaaagcagttggaagctactctctcatttacctagtatttatcgttctttttgcttagtggctttgcccttggtgctagggtacaatagatgtgatttttattttaccatagtcataaagaaaaatctgagtacttgctgtgcattagacgctaggttggatccttgtggtaatatagtagtgaacatgacatggctgccaccttcagaatggtcatgattaaggggtaggcagctgagcagtactgtattaggaagtttgatgggctcttagatggtccatttggccccatacttgagtggagaatcaaaaaagacttcctcaggaaagtgataattaaatgtgaatttgacaagtcacagaaaggaaggaaaaagaatgagatagaaagggagaagaatatatataggcaaggaatagaagtgtgagagggaagccttataaaacacagcatgggctgtgtgttttctgaatacattaagctccaggcagggaagtatataacatcagttttatgctttatgttaaccttgaatgttactaaatattttgaatttctatgtccactttttatagatgtctattgattgcacatagtaacagaattcataaagaaaatttcttcaagtgtagcatacacttacctacacatatcaaatacttattacattatcatatacttacacatattacattagattcattagtacagctttgtctttgcgttctattgctgtaaacagacaccatgaccaaggcaactcttataggaaaacttttaattggggcttgcttacagttttaaaagtttagtcctttattgtcatggagggaagcatggcagcatgaaggtagacatgttgctggagaaggaactgagaattctacatcttgatccactggcagccaaagtaaatgccacatagggaggggctctaacttctgagacctcaaagtgtgcctccaccattgcatacttcctccaacaaggccatgcctcctaatagtgctactccctgtgagactgtggggcccaatttcagtcaaaccaccacaagttcctcaccaaatatttagaattttttagtatgccaaaaattagggcatgtttttgtgcacttgattctataccttgctttttttgtgatagttctatagatttttgtatgttgtactcagatcaattgcattactttgagcagctatagagtattccatatttagctctttctattttattttaattcctatagaaagacatttagaatatttccattattttgattatgcatgaagctacaatgaatatccttgtacatatccaattgagttcatgttgaaagataaacatagaatatatgtgtacctataacatataaatatataaaatccttagaaattgaattgctggatcaaatgataggcactcttgagtctcctttctttacaaatgacctttgtaaaattacaccattttacacttccaccgagagattacctggtttcttttttttcttttcttttttttttttttttggtttaattgaattaggactggcttactggttctaaggttccattatcatcatgacatgaagcatgacagcatccaggcaggcatggtgctggaggagctgagagttctacattttgttcttttttttctttttttttattacgtattttcctcaattacatttccaatgctatcccaaaagtcccccccaccctcccccgcactcccctacccacccattcccaatttttggccctggtgttcccctgtactggggcatataaagtttgcctgaccaatgggcctctctttccactgatggccgactaggccatcttttgatacatatgcaactagagacacgagctctggggtactggttagttcataatgttgttccacctatagggttgcagatccctttagctccttgggtactttctctagctcctccattgggggccctgtgatccatccaatagttgactgtgagcaaccacttctgtgtttgctaggccccggcctagtctcacaagggacagctatatcacagtccttgcaacaaaggcttgctagtgtatgccatggtgtcatcgtttggaggctaattatgggatggatccctggatatggcagtctctagatggtccatccttttgtctcagctccaaactttgtctctgtaactccttccatgggtgattgtttccaattctaagaaggagcaaagtttccacactttggtcttcgttcttcttcagtttcatgtgttttgcatcttgtaccttatatctcgctatactgtttctgggctaatatccacttatcagtgagtacatttcatttgagttcttttgtgattgggttacctcactcaggatgatgccctccaggtccatccatttgcctaggaatttcgtaaattcattctttttaatagctgagtagtactccattgtgtaaatgtaccacattttttgtatccattcctctgttgagaggcatctgggttctttccagcttctggatattataaataaggctgctatgaacatagtggagcatgtgtccttcttaccggttgggacatcttctggatatatgcccaggaaaggtattgctggatcctccggtagtactatgtccaattttctgaggaaccaccagactgatttccagagtggttgtacaagcttgcaatcccaccaacaatggaggagtgttcctctttctccacatcctcgccagcatctgctgtcacctgaattattgatcttagccattctgactggtgtgagatggaatctcagggttgttttgatttgcatttctctgatgattaaggatgttgaacattttttcaggtgtttctcagccttttggtattcctcaggtgagaattctttgttcagttctgagccccatcttttaagggggttatttgattttctggagtccaccctcttgaattctttatatatattggatattagtcccctatctgatttaagataggtaaagatcctttcccaatctgttggtggtctttttgtcttattgacagtgtcttttgccttgcagaagctttgcagtttcatgaggtcccatttgtcaatactcgatcttacagcacaagccattgctgttctattcagaaattttttccctgtgcccatatcttcgacgcttttccccactttctcctctataagtttcagtgtctctgattttatgtgaagttccttgatccacttagatttgaccttagtacaaggagataagtatggatcgattcgcattcttctacatgataacaaccagttgtgccagaaccatttgttgaaaatgctgtctttcttccactggatggttttagctcccttgtcgaagatcaagtgaccataggtgtttgggttcatttctggttctttaattctattccattggtctacttgtctgtcactataccagtaccatgcagttttatagcaattgctctggagtaaagctttaggtcaggcatggtgattccaccagaggtacttttatccttgagaagagcttttgctatcctaggttttttgttattccagatgaattttcagattgctctttctaattcgttgaagaattgagttggaattttgatggggattgcattgaatctgtagattgcttttggcaagatagccgtttttacaatgttgatcctgccaatccatgagcatgggagatctttccatcttctgagatcttctttaatttctttcttcagagacttgaagtttttatcatacagatctttcacttccttagttacagtcactccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcatcttttccaatttgtatccccttgatctccttttgttgtcgaattgctctggctaggacttcaagtactatgttgaagaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaagacttttatcatgaatgggtgttggatcttgtcgaatgctttttccgcatctaacaagatgatcatgtggtattgtctttgagtttgtttatataatggattacattgatggattttcatatattaaaccatccctgcatccctggaataaaacctacttggtcaggatggatgattgctttaatgtgttcttggattcggttagcgagaattttattgaggatttttgcatcgatattcatacgggaaattcgtctgaagttctctatctttgttggatctttctgtggtttaggtatcagagtaattgtggcttcatagaatgagttgggtagatttccctctacttctattttgtggaatagtttatgcagaactgggattagatcttctttgaaggtcaagtagaactctgcactaaacccatctggtcctggggtttttttggctgggagactattaatgactgcttctatttctttaggggatatgggactgtttagatcattaacttgatcctgatttaactttggtacctggtatctgtctagaaatttgtccatttcttccaggttttccagttttgttgagtatagccttttgtagaaggatctgatggtgttttggatttcttcaggatctgttgttatgtctcccttttcatttctgattttgttaattaggatgttgtccctgtgccctctagtgagtctagctaagggtttatctattttgttgattttctcaaagaacctactcctcgtttggttaattctttgaatagttcttcttgtttccgcttggttgatttcacccctgagtttgattatttcctgccgtctactcctctctgtgaatttgcttcctttttttctagagcttttagttgtattgtcaagctgctagtatgtgctctctcccatttcttcttggaggcacttagagctatgagtttccctcttagaaatgctttcattgtgtcccataggtttgggtatgttgtggcttcattttcattaaactctaaaaagtctttaatttctttttttattccttccttgaccaaggcatcattgagaagagtgttgttcagtttctacatgaatgttggctttccattatttatgttgttattgaagatcagccttagtccatggtggtatgataggatacatgggacaatttcaatatttttgtatctgttaaggcctgttttatgaccaattatatggtcaattttggagaaggtcccgtgaggtcctgagaagaaggtatatccttttgttttaggataaaatgttctttagatatctgtcagatccacttgtttcataacttctgttagtttcactgtgtccctgtttagtttctgtttccatgatctgttcattgatgaaagtggtgtgttgaagtctcccactattattgtgtgagatccaatgtgtgctttgagctttactaaagtgtctttaatgaatgtggctgcccttgcatttggagcatagatattcagaattgagagttcctcttggaggattttacctttgatgagtatgaagtgtccctccttgtcttttttgataactttgggttggaagtcgattttatctgatattagaatggctactccagcttgtttcttcagaccatttgcttggaaaattgttttccagcctttcactctgaggtagtgtctgtctttttccctgagatgggtttcctgtaagcagcagaatgttgggtcctgtttgtgtacagtctgttagtctatgtctttttattggggaattgagtccattgatattaagagatattaaggaaaagtaattgttgcttccttttatttttgttgttagagttggcattctgttcttgtggctgtcttctttttggtttgttgagggattactttcttgcttgttctagggcgtgatttccgtccttgtattgcttcttttctgttattatcctttgaagggctggattcgtggaaagatagtgtgtgaatttggttttgtcgtggaatactttggtttctccatctatggtaattgagagtttggccgggtatagtagcctgggctggcatttctgttctcttagtgtctgtataacatctgtccaggctcttctgactttcatagtctctggtgaaaagtctggtgtaattctgataggtctacctttatatgttacttgacctttctcccttactgcttttaatgttctatctttatttagtgcatttgttgttctgattattatgtgttgggaggaatttcttttctggtccagtctatttggagttctgtaggcttcttgtatgttcatgggcatgtcattctttaggtttgggaagttttcttctataattttgttgaagacatttgccggccctttaagttgaaaatcttcattctcatcaactcctattatctgtaggtttggtcttctcattgtgtcctggatttcctggatgttttgagttaggatctttttgtgttttgtattatctttgattgttgtggggatgttctctatggaatcttctgcacctgagattctctcttccatctcttgtattctgttgctgatgctcgcatctatggttccagatttctttcctagggtttctattcccagcgttgcctcactttgggttttctttattgtgtctacttctctttttacatctagtatggttttgttcatttccatcacctgtttggatgtgttttcctgtttttctataaggacttgtaactctttagcagtgttctcctgtatttctttaagtgagttattaaagtccttcttgatgtcctctaccatcatcatgagatatgcttttaaatccgggtctagcttttcagttgtgttggggtgcccagcactaggtggcgtgggagtgctgcattctgatgatggtgagtggtcttgatttctgttagtaggattcttacgtttgccttttgccatcttgtattctctggagctagttgttatagttgtctctggttagagcttgttcctcaggtgattatgttagcctctatcagcagacctgggagactagctctatccttagtttcattggtcagagtactctctgcaggcaagctcccctcttgcagggatggtgcccagatatctggtgtttgaacctgcctcctggcagaagttgtgttccactcaccagaggtcttaggatcctgtgacagatcctgtgtgggtccttgtgggtgtccgcagactcccccatgccagggaccacggtgctgcagtgggccggccggaagggagttgagccgattacctgttttcttacacccttacaaattcttattttagaatggttcattatcatttgtatatacagtttaaaagtttatatgtagttgaacactttctcttatgttgataagacatcctcatttttctatgaatgatacactttttctttctctgttgttttgctagtttctattgtggattggttagtgtggtgcacacatcaaaggcatatatatatgttttaatttttttttactttcactttacatcctactcactgccccctcccagtcacccaatcccacaatccttcccccaccacccctccccttctcctctgagtgagtcggggggacccactggctttccccccaccctgacacttcaattctctacaaggctaggtacatcctctcccactgaggccagatgaggcagcctagctagaacatatccccacatgcaggcaacagctttttggataacccccgttccagttgttcacgactcacatgaagaccaagctgcacatctgatacatatatgtagggaggcctaggcctagcctgtgtatgtttttgattggtggttcagactctgagagccccaaaggtgcaggttagttgactcttgatcttcctatggagttcctgtcccctttggggcccacaatccttcctcctattcctgcatgagagtcctcaagctccagccactatttggctgttggtgtctgcatctgtctgagtcatctgctgggtggagcctctcagagtacagccatgctcctgtctgcaagcatagcagagtatgattaataatgttaggggtctcaagttgggcaggttattggttggctgttccttcagtctctgctccatcccctgaaaggtactggactcttagttgcatagagaacagatttccccagcatatcaccatcacattttggttttgtttctgatactcttctcatcataatttttaaatttttttgtaaataaattatatcaactttctttgattatttctgtatttagtggcttacattagaatttaatcttaagattaaagctcttcttgtattttctattttcctctagaatttataacaatgtcttttttacatttgaaattgtatgtgtgtgtgtgtttgaacttaatttgagtgacatagagatttgactttatccctcactaataactatctagttctaacaaaactgtatgcaaatgactcatctttcctatcttagcttaccataaactcacttcatatgggtttgaatttacaagtttagcattttatgggttttgtcatttgtactgcttatttagagtaaggaggccaggttggccttagacttgtggcacctgcttcagcctcctccccaagtgttgggattacaggtatgtgcagctacttctaggccgcattgtgtatttataccaagaatccaccgttctaattgtgagactaccttatttactgtaactttagagcatagttataaatgggaaggctcctcctcccctaggactctttgctactcttcatggtaatcaccacaattttattttcccatataatatttggaataatgttccaaaaatcacatctgctggcaaatgtattggacccatattaagcttatttattaatttgggtagatctgatgtctttacagtgttgagtcatccttgctaggaaactgcatgtcttttcgttcatgcacatgtagttttatgtcctttaataaagttttctaggtttttacagataggtccacgatatttcctgcttaggtttatttctagatattttatctttttaattgttgtgccaagtatgatcatatcttccattatattttctaattggtgtatgcataaaaaagttgatttctatatattcatcttatacccagacaccttattgaattttcttactcttggtattacattttcacttatcatgagttttcagataaataatgtcatctgtatataatatcttccactgttaatgtgttcatcatgtcaaatcacatataaagcattttttgaatattattaagtactaattgggaaagtgggcagtttcacttgttcccagtttttataggaatgtctccactgttttgcttcagggctaagggtaaagctctttgataaaccgttagcctaacatgtgtgagggcctggatataacaaatggtgctttcataggactagctaaattttcctgctagtagctttttaagtctacaaaggtctgaggattccaatcaaatatcttgaaggattagagaagttgttttgtaacatttatcttttgatttattagcattgtcaactatatgaatagattttttaacactaaatgagattttttaaaaaagattcatatatatgagtacactgccttcatgcacaccatatcccattacagatggttgtgagccaccatgtggttaccgggaattgaacttgacctctggaagagcagcaagtgctcttaaccactaagccatctctccggcccctgagcaagattttaatttctaaaatgaacatgcatgtttatgatgtatttttaacatcctccgggattctcttcactaatacttgttttgtgtatatatattcttagataagactggtgaaaaattaacaggagtcttaaaaagcaagtgtagtttttgttagagttttctcttattttagttttaactattatggtctgtggtcagttggaacattcttaattttgtttctgactttatttgttggtctttatgttacctgtagtttgcttatgatgtgtggtgcttttttggtatataaagattcagggcttctgggtatgaaaagataagcttgtaatgatagtttttacatggctaacaaatgaggatttaaagttctaaaccagcctggactatgtaacgtgactctatctcaaacacacacatgcacggacatgcacgcacacacacaggcacacgtgcatatacacacacatacatacagtatggggatgcatacatacatttctgtgtgtgtgtgtgagagagagagagacagagagacagagagagagagagcacactcacacccaaacaagaagaagaaagggaaagatttagtgtaattagatccttatcatgtattccagttgctagcattatgatgttcttttcaaggaaaaatgaatgcaaagtagaatcagggtaattaagaataatcgagaaggtcatcaggaggggcctctctgcctgatatagatttgtcatcttttggctgtccacccactactttttattttctttcttaagggagttgtgaggctggacagtttgtgagggtaaagacgtaggccaagacccagatgaaggtagtggagataagtgggtagggatttctaatccacatgggaactagtgatgagggcaataaggttttgtttccattttatctgaacttggttagcattaagtatactgttcctttaaaaaaaaaaaaaagaaatagtccctcccagccatcattacaactgttgaatgcatagtctgtctgctggtctaattgaacccttagaatttcctggcagtaggactcagcatgatgttgattgctcacaggctaccataggaaatcagatcataaatttaaagggcttaactctctaaaatcagctgaagagatgccatttaattttgataagtcttaccatgtagaagtttgatattttataaatgagatttttctcttataacttataaatattatttcttcttataagcgatcatacttgaaatttcaaattttcttatttatataaatgtaaatagaatattaagtatatatgcacatatatagcactgattaaaagttgtctcaaaagatttactgaataatctttatctcctgttttagaaggtttttatagggtggttttatagtgtaccttctttctttttttttttttttttgagagagggtctctctattatatagcactgactatcttagaattcactatgcaaaccaggctagccatgaactcagagatccacctgtctcctaaatattgggattaaaggcatgtgctaccatgcctggctagtctatcttatctctaaattcactgttttgttctgttaatcaataatatacttttacttgtagctgtttcatgagatatatatgtacatgtgcatatgtgtctgtatgtatgtaatttaaaacaatttttaaatttaaatatattttgatcatattcttccccttccccaagtccttccagatcctctctcattccttatccacctaactgttaagttcctttaaaaaaaagcaagcaaaaacccaatacaacaacaaaaccccaccaaaccaagaaaacaaaataaaactaactactctcccaatccaaactggacccaaatacagatatacacaaaaacctgtggaatctattacacactgttcaactattcctgaacgtgaaacctgtcgtggagtggttgatctaccccatgtcactttattggagaaaactgattttccttctcccagcaagcataagtgacagttcagttgttaacctttaccatagtggcttggtcttcattcatccatccatccatccatccatccatccatccatccatccattcatccatccttccattcatttatttttaaaaaaaataacaaaaatataataagataaaacaaaaactcttacgacgacaaaccaactgaaggaaaatagcccaagaaaaggcacaagactcacttgtttacatgcttgggacttccatagaaacactaaactgaaagccatgatatatacacagaggacctggtgcagacctgtgcaggccctggccttgcatcttcagtctccaagttcatatgagctttgcttatgttattaatccttctttgtcccatcttcaaattttctgtaacagaatactccttaatagattacactgctcacttttgagagttagttttcaggaaagcctagaattcaatgaatctttttgacatttcaaaaggtttttttttgtttgtttgttttggttttggtttttttttttgtttgttttttggtttttggttttttttttgttttttttttcttttttttaaccaaaagtggcagatacttgtgaatagtttatttcatatttttattccacatgtaagcacagggaagctatatgtagttcatttataatataccttgcgtcacattggcagtagagcagtggaggtaaggagtgacataaaagaaagaagtcatgaactttaaataataaagtattaaaatgtatggaatcttggtagtaaatgggaatatagatattcatggaaatcactatttctaaatactagaaatgtttcatttaaaaaaaattagagaaaatcaacaaatgaaatagaaaaccaggattataagccctagatattgcacatccagtctgggtgctttaaacagattgaggtaccatgtgtctatttagactttgtagctaaataattcaagttcaaatcgtagctctaccacgtaacctttataaccctggacaaattacttatcctgactgtgtcttggtttctcaaatgatgaaatccaaactgtaagaactacctctcctaggtttattgtaaggagaaaataaattggaccgtggagagcattgagcatatgctagtgcacgcttctcaacctgtgagtcatgaccccttgggggttgcagatcagatctcctgcatatcagacattgatattacaatacatgacagtaggaaaagtacagttaaggactagcaatggaaataattttatggttgggtgggttatcccaatgtaaggagctgtattaggaaggttgagcgttagggaggttgagaagtactgctctagtgtttagtacttagtttatacacacacacaaagtttgttgtcatcatttttatattcttatttctactatacatgttagaattttgtgcattttaacatttctgaaattatgtcatctaaaatatgggccctgtctatcacacacttgtcttggtcaatgcttatctgctgttttgcagggaaatggctcattctaaggccggcttttcattgtctactcccttccgaccttgcattgagaatccagcactggacttgtcaaactaccgagcagtctcttctcttgacatccttggagacttcaaacgtgcctcaaacaagccagaggaatcttcggtttatgaggatgagaactctgttgcctccatgccccgcccactgcggagccgagccttctctgagagtcacatcagtttagagcctcaaaacacccaggcctggggaaaacatcagagagaatcatttagtaaaggcagtgagactcagccagatacacttggggcccgaaagaaggtctttcctcctcctcgccctcctcctcccaactgggaaaaatataggctctttcgtgcagcacagctgcagcagcagcagcagcaacaacaacaacaacaacaacaacagcgatgtgaagaggaagaagagaaggagcaagaggaggaaggagagaaagaggaggacctaccaccccagtattttagttcagaactcactggctcatgtgcccctaatacagaggaacagccacagtccctgaagatgggccaccaggaagcctcaaggcagggttcacagagcctccaagagcaagaggcctttgctctgcatcctagcaattttgtgcctccagtaaggggctgcactgtaccccagcctgagaaagctcaacatccttgctattatggcactcatggactatggaggacaactgaacaagaagctactgtgaccccaaagtaagtgtatgggaaagatattgggtcgcagacaaggcagccagcaacatgaattgaatttctcctctaccactcaccagctgtctgtcactgatccttagtcttcttatttgaaaaaaattcatgataatgcactacctctacctgattctgactattaagatattgcatgtaaagggcatgaatagatggttggtacacagtaggttctcaggaagtggaacttaaggtttttatccctatcattaagaaaatatggtattgcttctcagtgtatctttaagctgtatagcacaatatctggcccttgatcatgaaagcataaaccattctttgcctgtcctaagccttccctgagccctggctcctgtgtgctctagcaaagtagcctgggcctctgaattcttcccccaaccccagaagaaagatgttgcacttacacagtgataagtccttataacagctaagggcattcttggtcttttccaccctccttttcccctgctttgcatttgctttgccagacagtaggcaatagttggcagggtgagctgcaagatcaaaacaggactgtggactgacgctgactcctacgtgaatgctgatcaaaatagcatgctgtgtgtctgtcctttttgctcctaaacagaaacaccatggtcgccattgctcggtgcttgggctcttagctctgcctggcctctttcagagctccactgcggatgagcagacaggtgtcccctaattgctttctttaaatctttttatagcaggatcttgcctgggaggagttgctattagaagtaccttgtttatgtgacttttatggacaggctaatcttgttacttggttatctggagctgattgagcagttctctgaggtgccataaggaaagcatttataaatcccagctcctgggctctgtgagaagcccttagcagaccacatgtggctgcttcttaagctgccttactgcgactggaaaatacgttgcagaaactaactgtgcggcagttgttatgtatcccagctgagagattgaaaggttacctggcagatagtaggcactgaactaatatttcaaaagacaaaatagataatcaaataagctttcaattaagcattttctgtgtgccagacactgcctggcgtttaatgtacatgatttaagttattcttcccaacatccctgttggccattaatatctccatttgacaaatgaggtagctgaagttgagcaaaataagggactaattgattcagtgttacgcaggaaagactcaaatccagatctgtctgcctctaaatctaggctgctgcagctgccataacctcctcctcctagtcgtcgtcctcctgcaacctctctcagaaagctcttgttctcctaggtggctggagctttattttcccttttctcttctaggataatgtgggccagaagtagcagttctaggctatggactttcctccattatgaccttttattgtcttgacccaggctactaagaaagaaatcactattactaggcatctatcactcagtcccaagatttatttataacaaattataaaatacaagggaatacattcagttgcacacagcctcagcttctagctgccaaaaatcaattctagatgtttcttccaaggagtggcatcatttccatcacagctgctatttcttcacctgtttcctatgtgccgagcatgacttaacgtattttcagggacagatcattctttccatgtgatgtactctttcttagggtttacaatgtacagatacaacatgaacacagtagaaaggacactttaaggtcgggaagtgttgcacttttcctaagctagcaagaggctgtatggtaacctttatgtggtgctgggaagcagtagtggcaggcagccctgtaatcatcaaagaaactgctgacattcgccagtgagttgtactgctaagttgtgaggtttggaaggtcaggtgtagttataagtaattttaatttaggatgggcttattgggacattgatctactctcccaaaacagacctaagaaagacttataactacccccgtccacctttcagatgaggaaattgaagctaagggaggggatgtaactctctcacaggctcacagctaaccagaacccaggcagtctagctcattgcctacagcatcattttgggatctcaggtcctggaaaagattctcctcagaccctaggaaagttcaaggtagtgttggggccaatagacttgtaaggttttcagtgtgaaatgcaaataaagacagccaacttttagccatctgaaaccatagtatctctaccacacatttcctttttcagtacagactcagtaaagcatatacaaggaaggcatgggaatggatcaaatgttgctccagtctaataactagttccagtatagatctagttggctttgtatagtctaagcacgtctgtccttgctcagcggaaggttctgagctttcatgtcatgtttactttcaaattcagattaggttcttatagatttcttgtaatcccttccctgttcatgaaggtaatgagaaaaagaaccccagagcacagcgcttaccatgatccactgtaatgtggtgcagggccatagctgctgagctgccttcccatggagcacatgaagtttgatcttaacagtttctgactccgaatattgacatgtactaagttcttataaacaggtattctcaaagttcaattatctgtagtacctccacaaaattctctctcttttgatatcaaaggcatagtccagctagacagtcctttacaaataggggtttgtagagtattaagttgttcatttgtcactatcacagagtataaagaataaaggcacagatgtgaagtcaggttgctattggtgagcaggtcactgtctactgacctggagaatataattttacctcttggttcttcatgttacctctctttaaaatggtcatgatgaccattcagttgtatgtacacatgctttgcacatgtgtattacctgtcttaagacactttctggggtatagcaagcgctgtgtatatattagtattatagttctaatcttgaaagcctatgtgtaaaatagatgtctctcgagtgaggaatattggcatgcccaggttgcctttgtgtgatgaattaagagacagcatagcatgaatcagtaaatagctttggagcctttttagccattatatttgacctttatctaagagctacaaatagctgcagagatgactaatgagtttcttctattttccctttcaaacagctagaggttagaaagggctggtgaaacagacaggtgcatggtagaatagctgcctggcaaagggaacagacacacagacacacacacacacaggcccaagtggggtggactttgcctttgcataaaccctgggcagagctgttttccctttcattactggaacctgacatagcctttattttcccttacttccaccagactagaagccataatggcagaagaggccaaatccaagccagggttgggccagaactacttctttcctgaggagaaattctctttcattttctggggctctgagaagccaaattttatcccctcgggctttggtatccccaagataacaaggtctgctgctacatttgtggagtccctgggtgtcattctgaacccgcacaggaggctggggccagtgagaatatggcacaaatggaggtgtgctgtcccttctcaagccgaagggctgtcttatgagagtgagtcagtatcagaagagcacactagaaatgtgatgggctatgacaagtccttggcaggaatgctgataccagcattcagaatgatgaccatagctaaggtcacaggtgacctctttgctgtggaacatctacagcaaaggggccatttcaaggagagacatcaggataaaagaaaagagtataaggcaagtcagggtacctttgcgaacaagcagatccatccgatagagctgggctgagcggactttgtacttagatcaggtggccaagcacagaggaacacttatttctctgctgcccctcactgaaggtcatgaattattaaggcaactcatttatcatcataagtctacagttttgaggtcttgtaagttcttctatattttaatggggttttaatgactaagccaaaagatacagaagtcctatgaactactaagttgagggacatagaaggacatggaaatagacttcttcattccttatttggtttttttttgtttttgttttgtttttttgtttttcgagacagggtttctctgtgtagtcctggctgtcctggaactcactctgtagaccaggctggcctcgaatgcagaaatctgcctgcctctgcctcccaagtgctgggattacaggcgtgcaccaccactgcccagctgacttcttcattcttaaagtttaccttcacttggcttttagatcaccttcatgttacctgttttaagtttgaatggtgccttttcttccattgtattataccagctatgggaagagctgtcaactattacaggtagagaaactaagaaaaatgaaaactcagtggtctctcaacaaaagcactcaattgtcaccttttgtttccacagacaagagtttcagcacttctcacctcctaagggggcctcaggaatccctacctcttactcagcttattataatatctctgtggccaaggcagaactgctgaacaagttaaaacagcagcctgagatggcagaggcaggcctgggagaggagggagttgactatgaactggctcaaaaaaaggtaaggttttggtgtatcccggagagttttagcattcagttaagtgtcagaggacaaccagccctccgtaccctccagcatgtcttttctacctgtgtatagaaaccacagtctctccttagtctgttctctaatcaatagtagcagtagtaattattctaatccttagggccatcacaatgtagggatgtgtgtgtatgtctctctgtgtgtgtctgtgtgtgagtgagactggccattgaacccaggtaggattttgtgtgtgtgtgtgtgtgtgtgtgtgtgtgtgtgtgtgtgtgtgtgtgtgtgtttgtgtgagagagacagagacagagacagagagacagagacagagagacagagagagacagaaagagacagagactatgcattgaacattgaacccaggtaggtgtgtgtgtgtgtgtgtgtgtgtgtgtgtgtatttgtgtgagagagagagagacagagacagagagacagagacagagagacagagacagagagacagagagacagagacagagagagacagaaagagacagagactatgcattgaacattgaacccaggtaggtgtgtgtgtgtgtgtgtgtgtgtgagagagagagagacagagagacagagacagagagacagagacagagagagacagagacagagagagagacagagacagagagagagacagagagagacagaaagagacagagactgtgcattgaacattgaacccaggtaggtgtgtgtgtgtgtgtgtgtgtgtgtgtgtgtgtgtgtgcatatcactgggaattgaacccaggtatgtgtgtgtgtgtgtctatgtttgtgtgtgtgttactgggagttgaacccaggatctaatatgtgctaagctggtgctttgctgttgatctaaatgctaaaacctgaaacagtctctcagtcgcattatttgaagtatttgggatcaaactagggcctagcatgtgttagaaatgcagtttacactgagccgcacccccaaccaaccaaccaacctcccctcccccctcccccacctccaccccggtagtgctagagctgaactcagagccctgtacttgccaggccagtgttgaccactgctctgcagctctagccctgcaaggtaagtgttactattgcccccacttttttttttttgccagctaaagggattaccttttccaagggtcacagactacattataggtcctgaatgggatttctgctctgccatactgtccttttgaattaagtaagctcactcactgcctaaggcacatcagagatctggccaatggctgtgccattaatttgtattctctgtaagtttctgggagagagaactgactgactaaggagaaattataggctggcagactattatttgcaatgatggtcagttatctcttgaaaatacaaaataggtaaatggggattttgttgttgttgttgttccaagcctccctttcttcctctaagcaccagtagcctagttttttaatcaagttcctggaatcattttgccccgaccccttacacttacctgttttatttcataagcagatagagttgtcatggcaacctcaaaggcccaatttaccattttgtggacatgtgaactcaatgtaaattgttcgtctgcccatatttctctttcaggacatggctggtaggaaaacataaggccattttcaaaagtactccttccagtttcccatctcaagcaaaatgtcagggaaataattggaccatggaagtgtcaaattttattgatccagatgctcttccttcaagtctatgtttcttgaacatggcagagagctggtccttgcttattcaaggcctggcctttccagggacaaacataatgaaagtctagccaagggaagagagatgactggaaatggcaaagaacaaaataacagagagtgatttgttatgactgtaggtggggcagggctatgtttgtgtgtaagtcagaaaggggaggaaggccatcaatttgccatggtccagaaaaacagatcagctctggctgagctgcggatgaaactgcagcttcatccagtacactttccgcaggctaaaggttcaggatgtgtagagcccagttagtgaggagcaaagtgttcctttgattccctttttttccctcagtccccagaggctggcctcctgtatgaataagtgacaatccaggagggccatgctttgacactgacacggacttttatctgagaacatggaaggtgacaacaccgttgaatgttttgaaacctagttctggcttccactcatatcactggattcctgcctctcactggatctggttctttgccccacacttgcaagcacaatcatgacgatttcctgacttctcctgacagtgggctttgaaacctcctagtcttggtcaccttcatcatttcctaatgaactattaggaacactccaaacgtaagtgttcaagaatgcctaaactagaaagcatctgatgacaattcttaccaatgtagggtcttggaaggtctctagttcctatttattatagtcttggttgcactttaaaaatgtcacttgggtccatggctaacagtcatctgacatcaagaactttggtggtaacgtggagattcctgtcaaacagggagagaaggtaactactcgagaaaggtactactacatatcacttgcataggtttcactcccaacctatcttttctctccctccgctcatgtccttcctccctccatccctcccttcttctccctttcccttccatttgtaatctgttcatttagccaaggttttagtctgtaatccccttgcctccaccttccaagtgcgaggagtacacatgctctgctaagcccatatcaggttctgttgaagtccatgttcaccctttgtcttccacattaactcttttagattcagctcattgaaagcattagtcgaaaactttctgtcctgcgggaggcccagcgcgggctactggatgacatcaatgccaatgctgcccttggagaggaggtagaggccaacttaaaagctgtctgcaaatccaatgagtttgaaaagtaccatttgtttattggagacctggacaaagtggtcaacctgttgttgtcactctctggacgactagcccgggtggagaatgctctcaacagcattgattcagagtccaaccaggagaaggtacagatgaggtccctgggggtggaaatggaagaaatagcctttttaatttttaagggagactgaaaaccaacattaaaagtgtaagcactggcttcacaagtgctctgaagttttagttctgcatggtagctgtgtatgactctaagcaacgtagccttactctgtctcacttgcttcatttacaaaatgaaataagcatacgatctgtttcatgtattttctgtgaggattgagataatccaagttaattgaataaaatagggtcccaaacagagtgaatatggaattagtgctagctgctaataggggtgtggtgatggtggtgataagggtggggtggtagcagaagcaatggcagcagcaacaggaaaagcagcagcagcagcagtaaatttgcctctgatcccttagagctgcaaagaggccctcaattttacaggttatttcatttggtgattatatttgaattaaactccattacctttctctatacaagtggctttgaatccacagtaagagctccatccacatgcatacacacaaacacacacacacacacacacacacacacacacacacacacacatgcatgtccactcacacacaggcaccatatagaaagcatcaccttagtgtaatttgttcagtgatagaagggacttagattggctttgtcagaggtttcctctattccaagccaagcagtagtccatggtttaaagacagccttagaaatggaaagaggtgattgtgcatccccgtccaaagctgctgccgtgctcaccatgggaaaagggaggtttatgcatgaacgtgaacttcaaagcaggggctctaaggctgattaattaccaaactgcgtagctgttctgtggctgcttccttggtgaaagactgctgtgcagatgcctcatggtcaggatggcatttaattggtcctctgcttccccagttggtgctgatagagaagaagcagcagctgacgaaccagttggcagatgccaaggagttgaaggagcatgtggatggcagggaaaagctggtgttcggcatggtctcccgctacctgcctcaggaccagctccaagattaccagcactttgtgaagatgaaatctgctctcatcattgaacagagagagctggaggagaagatcaaacttggagaagagcagcttaaatgcctcaaagagagcctgcacttggggcccagcaatttctaattgcaccaggagtatgccactgcacctcagtctattcccggtggaaaagggctttcaatcttcagaagcagtttgctagccaagtatatagacattacttagcagtgagtccagccatctaccttggccagccatcaaggagaggctgggaaggccccaagcttctcttacagagctgcagcaaggtgtggccacactactatgctcccagttagcaaggattaaaaagtgccttcatctctgtactaaaacaccaaagacttcacaaactcaagactctcccttaccacactaccctcttgaggttcaaagctaaactgcctgtgcaatttcccctcttccctagggatagtgacctagctagccattgtccacacagatgtgcttgacttgaatacattcacctcacaccagttccagggcctctaccaaatgtggcagcaggaggcacagaaggggagacttcacataaggagagcaagcatggagtccacccgagtattcttccctctggtaatagccaggcttaaacaaattggttccatgtgtaccctccccaacacctagttgatagctttgttaccgcggctttcgccctgttttcacatgatgatagacctgcctctttgtattgtaacctgtcctgatatcactaggagtctcgtgccagggtttcactctctgattctctaacgtatctctattatagttgactttgcaatacagcttcgttactggggaagagggttcttatcatatttcaaatggtctttaatggtattgatttttatgttttctttttctttcttaactaatgaggtgagaaaaaacaagttaggcagaaggaaaatataagtctgagcccaccgtggctaaggaagcaagcgccaaagccttgaattcttcctaccatagttccgagtagctattaagtttctctccttggacttagagcctcctaaccatagctcagctatgtgcttccttgagggctggatgactataaccttaacattcctgagtagggttcagtgttttttaactgccttttgaaaccagagtctcctataactgaaagatacaggatacatgaaggaaggaaggtgggtgggtgtggaaggcgctcttctaacaactgctttcccagccagtggctagctcaaggaaccaaaaccatgagagtattttcagccagggccaggcctcggagcaaattatgattcacccaggatctagacatacactatccttccttgtcttcggggcctatgtactaaagcatcccttcgggtggatgcctgaaatcctcaatagtaccaatgcttgtaaatagcacaattgttaatctcatcactgaggggactaataagtgactaaagaaaggctgcctgtatagcatggatacactggataaatatatgattgatggtccatgtgggatggagcaagctttcatcacactgcacagaatggcacataatttaaaactgatcagccatttgactctacgatgttccatttaatattgtcaaccatggttgagcatgagaacggaaactctggaaagtcaaactgcaggtaagagggattgatgcgcaaagcactaaagctgttgctctcgccaagacctgacgttggtagccagcttctatcctggaaaagcatccaagtgagcaatagcaagaggggactcatcaccaaaccgcccttctatcttgctcagtcttctgttccctactaactgggtacattccttgatgatgtcgcctaacgatctctcaaaagcccaaaacaaccaagccctggcatcaccacctgtcacagctgagttcctcagggtccttggacattccctgtagcttcagtgttactttattcaaccaaagaattggccaaggaacttcacagctgctacaaataccggccactctcttccattctctgcacactgtgtctgacagctatgggagaatcttggctggcgaggtattctaaagggatgggagccttttctatgagccattgggtatgctttttagtactgctgcctctgcaataagcactgtttatctctcagtactgccattctcccctcaagtgggagatcacaaattatcttcaacatgactctaaaagtatactgagcgctgaagctcagttgctgctatgctatgctatggtgtaccacaaagtactgtgcagcgctatgctgcgttatgctgttctgtgcttttctgttcagaatggctgagagtttacccaaagtaaaattgagaggggtgaggaactgtttgaataaaagccacacttgccttaccttttttaaatataatgggccctaggacaatcaataaggaagttgaaatgtcttatactagaatagtgagagttgtgtgttctgtcattccaagatgtgtttggctacagtagaacaaggaacattcactttactggatatcatggccataggctgggtatttgtagccttcgttaggtttattataccttaagtatatgataccaaaaatactgttaactgtggtttgtgtgtgtttgtttgtttgttgtgttggcattgttagagatggagcccaacaccttatatatactgggcaagtgtatcactgagctatagccccagccttaattctcagtttttatcacttgccccacctcaaaatggtttatacatttggaatcagaatacacggctgagtttccaaagtatttgaaagataacttcacaactatacagagctcaatagactgaactaacactggtatgccctactcctgctatggccttcccaaagtgagaatacaaaatgccagtgctattggcatgggttcattctctttctctctctctctctctctctctctctctctctctctctctctctctcgtcttgccttctgggatcagccatctttcaaggcctctgcgaagatagcagagcggcatggaagtacgttcagaggttgacccaccccctcaaaggttgctgatcatctactctttcccttcaaataaatctcattggataatacaaaagcagggtggtggatacaagggaatcaatgcaagattgtgatcatatgcctgttcttctcccatccccagggctgtaggtaattgactcccctcaagtactactattgaaggctcagctaagacataaaagtaaatacccaagtggagtctaaaggaatgggatagctttactgaaattaaagtcctaaaaagggagaaattggatgcacaggaaaggaaagagagtaaaaatatgaaaagcctctttgaagattggcttcatacttctgtttgccatttaacctcatatgccaagaaaggtgcctaaggggtaccagacttttctaataccaagcctccactagaggaagttgggtgtacttctggctatgtctacccatgtggaatttggtagctctttctttgccagaggagctatgtatggcagtaataattatgtggcagaatattgtattatttgaagattaaatccttagaagggggcagggtgtggggcagtgtatataaagagtcagtgtttgctggacaatttcggggaattgtctatcccatttaatgctattatttttctgggtcttactacatttgtgtcctccaccacttccttcttggctgacgttgatatgcctgccatattgtcatcaaggaccatacttcaataaaaggtgctaaggac

SEQ ID NO: 652 - DNA, 23909 bp, mus musculus; identical to SEQ ID NO: 63

SEQ ID NO: 653 - DNA, 32680 bp, mus musculus; identical to SEQ ID NO: 6

SEQ ID NO: 654 - DNA, 32680 bp, mus musculus; identical to SEQ ID NO: 6

SEQ ID NO: 655 - DNA, 3200 bp, mus musculus
cgggctctcctccaagtgcacatgcgcaacaatggctctgggatgaagcttttgttgggaaagcaagcgggactcttatttggacagtgatctgctgcgcatgcgcggcgcgtccagaggcggtgggtggtatattaggcggagaggcggggtcgcccgagctgccgcgctggcattttctcctggacgcggagagagtgcgggtgccgagagccggacagagccattcccgatcctcttgagtcgcgaagaaggaaacagcgaagggattggggttcggccctgaggcaaggtgaggttcgcccccagacggggcatctgcccccctggcgcggcgtccttccgccattcttttctcccagtcccttcaccctggattcggaagccccctgctctgcctgctcccggattcagaccctgctcccgacccttttctaatttgaaactccgtccgtccccctgaatcttttctccagttccctccccgaatcctatttcccgaccttgatcccgttagatggttcctctgaattcagaaccttaattcaacttttcggacgcccgtgtctccccgctcgccgccctccctccccgcccccgtaaactaccgcatccacagctcctctctgactccaaaacggcagcgctgaagcttttccctggccgcgtctgagattggagatggtctagcgggacgaccggttacttttcccgctccgcttaggcctggttctccccccggactcggcacctcacccgcccccagaatcaaagcacacacgcacacagaattcggtcctatgtcttttccttctgtagtgtaatgcccagctcctctctcccacacccccccccttaggctctgctcttgccagggagacgagagctatggctcagaaaccggacggcggtgcaggcctccgcggcttccaggtgaggaccccgctcccaattcccccatttttcccctgctgacagtttacgcccacccccggccccttaggtcgcgcgaatggcaggatctgattttgcccttcttccggcctagacaccgcgggctctcagatttctagcgtttatcgaatgggggggaggggcggcccttttcagccatcggtccctgcttagagaaaggggagaccctgttagtcagggcattctgcccagagaatgcgggttgggtaaggaaccattttttttccataaccctgacgcgtgtagagcagtctgtcgccccatcccccaacctctcgcctccaccctccctttctccacgccgcgagactccccctccaccctctcggcttatcctccttgattcctccctcctcgggtcttgagctccccacctcaagcctaaccagtccgtctctaaacccatttggggctcagagcttgcaccacattccgcaccagcccctgctgccacagactgtccctcaccttgccctgccccctctacccttaattaaattttgttcgcgccccgcctccctttgacccgcctctgcccccacgtctgagtactgtgacgcctgtctacagctcccctgctgcgttgcgccgcgccccccccctcctctggtctgccatgtaaggctcagagattgaaatgttgcccctcctgtgtttgcaggctgaggcctctgttgaagacagcgccttgcttgtgcagaccttgatggaagccatccagatctccgaggctccgcccaccagccaggccacagcagctgccagtgggccaaatgctagtccccagagttcacagcccccaactgccaatgagaaggctgatactgaggtttcagcagctgctgccaggcctaagacaggctttaaggcccagaatgccaccacaaaggggccaaatgattactctcaggcacgtaatgccaaggagatgcccaagaatcagtctaaggcggcctttaagtcacagaatggcacccctaaaggtccacatgctgcctctgacttttcccaggcagcacccacaggcaaatcagctaaaaagtctgaaatggcctttaagggtcagaatagcactaaggctggccccggtaccacctacaatttccctcagtctcccagtgccaatgagatgaccaacaaccagcctaagacagctaaggcttggaatgacactactaaggtccctggagctgatgcccagacccagaatgtaaatcaggccaaaatggctgacgtagggaccagcgcaggtatctctgaagctgatggtgcagcagcccagacatcagcagatggctcccagactcagaacgtggagtcccggactataattcggggcaagaggacccgcaaggtgagatcccagctagcttccctttgctttgggctctctcctttcttccaatttccttggctccaaacacaataaagggcatggatttatctgtattttggcacagttgtagggggtgctaaggtaactattattcctgagcccaggttgtccacaggctgatgatgagttgatacaaggacacaggcaatatgtgtgtaggccatcttacattttgacattaaacaccatgtcttaagctaggcaggctcacacagaatcaattagatcttgaagatgtacctcactctctagagagaacagagtcaggaagaaacgagttcagggtgaaaccaagcactgtccgtagtcacacaggaaaaggagaaatctaggtcccactttctgtttgtttgtttgttttttcctttgtctggtttggagatgaaacgcctgtctgaaagacaaagagaatcaaagtgaccagtggctagtgaggtgtaggtgaagattcctaggtacttcctaagatagcaactgggaggacccaggattaatagtgaccctgaaattttcttctctctaattatacaggttaataacttgaatgtggaagagaacaacagtggggatcaaaggcgtgcctcactggcctcagggaactggaggtctgctccggttccagtgaccactcagcagaacccacctggagcaccccctaatgtggtgtggcagacaccactggcttggcagaacccatcaggctggcaaaaccagacagccaggcagaccccaccagcagcacgtcagagtcccccagctaggcagacaccatcagcttggcagaacccagttgcatggcagaatccagtgatctggcctaacccagtga

SEQ ID NO: 656 - DNA, 3200 bp, mus musculus; identical to SEQ ID NO: 655

SEQ ID NO: 657 - DNA, 13726 bp, mus musculus
tgtgggcagtcatttcctgtcagtgctaggtaacaatggggaagataatggctgattgagctacgtctccgagctggcgctgttctagaggcgggtctcttgcccgggtttagaggcgggttagaacgcggcggcagcggcagcacagtagcgcagcggaggtcccagtggcggcggcggagcccagttgagttccctcctggccgaaacaccgtgtaagtgaaggtacgggcaccccgagaaatgggatgtcggactggaggcaggcaggggccgcggccctcaaaatggcccgagttggccagccgcggccgagacacccactacggcctccggacctgggctcccggctgtggggggctccgtggcgtagtcgccgctgccattttagttgggtggcgtgtgtcggccccgctcgtggaagaaggggaaggagtcgggcaggacttcctctcccaggccgtggagtcggggcccggccctcccgagctaagaacgaacgccggggaggcgatcctggactccgggcctcaggcgtgaggatggctccagtgcttcttactaagaggttccccccaccccccatcgtcgtcgccccgcgttgcgtatcgggctagggtttggggaagtggggtggaggtgctcttaattcggatgttgggaactcttgaaccttcagattttcacaggattcgcagagcctcattttgaacgcttctgtagggcatgaccagtttgttaacctctggggctacggtgacagtcttccgggaggatcggagacaaacgtggtttgcttccctgcacctttagccctaagtgtatccttggccagattttactagaagggttttcctcctcacaagaaaaaaaaaattaaaaaaacggagggaaaagacgttgcgggttgttttccctggtaagtgtgggaattgagccagactattttcaagttaatttccgtgtgatctgccagcagccctacccctcccccactcagaaaaaaacccctaagggtctctgcttctgcgggcgggcggtacctgccacgtacgccatagcttagtaactagtattaaccggttgggcttctgcttcctgaatactcagtccctttcccccttctgctgattaatttcaagatggaggagacagccacgttcttttcctggacagtttcaccatacttattccacaggttcgtttggcatctgaggcctaggagactagttatttaggtcatttttttcctcttttggaggggaaagggattttatatcagattctcatgggctcctggcaggccccactgtatatatgtttttttttcctagaaataagttgcttacatttcttgacttgtaattagccaccgtgcgtttgaatgattgaagacagaaagaataggaagtgtagtcctaatcatttctttgattctttataattaggaggcaggcacaattacaggtccaccttttcctcaaatcagtttctgaaatacaggttaaggatctaaaaggaccaacccaagcaccctttaagataactatttaagggcaaacaatcatgctgaaaaggtcacaaatatctcttagcttaaaatgtcctgatgatttttattattttaatttctgccttaggctactgtggtatgccaaataagttcttgaaagtggctcgtagaacttgaaaataattattagtctgataaggaaaagcctattttaaacaagctaatattaaaaggtagattgcctcttggcctttaaaggaaatcttttatctaactcctggttccttctgaccttggttgtccaaatatactaatactaacattaagttaggttgggttatgatatatataaccaaaatgtgtttttaagaatttgttgtatttcaaagaaaatacggattttgtaataggaagaataatgaatgcttttttttttctagagctgagtgaagaagactaaaatccagtttattggatttcaatactatgtcctaaaagacaggtaattatttttgtgttgtctcctggtgatttataataatagaatgcattttacaaatatacgttctattctacagtcatgtggttggatggattcattggtgttggctattcataatgggtactttctactgtgaattcaaagggtaccttttcagtacctgaaagtgctttatctgtggcatctgtctgcctgcctgtctgtctatctatctatctatctatctatcatgctctttttcaagacagtctctctttgtaatcctggaactagttctatagatcggcaggcctggaacttagagatccacttggtctgcctcctgagtgctaagattagaggtgtgcgctgaaagaaagaaaaaagtatgctgtttttaagatgttgttagagacctgggtataagaagttgtttttaaatgttcagtgaataaatgaaatagcaatagaatatgtgttactttctgtgccataattttcttttcctcttcaagattcaagaagtcatgttggtatgtattactctaattggaattaattttttcattattattaacattgtaagataaatatataaattacttgtgctaaccagtacacttaataagaaagcaaatgcaaacttagattgtcctaagccaactggttatggttttgaagcacttattttatctcaggtctgtctcaacactgaaggcaccaaactcacctctatacctgttggttctccagttaccagaaagctagtggaaattaaaagcgataatctgtaagttatcttgtatccgaaaactataaattctaaagtaatttgcctcagtggatcaggtgagaggggagagttatcaaccagtatacactatttgggtggtttgctatagagtttctatttcatctagtaatattcttggtgtaagttgagaaatttacttaaaagaaaagtcagtgccatggtggcccacatctggaatcctgacagttggaggaccagacacaggaagatcatcacaacttgagcccaccagatctagatagtgaattccagacaagatagtaaaatcttgtttcaaaaaaaaataatcaggagtctttttaaagaaacagcttaataacaaattctttagaaatgataggctgagctgggcagtggtggcacgcatctttaatcccagcacttaggaggcagaggcaggaggatttctgagttcaaggccaacctggtctacagagtgagttccaggacagccagggctacacaaagaaactgtctcgaaaaaccagaaaaaaaaaaaagttaggctgatatttttcagttgattaacattgtaataaggctttcaggaagaggagacgagtggagcatttgcatttataaaattgcattccatgtactttttccataatcctaaaggactgggaaatagaactacctcttggactagcatcctgttcctttgatttactctagagtgggtaacataaaaaagtaaaaaaaataaataaataaggttctggactttgaagtcactgtctaggaagaggccattctgttttgtaggtatacttatctaacatggagatttctaaatccttggggcccagttaatacagtactttgaagttttgataaccaatgctcagacagtaatagttgcattgttttttccttcatcatttatttcacctttgaatagggatatttcctagatagtatataaagcagttcatctttcctccttcagttaactgaggtgtttttcaaagatggttatcttgtttatgggtgtatatggttttgaacatagtattttccacctgaaatttgtaattgtcaatttcactctagattttctcatattaaacttgagatttttattccattaattacagcagcaccaatagatgtgtggaacaaatatctgtagtagacagcagcataattgtctgtctgcatgtgcttaaggtaggttaatggtaataactgcacatctatagattactgtttgtgacctgtggcagtctaaaggagtctgatgggaatgattctttctggttagggagatatactagtttgatgataacttaggtgcaggtataaaaggttcttattagtgtatgagtcagggttaaaggcccacacatgatttctgtgtagcaacagtacctcaggaaggatagagttatcatgtttgatcttaaagacttgttttcctcaactaaaatgaatttgttggtataggtgataggccagtccttttttggctgtgttttttttttatttatttttattttttaaagattatttgttatattcagtacactgtagctgtcttcagacttaccagaagagggcgtcagatcccattacgatggttgtgagccaccatgtggttgctgggatttgaattcaggactttcgaagagcagtcagtgctcttaacccactgagccatctcgccagccccctatttttaattttttttaaggcaaggtttcttctgtagtacaagctgtcctggagctaattatataacaacctcatggaaatcttcctgtctcatcttctgagtattttgggaaaatatttttgttttgttttgttttgctttgctttgctttttgataagatttgttgtgtagcccaggccatccttgaactcctgatcttcctaccttgggcttttacactgctagaattaacaggagtgtttcagaggcccagcttgataaggactcttcaatcttgaagtagtactgtggttactgactgctgtcagctggagatggagtgtcatcagagtggcttcccactaacctgatcctatacattggtagcatagcgcagttttgtcctttattatatttactctgtagttatttcaattgttttagagacttgtaggtggaattgtggactataagtctagtactcctctgcaaagagcttgggcatgagggacattgccgaatctgttttggatttctcaactaccctttcaagaggtaaagataggaaatgacaagaaaagctaagtgtgcattactgtttgggtaataggtaatctctccttaatatggtgtcttacgagtgttgagtgcactatatatgctgctagcatgctgctggaaatttatgaacaaattgtgtgcatggtgagcagaatcttcccataaataaatgcagtaacacaactctgttctgttttttttcaattcaatgtatttgtattaagtattttacctatatgtgcatatatgcatcgtatgtgtgtctgttgcctatgtggccaagggaggatgtcgatcccctggaaccaaagttactgatgtagtgagccattatgtagtgctgggaatcaaatcaggtcttgtgtaagaggaacaagtactctaaactaaggagccatctctatcccctctgccattgttttggttttgctttttgttattgatagtttagcactgtctagcctagaactcgaattctgtctacttctgcctcctgagtgctggaattaaaggtatgttgcactatgccctgtttttttttttaataatgctttgtgtttttaaaagtgagagatgacagacaagcacagctccccatccatctacttgcatatattatatatttaatgaaatttcaacattctacaaaggaaaattcctttttttttttgaaacagggtttctctgagtagcccccacagtcctggcactcactatgtataccaatctggccttgaactctggctcctaagtgctgagattgaaggcatataacaccaccacatgactaagaaaaattcttaacattatatctttgtacataatggtaccttttatcccgacttcaaatctagtagatcatttgatttaactttgtatatttttacaaacctgggggttgaaactaaagccttacacataccaggtaagtgctctactactgatttgtagtccaaataccctgttttattttatattcatgtttcatgaaattgcttaagctaccctggatctaactgtagcacagacaggccttgaacttctgagacaaggttttactatataaacctatgctgtgctcagactcagatctgcctgtctttttttttttttttttttttttttttttaaagatttatttatttattatatgtaagtacactgtagctgtcttcagacactccagaagagggcatcagatttcgttatggatggttgtgagccaccatgtggttgctgggatttgaactcgggaccttcagaagagcagtcggcgctcttaaccactgagccatctcgccagcccagatctgcctgtcttaagtgctgggataaatgtgtccatcaccatacttgactatggttaaatgaacaggtggtttttctttttggtgttagtattattgaacttatgctttattgataaaaataataaagcctaagaagtaggatgttagctgagctgtactgctcagtggtagagtgtttggctgatatgcataagccatttccagaactgtcagaaaattacagagccagcatggtaacatggacctacgctccatagtgagaccatggccctccaaaagcagagcagaaaagaaaaaaattcagctgtttatgccaggaaacaatgttttgtgggctgggtttataactcagtagaagagtgagtatcaattgaaagctgttttgctagtgggctttatgacatgggagtgtaatccctctacctgggaggctgaggcaggaggttaacagtcaaaatgcctcagaatgctaaggatgcagctcattgtgctagggtgcttgtcttgcatatgtaaggccctaggtttaatcctcagcactacaaaaactttttccccatgattgaaagcttttatacaaggcttggtttaaaagaagcacatggtgtgagattcagtagttatgcctattgggatttaaggactatattttaaagcatacactgtggggtgtgcagggaggcagtagtcatttagtgaaagcttgattgcctttggaatcagtagacctgtatttaattgctgaccagtcactatccatggcgttttcacacaaccattccttcctgttcttagcttctcacttgtgaaagcgtgaaattgaggcatgtttcctacttattgggactgttgtcaggactaagtggacaattgttttaaaagatctgtttttatattttataatcagaggtaggtaaaagagctaagtgctttaagagtagttggatttttttctacagttgacttgtattggtaatcttttgaggaaagtactgttttaaaatgtctgaagctacttatatatacaagtgtatgatctatgttatgaatattaagccttgagaatgaggtgatagaataaagaccctctctggttatgtggaaggattccaaggatgtgtaggccttgtctcctccctcagctcacagtagcaaaccagggcatcacacgtgagacaagtactctgccactgagcactatgctctttttccctgttactagtttaactggaaatatatcataattcctttcatcatatatgtcttaaaggctatcaacattttttgctgattattttatactacagtggtgaaaattctggcttttagttagttgaagatcatggtttcctaacgtctgcaacacatctttacctttaaaatgttattttccaccactcaaacaattgtgacttggctttattaccatttttcacatgctacagccaagacaggactcctttacctgatattgagaccactgcttgcattcagaatttccttttctttcaaaatgtttaagcaggtacctcaggttctggaacctgagatgtaactcatcattatggctttccccacaggtggatgtcccttctcagtgctgaaatctcttagccaatgcaaaattaaagcagatggatggagagttagggaagaagtggggaatgaattaagtcagatttaattatttaattattctccttgttcccaaaataactaaagcaacaaacttctgatggaagccactgccttagcaaacactgttctatttagcaaggccttgctagtttgcttgaagttggaataagaaatatgctgcagaaatatatggagagtttttcgaatatgtagggggactatagaacagtacgtcatggacgtaaaaagaaattgagctggtcttttattctgttttgtgaccttaccaagaaggcggtagaattttgtgtcattggaacatacagctcaatattaccattttcccagacatacatacctgtacttaatgacattttagtgcagagggtcttttgaattcactctgttttttattaacttctacacaatatgactatagatttaggtagtttgcttgctttaaggtgctgataaacatctccatttgggagcagttttgttataaaaagaaagaattattggctttcctgtttttgttaattcttggctctagtttgacactgggtgtcctttgctttacacctttctatttgaaggtgtctttctgtttcttccttcttcctctctcctccttttttaaaaatgcagtcttttatagtatcaagctagactgcaacttagtgtgtagaccagactggccttgaattcacttatatccatctgcctctgactctacctcctgagtgccaggattaaagatgtgcactgcagtgccttctctttttttctgttgtattttttagccttgttacctttgatctagtgtatttttcatttttattttagcctatcttcattgtctactgagaactcaactgtactatcctgactggcctatgtaaaccaggctggcctcgaactcacagagatatgtgtacctctgcctcttgagtgcttggattatgtgtatgccaacccattgagtttagatagtattttttaaatctccattttttttctaaaggtttctgcttcttccaggtttaatctccttgaagctgttcttaagactgccactgtttttggcatgtgagttttatcttaggttcatgtccttcaaatgatatttttgccttcttttatttttaaaacctattcacctggacgttatcttcagaattgtttactgatttgtcacaagtagatttcttcctaactttagtgtctggaattttgactgctttaagaatgttaattaaacattagtggtggttttcttttctttttttttttttaaagatttatttatttattatatgtaagtacactgtagctgtcttcagacacaccagaagagggcatcagatctcattacgggtggttgtgagccaccatgtggttgctgggattttgaaccttggaccttcggaagaacagtcaggtgctcttacccactgagccatctcaccagcccctcttctttttttttaaagattatatatatatatatatatacactgtagctgtcttcagacacaccaggagagggcatcagatctcattacagatggttgtgagccaccatgtggttgctgggaattgaactcaggacctctggaagagcagtcagtgctcttaaccattgagccatctctctagccccggtggttttctttaggaaattatggcttgggggttctgttttctttccctttgtgtttttctgtgtttaaaaaaaaaaaagcagttgctgctaccattaccaatgccaattcgtgttacttgtaagaaaaatggcagtgtgtgtgggttttttatgtgtatttagccttcttggcccatgtacttttatgactgttcactctgtcctggtccttccatagtaacaagttattaaaacacttgtcagaaatgtctatacaaatgaaacttagtaatgagctaggaaactgaaaacacctctgcctcctttcatgctcatcttattgacttaaacagtgaaaggatggtttagagaacagtggtttatgggaagtagaatggaatctgagtgactattcctacactgtttagcctcaagtaagtaactgggcaacatttaataagagcaggcctctttgtgctttttaaagtctggaatagggttgtgattttattttttagagatagtccttgtatcttgagctggctttgaactcttgccttgcttggtcttccaacgattgtagatgtgagctactatactgaggaggttttgttttttccttcaggactgatttatgaagatgctggtatattgttacatgtgtatgtggaggagggtaaattatagtactctccggcacagatttattttcatactgtcattgttggtttgggttactataataggacgtcctaagctgcatatgttataaacaacagaaacttaagagctcatgaaacagggtagtcagaatcaagacctggtcttgatgtctgatgagggttgacttcatggttctcactgtagtcccattaaagaaaatgccaaggtagctctcttaaaggtttctccaagaaggatgtactaatccttacttcctaatactataactttgacagttaggatttcagcatgggaaccttaggtgaaagagaagctaaaattacagaagggtcactcctccctttttcttgtttctgttggttttgttgcggttacttggttttggttttggttcttttgggggtgggggtggggtattactgtgttgcccaggttagccaggtattcaaactcctctgttctcagagccaggcatggtagcacacacctgtgtctacaatacttggatcatgaagtcagtgatccagagtttggggtcagcttttgtgatccattaaaccctgtcttaaaaatatatccaaaacatcatttgtcgctgggcagtggtggcgcacgcctttaatcccagcacttgggaggcagaggcaggtggatttctgagtttgaggccagcctggtctacagagtgagttccaggacagccagggccacacagagaaaccctgtcttggaaaaaaaaaaagaaaaaaaaaaaccttttgtcttcagtatcctaagtatctgggattacaagtttgtgctgctatgattggcctgataaagttgttgctgattaatctcaatgtataataataatagtttattacattgctacctaatacaagttaaccagtgagaagatggtcattctatttagggcaatgttctcaagtctgaagtcagtatacctcagtgaccacttgtaaatgtttgtccactgtgagtgacttgaaatgagatttttttttaacatgtcatctttagttttgtattattcatagatttgggggcaggggttgtgcattttacaccttgaaaatgccttttcacttgcatgtaccagctctttagtaatccatgggcttgattttttaatggtgcatagtcatctcctaaagattcaattcccaagtataacttttagggtatcattgagttactatttccccttcaaggccaaatagaagtttggttatatgctgtatgacttttattttgagatttacttatttttaatatgtatatataaaatatattatatatatgtgtgtgcttcatatggtttttgggcttttgggtttttttttctggcctacatgcatgtgtgtgcaccaaatgattggttagtatctggaggccaagaagagagtgccagatcccctagagatggagttacaggtggttgtgagctatcatgctggtaattacagaacttgtatcctctgctagagcagccagtgctctttgtttgtttggacaaggggcatggtttgaggcagggtttctctgtgtagctttggttgtcctatcttaaaattcgctcagtagaccagtctgaccttgaactctcggagatctgcccatctctgccatctgagtgctgggatttaagggtgtgtgccaccactgtcctgcaggagccagtactcttaaccaccaaacagttgccccagcaatgaagtttatttttgattttggaagtgtagttggagctcagagatctggtaaacatcaaaggagtagagctcccctgtctttgatagcctgttgtaccagcatttctttcaagttttgcatgtcctcttgccattaagagacattatcaagttatagccaaacctaattccttaagccatttgtattttgaaggaattgaggtcatcttcattaaggaaaaagaaatgatctttgacccaagttctataaattacaataaaatctagccaaggttaaacctgtggctcaaatgaagcaggagaattgattgccatgagttcaagtccagcataggctacaaagtgaaatcctctcttcaaaacaaaaacaacttggtagatttctgaaagaatcccagaactcagatggcagatctcttaagtctgagcctgcactggtctacagagtgagttctaggacagccaaggctatatagtgaaatcctctcaaagaaaagaaaaattttttgacaaaaacaaatccatacaactaaagatgattaaagccacaagaatgaggtttatattgacactactggttcagtaacatgatggattcatattttcttctaagtatttgttgaaaataaaatgagtgaccagaggctttaaaacatcttgagttttgataaaactaaatagtccaaccagtttttttcctactccatatatttttaccactttaaatcacctctaatcctaccattcagaaagctaggccatgaagattgacttgcatggtcaatggcattctatctagttcctcagtttttatataactatagtaaataaaagcatagggctaataaattaatttcctatgtacacatttctgctcttaaacaattttttttttaccattgataaaatggctttctttgctcagaaaaaaaattgagccatttggaaacttgaataagctttcatttttgcttttttttttaattgaaaaaaaaaaaggttttggctggatggtggtggtatatgcatttaatcccagcaaaagcaggcagatctctctgttccaggacagccagggctacacagagaaagaaaccttgcctcagaaaaaaaaaaaaaagaagaagaaaaaaggaaaggaaaggaagaaaccaaagggttttttatgcaatatattgaccatggtttcccttggcaacttctgtgatccttcccactcatgcagctccacccctttctctctgttggaaaccagaggcacatgaacccctccccagctgcttgctgatacctaacctctgcttatatgaacggcaacatgcctctcaaggacttagaaaatagtgtccacatataagagaaaacattatttttcttggagtctgagttatcttactcaggttgtttttctagcttcatccactgacctgtaaatttccatttttaacagctaaataaaagtacaatgtatttttttaatgaaatgttttagacgagatctttcaccttgggttttctaattagcagagcatagattttttttcttgaattgggaccattttgacaaatattttagtctaattttatactactttagcgtactgatagtatctgccaaagtgcaaccttggtcatctaatgcggttaaaagtaggtagccgggctggtgagatggctcagtgggtaagagcaccgactgctcttccgaag

SEQ ID NO: 658 - DNA, 13726 bp, mus musculus; identical to SEQ ID NO: 657

SEQ ID NO: 659 - DNA, 123760 bp, mus musculus
aggaaaaccagtagcatcagcagcagcagccaccgccgccgccaccaccacagcagtggcagtagcggcagtggcagcgtttagcagtagtgttcccagcgctagcggcagtcgcaaccgccctccgcgtctccgtctcgcggacagccgcagccaccgcgtgcagagcgggctccgggcaccgccgcgcgcagccggcgagccgggcagtgctggcgcgggcgagcggcgcggtgagaggagcgctgtcctgggagccggcgggcggctgtggagcctctgagtttcggcgcccgagcccgacagctctgcctccatctagtgcggcggctgcggcggagccagagtgagcgagcggagcgaggcgcgtccacctggcgggccccgcgcatggagcagaggcagaggagacggcagtgagcgggagcagcggcggcagctctagcagctccggcgacggcgacggcggcggcagcccagccttgactgcgaccgtcccagctcgggacgccggcagcaaggacccaccagcgacgtgcgcctcgggaggcggcctgcgaggtgagtctgagcgctgccatgcagcctcccccatcccccccgggccttctccctggctccccgggccggctggagccggcgggcggcagctgggggtgggggtggcggctgcgaggaaccgagggctagccgagcgaggagccgagcaagggatgccggcggggagagcgtgtgtgtgtgtgtgtgtgtgtgtgtgtgcgcgcgcgtgcgtgtgagtgtgtgtgagtgggagagtgtgcgaatggcgtgcgggtgctgtctgtgtgcgggaggcagcgaggccgccggggcgagggagcctggctcgcccgccgctgccgccgccgctgccgccgccgccgccgccgagcgtgcgctgcaatctaggaaaggcctgtgtgccgccgccgggggagggggaggggaagggagcgggccggagccgccgccactgccgccgccgctcacacacgcctgcctgccgcagggcagcggccgctagccgcctgccacctcccatcggttcggtgaccccgggggaacctcgggcgtctggggaaagtggcacggcccgaggcacgcgtccgagggagcgggaaaacgtaggcacgcggcgggcgccggctggcgtcccggccgaagctgcagaggtgcgaaggcgccgctggccgccgtacggacgcctcccccgcccgaggctcccgcgcgccccaggcgcctctggccaccccgcggtggcacgggcggctcgcagcacccgctccaagcagccgccgctggcgaccgacgagaagttaggggcccgagcgagcctcgcccaggcttgtcacctttgcaggaaattggcccgctgccctttcccgctctcccttgccgtcagattgacgctttcctccgggactcctggagctcgtcgctgctgcgcctgcagggacactgctgcggctcgatcttatccagccctgcgggctcagaggccgtggggcggccccgctccccgaaagtgtgcagaccgcgctgttcagctgaggaatccagtggtttcagcatgactgctcctgtctcattagtgagacaccgaaccacgggcgcaaggcttttagtctttttctgaagttaaaaaaaaaaaaaaaatcagttgacattcccattttgacaccagcacttcagatttttgtccagcttctggtagcattttggaatgaccaagtctcatattttgcttctgggctttggcttccaacatgttgttaaattctaggcgcaacagcatacttaactgtgtggctttttctaacgtttcattttgtagacttgtctgagaatacacaatagtgtgtggggttggcaggacttttttttaagtatctttataaaatactttagcgctgggatttaaaaaactgttttaattgaagaagcagagtgtgcttatagttctggaatattttgcttgctgagtaaaaggtgctctaatggtttcctctgaactgcaagagaccatttgggacttgcggggtgagtcgcacatctttatgcatggatagaatgaccaaacattttatttacagcagtgatgttctcatagctgaggagattttacacttattaaaaaatatttttagaaaggaacaaaaaaaaaaccttaagaaactgtcattttacatattaactagaaaaccggctaatcaaataaaactggctgagtgtctgaaactctatcccagtgaaatatgtggctgtgaatataattaaccatctgtctagtgagcaatttaaatttgggctggtacatttttattacagtctctaatttctggaagacttgtacattttacccagcactaacaacagaagcgtatttgcttactaggtcagaaatgtacttgtgtggtggtgggatttccctctatccccacccttacatcttatgtagtctctatactcttacatcttacatagtctccatactccttgaccagggaggtcaaataaacctcgggcttttttgcaagcaacatatttacaataggggaattcaaagcccctctggcagctagtgattagacattttgttgttgtttcttggaaatacttagcaaaaattgtctcccacagaacctagatagattgcatgtatttgagttgaaaagacataatttttgtgtgtgtgcccatgtgttcaaatagggtggggtgattcaagaaaatttgtaagacttgaaatttgatttcatttactttgtctttttctacttaattctttgtagagcacaccccccagcttgtcttcctgtctccatacccctatgccccacagaactaggctaagaaaaatcacactcttgtccctttagccagttttttttttacttcaatagtaccagatctgtgattattaacaatatgtcaagaaactaactttttttgaagaccaaacattcaaaatatcaaaacataaaatattgtgcacatttaaattcttcctgtggtatgatttttaacttgaaagtaattacttgaaaaaaaactgaaaagagtttagggaaaagattagatttcacagactccaaccaaatagctattgttaacataattaaaaagaaccactgattgtgcagcaagccagagaaagccatttaaaagaaaatacttttaaaacaaatatttgcctaaattacagctcggataaatgggtaacaattatataagcacatggcagaatttgacatatgtcaagtctgttaaataaatcagtctgttcaatgaataaatcttcgatgcatcaatgtttttttaacacacacatacacacatgcaggcacacgtgcaaacctgtaatatccctgttgccaaagtcaaacaactgcagaacactgctgctttctgttttactcactgtctttctcctgtctttttctttttcttttcttttcttttcttttcttttcttttcttttctttttttttacaatctgattacctgtaagctgcccagagagcaaagcgaactaaagatgtgctgttgattccctttgcttgtgtttacggaggtagaagagagaaagaaaaagctctaacagccggatttaaaacactcaaagacgtgctcatggcactctaacacaatcactgtggaggttctagtctcactgaagtatttgcttaggggagggactgtcttaaccaaagaagcatttattgcagtttctctgctcctaaatccagttctagagatttttttcttctgcaagccccttccattgtagtaagaggagattctagttggcctttgactgttatatgtaaactttttatgtgttagtatacccgtggtcaaaatgttcctgctggcagtaagcaaaagaagatagaagggtcaaacaagtgatacagaggagactgattcactgagaagcaggtcatttttggcttcattgtttttcccatgttggaggatttcagatttaaactttatattttcctttattattttacttcctctgaagagtcgagctccctagttaatagttcctcaccagagcaccctttcaaatccaaggtcataaggttggacataaagaacttaagctggttgtccaggacgctttgagaacaaaacaaagagccatgacaggagcacttcaggtgacctttaagtttgtaccttcactgctatccagaaaatgtattttgaggcagacatgaaacaacatcggcctcctgccacagtaagcatatcacaatttagggaaggaggcagttcagggaagctgcctttttgaggcctgctccaggtagaggcaaggatcttttgtctcttccctctgtcctgaatagtgattcacagactttggctatggaatgtgctccctttttcttgtaaatgctatgatctaatgtctttccttgttctccagccggaaaggatttctagcgtttgttttgcttttgttgtgttctgttccaagctttttccccttttccccccggagctgaagatggagcacagggccttggacacgctagagaagagctctaccttggagctacatttccagccatgagtgttttttgcttttgtttttcatttttagacagggtcttgtgtgtagcccaggctacttttggatttgtgatcctcatacgtccacctcccgagtactggcattacatacaatgttccaaaaacccctggcagaattcttaagagcatccacaacgcacacaattttttttccaaaatggcgtgtctatagatcatcttatttctctccagtaagatgactttgatttaagcaattatgtaccattttcctcaagtgtccccaaatcctatgaaaactatcagtttcattctcccattgtttttttcaagtgtcccacaaactagctggagaaagaagcttctgctgtctatctgcagattatctaaaggctggagaacaagatttgtacactgcatctaaacataggaattttgacccaccctccatcaagaacaagcataaacccagatgtggtataatcccccacacaagaggctgagaggcaagaagatcctgagcttgaggtcaaccttggaaacagagagttcgaggaaatcttgggatgtgtagtgagaccctgtcttgtttcagagacgggctgcataaaactccatgttcaatccttagtgccacctaaactggatgtggagctatgatcccagcattcaagaagaaaaggtaggaagacaagaagtttaaagtcatcctcaactagatagcaaacttgagaccagcctgggatacacaagagccttcccacagaaagatgacaaggaagagattcatttcatgtgaacaaagttaaagtatttttttatttgggattattggtaggttaccatatgttgtggcacacttgttttattctttaaaaattctatgattacttaaagtacagcacctttaaaagacatatttcctaatttgagttgatagttaattttcaaaacttgatagactagtgagcttctgagagacaatgactctttaacctagttcaccttacatttgtcagccaagaggtctttctgtagaagatcctcagaaagattgatgctttgtgtctgacagaattggaatattgtgttcaaagatatcgacacaaaatggaagtctatgtttgcacatacacatgtactcaaagaggtaccctctacacattggagagtgcttcttgctttcatgaaaggctggtaagagggaatatgttagggctggggagaaggctcaaaggtcaagggcactgcctgtttttatctagaagacaagaggcataggcatgtttagaggcaggtagatctgactaggagtttgattcccagaagccatatggcagtgcatggccatctgtaactctagttccaagggctctgacacacacttctggcctcctaaagcactagacatgtacatagtacacagacatatgtgtaaacagagcaccacacacatgaagtaaaataattttaaattttttgaaatacacagtgagttctaagtttatctggaaaccttagggttagaaagtacatcctgaccaccgtattcatgaagaaaatctttagcactaagggaagtatgataagagacaagatgctcttttaagttgtctgcctcccagtcctaagtctctgtgatggacttcattaatcgggagcaggagtgaatgaaaaggtggttccccaatctaaatctgacctatcatggaataataatgtaatcaagaaggaaaaaaatgaagctagttagaagtgatatttgtaaatattttcaagcttttattacctagttgagctttaccagatccattgttaatacatgagagattgtctaaagccaggaagagttgcaggggattacctaaacagccaaactggtaagtgaattttgttactgttgatgtatcgttaattatcacctttctctcttctgcagtaacctaagttttgtggcacgacgaagttctttccgactcctttcccattgtttgccatgttgttctgggcacatgtgatttattaacccagaagctggtcttgatgactcctataagcagaaactcactttctctttctttacttgttaataagtgaaccacacccagaagatacaccgccttactaagtagaggagtagaaaaaggaccaataccatttagatcagtgttccctaaccagtaatctctaattgcagcatgaattggtatgaaaatttgaaggccactgagtgcaggctcttcagagaactgcatgtttacctacatatataccatatgcatacatttcaggaagaccagtcgtgcattgtgagtttaaaaacctctgcataaccaggaggtggtgtcacacccctttaatcccagcacccgagaggcagagaggcaggtagatctgagttcaaagccagcctggtctacagagccagttctgggacagccaggaaacacagagaaaccttgtttcaaaaaacaaacggaagtccatcactcaaacactggaccaccaaacagacagcatacaccagctgatatgaggctcccaacacacatacagcagaggactgctgggtctgtgttcattcagagatgatgcacctaaccctcaagacactggaggccccagggagtttagaggtcaggtggggtgggggctgggggcatccacatggagacagggtggggtggggaggaggtatgggatggggagcagagggagaatggaggggggcagggaatggaatatggagtgtaaaaaatagattaaaaataaaataaaatttaaataagaacgaaagaaaaaacaaatggaaaaaaaaacaccgaaaaacaaaaacaaaaaaccttttccccagttgttacagagatcctgctatatgcctgtcatggtcacagcaacttgaaatgaaagccacggaaaggattctcaaaaatgcatgttgttgtatactcatggtctgtagccctcagctactgttccaaatatttttttctgattaactttcataggcacaatttcataggcatttttattatgaaaaagagccacttaatacccatttgaacattactgtccttactcaaaataagttgtctcattttaacaaattctagacttttcaactttaggcttcttaaaaatgctttttcatatacatgcatataataacaattaatgaaaaagaagctatgagagggaggaaaggctgggaagaaatgatggaattatattacaatctcaaaaaagaaaaaagatgaaaacaaaatacgcatgttcagctctcaccccaacaacttaattattaatgtattaattaatataacatttattacattatatcacataaaagctctaccttgcttacttttctcctgtctgtatctcttttgtgccttgctgtctataatatttcacttagccaagggattgagaaaaatagaagactgttcttggaaccaattgttaggtatggtgatagggtcagagacggaaatgacagatatgttcatgagacctttgggattcatgggctttttggactattagtcatcctggagtgagttaaaagatttcatcctggaactctagtatcatatattaaatgccaatctctgtaagcgctgcaaaaacaaacatatggcacatctgtgctttgcaggaggaatggtaatatatggaatccctatttatgaataaatgcttctggcatttttgtcttagcagtttggactattatagagtttgagggttagtagaatctaacactgaatgggtctattagttatcatttacagtacaattcatcaaatgtttttgagcatctactgtgtgctaagcattgggatattggggatagcaagagaaaaaaacataaaatgaattttcctgtcataggaaattaggtgattgggtcttctgactatttttttttaatttagtacaccttttctactgtctctgtattctatatctttgaaaaataagtacagttttcttaacagagcagaaaattcctcagtaaatagataatagatcccagactggaccgagacaagatttctagcttcttagctttttttttttttcttcgtttttcgagacagggtttctctgtgtagccctggctgtcctggaactcactttgtagaccaggctggcctcgaactcagaaatccgcctgcctctgcctcccaagggctgggattaaaggcgtgtgtcaccaggtccggctccgaattctagcttcttaaacctttggtttaataggctccattgaatcaagagcaacatgtttcttttccttgcagttctgaggaagatgtgctatccttggtttcattggtgatgtgggattgcaaaagtagcattcatcattatatattgatgattgccctgagagtacaaatctatacatgtttgtgtatgcagatgcatgtgagtatgcaggtatgagaaggacagagatggatggacattgagtgtcttcatcaatccttccccaccttgttgtgtctaagttttaaaattaaatttattctttacaactttatagatatatactgtgttctggttacactcaccctccaccctctatttattatttccctgtcatccttgccatgcactctctacaagtccctatttcacatttatgccctcttgtgcaccttattttttggaacagggtctcggtgaacctggaacttgacagttcactaagtggtcttgccagcaactctctgggatccttatgtcacctcttcttcagtgctggctttactgcacctgactttttatgcagatgctgaagatatgaactcatgtcctcaggattgtgcactaagcactttactgagtgctccagtgccccagtgccctagtgccctagttgcctgtctttgactgagttagtttttaactatgtggctggtggatgtgctgctatggatgctatttaaaaaaaaaactttcccaaaacttagtggtttaaaataaaataaatcggtattcagttgctgtggatgtcagtagtctaaaccgtgtttcactagactaaagtcaaggtgtgaaaatagctgtgttcctttcggaaaccataagagcaaaactctatttccagccattgtttagcttctggatactacttatatttcacattttgtgaagactttctatattcaatccttccagtggaggactgatttccccacatctcatcacttcaatattgtttctatctgcatctctgatttttactcttcctcctctcccttccacttataaatactcctataattgcattgcactgcctgaatagacagtctccccaactcagcgtagtcgatttgccgccttcacgatctacaaccttaattcctcttatgccatataacctaaagtattcacaggttctgggagtagcatgtggacctttttgcaataattaatagattagtaggttaataggacattaaaagacaaaggggccttgtgtaccactcgtccagttcttccagttgttcaaccttgcataaccatgcataatatcaaaaccatgaatttgccttagtcatactgactgtatagttccatcccgtcatatcccatatgcatgtttgcataactaccaacatgatcaagacaaatattattcatcacaagaggtttgcttgtgctttacccattgtagtttttgcacttttactcaatccatatcaaactttcatagtcactattccattttccatatctatagtttcctcattccaagaatgttacatgaacggagtcataaatgacatgagcttttcatggactcctttcacgcagcataatgccccagctccacccacatttttgtttttgttgttcttgtctgtctgtttgtttgtttgtttaagaaaggatctgactatgtaaccctggctagccagaactcactatgtagagtagaatggcctctaacttagagatctgcctttctctgcctcccgagtgctgggatcagaggtgtgcatcatcaggcccagtcatccaatttgttttgtatgtaaatagttcattccttcttgcaattcaaaagttttgtatagtatcactataccacagtttagcttttcacttgctgagagactttgcttatctacacgttagtctatcaacacacaaagctgctataaacattaatgtacaggtttttttagagaacacaaattttcatttttctgtgatgaattttcaggtatgatgactggtgtgtatggtaagtacctgcttagtttctttaaaagcaaaactaattttgaacaaactatcccaggttgggcatggtggcacatggctataatcttaacacttgggagcccaaggtaggaggatcttgagttggagaacaacctgagttacatgataaatttaagtctaggctgggctacatagggggacactggttcagaaagcggcaaggaaaggagaggagagagaaagcattttatagagtgccggtctataacttattatagcttaggaagattgacattttggcactctatattatatttataacctaatggttttaagtatttcttctttatgtatttatagctatatcagatattataatttttgcttcagctgtaaaacataattgagacaggttaaccttgctctttctgttgttattttttcctgagattccaagatcgtgtttttgcactttttttcctgtttagagaacatcatttaacaattatttcaaggcaggtttacgagcaagaaattctaactttcttccctttgaaaatttctttattgcccttccacagtagtatattttccgtaaagtatattttcatgggacctgaggttcaaggttgacagttctttttatgaatgttcttgagaaatatgtcattctattctagcttccatggattctgaggagaaatcagctgtcattgtaactattttcccttgttagtaaggttacatttctctctttactgctttcaaggtattattattattatttaaagaagtttgaccatgatccatgatgtggctcggcatgcagtttttgaattaacctactttgaaatatagttaggtttttgagtatgaaggtttgtgtgctttgccaattttaagacttaacaagaaaaagaaaagacaagacaagaaaaggaatatcatttgaaattcctgacccacctcctatcattcttggcttcctctgatgacaggaaactttttgctttagttctataattcctagaggctctggacattttcctgagtctagtcattcttttttacttggatgaaatgattcccatcattctagtatgttaactgattcatttcttggctctttccattttgcccaagagaaggtttttctgtattattgtatcttatctccaaaattctgctcttttctttatatgctctgtttttatattgtatttttctctttgttccaaaagtacttgtaattgctaattgaaccatttttgtcacaggagctttaaagtctttggtaattctatttattttattttttattttcttattttttgttttcaatacatcccaactgcagtttctttctcttcccaccccttcttgtttcttagtacaagggagggatgcctttccttatttaaattgtcttgttttgttcttgagccaaagctccatactgtagtagtgtaggttcctgtggaactcactgtgaaattcagactggccttggactcaccgcagtcctccagcattgaccacaagagtgctaagattactgagcttgatgaacaatttattttattgtttttatttctttttatttaaatgtacaggtgttttgctgtctgtatgtgcatcatgtgtatattaatgaccatgtaagggaagcagcttcctcttcactctgacttttgcataatggcaacattttccattttgaagaatcgagtctcagaaacattcaagtgagtttctcagagccacacaacacactactttgagccatagtgatgattataggccagaccatcatcttacttccaaatgcatgatgcctgtttttacccatagcatttaatactcagcttcacctgactcatttcccaacctgctccttctcggttctcaatagagcctttaactttccctttgatgttgtttgactgcagctgttttcctggtttattgtgtggctggagcaaggttagacaagagaggcttgagctcctttgtgggaaaggggatcagagagggaagaaatatttaaaacaaccattatattataaggtaccctcaaaaagcaaagagagcctagagtttatacctgagacataagcgaaaagggattacagaaggggtcaggacaggaaaccagaagacactggattgataaaagtaaatggattcaatgaccaataaatatgcaacaaagaggccaagattatagagatttcttccaagttgagataataaagattattttttgactatggtaataacttgggagagagagttaagggaggaaataaacagtgtctcttcattaggttcaactttcataacagaacaaagtttttaaaaatctcaaaagtttaagttattgtgagaaagtgaattcagaaaactatgttccctatatgattcccgggaaccagtgtgatattggttcaaaaaggaatgacagaatacatctgggtgtgtaacagataccatgaaaaggtaagtggagataagcattgtctgcaaaactcagttaaacaaaggaatttaaaagtcatacgacaataaagtggggccatccaggagccctaatcctgaaagagacacgtttgttcagtctctggcttacagaccagagcagaaatgtgttgagtttctttggtgactttgatgtatcaaggctccaggccctctatcttatctcactaactgtgtcttttttttttctctcttgttatttttttctcgtcttttcaagttctctggctttaaggttaagttcatttgtcatttatcaaaataatccctgaagggtaggagtgtagctcagtaatagaatgcattcaaggtcctagatttgatgcttgcactgcaaaagaaatccattaacattactgaagtatgtagaaaaattccaacattttttctttaaacttatatataattttgttttgaataagcaaaagtattgcaaaacactgagaatcgataatggatatatcctcagcttgacaaacttcaatactttgaatgtcagtttgctttcttttttggtttttcgagacagggtttctctgtgtagccctggctgtcctgaaactcactttgtagaccaggctggcctcgaactcagaaatcctcctgcctctgcctcccaagtgctgggattaaaggcgtgcaccaccactgccaagctgtaagcttgctttcaatttctatcagaaagagaaaatgaaacatagcaggcaagttaaattctgtccccaagcctaatcatatttaccttggtttccagggacaagcataaagataaatttggtgtgtattttctattttgtttttatacctctgtacatgtagttataaccataaataatatataaaactattcagtatttttaattttatgtaagcaaaatcctaaattatgtgccattctatttttttctattcaacaatttatttggagattacctttttaaaatgttctatgtcttctttgtgccttagagtcaatggtgcatgtacattatttttctttataaaatacgcacaatattgttatacaaaaattgaaaaattcaaccaattgaccaattcaacttgcaaagattctagacagctcatttagcccagtggttcttgcaataaaatactgaagagcaaaatgagaagggtcctgagagataactctttgccagtttcctaacacatttatgaaggaacaaatggaccaaatagaaggaaaaagaacttaacaagaacatacatccagtattatacttgagactccctggttccctgttctatacttgaaacttttcgaaaaacaaacagacaaagaagcaaacaggatagatagatagaaaaagaaacgtaaaattacaattttaattataaaatgatttattttgataaaatatgaggaatacagaaatgtagaaaaatgaaatctaggacttgctatattttagtatttttatttctttccctatacagtttccatatttctgtaattgctaattttttcttaaatagatataggttatatttattaattaatatatgtcttaaatagaatagtttaaaggattataatttcagaaagcatatttttcagaaaggtttttatgcattgaaatcttgtcagcaaatattttagggtatttgtttactatttagctattgcaatcatatagacagtaactacctgatcatacttgtctgcactattgtttgtttattcctgttcattgggcagatctggttactttaatttttaattataatttatctgtatgtgtgtttgtaattatatttattttatgtaaatgaatggtcctagatttgatactagcactgcaaaagaaatccattaacattactgaagtatgtagtagtatgaagtatttacttacatctacgaatatgcaccacatgtgtctagtatccgcaggtattagaagaggctgtcagatcctctggaactgagattatagatgattgggaaccactatgagggtgccaggaaatgaacctagaacttctgcaagaagaacaagttttcttttttgctcatttatatatatatgcatgtaatagtaaagatatatatgctttaatatgtttgtttgcttgaaagcttgcatagcaccttttggtactatgaaagttagtcaccagggttttcaggtgagatacagctaggatcctccaaggcttgtgtccaaagtacataatgttttcagtaataagagctttacctttgggaggtaaccaagggctacagcaatagcctgtattgtttggtagtctcttggactttcctgaccaacaattcaaaagaaggtttctagtgcctggtaatgagatttttgttagatggtctgtggctcttagggcagggagaatcattatcaggccaattgacataactttatttaaactatacttggataagtatacatgtaacttgtatatagtatatgtaattttgggtaagcaaagttctgagtctttctggctttttcaagcatccttagtgttatttttctcttttcttcctctccttctgtattgccctcctatcccgcccccattaaagctccaaccttttctcatataccccttcacatcacctgtaccctgctgttctcctccagcacaacccatggtaccttttgacttccatggcttctacatttataccaggttatctactcacatctgaagatttggagctaggaaatgcatatgagagaaaaaatgtgatgtttgtgtttctttttttttcttttttaaagactaaatctatttatttatttatttatttatttatttatttatttatttatttattatatgtaagtacactgtagctgtcttcagacactccagaagagggagtcagatctcattacggatggttgtgagccaccatgtggttgctgggatttgaactccagaccttcggaagagcagtcgggcgctcttacccactgagccatctcaccagcccagatgtttgtgtttctagatctaaattacccagtcagtatatttcctagttccacctctttacctaaaattttcatgatttattttaattttgtttgcaattgaatagtattccattgtgtataggtaccacattttcattatccattcattgactgaaggatatttagtttgtttacatttcctagctctatgactagagtggcagtgaatgtggctgaactagtatctctggaataagatgttgagtcctttgggcacatgccaaagagtgatagggctgggtcatatggtagatttatttttagctttttgagagttctccatactgatttccagagtggctgcaccatgataagatattcctaaggattaaatagtgccactcatatcttggcaggaactaactgctgtctagttggacttaaagcctgctcaacaggagggaaatcatggctgataagatactgtaaacctagccaactccctggggctagtgaagtcgtggatcttagaggagaacctactacaactactttaataaaccagaataactcctaactgaattctaaacacttatctctagacccacagataagtccaactttcacccttcatcaaagaaacttctgtcttacaatggacagagaccattatagaaaaccacattcagtcaaaatacagttaacaactaatctctggggtacccacttccagcaaatacatctacaacacaactcctgtacctaagactcaggaaacattggtaatgaaaggagcagaaagattgtaagagctagaagaccagggaatctgtgtgagattatgtctcctataaatggcagggaaggttcacgcatgatacatcagcaatactgctgcctaaacaagagctgaacaaagataataccaatagacatgttatcatggaaggggccaatctcatgggtcccatccattgacaaagaactatagataactaagaactgccaagagagggagacttagtcaccacacagatgagctgtctagttggttactaaataccaagtagtcagccctgaaatcatatacatacaaacaacactaaatggacccagaaggttgtattaaaaaaagaaaaagaatttgaaaggaagcaaggaggtagagatagggattggagggagaaaagggaagggggaaattatctaattctactttaattttcaaaagaagagtaacaagcttgcttaatccactgagccatcactctaactcccatcccagatctggttccttaaaagctgacatcaaaccttagattcctgaaaaaaatcattctggacaattagatagccatctggagtgcttgaggtctgaccaatgacatggaaggaaatcctttcacctctaaaataagcatgttttggagcacaaagggagttccttctagagctgctggttccatggaagtttaccttggggaataaatagtagtgatttattctgctccattaagtgggctgggatgcttaatttctccacagctggagaataaacgggatggaaatcattaaaatgtctttatcacttactaagagaggagaggtacatgtctagacaacttgtatgcatacatatacacacaattaaaaattgtttacagttttgtttttatcatttaattgtaatccatgcaaagtgcattcaattgtcaggaatttctggaagaagggagagtggtagtttattttgtttgtttttggggtgtgtgtgatatacatgcatgtatatgtgcatgcgtgttcacatgtgtgtggtggtacatgtgcacatgtgtgcatatggaagcccaaagtttgtatcagatgtcaccttcaatcatgtttgaccttatatagtgaggtcttgctaaatccagagctcattatttaggctattctgggtcatctgttaactccagggattatctgttccttatttgttccaccttttgtgtactggcattacgaaaaagccattatgctcttacctgctggtattatacacaggcaggtataatcatacccacttgacttttacatgagttctgggaaatctagtccttgctgagccatcaactcacacctggtgatagatttttgttttaggcagttgaacatactgagacaacaaagcatggagaaactgagcaagttgagtatcacacagcaaaaaggtatgatgttgatattaaaaaataaaataagtggggtacagagtggttaagatcagtggttaagagtgtagagacctggagtttggttctcagcactcatttcaggtggctcacatctgcctgtaactccaagtcaaagggatctgatgccctctttttgcctccatgtgtacaaacccacacttagacatacacatatacacatatttttaaaaaataattaaaataaaaatgaaagtgccattatcttttgtctcttaattcttacatttctatttttatttttcttctatttctattgtatgttgggcacatctatctatctatctatctatctatctatctatctatctatctatctatctatctatgtgaggccacatatgtgccacagtgagtatgttgagaccagaggacaatttttgagagttagttctccctttctgccatatgaggggatggaactgaggcatggcaacaagcacctttacccaataagccatcttggcagttctcctcccaggtcttggaccttgtaaagctgcatcttagcccacgacaactcacccatggttctacgttaatcaatttaaattggtgctgctttgcccttgctgccctgactgtcttaattttggccaaatggcagctcacagtagttgttatgaagccttgccaattttaattgttctgttcttatctccagcttttgggcagggctggaaaggtgctagagtcatgctagttggtagctacattttgaccccaaatttgtccaataatggtttgtgtttggaaggggatggtgttcatttactattgtaaatcagtgagaatcccaggattgagaacatcatgcttttattttttaatataatttattatttatttttagttattctctcacacattttcatccacattctagttttaaataaaattaaaaagactcctttatacagaatcatattccctattaaaaaagatttttttgtttaaatatacctatttctaaaaccgcatagctacagccacctactttttgacaaaggtgttaaaaatatacatcagaaaaagacagcctcttcaacaaacgatgctgagaaaacatttgcatgtgcaagaatagggctaaatacatatctcttatcttgcacaataaccaatttaaactggataaaagaccttaataaaagaatgaaatgctgaaacttcttgaggaaaacgtaggtaaaacacttgaagatacaggaataggtaaaaatttcactaaaagcaaaggaaataaacagcgagtgaagaaacagcccacagaaagaaaaaatctttgctaactatatgtctgtctttttttttttttgtaatcaacttgacacgctaaactcagttgagaaaatgcttccatcagatagcctgtagttaagtctatagtgcatttaaaaaattactgatgtggaaggcccatcgcattgtttgtggtacacccggggtggttggtttgtgggaatatatcagaaagcagactgagcaagccatgaggagcaaaccagtaagcaatattccttcgaagtctgcttctgttcctgccttcagattgtgccttggcttcctttgatgataggctgtgctatggaaatgtaagtcaactaaaccctttcccctccaagttgtttttagttttggtgtttatcacagcagtagaagctatagctaagacaatttcagagaggggattaatatctagaatatataaggaactcaaaaataggtgtcaaagctcacatcaaccgataagtgggctatgaattgaacagacttaaattaagtaaataattaattaactttacattatgacttcagtttcccctccccctcccagttcttctccccttccactcctcctccctttctccttagaaaagggaagacctcccatgaataccaaccagctttggcatatcaagttgcagcaagactaagcagctcttctcatattaaggctaaaggaggcagctcaataggggtaaagggtcccaaaggcaggcaacagagtcaaagacagtccgcattccagctgttatgagtcccacataaagactgaactacacgcatttcttgaaagaaacacaagggataatacatatttgaaaattttattatctttatccatcaatgaaaactacactgagattctatccacagtcaaaatagctgtctccaagaaaacaaataacagatactggtgagggtgtggagaaagaacctttatatactgctggtgggaatataaataaatgtagccactatgacaagctatatggagatgcattagttatttttgaccaaggcaactttagaagaaagagtttatttgggctcatggttccagaggcataaccatcatgatgggaaagcatgacagcttacatcttgacttaccataaattaggttttaataggaaatgtttatgggtcaaatatcccatgaagcataataacacatgtgagaaagtaagtctgaaatgcaagaattaaaataaaacctcggtttttttgtatggtggtagataatgattgattggtgaagccagaacctagaatgtgtgtggttagctttgggaataggagtgtgaacagaacaaaaattaatgttttctaattgtccttgcctgctgcagatattaagcagctagctctgtgttttttttttaaaaccatttatcaaatactaatggaaaggtgctgaggtgtcgctaatcccaaacagtatataatccccaagtcattttattgtaatatcctgtcatacatccacaccccagtgccccttccccgctgttctattttagaagattcggagactgcactgagagatttggcaaatggggtcaacttttattgctgggctgtctgtgtttattcacacacagggtaagaaatttgtaactgtcttgtcacatttcctttatatgtgctctagtgatctgggaagaacaaaaactctagagaaaacttttctcctttactatctggccactccatcaatcttaatatcaatttggacaaagtataaattgtggtgtgtacaaactatttcaaatcagctcctcgggataaaagattgccataccaaaagaacctgaggcttttaaagtgttttgtgctgaaacgaaatagccatctatctgtggtgccacctactggccagaataggaaggagaaaggagcaaatgggaaggactgaatttccttccagtccatgttggccttttcaacttcagtgacaaatggtgggaagaaacaggtgaatgtggacactatctatccctgcttggagagtagagcttgttgacaattgggagcacctcatttatgttaagtcttagttttaatgtgttatgggtctctaagaccgagaacttgggaattgtgatgatataattgagtctcctagagaggaagggaaaatgaggcagggttttaactatcaaaatgtatgagcactttttgtttgccaatatggagaaaaaactaagccctttcgaacataaataaataataaatgttataccccaaaattattagcttttggaaatatggttaatgtgtttttcttctaaattaggaagttaatggcacagccaggtcagctgtgaatataaattcagatgggtctgagtgatcttgtgtttaggcagctagaatctttacaaaatgtctgatgagcccaagatgaaactttgagggaaagcgtccacactacttgtagatgctatcagattttgtatagacatatgctgagtagttaaaaattcttccaatttgtttcattacagttttcatatcttactcttggatgaaatatcttcctattctttctctgacctcatcattctgcctcatatgtgttgaatggatgaaattaagtatagtagttttaatttgaataattttattgacttggcttgcctagctgtgactttacagctagacatgtggtagtatatataagtcttactaatcagatgtatcttttatgtctataaacacatgagggtaaaaaaacaaaatgcctggatttttagtcttctgtttgctttgtaccaagaggcctaagaactatgtctactttatcttctctaatggtgaaataaaacactttcactttttctattaccagaaattttctgctttttggattattcggttttctttactcctcaactgttcagtgccacatctaacaaagcatatggtttttctatcaaaggagcagtcattgctcttaggtatgcagggggaaagcaaaaattacaagggttaaaaaccaatccgttcctttctggtatttaacttctaagtcagcatctttttttttttttttcttaaaaaaaaaaaaacaactgtctggctttccctccttgcctaccctcactcctatacataaatattttctcctttttgtttctcctttcctcctttgctaatattatggatggactgacagctcaaaaatactctaattctttttttttttttttttagccctggctgtcctggaactcactttgtagaccagactggccttgaactcagaaatccgcctgcctctgcctcccaagtgctggcattaaaggcgtgcgccaccactgcccagcaaaaatactctaattctaaggaactagatttgttctttgatatttcattgcccccgtggttttaattaggtgtaaattctcctatgcttgctttgaaacatgcctcaggatcttagtgagattaatgcagggagatgtttctctcttcatggtgcccaggcaacatttattgtcattaaaatagtgtcattcaaatgaggtggctgatattggaaaataaatgcaaggttgtttgttgttctgggtctgagctatggtgaagaggtggaattggaggcaacacttgaaccctgcttatgcagtatgtatctatgtatctatagctcaatagaagactcctgacatgaggacaaagcttctaagactatattagggttggggcatgaagatacctgtctcttctgctttccaagctgagaggaaaatgtgaaaaaaaaaacatgcaaagtagccaatgtactcagaaggaaaaaagtgggtatcttctgagccctgggtaagatcctgggtaattccttttgccctgccaagtcctggaagccctataatatttttttctttcctaatcaggttttcttctggtggccaggttaaagagaaattgattcctttataggcagtgtttagcttttgtccttctgcattcaggctgtcaattgagaaaccctcttttagtctgtaggactgcctgctgatgtttaggcttaaacattaaacaatcttacagacctaattagtatttatggcttgtggccaagtcaactaattttgctttgtagaatttctgagaggaaaaaaaaaatcatacttagtgaaactcccttcatgatatctccttgaaaattgaagtgttgctgacctagtggaaatatttcgtcgtacactagattgggaacaactctcacaaaacatacctttttatactgtgttctttattacatcacactgggttaagctgtgaagagatgaggacgatagtggccattttttgaaaagtagaatagattgaatcaaatgtgtagagaacactgcttgattgatttgaaactgaaggtctagcctccccagccccttgctccatggcagcaatttcttcttggctagagacctaagcatctgtgtccaaatctcatatcctttcctggatggattcagcaaggcaaaccttgagttgcttagagttattttttttcaccattccctaatttaagttaaacttaaaaatgaaagccattaagtagcaaaacaaacaaatacaaggataataagagaacattttgtcctggccctcagaggtcactttaatgtgactagcagcataaaacttcacaaaggctttcgctggagggttaccagaagctgcatcattcagtgtgttgccatatactgctattctttcactttggcattatttattgattgtaacaggagcacagtatttgtacctattaagccttttagtttcctttcagcttttcctgagtaaaagtagaatggcacccattattgttgaactgttctcaaggctaaaaacctcctgaatgttgtttacatgcatggttacaaaggcaagtactgaggcagaactgctttgcctgatttgattcctatcaagggtaatgtgcgctctctctctctctctctctctctctctctctctctctctctctctctctctctctgtctctgtgagtgtgtgtgtgtgttcacacagaagaagtgagtgagtagagttttaaggaagggagactggaaagaaaactttcaatgaattaaaactacatactgagaagatcctgaaatttaattaggaaaagatggctgtgttttttctctcacctcctcctcctctctctctctcctttccttcctccatccttcactttgtaacagcaccaaagtgaaatgagactattcgattgaagctgcacacccactgtaggtctgttttgagaaaaggattttttttcctccccacatttacttggtggtagcagcagcagcagcagcagatctattgatgaatatagtcgctatgtggcatcatgccagtgttgtgctcatttccatctcttctgtactactctctggttgggtgagcagagtccaagctacaagtgtgttcacttttaatgtatcctgtggtttacagtgtgctcattcagtgttcaaccactaaaaccctctgcttgagagagctggagatttagtttctgactttagtcagaaactcagctttagtgtgactgtgcagtgggtttgcccttatggacacaggatctgttgggaacttttggaaaaggaatagaacatgtttttaacctaaggaataagaatgtgtttgaaaacaaatacacaattctaataatgcattttaaactacaattgcatgacttaacttcgagtttcctctttaaattttaaatttttgtctttagagtgcgtgtaccaaaatccattaataattttcaagtcagtaattaattgtcaacttatctaaaccagtgctttggcattttcttggtcttttctgactctggttttggttttgtttgtttgtttttttctagtatgttcttggttataaaattaagctggacagtggtggtgcacacctttaatcccagcactcgggaggcagagacaggtggatttctgagtttgaggccagcctgatctacagagtgagttccaggacagccaggactacacagagaaaccctgtcttcaaacaaacaaacaaacaaaaaattaaattataccttcttaagaatggtggatggtcatttggctttaatacattccatgaaacccctcctgtgcacattcgggtataacttccccacatgtgataaatacctctccagctggtgaagagaggcataaataccagaacatgattgaggtcactggatatgcacccaagttgggagaagagtaagaatatatatgacgatggtgagcctgcaagaggaactaggtacctgaggggaaatggtattgggtagcaaggacctagaatagtggttctcaaccttcctaatgctgcgatcctttaatgcagttcctcatgttgtggtgacccccaaccataacattatttcattgctacttcataactgtaatttacttttttgctactgttatgaatcataaatatcagatttgcaggatatctggtatatgccccctaagtgtgttgcaactcacagattgagaactgctgacctagaaggaagacaaagcaggctgaaaagcactgtgtacttagttatggtcatcaccaaacaacacttcctgcttcttgtttcttatttctgagatgtgtacactgtatagttcaatgcacagaagctctatacagcattgatcatttcattcattattattattattatttttttttttttggtttttcaagacagggtttctctttgtagccctggctgtcctggaactcactctgtagaccagggtggcctcaaactcagaaatccccctgcctctgcctcccaagtactgggattaaaggtgtgcgccaccacgcccagctcattcattactttaataaaattttatcactttcatgggctttattggctcttgttgatatcttttcaaatcttagaactagatgtaccatttctgggggtgtactcttggaagatgaatttaccattcaaccacatacacacttagcagacattttaaagacccacattctttattatcctttgtgatcctaaaattctctgttacatctgttactctgagttttatttcccttgttagataaacaggatcttctatttgcaactcagccttgtagcctaaaactggccaaatgacctagaacaacttttttttttttttccattttttattaggtatttagctcatttacatttccaatgctataccaaaagtcccccttacccacccacccccactcccctacccacccactccccccctttggccctggcgtccccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcgtttggatgctgattatggggtggatccctggctatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatccacgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcccattcttctacacgataacaaccagttgtgccagcaccaattgttgaaaatgctgtctttcttccactggatggttttggctcccttgttgaagattaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccatctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgtgttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggagggtctcagaccaagatggcgaccgctgctgctgtggcttaggccgcctccccagccgggcgggcacctgtcctccggtccggacggtggctggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtcccaggcccacacagggtgctgcctcagcgcctctgtgcttctgcctgttccagaagctgtcaggttctctggcgcaccctctcacctgttcagactattttcctaagttcggcgggtctcggaccaagatggcgaccgctgctgctgtggcttaggccgcctccccagccgggcgggcacctgtcctccggtccggaaggtggccggctgtccccggcccacacagggtgctgcctcagcgcctctgtgcttctgcctgttccagaagctgtcaggttctcttagaacaacttttaacttgcattattcctgcctcagtagtattgaaagtgtgcatcaccataccttagttttaaaataaacaaagctatgtgtttagataaatttaggaaataataaaatacacaagataaaatgatgtctttactacacatcttaaaatagtctttctggtatgcatattgtgattctggtacattactcaactaaatttgctgaaaatatctttagtaatactttttttcttttttttaaattagatttttcttcatttacatttcaaatgctatcctgaaagcccccaataaccctctctctgccctgctccccaacccacccactcctgcttcctgttttttgtttcaaggtgtgtagattggaactatcattaaaatttatagaacttggatatcttaggacacataatattgtatttgtaattatcgttcctgtgctcatttgcccattgccacttctgtgctccaacaaaaggaaacttttttatcctgatgtcagtacttccttccatgtcactggttttcattttcaaagcccaagaagttgctttcatatcccactccttcctttgctatatttctgctttagccatgctgaaaattcatatgtaccattctgatcctcacagagaagttctttctccgcttggcaggcttaaacattagtgggtataataagctctatataagcttgctgagacttctactttttaagcacttttatagccatcatctcatgggatccatgagaccaccctcagtaggtaatcagtgagtgaagattccattctagctcaaggccatgcagctaaacgtaggggcaatagtgtttatagataaataagttttactacttttaactcaccgtcaattcctcagtctaattccttttctgcttttcttttttgaaactcatcatatataagaattgcttggcaaatatgagaatttgctgagagagcaaatttggaaaactgagtggagattacacatggatgtctctggctgggtcactcagtgcttcagtattccatgggaagttatgatgaaaaaaaagtaccaaggcaaaccttgattgagccatcacaaagaagaatcattactagatatctaggatcctttgctcttgatgcaaaggtctacaaaatcatgaaaacccataagctcctccctgattgtcaaaggcctactggaagaactgagaaaggtaataactagttggtcctgtgtatgtttttcggacatgattattggagacaggctacggaaatcgttttggcacaagacatacattctcattgtgggaaagtttgcttttttggacatctggcaatgtctagagacatttttactaagaacttggttgctactgacatctaatgggaagagattaaagatgcttctaaacctacaacccatccctaccttacacacacaacaaaaactaatccaacccaagacagagaaattctggccttagcctctctttacaaaattagtttgttctctactttcacctccagtacctgtactatgtatgtacatgtgtggatatttcttaaatatccattttaaaagtctacccacctaagaatagccctcagatagtactgtgctccaaagaaatgattgtgcgtggacttgatatttacttggagtgagtattaggttcatgtgggatttcaggtataccgcacatataggacacaggatcacctgctaatactcatgtggatgttttctatagtttttcattactgtgataaaatactaaccaaaagcaacttgggaggaaagctctttccttttatactcccatgcccagtccatcactgagtgaagtcagggttagaactcaagcaggaacctagaggcaggaactgaaacagaaaccatgatagaatgctgcttactggcttgcttcctgtggcttgctcagcttgctttcttaaataacccagagcaacctgtcagaggtggcacagcccactataggctaggcaccacttctacgtcaatgattggtcaagaaaatgcctcacagaaacaaccacaggtcaatgtaatgaagtcaattctcaatcaaggttccctagtttgtgtccaggtgactcaaactaactatcaaagtgcttcttatcttgttgattttccagtaattcccaaacttcataggcctcaggtactactttggagtaagcagaaggggttgtggtaagctttgagatataaacctagtggggattgcttttaagctctctgaatgcaggtggcttgaattctttttttaaaagatttatttatttattatatgtaagtacactgtagctgtacttcagacactccagaagagggcgtcagatctccttacggatggttgtgagccaccatgtggttgctgggatttgaactccggaccttcaaaagagcagtcgggtgctcttacccgctgagccatctcaccagcccaattgggagcttttgtttgtttgtttgtttttcaagacagggtttctctgtatagctctggctgtcctggaactcactttgtagaccaggctgacctcgaactcagaaatctgcctgcctctgcctcccgagtgctgggattaaaggtgtgtgccaccacgcccggctcaaattctttcacttaaataagttgagctaagaggagtcggtgaggagatagtttcagtgattgttgtctgggtttttttctcagttatcttacatgtaggaagatattttaaccaattcagccactacagctgtcaatgtggaagaatctaaggagaaagccatgtgcatgagcagaagaagtatagacatttggtgagcatccaggtatgtttgatcttttgaatttgggcttcaactcagtgtctttcatttgtataacagtttctttccactcttaatttctcttgactaagtggtgattaagcatttcaattttggcattatagataataaaatggaattcattcttttatactttactgtggtactggtgcctgagtaccagacaccaatgggtattggactccacatgtgcacatgccctgtgtgatgggttgaacaagaatggaagctataggctcatagatttgaatgcttagtccccagttggtgaaaccatttggtaaggattaggaggtgtggcctttctagaggaggagtggccttattggaggtgataggtcactgagagtgggatttgatattacaaaagtccatgccatcccagtctccacccccctccccttcatcttgatccacaggcagcagaaggggactatgtgactgacttgagcatatgaccacaaagctctgcctccacagtggcacactgcctctaacaaggccacacctactccaataaggccacacttcctaatggtgccactccctatggccaagcattcaaacacatgaatctatggggacaatacctattcaaaaaaccatcactaggtggtagaaagagtgtaagagtcaggggggatggaggactccaagaaaacaaggtcctctaaatcagcccatatgaactcagagaaactgagacagcatgcacagggcctgcacaggtctgcaccaggttctctgtgtagaacattttcttggtatctacatatttatatcgataaagatatgacccttcgttaaatccccagcactaaaagaacagattagctgaatggtggcctaggaaaatgactccatttctcctttatttcaaatttgtcaaaacaaattatcaggttggttaaagggggaaactatgtagccctctgaattcagttatcttctcagaatccttcgcaacactggcgttcttttgattgtctcctttaatgactgtctcaagcctgtcttcttttcttctgagtagtatccctttggtacctaacacgcgacagataggaattgtttgggtttaatctgtcaaagtacatctaagcgagaaccatcacaggatagctggggaccacaaagagatttccttgcaggaaagaccctgttaattaaattttgtataaagactcaccagaaacatctttttttccaagccaaaagttataagaatttcccagagagacctcaactatgggcttttctgtgaaaatcaattagtgttatgattatgaaatagctttcctttaaaaaaaaacatttgtcacaacgaaagtctacaccttatcataaagagaaaaaaatttgccttcacttttttgcctttcaattctctttttgaatagtctacaacaaatagttattttgtgtgtgtatgtgagtaaaactagaacctcatatatactaggtaagtgctctgtcactgaaatgcattcccacctaaaatatatttgaaatggttattttctagtggatagtacaatagatccctttcctatgctgaataacctagtcctctaaatgttgtttctacctttagtcacacacacacacacacacacacacacacacacatttttgtgtcctaaaccaaaaactttcttggtccaggagcctattatctacttatctgcattaccataaccttctaatttcttaatttatttcaactgataaacattacttaatattagtctattttgtgttaaagtgtcttaaaattattttttctttttacataattttggttgaacagtacaaatttgttaacagaattctttacttttaacttaaatatttcaactaaattcaagaacatttctaaatgctatttctttttttggataatttgctctttattgatctttttttttccttttttctgcctattggctccatacctaccttctatttctacatattcaaatcttccccattcttatcctacttaagcaagtgtatatcttgagaagacaaagactttcttatttatgccactaaataatgccctgtaactgaatacactaaacttttaaaaaatgaatattacataactaacttataaagagaagatgaactatgcatccaagaagcttttcttggtcattgtcttttcttttttgtcaacttatacaaactagtatctgggaagaaacctcagttgagaaaatgcttccattagattgcctataggcaagtctttagggcattttcttgatcaataattggtatgggaggcccagcacattaaaggtgggtgtttccactcctgtgcagatggtcctaagaaaggagactgagtcagccccagaagcaatccagtaagcagcattgctactatttcagttcctgcctccaggttcctggcttgacttcctgttctgactttcctcagagattgagtgtaacctgtctgatgaaataaagcattttctcccaaattgcttttggtcagacagaaattggtcatgaggtattgctataatagacatagccttgttgttttggagaggattgtagcaggagtttggaatttgggggtgggaaatctgtgactgttcatatcataatgggctattctgttggggcttggaagatacaagtgttgagattaatgtagatgatgggggcctggcttgtgacatttcagagggaggcaaagactatattagggtcatgtgatatatttgaaataagaatctgtggtgtctctcagctggagctgaaaaaatcggctgtgattaacaagacacaagcatcattgaagtgaaacttacattgctgggacaattgatgctggttcactggggcatagaaatcagctgctattaagaacagacttagatcatgaggtgaattcttctgggagtatttccctgggatcagcacggagaagctgtggtccagagtagacaaaggctgcaaataatggaggcataaaaacttgataatgtgtaaagtatctcccgtggggtactagttttgaagacataagagggatcatggagaacatctgaactttagcactgtttgagagactagaaagtctgttggggaaagtgccaccgagtcccagtggggaccccagcatattggagatgacataactgtggaaaaaccatcaaggatagcagtacctatgagtggaactggtccgagccaacaggacaaaaactgtgttgtggatgggaaagccagagaagtggagctgcccagggtttggagtttagaggattttgaatgggtaccagatgcaaagcactgaacttttacactggtgaagcttggtttgctttgatttggttgtgactataccctgacttctccctcttgtagtaagacattctgtaatttccttttcattttttacaagatcccacaatttattttggattttaaaggagacatggatattttaaagagactgaactttttagcatgtttgaatttttaaactggaacttttaaagttatttgtgttttgtgatgttcttgtgtttattggcacaataatattgtgatgttaacattaatatgagatattggggattgattaaaaaaggaagacttactgcaagtggctgtggttttgttatccaaacttctgtatcccttttacctttcaggcagatcaaatttaggaatgtgttcatatggaaactggactcctttaaaactgtcctgctgtccatagctcttttaaaaaaaaaacttaattatgtgggccacagttttgaaatttttctatttggcatgctgtgtttgctgaatgctataaagaaatggatgaatgcctatatttgttagaactgtgaaatggaattatactatgagtatttttatgctgaatcatcaccaccaaggtgggttgaagacccaccatattcagcctaacatgatgaaagattcacctattacaaagacatatttaaaacaaagatgctccggattcttcctaatttcaattagtatgttaggttgggttactataaagctttatcatagtctgagtgcttataaacaataaagtttacagttcaggatgctggaaggtcaaagccccaagagactgaaagtttgatgggggcttcctttctggttcacagccaactttgaagtgtaccttatttgtagaaaagtccttgtgaatgaaattttaaaatatcaaaatgaaaagattattatgaattatttttgtgtgtcctgtgtgtgctgtgtgtgtgtgtgtgtgtgtgtgtgtgtgtgtgtgtgtgtgtgttataagaaaggaagaatctccataggtctacagagagtgcagccctgctctaccttgattttagacttctggatttttgaactgtgaagaataaattgccatcatgtttttaggaatttgttacaaaaccataaaaataaaaacaattaatgtttcaaatccatgataatttgaggttaacatatatccagtaaaaagcaaacaaacaaaacaaacaaaaaccatgaaatttctgtcagctcatttgaatttgatttgtttatcatggaagaaaaatagcttgtagtgttgattaaagtattgcttttattacatttttattcatcttgtgggaagaggcacacataacaggtgaaaaaagtcagaagacaacccacaattgtcagttttctccttctaccatgtgggtcttgaggaataaacccaggtcattcagacttacttactgactactaactactaagctatcccaccagccctgatagtataatttttaagcaaataagagcactttttaccacaagagaaaaaaatacaaatatgaaaaaattaataatcctgaaatattatttaataagctataatattttgtctgtgaacaaaaaatttagtaagtaagcagtctaggtcagacatgagctatctattggtgattataagacaaataattcttccttagaatgtattcagttgataggaggagtgctcagtcaagcttggaacttaattgtctgatattttcattgataagagtcatttaatgagatgaataaagtgaacttacatgtcgtgtatactcaaatttttaattcatattaatattctattatatgctgttattgttaataatgtgtagtcttgaatagacaattttttgaaagaatagtgtgtgtgtgtgtgtgtgtgtgtgtgtgtgtgtgtgtttgtgtgtgtacctgtggaggccagaaaaggatgatacaaggtatgcactcttaaaattatatttcccaaaacgcacttgtaattgagggagtgagacaaggcctgtggactgtgattttgaagtaatgaacattcgctttaataaatcagcacttagtttatgttttctcccagtagtgtgcgtagcatctttcagcactttcaaagctatccagtagggatgaaatgtctagtagagtaccagtgaaatttctccttgtttcataattcaagaatatagtgtcttcagcaagtcattttatagagggtaatctatatcaggggcaatagcctgtagtatatgggtctacatattttatattttatagaggggtctatgggaacccattgcttagcatgttcagatgtggtaacccattccttgtagagggttggttgtcgtttttcccagtgtctgatgtctactttgggtatttctccccattacaggccaactgcattttagtgtttcatatatatatacatatatatataatatatgtatatattatacatatatacattcaattttaccatgcttaccataaaaaataaatcagcacttaaatattaaaatggatattgtcttctaaattggtcacattaggaaatatatacattagtcttacgaaattgacattacttaaaagtgttttggaattgtccagtaatattttcttcagatactgcaatatgttgctcagaactctatgagtagaagctatgtcacttggatcctgcctgcttgttcttttataaattaacctctttaaagtagagcacatgtgtgcaaaacctcagatttgttttcttttttttttctttttttctttttttttggtttttcgagacagggtttctctgtatagccctggctgtcttggaactcactttgtagaccaggctggcctcaaactcagaaatccacctgcctctgcctcccaagtgctgggattaaaggcatgcaccaacacgcccagctctcagatttgttttctaaagacaagtttgtttcaatgctttatgaacatattttatcagcattgaaataggacatctagacttttctattgcaatctacctcagcatacatggcttccttgcttccaatttctgatgagaagggttgattagaaagaaattgctatggatcaatatcttctgtgtgtttcctaatctctttatttttaagttaaagaactttctggccaatataccattatatatcaagtatatgtatgggttatgtattttgcatgtttaggcaaaagtccctggatcagaagaattgtttccaaggagcagtgtttgcaagaattcatctgcatacatattctaataacatcttcttaccacttttccagcctctgcctcctgcctaattctataaattagtttgactcagttcagttgtttgttatggcaacactgtactaggtacaaatttctgtttcatttagtctttgttgcataagaaactaccccaaatgtattcatttaaaataaaaaaaaacaaaatataaagagccaattaatatctgagacacaactaatccactagtaaccatttatattgttagacagtcctgtatagctatgagataaaatgtggacatggccaatatagtacatgaaacatagagcaaatatatgataaatatttattatctgcttatgtagcttaaaatgtagctaatttctaattgtaccccattctgcaacaaaataaattattattattattattattattattattattattattattggtgtttcaagacaggttttctctgtatagccctggctgtcctggaactcactttgtagatcagggtggccttgaactcagaaatctgcctacctctgcctcctgagtgctgggattaaaggcatgcaccaccatgcccggtgaattattattattttttatctatatcatgaagcttcatttatattaaaactgttctaatcattaaaataattctcctccaagatcaacacaatcaggtccttttgtcatcctcacatgtcaggatttatagataaagtatttctaagggagaaatgagtagtaccagaagtttgttagagtccacagaccagatatccatatggcacaatgagcttgaaaaggttgagtgatgaaagtaaaatatatctatctggaccttaaaatataagtagaattcagatggactgaaaaaggacttgaatggctaagatcaaaaattcaggtgacagcagatgctggcgtggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatttacacaatggagtactactcagctattaaaaagaatgaatttatgaaattcctagccaaatggatggacctggagggcatcatcctgagtgaggtaacacattcacaaagaaactcacacaatatgtactcactgataagtggatattagccccaaacctaggatacccaagatataagatacaatttgctaaacacatgaaactcaagaagaatgaagactgaagtgtggacactatgcccctccttagaattgggaacaaaacacccatggaaggagttacagagacaaagtttggagctgagatgaaaggatggaccatgtagagactgccatatccagggatccaccccataatcagcatccaaacgctgacaccattgcatacactagcaagattttatcgaaaggacccagatatagctgtctcttgtgagactatgccggggcctagcaaacacagaagtggatgctcacagtcagctaatggatggatcacagggctcccaatggaggagctagagaaagtagccaaggagctaaagggatctgcaaccctattggtggaacaacattatgaactaaccagtaccccggagctcttgactctagctgcatatgtatcaaaagatggcctagtcggccatcactggaaagagaggcccattggacttgcaaactttatatgccccagtacaggggaacgccagggccaaaaagggggagtgggtgggcaggggagtgggggtgggtgggtatgggggacttttggtatagcattggaaatgtaaatgagctaaatacctaataaaaaatgggaaaaaaaaagaaaaaggacttgaattcatcctttatatgctcttaaagggctttgaaagggtgcaatgatgaatatttattactggctctctctgcctaaaaaaagaagagagatttttaagagtggaggtagttgcaaataatcttgaagataggttcattctttaaggctataccctttaactagctcctgtagcagctataggagctgaggatggctatgaggagaatcagtagtttctgccaaagtagatcctcttgcttttggggaaaaaaaaggatactaattactgtggatgctaattgtttctatttgaaaattcttatagtggtttttctgaaacacactaagtgagcattaggttggtaagtaaatcactgccagtaaagaaccttcttccctactagtgtgaaaagactgagttgcataaggaaatgagcttggtaccacctcttctattatgctcttcttgggagctgataattgaaaatattttaagagaaaaggttataattagtgttctggagttgtgacttgcagcttttttttcctttgagattttatgtttattttttcagtgactcacttggaggaatatcagttgccaaaactcaccaagtatattatccacttgtattcttgagttataacacaaatggggtgggtgtgatggcatatacatttaatctaagtacttgaaaggcaggcaggcagatctccacaagattgaggacaaccttgttagtttttggacaaccagatctatacagtgagatactgtctcaaaaatatcaaacaatagcaacaatgtttggatggtattagattatctctatatgtaccgacagtagtagattgcaggtcatttgttgtttcattggccatacaagcccagtaaaagttagcatcttcactctctgtcttcccctcttgctcaccttcacctcgtttttctgctcaaatataacttgagatcttggcctataagctaatgaagtttttgaatcccatggagtttctagccaccacctaaaacaaagtcatagaatatgagtaatttgatgacatctcaattgagacatctgcttgtttagatttaaaaaacacaccttactttgtatatttttcagttaggtatatcctcatagtagattgtcaatattctgaaagataaacaagataaaggaaaaggcatagattctttttttataccatagtgaaaatgttatttgattatttttatttatcatagcttctatttttaaatatttctccttctctgcagtactgattactaaggtatgtatagtggacacttattttcaaaaatgttcaaattttagggtttttattttctaaagtcagggagcatctattagctaacagatgacatgtgtctatgaccattaattctgcaaacaaatggcttctctgtgtgagcttgttcagtaaaataattatttagctataaccactgctaaaaatgtgaatagtaaccaatcaatgaaaactctggctcatttgaaaagtgaatgtccagctggtttcactaaaaactagttttggatttattgctagatattattacaggggtgttccagttctctcatgcctatgttgcagaatatcctataatgtacacgagacgaagtctaaaagtgttgaattaatgaattaaatcagaggtctcaagaactaagtcattagcagctctccttccaaaatgttttatatctatgatatagttatagccaaagtatagaaaggatatgtttttatagtttaaaaatgaccaaggctctttagctgaacaggagaaatcaagcctaccatggaggaattcactagaaacctcagtttcttctccatacaccccatctattaaacagtcattaggattgccatgggaagtgaggtttactgtaagcaaccattccttgttatgtgagagaagagggacttgggaggcagggagaactcctgaaaatcccaaacatagcccattattctggagtacttatttatgtatagatcatgttagccatgtagcctaagctggctttgtcttttgagtccttgcttagtttgggggagtttaatgattaatggtaacttatatttttccaggacaattattttgatggtaactgaacttagtttatattgatgatagataacacaccactgagagagataattatatcctaaggactgagcaggttactagagttttgccacaaaaattcacaaaggaatacaaattgtaggagtatatgtgtttaagcttctttacgtttccattagtttgggggcattgccatattctgtgcatataacaatgaacaactgcatatgtgggatacaattacgtgaggggtagtgtagttcttcacttttgctgtgattcagcacctaaggcaaagccttaaaccccaacagtttaaatactggagcagagtaaaatctttgtctactgcctggtgtcttcaaaggatatcaatgtattgttgatgtgttaataatgtcatagtgccatatggcaaactggctgaagggggttagcaagctcaaatatataaggatctccattaagaacattatgaattattagtcataataattcatagaaatgcatgcctgcaatctcagctttgagagaccaaggcaggaggactgactttggactatatataacaagacactatctaaatcagcagacaatatacaaaaatttatttcatttgaaaagcaaagtcagtgtaaaaatcatcacactttagttattttaaactaaatttccatttaagttaatacattatttcatagaaatttttcctttctaaaatgccacttaaaatgttcataaattgaaatttggatttctagaagcctcagcgttctctgtgttgaagctgattaaaattaccacataggttgtttgcatcaagttcatctatatatataggcttagcatagtttgcatatacataaaaccacatcagcatatcaagattttatgaatttctgcattggaaatatagctggaatgtacaatgccataggttcaatctctgtattgtactccaaaataaaaaaggacatgagttccattttgtattctttgaactaatatttatatttagattcaaggttactctgaactgaaagtagtttttccttttggtctaaggcctaaaaccatgatatcttatttgaggtctgtttagattacttcttccatatacagcatccctctcttctgttctttttcaccacttattggaaaattcacatccccacacacacatatgtgcatactcacagacttacacacagacagaccactgtgctattccctttcaataggaaattgcaatgtcttttacattaactcaagaattactttttctgttcgatgttggatttattcctcactctcataagaacttgatctggtagttatatacagtctttgtcttccaggggactagtatctaatggtgcctttgaaaaataccttgaaaatgtgtaaatagtaggaagagagtaaagagattgctcttttataatctaccttttggggcaacttaactgtagactatgttgaaaacaaaaagattataaatgtatgatctttattagttaatattatcttccctcttgggtaaataagaagagtatcttgtctgtccaagaaggaagaaaattacatttcttatgtttgctggtatatagaactattagaatatatagaacaattgggtatgctgaattctgttatgttttatgctattatctatcaccttttctggatatttgtgcaaggtaggtttttttttttagcacatatagatattgtctatattgagtgctttagtttagatacataggagaaaaatgtgacccttaaggttgattgttagctgctaacccatagtataagtaaataaattaattagaataagatttcaggacatgtaaacatgaagattttatgttcctttttgagtgctgggataatgaaaatgccagggtaaccctgatctcagggagtgacctcttgtacacgtacacgtagcctcacatatttctacatattgtctcatagttgcttgctacacctgaagattgctaaacccagaacaaatcataagttagtttatttgtgagggaagggacaaaatactcctgatctgttctactgtagtttttaggtatcattttcctgtcctcattgaaaattattgactgtcatcttcttccttttcctcttcctcttcccttatccatattgtctttcaccctcaccttcttatcctaaattcaatgtggttgtttgaatgggaatgacccacataatctcatatgtttgaacactttgtccacagttggctgatcagtttgggagggagtaggaggtagaatcttcttggaggaggtgtgtcactgggaacatgcttttaggtttcaatgggtttgtgtcattcccagtgtgttcattgccttctgtttgtggttgtggttgcaaatgtgagctctcagatattcctgttaccatgcttttgtctgccatcatggaccttaactctatggaactgtaagctcaattaaatgcttttttaaaaaaataaattgccttggtcgtagtgttatatcttagcaatacaaaagtgattagtacagaagttggtacaatagagtgggatgtttctgtgatagacattgccatatttgtgtgatgttttgttttgtttgtttgattgttaagaatgtagaagcctttgggactttggactagaaaataattaaataatgcaagcagagattactggactgtcttagtatgggcttagaagactgtagtgctgagagttacacaaactgtggaggcccagctcaagacgttccagagaggaacatgttagcaactagagtagatattgttcttgtgatattttggcaaagaatgtggctgttttatatccttgtcctaataacttacctgaaacaaaatttaaaagtaatggactaattttttttttggtggagcagatttcaagatagcctaatattgactcttatcatgtgattattaataattactcatatgtaggactacagtgaaaaagaacatatggtacagaaggaaatgaaaaaatgaacagtttgaaaaggagcaagccttgtgctgaaagaaataacattaaggagaggtcaaatcttaggcacccttggggcaagacctcacccagctaagcatctgacttgtaaaaggaagatgcctaaggaattaataaagtttctgtaactgtgatagggcaatagggcaaggattcattgcaagcaggcaactgaacttggcagggtcattcacacgattttttgctttacagccataaaggatatgtgagtaaagggtttgtggactcttctgcagtttagtgattgctgcctaggccaagcccatggctgaggaatccatgcatagaatccctctgagagaacattgtgtaaactgtgaaagtgaactctggattgtaatagagaaccaaaagtgtgttagaggtgccacagccttgagacatctgccaaggcaaacatacagggagtgcaaacagacagagagacagggatatatacatgttgctggcaacaaagctggaaaggcagagccatctaagccttctaacacaaacatgaaactacaggattcatactgagtttgccctgctgggttttgggcttgttttatagtccattatttcaacactataccctaattcctcccttttgaattggtaatgtgtgtgtgtgtgtgtgtgtgtgtgtgtgtgtgtgtgtgtattctgaccctttgtatgttggaagtatgttacagataatagattggtttgagtctcagatgagattttgatctttggatttttaaaaattcaaacagtgacagtgtcaagagtgaaagaatatggagacttttgaagttgaactaaatgccttttacattatgatatagccatgaaaatatgggggccagagagtgcattgtggtagtcttggacatttggatagttaaatcctagtgttggtggctattaggaaggattaggaaatgtggtattgctggagtcaatatgtcactgggggaggactttaaggtttccaaagacttgtgtagttttgagttagcttctacctcctgcttgctgtttgagatgtgagctcttagctattcctaccaccatgcttttgcttcaccactctagactttaacccactggaagcataagtctcattaaatcctttcttttataagccagtccttattctagtcaatgagttgcttcaaccttccttacagatccccgaaaacatttaaatcccattgaattaagtcactaatcaggaagagtctatttaatcagtattctataaagaatatatacttgtttgagttgctgctaataaataagcttaataattcagacaggtgggttttatgtttagaagatatgggagtacacaaataaagtagtgatttatactttacatttttaaatcttgagcttcattgtgaaaatatataattttttattttgtgtatcaaaatgaataattttataaaaagcaagtccaaaggtaacaaatgttttcagggtcaccagaaaagatctacaattaaaggcccatttgtagtttgtaaaggcatgatgatttcagaacgacaagtataattgactgggaggaatccttaaggcatttcttatactacaactatagttgcactatctactgtaatcgatttaaatactagcaatactatttgtaaatctctcatctcatatttagtttaaagtagttgtttggtaacagaacatcccttaaagatatatcctttttgcacatgcccttatttctcactaaaaaactcctaatgattcccactaccattaatgaccactagcattaaggaacttcatgatccaactctagtacattttaacatcctctatcattatttcttcagagaaatttctgtcttctaataaactgttccattaacttttgccccatatgtctgcatttctatttctgtcttaactccattcattaaccacacatggaattcaattttactagttacctttggctagcctattcaagtcccatcattttcaaagagttttttttttcaactactatagctcagatgacctctttatttaaaccacagctcacctctattttttgttctttaagaaatattttgcctgagtgtatgtatgtggaacatgtgcatgctcggtgccagaggaagtcagaatagggcatcaggtcctttgaaactggagttacagatgacttcaagccaacatgtaaggtgccaggtattgaacccacctgagtcctatacaagagcaaccagtgctcttcaccactgaaccatctctccggcagtagtttttgttcttatatacattagctactgtacattgttttacgttttgtttaagtagaatatatatacctagacactctacactacaggataagtatcaccacacataatttcaggttataccacagaaccataatgacaaaaccaccatggttatggcacaaaataagcacatagatcaatgggacatactagaaatcattcatatatatcagcacgtgctgttactcttttagccatcttactggttcgagtctcacatagtttgtaactgtttgtgtcaattgcatatttagttgtatgttgttagctaattagtttgtgtcagttacatattcttccttatattcttgtctagttgtttcatgcacaccagaaatagcatccttaagataatcagaagcctttttgggactgagagtatacttctctttttagtcccaccagtaagtgtcatgaaacacttacaaccgaaataagatatttctggatatttgagtctggatccattgtactattgtgggcctctataacactttagattccatggtagtactgtgaatgttgactcaaatccagaacatgatgttatattcctaatagatgttccagaaatgttgttagaatattataattcaagattcaaactataaagtagaaacaaataattacctgaaaattgagatcagactggctaatggattattttttacttttccatttgagtcttccaattaaattttctgacttcagagtttcctatatgaaaaatgagacagtaattaatacattggtaactgttgtgatggttaaataaaattatatgtaaatatcctcacagtaccaatttcttgaaagaataggtaacccattgtctgagaggggatatgctagagcattgacactctttctgacaaatccattgaaaagttatagttctgtgtagtagcagccataactgatgatactcaagttactgtcaagctctgaaatgctctaattataacatccataatctttttcatgtgtattgatatttatgataaaaaagcttttacacttacctcatttgaacctcaaactagaaataaaagtatgaaaatatttatttgttgagcctctaatatattctaaacttcagcatatactctagcagctgtataaacaatgtgtgctcaataagaccaagtgctagcaatgatatatcagagacacagacagatgaaggtccttgccctcatggagcttacattctggtggattgaattctgagtgaagccacctgaattctagtcctgatgtagctactaacttaacagtaagaaaaaaagtgtgctggtggaagtggtggtgtggtgtgtgtggggtgatacccagagggcgctccccttctcagaggagaaggaaaggggagaatctgtctgtatgaggggatactgggagctgatgttaggatgtaaagagaataaataaatttttaaaaagaaataaataaaccaattttgaaaacgaaaccaaaaaaggagagaaaagtgtgtgtgtgtgtgtgtgtgtgtgtgtgtgtgtgtgtctatttgcacatgttcttacctagatgttttcattgggcatatattgttgcaaataaattatagttcaactttactcattctcaaagctcactcagaatatagattttctgtggtctctgtttggtagcacctgctgtgtctcatagaaaatcactttatacaatctgaagagaaaccagatgtacctaaccctcaggagactggaggccccaaggagtttagaggtcaggtggggtggggatgggggcatccacgtggagaaggggtggggtggggaggaggtgtgggatgtggagcagacagagggtggatggggggcggggaatggaatatggagtataaaaaaataaattaaaaagaaaatttaaaagaaaaagaaaatcaatttatatcaaggagagacccaagaaaattatttaccccttttcagcatattagcttactcatctgcttcttactttgatttttgttttgtttaaaccttgaatttaatacagagtaatgtggagtctgagtcgtttgctttctatctgtttaatcaaggctatgccatctaattcttgtaattctttacaggctccctcactgaaaggatgctttctttctaatgttttcttacctcttttcttacactcacatcctccctgggaatattaggcctattagtattattgctctttgactgcaggagaaactaaggcataacgggagaaaatagctaagcctatattctctggaatttaaaatagtgagtgtacattcctcttggtcttggaccttattcactatcccagaattcagtcagttcagttagccatcacattagaaaaagctacatttgttctgaacttggactcagaagacttgttctttgatcctgagtctgtttctttcatgaccttgaacaagcatctaagccccctaggtttctataaaactagataaaaaatagcttttcttaagcttctcatattttcctattctttggaagtctttgcccatcttatcttcttttctccactacttttaatttcagcttttattccttttccttcagagatgtccactctcttgcagtactgactcctattatcttggaccaatctcatatttatttcagtcttacattgtcctatgtaatttcctgcattctccttgaagtaagagaaagtgagcataatataccatcttcagatataccggaagagggcattggcttccattacagatggttgtgagccgccacatgctttctgggcattgaacttaggacctctagaagagcagtgttcttaatcactgagccatctctacagcctgtagggtactataacttaattcattacttgttggaagaatatcaagtactaaatacaaagacaattaaaaatcctaaatagctaacaatgaacttcatttaaattatttttaatgaagaggctatcaagctgtggaaactacttgttaatttggtatggagtgtgtgtgtgtgtgtgtgtgtgtgtgtgtataagtttgggtagtgtttggattggatatcttaattgtgtataccaaatgagttgttgcttgtgattaatagtgagtaaaattgcttctcggatgtgctagttactatttactgaggctgaatagtagaaatactgataaaatgaaactctcctttctaattactcccagggtccaattctgccttctatctaatcttcactaaatcataacagcctgcttttcagcaaattattatttagacaatctgtttgggagaggaaagcatacttgaatcatgcaaatgctctctttgaagctatattttttcttttatgttcagatgggaatatattatatgcaccccacactgttttttctccatgcttggaaatcaaggacaaagagtgcaaaagttatcttaccacatcacccaagaatgtagcatattagagttctatgaggaacaagagaatccagttatcatcccaaagaaagcaaataaaggaggaagctggctgtataaagcagcttgtttattcttcaagttaggagactgtggattagaggaatcctaactagcctatgcctaaaggttcagaggaatggttaagtgacatcattatgcttgaaggaataggtgagtttttctaagaacaaatgaacactctttgaattttttatttttttatggcatttatttttattttaagaatctctattccaggatggtctcaaacatgctacattgctgaagattaccttgaacttctttttttattttttaaaatagtatttatttatttttacttatacaagtacactgtagctgtcttcagacacacaccagaagagtgcatgagattccattacaaatggttgtgagcccatgtggttgctggtaattgaactcaggacctactggaagagcagtcagtgctcttaaccactgagccatctctccagccctacaaatcaacattattaacttctatttattagtcttttcagtctaggctaggtaacaactactgctagctgaggaatatagatgcaagaaaataccttaagctaatagagaatttttgtttatctatgcattgtgctaaaaatatgaattgtagttttaacttagggaaaatggcatactcaatcagtaagacttcaaaatggagacaagcatgagtagagtacttgcttgtgtgtttcttttgggaaagaatgagaaagacctatagaatgcatatgggaaagaagggaaaatgaaaaggaaaatcatatttggagataatattgggaaaatagtaataaaccttatcttggaagaccttcagtgctggactgagttgattgaaactttaccgtgtataaatacacctagagaaagtcttatggtctgaactaaaaggggcccaacaatacaggcttagaatttaaacaaaagtgactttgaatttctttccctaatgcttactgatagaccttaaatatactgctgcttctttcgcatgcctcactttcctcctttcatggataacagtaattgtcttagataattttcagtcttaagtgttataaatgtaaagtgaaatgatgtatataaaactgaatgcctggctactcaataaataaatgttatgaataatccctttgattctagtttgataatgataattggttttgtttgtttgtttgtttgtttttggatttttttgagacagggtttttctatgtagccctggctgtcctggaactcactctgtagaccaggccggcctcgaactcagaaatctgcctgcctctgcctcccaagtgctgggatcaaaggcgtgcgccaccaccacccggcaatggtaattgttaatgaatatgaaatgtagaatggtttgctaaccttcatatattattttattttattttatgctaatctatggagttcattagtactattatactagggaaaacatgcccaggccaagggtttctctagttataaaataatatcagagctaggatagaatccagattatttaaagttcaatttggtattctttttattatacaatactccaaaaactgagtttagactacttttactttgatttgtttctaacaaacttttggtaaatcatattgggtgtttttaaagttaaaactacatacttaggcacggtggctcaaggctgcaattaccagtactcaggaagataaagtaagactattgctgtggatttgaggtcaactttggctagagaccctgtctcaaaataatgaataaataagtaaataaatacactaatgaataagtaaatgtacttgaatggaacaaggttgttacagatatactcccaatccagtattgtatgtaagaagtccctacacctgcatctttccctgtcaaatccttgagatctagtatttattaaaaattaagtgaacaaaatacccattgtccttttaaaaaaaaaaaagatttatttatttatttttgtgagtacactgtcactgtcttcagacacaccagaagtgggcatcaaatcccattacagatggttgtgaaccaccatgtggttgctaggaattgaactcaggacctttggaagaccaatcaatgctcttagcctctgagccatttctccagccttaccccttgttcttgagacaagcttttatacttttctttttaaaaattctgattagaagggaccccccccagtaaataggtacagtccccaagttgagggatggtgccacccacccctctcaaaattgttaacccagaaatgttcctgtccaaaggaaagacagggacaaaaaattgaacagagactgaaggaaaagtcatctagagaatgccccaccaaggaatccatcccatccagacaccaaacctagacactattgctgatgccaagaagtgtttgctgacaggagtctggtatagtgctgtctcctgagaggctgtgccagagcctgacaaatacagtagtagatgctcacagccaaccagttgaagagatgggggaaggaatgaaggagctgaaggcgattgtaaccccataggaagaacaacattatcaagtagccagatcccccagagctcccagggactaaaccaccaaccaaagagtataactgagtgcgtctatggctccaaccacatatgtagtagaagatggctttatgtgacatcagtgggaggggagacccttggtcctgtggaggcttgatgccccagcatagggggatgttagagcagtgaggcacgagtgatgggtgaggtggaagagcacccttacagaggcaaaggggaggagggagaggggatgggatgggtggtttgtggatgggtaaccaggaaaggggggatatcatttgaaatgtaaatgaataaaatgattaataaaaaggaaaagaaggaaataaagagaatattggaggaatacaaatgcccaatggtaaaataaaataaatatgtaaagaaattttaaaaagaagggattgtagtatttaagcaatagaaagctggttcaatttacaacttgcaatcactatcttactctatctagagaagaaaacatattgaaagtttcttcttttaaaaaaaaatactaaattcatatggatttattttcttcctcttgacagatcccagtctattagaattatttttttgtgatcttgcttaagagtcagtgtaagtgtaccagtcatggaatttggttttcagggtcctcctgtttattattttagctatgttatttttttcttcaatgtaatttacaaatactactctattaaatatcacacaagatacaagcataactgacaccagaattccatgggtttggtgactggtgtgaatagtggtactcttgatgctgtgacagaaggaagcttgagggagagaaggtttacctttgctccaagttttaagggaagagtgcatcatggtatgggatgtgtggcttcaggagcttgaaacaactggtcacgttgtgtctacactaagaaagtacagaaggatgaacaatagtactccctacttgcttgctttttcctccgcccagggtgccaacccatggaatgttgtacaacctacattcagggtgggtcttcccatctcagttaaacttctctagaaactctcacagacgggcctcattcagaggtgactatcccattaagacaacaatcaaaattaatcgtcattgtgtgtgtttagagggggtgctgcaaaagtaatgttttatagttcaataggaaaaaccctggttttagcatagaaaatctgggttcatgcttaagcatgtcacataactcagtttcctccctctgttaagagaggccactaaactcagctagtttcatctctgtatttgtggaaccaagtttctctacaattcttagttggatgcattgaacttttaaggtgaaatttgcaaggtgaccgattgtacaatttttccattatcttaaattttttcattgtaaagtttttcttgttgtttgttttgtttgtttgttttttgtcactttggttaaataaccctacaggttttatttgaaagtattgtgaaagtgttttccttttcttgatttctttctgggcgaattctattagtatatagaaaggcacctgactttttttttctttcctactaaggagagatgtcagattagtatgcaaaataatgggtttcgccatgggctattggtttttatatactgactttggaccctgctgttaaaataaacccttcaagatttatggtggagtcatcagggttatttaaatatagaattgtgtcatctgcaaataggagtactttgatttcttcctttcctatttggatccattttatttcttattgctgaagctaagacttttgagcattatgtcagataagaacagtggcaatttacattttagcctcaattctgattttagagcaaatgctttcatgctttctccactttgtaaaatgttggctgcaggtagccttttatgccaatatatgttttatctattcctagtttcttcaggacttttatcagtaagggattttgaactttgccaagggccttttctgcatctataagatgattctttaattttgtccttaatatttatgtattatattacatctattgatttgcatatttcaaatcaatcttgaatccctgtgagaaaaccaacttcttcatggtgtatggtcttaatatgtttttgaattcaatttgcaccatttttattgcaaatttttgcgtttatgtttgccaagtaaattggtacatagttttccttaagttataaaattctctagaattgaaagatcagggaggggccatatctggcactcttgctggtagtaatgcggtcaagcagaattagtttgatagtgtgttctttacccttctgttttgtggcaatctttgaggaatattactctgttaaagatttggtagaattcagtaataaaggtgtctaaccctagacttttcattggggggtggggggtgtactttaattaatactttaatttgcttgttagaatatttgtatattacttactaaattctaccaggtggtatatgtgtaggactttgatcatttcttctatattttccgggtgttttgaaacataaattttgaaagtatttcccaagaagtcctctgaatgccatcaaaaaatgttgaaacatccctcctttaacctctaattttattaatttgaatttttctgttttccttttagttagtttgcctctatgctcttcctaacttccttacctttccaaacaattatattttaatttgattgcttttgtgaatggttctttttgatatttttactaatttattctctcatctcctacatcctgtccacagttttaccccctcctgtcctctcagtctctgtcacctcctccctccccatctgttcctccttctcccatttcccttctgaaaagagaaggtcctccagggatatcaaacaaacatggcatatcaggatgcaagaagattatgtacctcccctcatattaaagctgggtgaagcaacccagcaggaagacagggatctccaaactatacagttttcaaagcctatttcagtagtttctttgatgacttgtgaaatttcttgccattgtttttttggtttcttcatttttttctaagaccttgggggaacatcattaggtaatttatatgtagtctttctgattttctatgtgcccatagctgccaactttttcttagagctgccttatcatctggttatatatcttagtttataaagttattacctaatgtggtggtttaaataaaaatggtccacaaaggctcatatatttgagtgtttggttcccaatgggtatgatggaaagtttaggaagaattagaaagtatgtccttgttggaggaggtgtgtcactggggggggggggctttaaggtttcaaaacctcaccccaggcccaatcttgctctttttctgcctactacctgtggatgaagatgtaagctcctggctaatgatgtaccaccgtggctgtctgcctgttgccacgctccatgccatgatgaactaaccctctgaaactttaagcaagccattaattaaatggatttttttaaaaaataaaagttgtcgggggctggagaaatggctcagcagttaagagcactgactgctcttctagaggtcctgagttcaaatcccagcaactacatggtggcttacaaccatccgtaatgagatctgacaacctcttctggggtgtctgaagacagctacagtgtacttacatacaataaataaataaatctttaaaaaaatacataaaagttgtcttggttatggtgctttgtcacagcattaaaactctaagacagcaccgggtcaccttggatgcggattcagtggatactcccaaggtcctgagaggactctccatgtgatcttaggaccaccggtgagtgtaacacaacttctgttccattccaatcacgcaggacctgagacagcattagggaagcagaaaacccggcctgaccaggatcacaagacccttccagtctgcgccagcaccaggtcacctggacacagagtcggaggacaacctcaaggtccctagaggacagcttctgaggcagacccctttttgggctccagacattcggacaccttccctgccagaggagaagtgtccagcccgcccgggagggctttgctggagcacctggtggagccatcttggttcccagatcccgctgagagtagtggactacagaagcagacagcttcggggacaggccttgtccaccccacccagtactgggcaccccagcacacccaaaaagctagacccggatttaaaagcatatctcatgatgatggtagaggacaccaagaaggactttaataactcacttaatgaaatagaggaaaacactgctaaagagttacaagtccttaaagaaaaacaggaaaacacaaccaaacaggtaaagtccttaaataaaaacagaaaaacacatccaaacaggtgatggaaatgaacaaaaccatactagacctaaaaaaagaagtagacacaataaagaaaacccaaagtgaggcaacactggagatagaaaccctaggaaagaaatctggaaccatagatgcgagcatcagcaaaagagtacaagagatggaacagagaatctcgggtgcagaagattccatagagaacatcggcacaacaatcaaagaaaatgtgaaatgcaaaaagatcctactaaaaacatccaggaaatccaagacacaaagagaagaccaaacctacagataataggagtagatgagaatgaagattttcaacttaaagggccagcaaatatcttcaacaaaataatagaagaaaacttcccaaacctaaagaaagagatacccatgaacatacaagaagcctacagaactccaaatagactggaccagaaaagaaattcctcccaacacataatcagaacaacaaatgcactaaatagagatagaatattaaaagcagtaagggaaaaaggtcaagtaacatataaaggcaggcctatcagaattacaccagacttttcaccagagactatgaaagccaaaagaacctggacagatgttgtacagacattaagagaacacaaatgcgagcccaggctactatacccagccaaactttcaattaccatagatggagaaaccaaagtattccacgacaaaaaccaaattcacacattatcgttccacgaatccagcccttcagaggataataacagaaaaaaacacacacacacacaaaaaacaaaaaacagtacaaggatggaaaacacaccctagaaaaagcaagaaagtaatccttcaacaaacctaaaagaagacaaccacaaggacagaatgccaactctaacaacaaaaataataagaagcaacaattactttaccttaatatctcttaatatcaatggactcaattccccaataaaaagacatagactaacagaatggctacacaaacaggacccaacattttgctgcttacaggaaacccatctcatggaaaaagatagacactacctcagagtgaaaggctggaaaacatttttccaagaaaatgatctgaagaaacaagctggagtagccattctaatatagagtaaaatcgtcttccaacccaaagttatcaaaaaagacaaggagggacacttcatactgatcaaaggtaaaatcctccaagaggaactctcaattctgaatatctatgctccaaatgcaagggcagccacattcattaaagaaactttagtaaagctcaaagcacacattgcacctcacacagtaatagtgggagacttcaacacaccactatcatcaatggatagatcgtgtaaacagaaactaaaccaggacacagtgaaactaacagagttatgaaacaaatggatttaacatatatctacagaacattttatcctaaaacaaaaggatataccttcttctcagcacctcatggtaccttctgcaaaactaaccatataattggtcacaaaacaggtctcaaacagatacaaaaatattgaaattgtcccatacatcctatcagatcaccatggactaaggctgatcttcaataataacataaataatagaaagccaacattcatgtggaaactgaacaacactttcctcttggtcaaggaaggaataaagaaagaaattaaagacttttttgatttaaatgaaaatgaagccacaacatacccaaacttatgggacacaatgaaagcatttctaagaggaaaattcatacctctgagtgcctccaaaaaagaaactagagagagcacgcactagcagcttgacaacacacctaaaagctctagaacaaaaggaagcaaattcacccaagaggagtagatggcagggtgaaatcaaccaagtagaaacaagaactattcaaagaatcagccaaaggaggagctggttctttgagaaaatcaacaagatagataaaaccttagccagactcactagagggcacagggacagcatcctaattaacagaatcagaaatgaaaagggagacataacaacagatcctgaagaaatccaaaacaccatcagatccttctacaaaaggctatactcaacaaaactggaaaacctggatgaaatggacaaatttctagacagataccaggtaccaaagttaaatcaggatcaggttaatgatctaaacagtcctatatcccctaaagaaatagaagcagtcattaatagtctcccaacctaaaaaagcccaggaccagatgggtttagtccagagttctatcagatcttcaaagaagatctaattccagttcttcacaaactattccacaaaatagaagcaaaaggtactctacccaattcattctatgaagccacatttactctgatacctaaaccacggaaagacccaacaaagatagagaacttcagaccagtttcccttatgaatattgatgcaaaaatccttaataaaattcttgctaaccgaatccaagaacacatcaaaacaatcatccatcctgaccaagtaggtttgattccagggatgcagggttggtttaatatacggaaatccatcaacataatccactatataaacaaactcaaggacaaaaaccacatgatcatctccttagatgctgagaaagcatttgacaaaatccaacatccattcatgataaaagtcttggaaagatcaggaattcaaggcacatacctaaacatgataaaagcaatctacagcaaaccagtagccaacatcaaagtaaatggtgagaagctggaagcaatcccactaaaatcagggactagacaaggctgcccactttctccctacctattcaacatagtacttggagtcctagcaggagcaatttgacaacaaaaggagatcaagggaatacaaattggaaagggagaagtcaaaatatcactttttgcagatgatatgataatatatataagtgaagtagctagatataaaattaactcaaacaagtcaatggcctttctacacaaaggataaataagctgagagagaaattagggaaccaacacccttctcaataatcacaaataatataaaataccttggtgtgactctaactaaggttgtgaaaaatctgtatgataaaaacttcaagtctctgaagaaagaaattaaagaagatctcagaagatgtaaagatctgccatgctcaaggattggcaggatcaatgtagtaaaaatggctatcttgccaaaagcaatctacagattcaatgcaatccccatcaaaattccatctcaattcttcaacaaattagaaagggcaatctgcaaattcaactggaataacaaaaaacctaggatagcaaaaactcttctcaagcataatagaacctctggtggaatcaccatgcctgacctaaagccgtactacagagcaattgtgataaaaactgcatggtactggtacagggacagacaagtagaccaatggaatagaattgaagacccagaaatgaacccacacatctatggtcacttgatctttgacaaggaagctaaaacaatccagtggaaaaaagacagtattttcaacaaatggtgctggcacaactagcaattttcatgtagaagactgtgaattgatccattcctatctccttgtactaaggtcaaatctaagtggatcaaggaactccacataaaaccagagacagtgaaacttatagaggagaaagtggggaaaagcctcaaagatatggatgggcacagaggaaaattcctgaatagaacagcaatggcttgtactgtaatgtaagattgacaaatgggacctcataaaattgcaaagcttctgtaaggcaaaagacaccgacaataagacaaaaggccaccaacagattgagaaaggatctttacctatcttaaatcagataagggactaatatccaatatatataaagaactcaagaaggtggactccagaaaatcaaataaccgcattaaaaatggggctctgaactaaacaaagaattcacagctgaggaataccgaatggctgagaagcacctgaaaaaatgttcagcaccttaatcagcagggaaatgcaaatcaaaacagccctaagattccatctcacaccagtcagaatggctaagatcaaaaattcaggtgacagcagatgctggtgaggatgtggagaaagaggaacactcctccattgttggtgggattccaagcttgtacaactactatagaaatcagtctggcagttcctccgaaaattggacatagtactactggaggatcccccaagacctctcctgggcatatatccagaagatgttccaaacggtaagaaggacacatgctccactatattcataacagccttatttataatagccagaagctggaaagaacccagatgtccctcaacagaggaatgaatacagaaaatgtgatacatttacacaatggagtgactactcagctattaaaaagaatgaatttatgaaattcctaggcaaaaggatggacctggagggcatcatcctgagtgaggtaacccaatcacaaaagaactcacatgatctgtactcactgataagtggatatcagcccagaaacttagaatacccaagatacaagatacaatttgcaaaacacgtgaaaatcaagaagaatgaagaccaaagtgtgaacactttgcaccttcttagaattggtaacaaaacacccatggaaggagttacagagacacagtttggagctgagacgaaaggatggaccatctagagactgccatatctggggatccatcccataatcagcctccaaacgctgacaccattgcatacactagcaagattttgctgaaaggaccctgatatagctgtctcttgtgagactatgccggggcctagcaaacacagaagtgaatactcacagtcagctattggatggatcacagggcccccaatggaggagctagagaaagtacccaaggagctaaagggatctgcaaccctataggtggaacaacaatatgaactaaccagtacctgccggagctcgtgtttctagctgcatatgtatcagaagatggcctagtttgtcatcattggaaatagaggcccattggtcttgcaaactttatctgcctcagtacaggggaatgccagtgccaagaagtgtgagtgggtggccaggggcgtggggggagggtatgggggacttttgggatagcattgttaatgtaaatgaagaaaatacctaaaaaattttttttgttaatttttaaaaattaaaaaaatactctaagacagaagttggtactagggagtcaggtattgctgtgacagggctcaccatgctgtcctttggagaaatatgaaagagtttgagactttggactaaaagcagtttgatgctttaagtagggcttaatgggtcatctagtgggatggtcatggtgaaagcaatgtagactattgaggcccagctcaagaggttacagagaagaatattagagatgattcttgtgatactttggcaatgaatgtggtttttttctgcccttagccaaaactctgccagactcaactgaagagttttgtaccagtattgttagcagaggagatttcaagacaatgtagcattgactgtcacatggttattattgatctctcttatgcagaactacaaggaaaaagagcaaagaaggaaaaaagaaatatgaaatgtgtactttgaggagaaaaagaacaccagagaatatgataagctcaaagagatatgaagtttttaaaaaggcctgatgctaattgtaataaagggatgccaccctcagggtaagaccccaccagctaattgtataatctgtgaaagagaaatgtccaagggatttccttggtctaaacaacagcaatccaaagtttatgcaaatgtaattcaaaaagggggctgagttccagctgcagcaggtagcagaatttggctacatggttctggatttagagccaagaaggaaacaggaaatgggttgtggagtcttcctccatggtaaaggaacgccacaaagaccagacatgtgacagggtagtcccttcctgaaggccattgcatgaagctgtgaaggtgaaacctggattgtgttggaaacctcaagatgtgggaaagagcagaagcatgccagtgagagctgcataaaggatgtggaaccagctcaagagaaaggagtgtgctacagttaacaaagctggaaggagcaaaagataggaagagccatctaagtcaggatgtagagttaggcctgctgggtttccgaatagctttcatccagtatttcctttctttccatttagaatgtatattctgtgccattgtatgttggaagtatgaaactagctttttgatgttacagggtgttactgttaagagattcccttgagtcacagaagagactttgaactttgcattttgaaacatacctgatactgaaagactatggggacttttgaagtttgattgaatgcattttgaattatgatatggccataagcctatggggagctaggaaatgaaatgtggtgttttgaataagaatgagccccatagtcctccctcttctcagagaagaaagggagagggacatgaagagaggggctatgtgaggggggacctggaggagggggttacaattagcatgtaaaatgagtaaataaattaattagtgaaaaagggctcatatatttggaagtttgtgtcccagttgatagatggtttagaaacaattaggaagggtggccttcttggaggaggtatgtattagtcagggaatcctagaggaacagaatttatatataggcttgtagttactgctccagcaccatgcctacttgccaccaaattccccaccataagatcatggactaaccctctaaatatgtaagcaagcccccaattaaatgctttcttttataagttgtcttgctcatagtgttttgtcacagcaatagaacagtaactaaggtacgtactatgcacagagtcctgagttcaatccctagtaccgcatatatttagcacagttgttggttgcctgtaatcttgggaggtggaaacaggaggatctgacctgcaagggcatcctaagctacacagctaaagacttgtctgggatacatgagaccctgtcttaaagaaagaaaaactgcggggctaatatccaatatatataaagaactcaagaagttggtctccagaaaaccaaataaccctattaaaaatggggtacagagctaaacaattctcaactgagaatactgaatggctgagaaatacctaaaaaaaaaagttcagcatccttaatcatcagggaaatgcaaatcaaaacaattctgagattccacctcacaccaatcagaatggctaaggtcaaaaactcaggtgacagcagatgctggcgaggatgtggagaaagaacaacactcactcctccattgcctcaggctcagtacaatcaaactccagaattcttttcaattgataagatctgttcctggctaccaaagggaggggtgcttttgcccatgcatttaactatctaagccagattcctgccacttaatgctttctggcttttcagtatctgtcccttttctcttttccaggctgtctcttaccttcagactttggcagattgcattcaggctccctaaatgataggtgttcccaattctcagacccctagcatagtaaagtttcaagcagtaggttcttctttaagatggtgcttgaccctgaattctgagtcataccaagtattaaaatgtaatctctccctaatactcacccaccagacaaaggaatccttgtaacaaaacctgcatattggttttgactcatgtacgggttgtgggattgtcctgggagtagaaccaccagtctctgctctatgccagggtcttctggctctccttttggagagggctcttatctacctcccagtcactcctttttttttcaattaggtatttatttcatttacatttccaatgctatcccaaaagtcccccacctgctcccccacccacccactcccacttcttggccctggcattcccctgtactgaggcagataaagtttgcaagaccaatgggcctctctttccactgatggccgactaggccatcttctgatacatatgcagctagagacacgagctctgggaggggggggggtactggttagttcatgatgttgttccatctatagggttgcagctctctttagctccttgggtactttctctagctcctccattggggaccctgtgatccatccaatagctgactgtgagcattcacttctgtgtttgctaggccctggcatagcctcacaagagacagctatatctgggtcctttcagcaaaatcttgctagtgtatgcaatggtgtcagtgtttggaggctgattatgggatggatccccagatatggcagtctctagatggtccatcctttcgtctcagctccaaactgtgtctctgtaactccttccatgggtgttttgttaccaattctaagaaggtgcaaagtgtccacactttggtctttgttcttcttgagtttcatgtgtttagtaaattgtatcttatatttcccagtcactcctgacagggaaccacacacctaacgcttgggtttggcttcttttttatatctcatctgtctttcttataacatattttcaggtatcctatcactgcctttgtgaatttcataagtcattttctgtctttgaaatagagtctacttttttcttatcctttattttttgagagggaataatatttttttgtttcaaaattagctgacaaacaggaatgatttcctatggcatttgcatacatacttcatttttgttgagtccctcctcatttcttccccaacatcttcctccttctgtttcctctgtaccctagtcagccatcattgggaagagaggcccattggtcttgcaaactttatatgccccagtacaggggaatgccagggccaagaagtgggagtgggtgggtaggggaacagggtgaggggagggtatagggaactttcaggatagcatttgaaatgtaaataaagaaaatatctaattaaaaaattggaaaaaaaacatacacatactgtaaaagaaaaaaaatccagtggtaaccgtggtcctattgttgtcctagttctctgtcctgatttctacagtggctgtacacttttaccaacagtggataaaaatttccctttcttcacatctttgtcaccatttataatcagttggtctttgatggtggccatactgactgaagtgagtgagtagagcctcagtgtaattttaatttgtgtttctctggtgactagaaaagctaagcactcttttgaatatttgtatttcttcttttgagaactgtctgttcagttcattgatctatttatgtattgtcatttttttgtttgtgcagggtcttgatttttacaattgtttatttattctggatattcaccccttgtatgaagcgtgactggcaaagatgttttccccattctgtaggcctcctgtcccctctgttgatcgtttcttttagtatgcagaagaagcttttacagttcatgcaatcctatatttcaattttaggggctatgtcctgtgttgttatggttgtattcagaaatgtgttgcctgtacctgtatcctctgactgttcctcattccatactccctcccccatctccacgagtgtgtctccaccccacatgacaccccacaccccaccagacctcctcacactccctggggccttcagtctcttgagggtcaggtgcatcttctctgactgagtgcagaccaagcagtcctctgatgtatatgtgttgtggggcctcatatcagctggtgtatgctgcctggttggtggcccagtgtttgggaaatctcagggatccaggttagttgagactgcaggttctcctacagagtcaccctcctcctcagcttcttccagcttttccctaattcaaccacatgggtcatcagcttctgtccattggttgggtgtaaatatctgcatctgactctttcagctacttgttgggtctttcagagggcagtcataataggcccctgtttgtaagcacaccatagcctcagtaatagtgacaggtcttggggcctccccttgagttggatcccaatttggatctgttgttggacctccttgccctcaggctcttctccatttttgtccctgcagttctttcagacaggaacaattatgggttagagttttgactgtgggatggcaacccccttcctcatttgatgctctgtcttcctgctggaggtggactctgttccctccccccactgtagggcatttcatctaaggtccctccctttgagttctgagagtctctcacctcccaggtctctggtacgttctggaggatccccccaccttctacctcctgaggttgcctgtttccattctttctgctgttttttcaacctatttttgagattataatataattacaacatttctcccttcctttcctcccttcaaacccttacatatgaccctaccttctctccttaaaattcatgacctccttttcattaattgttattcatgcatacacacacacacacacacacacacacacacacacacacacatatacactaaatatagcctttcagtccatataatgttacctgtatgtttgatagaacattttgctaggtttgtttttaattacttactatcaaggcttgaaatctatctttccatgttttcctggcttttagggatgctggaaacaaatgtgatactctaatgtttctgcttctaaatgttagttggcctcttttctttatagttcgctccttgtgtttggatgtacatttctgtctctatgattgggaaattctcagctatattttcactgaatagattgtctaagccatttgactttgttttagatctgtcttctattctgtgaattcttgggttttgtcccttgaatgtatcccagacttctataaagtttcagtcatgcttgttgacttatttttatttctatatgtcaatgtgtattactgtcccatctttctcttccatctttgatagtcattcttctgatgtgtcttatctgtttgatgatacattatgttgtgtttatcatttgataaattgattctttcatttccaaaatttctgtttggtgtttttcagtgtctttatatccttgctgaatttttcctcgattttaatttcattaatttttattgtgtgtgtgtgtgtgtgtgtgtgtagaacaaaagttgtagttgtcttcctctatcactctccaccttattttttgagacattgaacttctcaccaaacctagtttgctattctgttagaccagctagccagtaaacccagggcatacgagattcacccaaatggtagaagagtctcaattctcccaagttgccctttgacttccccacgtatgtgtgtgtgtgtgtgtgtgtgtgtgtgtgtgtgtgtgcgcgcgcgcgcgcgtgtgtgtcccaaataaatacaagaaaatttcaagactaaaaagaatttgaaacaatgtataagcataaatgaacagtaactagaaatatgctcagtcactgcttcatcctggttcaggaagagcctgtcctctgtgtttatattaggtccacctatcaggacacagcattggtacagtcacaaccttggtctattggtttggctccttttggctatggcataagtggggaatgttggtgatctcttggcccagactcccttaccatccttctgctagttccacagactatgtgctttgggacctgtagcatatacctagatgcaggagtacattccccattttgcctacgtacttccctttcactggatttgtgtggtttgctgagttgttcatctttgccaggtggtcaattcctttgaagctcttatccccagtagcagtcctgtcatattctgcaatgccatgggttcattgtttgttcctctaggttaaggtgtgtgtcctctgcactatatggagttctggggccattacagcattttctttagggtcacacatagaactaggctcttggataccaagccagtggcattttctctgcttggccagaaggattagtgcagctttgtaggttgtttgtgttgtctctctttgtttaggtattctttcacttattaaaaatgtaatatttatattaatgttttgataatttcatacaatttattttgatcatatttactttggaccctactcctccccttaactcccagatcaatccctacctcccatctttctttaattattactattataagtatatacatataaatacataaatacaactggttcattcagtgtcacttgtgaatatgtttcttattttaattttaatgaaatataattacattatttgccacctctgtcttcttcctcatactcccacctctcctttatagcctcttccgaattcccaaggcctcttatatatatgtatatgcttttagtgaagctctcctcagtcattttggagtattctctgttattccttttgcaactctacttaacagctatcattgctctgaagactctagtctaccatcttacctgaaattacatttttcttattctggatgttcttttctccaggtaacacctaggtagcatctagtctaccatcttacctaaaaattcttttttagtgttttgagatttgagtattgagtgtaactctgtagctgaggctagccttcaaattcactatctaactcaaactggcctcaaactgatatgataattcttttccttaggatttggaagtcctgggatcacaagcaggcaccacaaaatcctagcccacttcttctatttaatgcaatatttggatgagtatttgtgttacttcttttttttttttataagactgatagtattcagcagagtatccatctggttctgggcttctgtttgctcagttctccatacgtattacttatatagatctgtttaagttgtttatatcctcttggtataattttggaaggccatatgtttctagaaatgtattcatttctttcagattttccaatgtattggaatacaagtttcccttgtactctataacaatcccctggatttcattgatatcccttataatgttctcattttctttcttaatttggggcttcctccttctccctcctccttcctaccttccccatctccctctttttctccctctcccttcattcttttggttgttatttaactggttaaaagtttataactcttgtttgtccttttaagaattctttacttcattgactttatttttcatttactttacatttctataatgatcttcatttcttgcttcctaccaagtttggtttagcttgttcttatttttctgaccttgaggtatatcataaaattatgaattctctttgaatttttagagtaggcactcatacttacaaacttccctatagcaactgcctttgcagtatcacaaatgtcctgataaagtatagttttattttaatttgattctatgaatattaaaatttcctccctcattttttccataaaaccaattgatcaaatgggcaaaggataaaagtggaaagtggtggatgtaaattaagagagagaataaaaaaattgactattagaagatgaaggagaaaaataaaaacacaaaataataaaagaaaattattacaaatacaaaaataaatgtatatatatgtgtatatacatacacatgcacgtatgtaggtattatatgccattcagcaatactagggggaaagggcacagtagcacactattataaaaccagaactgtaaaggtagagctaagaggatcaccagtttgaggaccagtgtggcctacaacgtgatttctaagccaacttgagctaccttgttaaaatgttccaaaaaatgttttagaaattaaaatgttatgtcctctgggtagtcatgtgaacaatagtggctgttcattatgtctaccagttggcacttatatgtccatatgtctagaacaataagcttattggagaaagcaaatgcaggtgatggtcacctttccttttctgttgtcagccaatctgacaatgtgagtgttttagtactgcatatattgttttagtagtggaatacctttgttccatgcttgctagtatgaggtggtataaaccaaagttccctcagtcagaatttcctccaaatatattagttgaacatactttccacacccccagccagagcctgcctgaccctgagatccacatagataatggggcaacaaactatacaaggtagagtcatagagcaaatctcatgtttttcttactcacaactgtagtttcccgagtaccagtctacatatgtgctttctcagccactgagcatttttatctgaccactgcactgcttatctaaaaggggaacatctcccacctgaatgtactacatgtatttttcaatgagctttccttagcagcattcggctgggcctacactggatgctgcaagggacagagtagaaaaattcaccacgagttttatagggaaggaaactgtagggagatatttctcaaagcaagcagcttgaacatgaccttttaaagatgtgaaatgtggaacacttcccaagcaccagcatgctatgtagctcccagcagctaagttcagactttctgctctgcatctgtctctgtgcaagttatgcccactaaatctttctccttttctgatagtacctctgacatgctgccaagccactacaggctcagtcaggatgcaaccttttcaccctctgctccaatagccagaggctctgcatttccccaactgtgtgtctgtctaatagcttcagtgcatcccctccctcactttctgaagaagctattttctgactgttctgatttctagctgggaaaagtctaaatattctgtttgcttctaacacaaaagtttggcataaatatatttccatattattgtataaacatcagtgattagcaacaaaaacatgtattttaaaggaggtataagcaactcaaatgttcattgttgtgtgatagataaatagaacatagtgtatatctgtaatgaactagtatgcagcttcaaaaaggggatctagtcacatgctacaaggttgatggacattgaagatattgggataagtgaaataacccaactatataacacagtaagtgttgtatgatggtggaaaggaagacaataaaggaaggggtaaaaatgttcatgatacctctgaatggtgggctagaaggggggttgaaacatttatgaaccctaaataaagtaggtgttgaaaaatataggcctacatacatgtgtatgaaaatgccataacggagccattattttatgtgtaaaccttaaaattggcgataataaaaatatttagttgcagtgcaattgtattaaaaagtatataccgtaggaaatgattcatctgtgagctgtacctttatagatgaaattactgctcttgaaaatcaagctacaactgagctagaaacttcctttatgctagataactttcatagtgccagaagaactatgtagactgctagaggagcctagcctgctaggcctgcatgctataccacagacctacaagacaagatgtgcccactgtggcaatagtggcataactgttgagtatatccagccacattctcatttgatttgaggaggaaattcatgcctattactgtaaacctggtaacaagtctgtagctgtggaggccataagccctagaaggtaaatgtttatttttattttgctaaatggacatgttatatccatcaagttatcatctaaagacttacggttgtgctcatacatgagtgctgttgtctgttttgataggggaagcttccttttgtagtgggcagcgttactgcagagattcaaaagtactcaaggtgctgagaataagtgacttatggactgcccagccctaaaggaagcatcgctatcatctgccccaaggcttgaggaacttttcagaaaagggagcagaaggaattgtagcagctagaagaaaaggaagagtgttgtcgactgctctctcctgcctatgacatggttgtagcactattgaagtataaactgcacaagattgggcctatcaaatttcatcatgggtggggaaggggatcacaaaggcccactcctcctagagaatttattggctatgacagttgctatcaggaagaggcttcaccccttcctgcagcactattggtagtttgattgctgaaggatggaaagacatttttttcatagatgataacttgctcctctaaattaccctcatccaagcaaccctatttaaagtgatggggacacccaaaaccaagaaagagagttggtacttgctaggaagatatatatatatatatatatatatatatatatatatatatatatagagagagagagagagagagagactttacatatatttgtttttaaggcagggtttctctgtatccctagatgtcctggaactcattgtacaccaggctgaggtcacagagatcacctgcctctgcctcctgagtgctgggattaaatgcatgtgccaccatcagctgtgtttctgctcagatgaagaggtaccccacctctctgaggtgggacagtgtcccagtggaagggcatcctgagacatggaagctcaggaaccgcacagctttgagaggaagcctcctgagcagaggcattgcagcgcccaggagagggtaccaccagcttaagctgaggagctcaggaccctcaccagagagtcacaacaggcaaaataatcttatgaaagagattgaagggtctagggtataaagggacgaatccaaggatggatgccctctgcttcctagagcagacagaagagaattggacaaagggacacttgcttatacaggatttctgagggggcggagcttctcagggcagagatttccagattgaagattggtgggatttcaagttctgagcttgggcaactcagggattggaggattttcctgttcagagattgtggcttttttttcactcccttctacctgcatcaggctcatgggttaaggtgggaagtacttgtctactgcaatcagcttttgctgaggtatcatctgtgtgtggctgctccagggagactggagaggaggtgctgccactgtggatagctcctgtgagacagcgcctacagtttcaccaagaaggtattgtcaccgtggacagctcttcatgctgcagtaggctgaggcaggaaaggtgttgccactgtgttcctggggagcaccctgcttaggcaggaaaggcagtgcatcactacaggcagctcctgtgactgctgcaggctgaggagatgtcctggtgccaccattttaacagctcccgctggggcatctcaccacagccttgggctgagtgggaagtggggggccagtcatcactttgactgcttctgcagcatggcgggccacttaaggattacatcacccagcaacaaaatatagaatgacataatgaaacccattattgtatataattaatatattttaataaaaacaaattattagaatgcctttaaacagtgagttcattctttaatcccttttgttttatcatgtcagaaacagaacaagctatcatctattgaacagaagttagccttcaccacacaataagtctacttttgtaccttgattgttttatcccccaggtctataagaaacaaattgttactcacaaattacccaaggtattttaaggcagcataaaagcattatacaaatattagaagagcaaactccaaaaacaatgacaggaccaaattatgatgaagatatcaaataataggaatttttgtttgttgctggagatacaaaattggtacagccattttggaagaaagttttttcataaaatcgagtgtacccacattaaatggtctagttatcatgctatatgtacttatccaaatgagtttttgaaagcttagacctacacaataattcacatcttattcagttcattaagatgtccttcatgggtcagtgagtaaacaaacaaatgtgttggatacacacaatagactattcagcctttaaaagaaataagctttcaagccaaaatgacacaaagaaatcttaaatacatattactgaataaaataatttagtctgaaaagtctttatactgtataattccaactaatacaatatgcttgaaaactaaaactgtggtgacaataaaaattttcataattgcaggatttggggggaaggaataaatactgcacagggaaattttaggacagcgaagtcatacgaaagtgggtccatggcatatgtcaaagctgttagattgagtgaacattaaactgtagaacttaggggtatgtgtacttcagaggatggccttacgaattgaacttagagtaggtttttttttagcattatatgaaattgggaggggatgggctggtggatctggaaggctttaggggaacaagtgggaatgaatatgatcaaaatacattgtgtagatatatgaaattcttaaagaattacaaatggtttatttatttatttatttatttacactccagattttattccccctcccagaatatgatcaaaatacattgtgtagatatatgaaattcttaaagaattacaaatggttttatttatttacttacttacactccagattttattccccctcctggtccaccctctgacttctccacatcccatacctcctccccaccacaccccgtctccacgtggatgtccccacccactaccccaccagacctctaaactccctaggacctccagtctcttgagggttaggtgcatcatctctgactagacccagacctctgctttatatgtgttgggggcctcatatcagctggtgtatgctgcctggttgttggctaagtgtctgagagatctcaggggtccaggttaattgagactgctggtcctcctacaaggttgccacaaaaatccctgacatagtagtgcatgcctttaatcccagcacttgagaggcagacatgggcagatctctatgagtcccaggacagtcagggctacatagggaaattctgtcttaaaaaatgaataactaaataagtaaaaggaggaatttagagatctagagagatggctcagagattaagaagagaaaacttgctgttgttgcaaagagctgaagttgggttcccagcactcacatgaggcaactcacgacatgtaacacgtttcttcactatcccttagtttattatcttttttgtttctttttatgtttcctttttttcatttatgtacactgtatgcatgtatatctgcatgcagcttacatgtgtgagtgggggtacaggtccacatgtgtacacatgtatgtggaggtccaagctcaatttgatattcaatgttctttcaccacaactcaagtcaaggtctctgaatcaaatccaaagctaaaagatatggctaccctcactagccagcttgctctagggattatgaccacacccactaagtatttccatgaattctaagaatctgaaatctggtcccagcgtagccatctctccaccccacctttgaaattattattgttgttatttggcaagttcatatataaacataatgtattttggtaatttttacctcattttgtactgttttttttttctattttattttcctttttctgaccagttttcctttttttccttctatctcccttttctttatacttctcttccaggcatctttccctctgatttctccttttacataggcctgttattgttgcaaacggacattgaaactaaatattttaagttattataattatggatttattaataaaataaacaattacattttgtttttaagtagcatgaccaagctacttggagaggaaaggaatttttggcttatagcttgtagtcaatcatttaaaaaagtcagggcagaaactaaagcagaggccatggaggggtgtaacttactggcttgttcagcctgatttcttatacaacccagaaccacttgcctagggatagcaccaacaaccatgtcctgggccctcttatatcagtcattagtcaagaaaatgcccccacagacttgcctaaaggccatattaaaggaggcattttcttgatcgaggttcccagcatatcatataattgaagcttctgtgctggaagaagatgtattcgaagaaagtaaacaaaaatatattgtgaaagaaattatagtaacttgtcctaaatgttcgccttgctctttattacagttatataaatgtatacagggctggagagatggttcagaggttaagagcactgactgcttttccagaggtcctgagttcagttcccagcaaccacatggtggctcacagccatctatagtgagatccgatgccttcttctggtgcgtctaaataaataaataaataaataaataaataatcttttaaaaaagatgtgtacaagactgccttaataagcaacctttggccgggcggtggtggcgcacgcctttaatcccagcacttgggaggcagaggcaggcggatttctgagtttgaggccagcctggtctacaaagtgagctccaggacagccagggctacacagagaaaccctgtctcgaaaaaccaaaaaaaaaaaaccaaaaaaaaaaaaaaaaaacaacctttgaagaaaaaccctttggtttcaagttcatgaactctagatgaattgcagagtgtctgtggttgtttgtcacacttagagaactgctaaaagttctgactgagggaaactgttgggtttaagcgttactaagtttaatgtgttagtaataaccttatgtttcttagaattctggctttcctcctcccctccctttcctctcctccccttccttcccctcccctccccttcctttcccatcccttcccttccaaaatattatctcatcacgcagcctagggctagcctctaactcattgtgtaacccactctatcttcaactcacttcctccattctgagtgttggaattacaatagcactccaccatgcccctctgtagaagagcctctttcattttcttgcaggctgataagatttggacatctctgctgaattttagatttatttccttctctaatctaatctataggcagctagagtagactagaaaacgtttggtgctttaaatgttgttcaaggatgacatttgaaatgtaaataaagaaaatatacaataaaaatatttaagatggtgatctagccctttagttttgaggttggtgtactgtgtgtgagtatacatatttatcacacacagtcactatcttcgaaagtgagggtgcacatctttctcagccatctcttattaagccattaaagtaatgccaacatctgaagctagcacattctggttctagaaggtcgagtttttccttggaataaactgagtttagcctgagcagagaaagaccttcatttttaaagttagtagtagtaatagtaatagtagtgtgtgtgtgtgtgtgtgtgtgtgtgtgtgtgtgtgtgtgtgtgtacagcggccaaaggagggcatcaaatgacttgtgttatcactctctgccttgttcctgttttaaggtctctcacagaaccatagagtcaggacgagagtcagaaaacctgactgactgattctcctgtgcctacctcactagggtttctggcttcctcccagccatgcctggcttttattgtatacatgctgagagcccaagctcaggttctcactcttatgcagcacagaagaaaataaggaagttaggtgacacatcagccaaggtacattgaggttacctgatgcttaatgactctttacacaaaacagaggaatgcctacataaagaccagcaggaactaggcaatgtaacaactgagacaaagtcagctctatctaaggtcagctatagtcttagaagccaggtgtgaggtcgttacactcctggggcaagggctttcacgcccaagccatagttctaattctgatttattgtttagcccaccaccacccagctcttagtaaatacctaactatgctattccccagggctagtgaaagtatgtgctagggagttccgctctagctaaccttctcatgaataatgcaacacactagttcctccttaaatcacagcccgatcttcttcctaaacaattgtaaattcctgtatgtgggagttactcgcctgttattctaagtgattttgtgagggactttcttctattaagtaatgtagtctgacatatataactataataagaattctaaacttactttgctaagcttgccctgaaatttctaactatatgtagtagatagtaacgcccgatttcttttgctatctctctttcaatactggaggcaattcgtctgaatagataacattcttactaaattccaagcccagggtcagctcaaggactgcctaggacgttggtgaagaccaggaagcaaagttcaacctaatttaggtatttgtcaaatcattccttggaggcacctataataaaacaatactgaaagaaagcacacagaaccattcgccaactattgcaaggacgaatctgaaacacatctgtttatgggacaccagaaactttccaggagacaagtttccataaaactttatgcctcatgactgtagccaagcttttgggcctgtcaggcagtttttactggagtgggtgtggcacactgtagctgtcttcagactcaccagaagagggcataagttctcattacagatatttgtgagccaccatgtgtttgctgggatttaaactcaggaccttcggaagagcagtcagtgctcttaccagctgagtatctctccagctccccattttcctttcttaaaccacgcttatatattggctttcactttgccctcatttcctagtgtactggctggtattgggtgtcaacttgacacagctggagttatcacagagaaaggagcttcagttgaggaaatgcctccacaaaatccagctgtaaggcattttctcagtgatcaagggggaaaggccccttgtgggtgggaccatctctgggctggtagtcttggttctgtaagagagcaggctgagcaagccaggggaagcaagccagtaaagaacatccctccattgcctctgcatcaactcctgcgtcctgacctgcttgagttccagtcctgacttccttggtgatgaacagcagaatggaagtgtaagctgaataaaccctttcctccccaacttgcttcttggtcatgatgtttgtgcaggaatagaaatcccgattaagacacctagagaacacaaaacagataggagatttaaaaccatagaagtttcattctgcttcttaacaaatcatttctataggattcctggtggctggaaggcaaattgaacattctactttgatcttgtattagtaaagcagatggttttgttaaacaactccctagggaagatttgggtctctgttccagcttctgacatagccaaaaagaatcccagagtggatagagctgaattggcctttcagacatttttgttcaatcccttatggtacatattgaaaattcaagcctagaattggatattgttcaaggtcacagtcacatagtgaatttctggcttcaagagagattattcttccctcctatgcaaagggggaatctaacagatactgtttaagctatgaactcttgtgagtgtgaatgtttcatgtatgccattatagtttaatttttaataattggaataattctatatttataaaaaattgcaatgtacaaaaaatcatgatcattgtctcttttctcttatattgctgtggtataatttcaaaataaaaccccagattttatcagttttctatgctagcatctagaaaatcaggatcagagataactgaaaatctttgatcttcctatttccttagttttctcatctgtgccagttttttaggtttacctgtaagatgttttgtacaatgtccctcaatttgttgtgagttttgaaaaaaatactacagagatgaagtgtcattactatcaaggtatatataaagtggtacacagtatcagtagttaactttgataatatggtttgccatgttcacacaatagaaagttgaagtttttttcttttctgttctctatgcttcagaaattcactcacacctaagttcaacctccttgaaataaagaatacttgtatatatttacatgtgtagaaatataattcatgtttttctaagacaatgtcttactgtatagttgtgactgtcctggaactcactactgtttgaaactcactttgtagaccaggctgacctcaaactcacagagatccacctgcctctgcctcttaagtgctgggattaatagtgtgcaccgcttttgtctaaagcaatttataaaaaataaatatagaatttggagttctttttaaagaatatcaacttttgttgactgctatttgattcctgtgcatgaaggtagaagtgttttggatgttagcttatctgttctgttgctcacaatgttcttactttgaccgtaagtgattctttcagattagcttctgtagcctcttgacatgcagcttgaattttatcttcttagattgataattttctggtacttcaaaatactccaaactcacaccagcagtttctttaaggaatattaattgattgggggggacaatgtatttgaaaaccaagatctgagccaatcttaccaactatcattgtttctgtactttctcaatggacaacttaagtaatatatagctgaactattctatatatacatatgcatctataattgtctatcaatctattttatgtatattaagctaaatatgacctcatatcaataccatgaatgaatccagtactagtcttctattcctgtttacctataaatttcttctctaacagtgagaaaactgtgttctaacacctactatacatttgtttatttcttcaataccaacacatataaaacagtttcagaattgacctattgtccctatgagaaccaaatggacaagaataatgtttatgttcagttatttatccttacaattttgtgtcaaaacataattttctcaagtaaaatctgctttatatccctcagtgcagttacatcatttatgttttatatagttaaattcattttcacagttttcattccatcttatgatcttccaacatcttggttgatttttaaattttcatatactaaggctaagtctttgtgaataggaggtacataatttttggcagagtgttatatactctttactccagcatcattgagaaaagttctatcatttttaaacttctgttgttgccaaccaggactccttctcctaacattctgaaattactcatgggtttccatccctatattccaatctgttttacagaatggcataacaatataacaatataatatgtggcctatttgggtatagtttctgtttctcagcaaagtttaatttaaggtacagttcatattgtgtgaattggtaatgcatttaaaatgttccgttttgggggctggagagatggctcagcggttaagagcactgacggctcttccagagatcctgagttcaaatcccagtaaccacatggtggctcacaaccatccgaaacaactatctggcgccctcttctggagtgtctgaagacagctacagtgtacttacatatgataaataaataatttttttaaaatgttcccttttggtttggggagcaggatgggggttatagggggctttggggatagcatttgaaatgtaaatgaagaaaatagctaataaaaataaaaaataatgatgaaaaaatgctcccttttgtctttggccatgttacccctaatacgcctaatctcaccgagtgttttgttttattattgactagtattccattgtagaaataactagccaatattttgttaaaagtcattttgagtatttctaactttgggaaactatgaataatgttactataaacatgtacttataggggttttgtgttaaatatacatttctaatttattttggtagactactagcaatatagttggtggatcatactataagcctatttacatttgtgcttttaacatatatttccaagaagtttgggttgaagttgtttgtagggtgtaataggatctctgcttgtaagctgattggaataattatcattctctaagcatattctgtatggatagaaaatacaatatccacaagaagatagctacatttaccagaatgatgaaatttctgtaaaatgaccaagtatttgctaacatctagaaagtcataaatctttacaagattatggaagcattaaaatttggtcattttatatacaaagtagtgaaacaattaaattagaaaacaaacaactcagtgtttttaaaaattagctaaagagagaaacagaattcacagaaaattaacttttcaatgagttcaacagccttagtcatcagataaatgcaaatttaaactactttgaatcagaatagataacatcaagacaacaaatgacaactaatcttggtgaggctgttggaaaagaggaacattaacaccattgacggaaatgtaaactggtacaaccactgtggaaatcagcttggatgtttgtaaaataactgaaaatagaacgattgcatggcccagtataccactgctgggcatataccccaaagactatatcccaccacagatatatgcacaaatacatgtttactgctgcactattcatagtagaaaggatatggaatcagcatacatgtccatcaacagctgaatggataatgaaaatgtggtacatatgcacagtggaattattcagtcatgaaaaatgaaattattgattaaattttcaggaaaattgacagaactaggaaaaaatattaattgaagcaacccattctcagaaaggcagaaacctgatgtcgtgcccagtattcagatcctagcttctagcttttctctatgtgtagttatgtgagaatgagtgagtataaacaccagaaaactagaaactggaaggaggagctataagggagaaggatgaggagagcatcagaatacatgtaatatgaaagtggaaggagggagggatctgggcagcagggcatgtggaagacaaggagaatagggagagaagtataaaggatcagggacttggctgtgggatttttgtcttctaataacttcagaagctatacccataagttacacactaccaacatgtctaccaaatgtgagctaaacaagattgaaatcaacaaatttgccaaattgcatgggaaaagcccaggaggcttcaactctacacaaagatctgcacaggcaacttagttaagctgggagcatgagaggtagtcctccccaaggaagagcataccaattggttgtccagttccagtcagccatcctcacaactgatcctaccccagtttccctccccacctactctcccatctatccacctccttccattaacttccctccttctatccatcttcaatgtctattttatttccccttctgagcaagattcaagaaacctcccttggattttccttgttacttatcttctttggatctgtggattatagcatagttattctgtaatttatggctaatgtccacttagaagtgagtacatatcatgtatgtctttctgggtctggggtaccttactcagaatgatactttttagttccatccattttcaccatgtcatttttttaatggctgattagtattctattatgtaaatgtaccacattttctttatccattcttctgtaggttgccgatttgtcttatcgactatgttctttgccttacagaagctttccaatttcatgagatcccatttatcaattcttgatcttacagcatgagccattggaattctgtttaggaaatttccccctgtgccaatgagttcaaggttcttttccactttctcttctattagagtcagtgtatctttttttgttgttgtttttttatttttttgaggcagggtttctctgtatcacctggttgtcctagaactcactttgtagaccaggctggcctcgaactcagaaatcggcctgcctctgcctcccaagtgctgggattaaaggcgtgtaccaccacgcccggcagtgtatctggttttatgttgaggtccttgatccatttggacttgagctttgtgcaaggtaacaaatatgggcctattttcattcttctacctacagacagtcagttggatgagcaccatttattgaagacgctttttcccccattgtgtatttttggcttctttgtcaaagatcaagtgtccgtaagtaactgtttaaaaaaattctgaggattttacttttctctgtgattagaaataatttcatcaacagtaccattgtgttccttactagtttcacattgcagtttcttatcagtaactgtatatttcttggtggattgtattgtagggttgttgttttgtttgttccaattatttttcatacaagctacattgttcaacaacggggggggggggggaggcggttggcaaagatgttgacctctcaaaaaacatacagaactgaaatagtggagcagagcacagccagattcttcccagcaaacctcagggaagtctctgtgaagaacggtttctctggtgactagtacctgtaggagatttgaaaaagaatcgaaatggaaatgaattaatgtgaccctaaatatggctgaagtgtacaggttttttttagctaaatactggactttatttccagccagccttgatggttcttccaaagggcagaagtggggagggagcgaggtttgcaggggatggaggtggagtgtgctctaaggatgaagaaaaagaacataaagagactgtgccggggcctagcaaacacagaagtggatgctcacagtcagttattggttggatcacagggctcccaatggaggagctagagaaattacctaaggagctaaagggatctgcaaccctataggtggaacaacattatgaactaaccagtaccccggagctcttgactctagctgcatatgtatcaaaagatggcctagtcggccatcactggaaagagaggcccattggtcttgcaaactgtatatgccccagtacaggggaacgccagggccaaaaaaaaatgagaatgagtgggtagggaagtgtgggggagggtatgggggacttttgggatagcattggaaatgtaattgaggaaaatatgtaataaaaaaaatcaattaaaataaaaaaaaaagaaaatccatgcaattagtgacacgtgaaaggatagtctgttttctgtctgaacccaagtagcaacggcaaacaagactgttaaagagcttccagagggaccactagcatcataatggaactttgttaggaaagtgggtgtcaaatatattttatctcccttcaatctcttcctctgctttaagctccatccctaaagtggatcttgaggcagttccctttagtttgcatatgagcttaaattggctcatttgtttatctgatacattaattttactcagtatgtcagagcaatgtcagtgattcttctttgactggccttatgctgccagaccttagcagccctggaaagctttcatatataatgtaatatggtctctttagattgctaaaggaagaagacagaaataaggtgtggagaccctgaaatcaagggaactcataacttcttttgaagtaaagtattttgaggttgtgcataaagaaataagggactgactcattccttgtcttactacaactgcttcttttacccttttctagcagttaaaatagcatttgcataatttttatactaatgctttcctatgtattattggatcctcacactatttttattgatgcaccacggccaaactcaaatgttttttctacacaaacattgaatttaacttcccgtgacatctttagaaattttatgaaatgctctgttgtattaagtcacatttctttctgttttaaattatagttattcatatatacatatatatacatacatacatcatttattatattcaaaaatggtcaatggcgtgttctagataagacttactcatgactgacatagtgagcaaataatgaataatggaaaagaaatagagtagagggctgaagagatgactcagtggcgaagagcactgactgcccttcctgaggtcctgagttcaattcccagcaagcacatggtgactcacaaccatctgtaatgggatccaatgccctcttcttgagtgtctgaagacagctacagtgtactcatataaataaataaataaataaataaataaataaataaataaataaatcttaaaagaagagagagaagaaagcaaatatttaaagcttagataacattgataatcatttaattacagacatagaatttaaatatgatttttttctaattttgtattaacattttgtattattattttaaaatccctcaacagtttccttgaacacacttactcttcacaaaaatagagatgatttaaagaagtgatagaccatgagagattggcataaattgatgagataaagtacgtaggattgttgtacagtatgcaacttagttggtaaagtgcttccctagcaggctgaggctctaggcttgatcctagcattacattaacatagtatgcatctgtaacccaatattggaaaggtagagggaagaagatagaagcccagagtcatcattggctacatgcatgtctgtctacctgctccaattgactttgtctcaaaacaaaacaaaatgaatagagaatggtattctgaacaaacaaatcagtgaaactcataaggagggtgggagggcatggtttgtagagtgacgaggccacatctaacctttggatcacgtcttgaaaaatcatgcagaattctgggaacatttagtggtaggaaataaagcccatgtcgaaggccttctaagagggagtgagggaggtggtagagatggctcagcaagtgcactgactgctcttgtactcagttgctgagtgctcctgccttctgccttgatcaactcagaatatgaagtatgtcttattaaacataatctaatgtgtgtaatcccagtacttcagaaactgagggaagatgatcataagtattatcctgtctcataaaaaggtttaaattgctcagtagcataaaatcttagttgccaaattttcaaaccaaaactcagagaatgccatttttcaggttccctcctccgctggggcactgtgttatcctttctctgtccaacttctctatactggaatcagatttatttttaactacttcctagctttacaagtttggtaggtttctttccttttttctttttcttttcagatgtaatgtcaatttttttaaagatttttttctttttattctctcatacaatatatcccaactgaagcctccactcctccaagcctccccacccagcctccctctcccccagatccactgctcttcccttcagaaaagtgcagatcttatcaactgaacacagcattaaaggatgcaaaaagagtgggcacaaatcctcatatccaggctggacaagacagcccagtaggagaaaaagggtcccaagaacaggcaaaagagtcagagaaagctctcactcccactgttcggagttccacaaacaccccaacctaaacaaccacagcatgtatgcagaaaacctagtactgacccatacaggtttcctgattgtcatttctgtctctgtgagccctgcttagttgattctgtgagctgtactctgcaggcatcttcaaccccactggctcctataaccactcctcccattcttccacagaactccctgagcttaggataatgtttggctgtgggtctcagtatatgctcctatcagctgccagaggaagattttctgatgatgactgagctaggcaccaatctatgagtgtagtagaatattaggagtcattttattgatttgggggggggggtaagtcctgtttagttttaccctaggtctctgcaccatccagctttcagtttctggccatccaggcagtactggacatgggctcctccttgtggcttcagcctcaagttagagtagtcattggtgggccattctctcacagcacatcttgcaggcaggacaggtgtgggtggaaggttttgtggctgggttggtgtgccagtcccaccattggaagccttgcctagttaacagaagatgaccagttcaggctgtatatcctctattactaggagtccccattagggtcaccctcataggtttcaggaagtttccgttgcactagatttccacccactaaatacccccctatctcatctctccctctttccctccttccataccggaatcagatcttgttttttcaacttcctagcttttaggatttgtcgggtctctcttaattcatctgattcttaagattatttctcctcccataaaagataatgcccaatttataattttattgcacagaccaaataaaataacagatgtgacatctttatagcctataatatactgtgaaaataaaaggtagttttatcatgttagtcaagaaatgccaaaaggcacaaaattttatcacatctatgaagcatgatttttcactagatcatgtggtatattgtttcaagcctatttatagacacagatttgcttaagttcagttcacttggacactttgagtaaagttaacattagagaaaaaaatctagtctttttctgattgatacaaaggccagtagcaattatatcacatggatatagttagattttttttcagttggtatcttactgaaatccctaatgaatgcctaatgaatcacctaatgaagagtgattaaaacagtcttcctttaacagaagaaatattttataggcaattagtaaaatgtaagaaaattagatgaaaactgaatttacattcccctagctacttctaagtgtgaaacataaatctgtgttccaaatctcccagtatgtagaagtatctttaaggaggtgacaagaaagtattgaataatccttcattgcataccattgtaagaattccttcctaggaagatgtaagcaaaggattaccttcctcttaacactcccaggacaaaccaaagtaagtttctatcaaagtctaacttagacaactagtgagtatttttttacttacagagaataggtgacttcagaaagtctcacccaacagagatgatgaactcttcagagatacatagatggaggagacacacacatacttcatttaacatttcccagtctgtataatcccaaaccctaatggcacatgcagttaaggtagaatttcatgcaaataactgggaaatgaaggaaagaatcaggattttcaatgagagtgcaatgactctccctatccccaccttctctgagagaacaccaacagtcaaaaggccagtcttgatgtctttatggtctcctgcaagcaggcacagctcatctgatgaaagtagcagctgttgtctttggagtaccacattctataacatatattcagatcactgtgtaggggcttagtgtggtagtatacgtaaaagtctaaggtaatgtagcatcctgtattaaatggtatggaacagaagacattctggagaagtgatttcagaagactgatagaaagactgcaaggggatttttgtgtatgttcaggcagaaagagtaagaatgtcttccaaatagaaggatcatgtcaggtatggtgcgtgattccaggtaaggctcttgagatatggcagggacagtttcgacagaccgttcttgaaattctgacagagaacactaagttggatatggtaggcagtggtgaccctttgtgaattcctgagtcagaaacttgaagaggaaataatgtgttaagcagtgcccagggcacgttatcgtagacataagcacttactatcaaaactcgcttgtaagctttcattgtgtgatgtaatagtaggtataaagaatgtagtgttccatgcaagatatggtcaaaaagagagaacaataagaacactggggttcagaaaattcttatcaataagtcagaagtctggcataatagggactttttagatatgctatagatgaacctgaaattcaataccttcctagagctaaatcagtgaatggcttctggatctgaccaacttccaggagccaaaatgtgcaacaatctttcctctccagactttctcaaagcatatgaactcaacatttgtgttagtgtgtgtgtgactgggtcaaaataacctctgctgtctgaaaagaaagacaattcaaagaaaaactgaacagactcaccaccaaaagacgatacacaaagaagttaaaggaaaacaagagaaaagtcagttaagtagcaagctgtttttactcaggaaaatgttcactttgacacacacaaacgcactcaagcatctgcatctgtccctaccctaaaatacttacatcacatactggactagaatgataaggctctgtgactttaagaaggtttcttaaaactctaagaaacctcaggcttctcatttgtgcaatagaaatgctaattcctttctacttcagaggattttttttgtaagggtaaaataatacaattcaatataacgtttctagaacatagcatgaatttaataaacttagtataattattagatattaagaggatactggtcagcttattattggttcttaaacttgagttcatttacaaacagcaaacatttctctcagctttgttgttaagtggtggctaaagggtagaatttaacctagtgtgatagcagctgcttaaatagcaactgggttttagtttattcgactagctacagttgaatagaggttatgttggatgagtggtcagcagctaataaatctagtatgcaacttgttttggtgaaatactatacctttccctttctttacccttcctgtttgtaatcatattttctgtaaataaaataagtctactcctaagggtaatgtgactttaatctaactggtacaaaatatgcattttctcatagagtttgcttatgatgtagcttcacttgagagaacttaagaaataataaaagataccatatggaaatcattaaaaataagagctatttattgccattcacctgcatatgctgtctgtggagcctattggtgcataccaaacacaaggatactgtccattcatacagtacatgtgatggcatgcttatatttttggctatgcttgggttctcgtatgaattgctttctttgttcagtaagactgggatttaatctaaagaagtacaaatactactatgacttttccaggtgaggttatgtgtacatcttgctcctttacctttgttcacttttatgtagacaaacaaatagtcctttttaagcataaataaattagacaaaaataactaagactatagctactattaggtatttgtggataattggatctaagatgtcacaatattctccagagtaatttagcaagtgataaaatgtttagcctaccttggctattccactataatggaatcaaattactatggtaccttgcattaccttgtcatcccatagcttcttggtgacaactatttggataaccaccaagattttagtgtcagagctatagctatgagttggcatggcagactgaacccttatactctggctaatattgtgaacaaaaattagcattcaattttgtcatgttaactcacctgaaaattttatagatttcagccctctattcctatttatgaaaaaacagctccttggtctcatttcttcatattataaagccatacgtttgtttctctggcaagtaagttcagtacttgccagtattagcaaaattaccaactgattctgtgatgtgtttgcaaataacaaggcacattttattaaatagtctctgtaggggctatggatctttaattacaggatcatatttagagcattatctttataatgctagctttttaccttttcaagagccagcatcttgggggaaaaaaagcctgccagttattcatattatagttaggatagagattggaatatcttgtctgaatatggtacaatttctccagaactgtataaatatactggaatattttgagaacaaaagaagtgagtgatagcacagaactagttgggaaaactaaaaaattggagcaaaaatgaaaagaggccaataaaaatgaagaagaaagagtgaacaaaaataacttgagccagaataatagtccccctccaatcttttaatatgtgtcaaaataacttgtctataatccacaggttgtctcattatatagtaggttcatttgatctagtaagatttttatctaggtgtatattaagagataattaggctgtcttttacactgaaaaaaaaggccaaaatgtaaatttttttctttaactcataatggaagatgttggaagacattttgctacagctctctcctatgactcataacccatattcctgccatcttactggtatcttagttttaagtgaggctgaatctttgggccctaatggtttcaggaagtaaaaaggaaatgggttatgcaataagaaaagtctaatgtcaccacactcatcttcccttctaatccaagcgtagtacctaccttatttacagagcatattgtatggtgaattttatatctgcattgacaatgttacaggtcaatatatttatcataaatgacaatagaatggatgatccattgaatatttatttaaaacttctatgtaacaaaggtttgatttatttcaagaaaaccaatcacggtctctctctctctctctctctctctctctctctctctctctctctctctctgtgtgtgtgtatgtgtgtgtgtgtgtgtgggtgtgtgtgtgggtgtgtgtctcacattggggtgattaaaccaagcatgtcatgcatgttagtcaagctgactgcactctcagaccaaagtatcttatttattttcttgaggtcctggggattgaacctaagcattcttgaatccattgtttctctcatctgagctcccaacaccttttaaatattaaaagcaggaattgtcttcattttgcataattgcataagaataattagataaagccatgatttaaacttgggcccttgctgcttgtccagcattcctcttgtttcccactatgacctcttgtgattcaacttaagttgactaacctaatgtgccactttgatcacttatcttttctaccaaaaactgtattgaataaactacaagattcaaagccctcagggcccaagcaaccccattacaacaacaactttatgctattgtttccctggcccttgctttttctcatcaataaaccaagatgacagttactttactgacacgtggtatagtgatattcaagtgtaagaatgtatgtggccattttgttaaattgtaaagccatctgtaattatttatttatttattccttaaatttaactgaaagcgacactagaaaagcagactgagaccctccctcaaaaccaaaccaaacaaagcacaccagaatttggggagggaatccttcttactgtatttcttttgattaagtttcatctgacaaaaatatattgattataatgctaactcttgatttcaggtgctctgcaagctgagaactgacttcagtctcctctacttttttattagtttcctgtaagtagatattatatatataaagagttcaatggaattgtttttgctacagcagcatgttaatgagttcaagattgttgtttaattcttttttaagatttatttatttattatatgtaagtacactgtagctgtcttcacacactccagaagagggcgccagatctggttacagatggttgtgagccaccatgtggttgctgggaattgaactcagtatctttgaaagagcagtcagtgctcttacctgctgggccatctcgtcagcccatcgtttaattcttttttttttatttatttattatacataagtacactgtagctgtcttcagacacaccagaagagggcatcagatcttgttactgatggttgtgagccaccatgtggttgctgggatttgaactccggacctttggaagagcagtcgggtgctcttacccactgagccatctcaccagccccatcgtttaattcttataatcagttagtccacatgtttgttattaatcttttggttatcacacagagaaatgagttgcattgcgacatatccattatattttgtttatttttgcccactactttctttgcttgttcttgctggtcctctatccactcaaatagtaccactttctattttcatggcacacatattcctgtatctaatcttgttcttcctacccctcttcttcctcacctctcatagtaccctttctactttcaaagagagggagagggagagagagaatgagagaattgttttattttcatactgggaatgtctcacattgatgtggcaatgcatttgtgtatcataaatggtagtagaataaatgatccactgaatctatgtttatgaccccatcaaagagcctttgccctcagccctagtatattaatacaagataggaccatgagctttaccaggaataacttagtgctggacctaaaccctgattcccttcctgttagttagatggagttcaatgagttaactttttctgagatttttttccatatttattaaagaaaataataatatatgtttaacaaggctgctgtttgcataaagtaataaatatatttaaagtgcttggtaaagtatcactcaatacatgttagtcttcttttatcacactgtaaatgtaaagtataactaggtgagtttgtggatggatcagtgtagaatacatccccactcctatagaaagtccttctgagaacatatcttaagaatggagagtgtttccagcatcctatctgaacactaatggcagcattattacagatatacaagcaagtaaatactccatctttagcagctgtgtttagttaaggaacagatttagaaagtgcagactttaatctgtgttttctctttggattttggcaccatctgatttacttttttctggataaaaagtgtaattgtagcttgatttttttcccctccctatacacgtatttctgccgtcctccaaagaaaaagctgccttttaaaaagcctaaataggacaacgtgtaaatatttgaaagacatggcaataagtggatacctgaagaggactttagagtaaaaactttagtgactaatgcctttttttctttaatgcccatgaggaacagataactatagaggcaccacatccgaaccttatttctccctgtttgaataactgggtgagttaatagtcaagaaagaagctgttatagagtacaaaaggatgatagaagtgtccatggacttagaagcatttctctttcctcaagtaggagctggaggacagagcaggtttctggaacagaagccattggttcttctgacctctctcttccacctaaaaacttttgattcgagattctaccttgggatttgaaatttgatagcatagagttataaagatctgaggacagggaccaaatgtggtcttcagggtagctctggggatgctacgtgaaagcattaaggcttcaaccatgaagaagcttcactactgagagggcaaaggttttcagtgtatcctaaaccatgtccctctacaatccacagcttcccttcccttactgctgctcagcaataggcaggttgtatccccagtgttctcacagggaagcagagacaagaaaattcctggaagctttcaggccacctagcttgttgtgcacagaagcaaatgagactctgtatcaaacaaagtaaaaactgaagacccttgtccaatgttgtcctctgatgtccaaatagaagttgtctcacgtgcatgcccatacatatgcacatatgtgtgcgcatatacatgcgtgtgcatgtgcacatgtgcattctctctctctctccctctctccctctccctctccctctccctctctctctccctctctccctctctcccccccctctctctctctccctctccctctctctctctccctctctctctctctctccctctccctctctctctctcttctccctctccctctctctctctctctctctccctctctctctctccctctctctctctctccctctctccctctctccctctctctccatacacaaatatgtacagaggtaaaagagaattcattgtatatataacccattcacctgtgctaagactcagaaaccaacttgttgatttaattcaagactaattcctttttctccatactcttgcttctacctatatataaaaaatactacttaagtatttttatatcatgtatcactagctttatgaacttgttgggtcaggaggagaaagaaactacatggatttactaagttctatgcttagcaccactaaagggatgtataacagtaacaagtagctgttgttggaccatagccccctaaggttgatttgggatctttgattctacagcccagacttaatagggttgtgaaatcaagaatttaaaaccagtcaattctaattaagtatcctttatgttggagccattccatgggccatgaagtgcctctagtcctattaagatctgaaacttgtggacataattttctggataggtagggcaaagtatatttttgtctaggaaacctaaaagtcatgtgccaccaaataaaatttgtgaaatcactgttaagacatcttgattataaatgtgttgaaacataaactgtgctagaagtatagcatgtgcagatgtggcagatgatagaagcttacaagattgaagatacatagctaagcctaaaagaaggttctatttttctttctgcctttattttttttcatatctgaagaagctcttagtttcttttcatagagttggcatttgattttcattttaattttcatggtgtgtttgcacttaattagtgctgtggcaggttggctgcatgttgtttgctttccacaaggcttgattgtaatctagcctaggttagaagggaaattgtagagtgccgcaggcaataatatacagccaagtggaatgaagtatcatttcatttggcttttagacagtgcagaaacttggaatattgtggccgttcatttttgaaaaagcatgcctttttaaaaatgattgatttattatatatatataagtacactgtagctgtcttcagacacaccagaagagggcactggatcccattacagatggttgtaagtcaccatgtggttgctgggaattgaactcaggacctctggaggagcagtcagtgctcttaaccactgagccatctctccagcccaaagcatgccttttttaagatggagaaaatataggaccgagataccaaaggcagagaatgctcatctaccttggccaatttacacatattttaattgaaaaatctccatgacttcagccaaggggagagaagaactatctatggattgggtgtttaagaagtttgcaacctaccacactcctccactgcccacagtttcttgtctttgacagaatctccctgtcctttataataatgtaacccaaatatggcacagtatgcaaatggcttctgttattccctttctcattcatggctgaacaacttgagtaggaactaatttgattggatttgctgtgggttttttgtatatcttcttagaagttggccaaatttattttagatttgtgcaactgattctcttgatgtcacataaagcccaccagtctgttttatccatccattacttaaatctgttctttaatgttgtcaaattgttgcccagctagtgacagaaagcttactttctccttatgcctctcccttagcgttcattttatctttatatttttctcttagtattatgagctaatctttctccctcaagttagttccttttgtggtctaacaaagtcaacctttgtgatagatatatttaaagacaaaaatcacatttcttgaatttactcccctaaactactattttgaatgttctagacttttccttcttaataatttctagtttgcctgcattgctcatcaaagctaatcggaacatatattcttttcctttctgccaacttaatgataacctgtgttccttgttcaattacttatttatatttctgtatatttatttgtttttgtttgtttgtttgtttgtgacagaatcttactatgtaaccctgatctgcatggaactttctatattgatgaggctgatcttgaactcacagtgatccgtctgcctctttctcctgagtgatagaaggcatgcttcactactcctgtcctagtttctgatatattttttagagattgttcgtatttttaatgttagatcattagcactgacaaattattttagtttaaacacttgccatcaacaccttcttcctacccatcctccctccctcaagagataaacattctaatttggcatgacattatctggcctaacagtacctggaatatgaaggacctaaaaggtcatcttccactgttttagccttccagagtggttgaattaagttcaaactcgggatgtttttgaaatcttaaatctctctggagatgtttttcataacatctttgaactggataatgctacaataaataaaatatgctgcactggattaaaaggttatttccctagtgtatcaagttaacagacaacatgaaacttcccattatgctttggacatctctggctgtcagtgtagtaaccctgcctccattaggtccctaacccctgctgttccataaaaaccttagcttgtaagctacctttcagagtgaatgctgaatggcagcaagaccaaggaaacaagacataaaaaaagtctaaaataaacaaaagatatgagatacttcataagctcataatctgagtccagagaatcagagccaaagaacaatggaaacccattatttgaaattaagattgggaaataaaccccatttgagacaaacaaaattgacaatgatagcaacaatcaataattaacaccagtaaattaaaataataaagggcagggcaggttagaataccttcagttaaaagtgagatcacatagccaaatgctttcacttatgagtctcttaaagtctttgtgtgtgtgtgtgtgtgtgtgaaataaagaatttccatacaatgctaggctgtgtattctgagtatctatcaaaatgaaagtagaagtacaaactctggtaagtatataccatagagcattctgtagcagataaaaatttaaagcatgtaatatttgcatagaagtgtgaaaaaatcttacaaatgtgttatataacaatgaaaataatgaggcctagcatggtggtgcagtcctgtaatgcagcacttgtagaagaaccactgcaactttgaggccaccctggtcagcaatgaatagtgagaccttagcttgaggaggaaaaacccttaaatggtgagatctataacatgattccattcacatgtgaactcaaagcatgaacatctaacagcactcctttaaatgggtatgtggacatgcacatttagcacattggtagggttacctgtgacagagattaggaataagcgtgagcagctgagtggtttacgagaggaaagttttgcttggttcattgagaccaacaaaataataaaaatcatgcaagcctgcacaaacagagaaaacgactaggtgattagcaagtaagaacagcagtgctgacctgcttgcatctgtatgataatggaaatggtctgtcttggctacactagccacgtgtcattactgaacatctgaaatatgactagaatggttgatgagctgcttttaatctaatcgtatttaaatttaaatttactgctgactactagccacagtgtcaaaaggtaaaatttagatgttccaaaaaagtagatggatgttacagttttaaaaaaaaaagtcattataatacttggctctattgatagataagtggataataaaagaatgtaagaaaaccaggaagaatgtgattgtccttgctttctcagaaactatttttctcattaataagtgacctacaagcctagtccctcactattcttccctgtgtttaaagaaactgaggtcacaagactctctcccaagcactcagaaatctcacactacttcatttttgaactgtgttccaacaatcactgaaaactcttaatatttttcatttgtaatgttgtctctagtccttcttctcactccaaaatttttccaacgctgttttaacttggtcttactaaatagttgaattcattttagcactttgagattaaatgaatccctaggtccagtcatcttccaacttttggttctctgtatagtaacctgatttcacactgggaaaaacatattgtgcttttacttcaggatatacatctctctctctctctctctctctctgtgtgtgtgtgtgtgtgtgtttgtggtgtgtgcttttacttcaggatatacaactctctctctctctctctctctctctgtgtgtgtgtgtgtgtgtgtgtgtgtgtgtgtgtgtgtgtgtaataggaactaatctgctttattgtacaacacagaactctaaaatctgaaagctggatttagcagaacctttgtcccaggtgaatgagaacttttttctcccacccctctttatttcatcttgagataaacaaggatggctcttggatttgtaacaacatttctgccaataaagaaaaacaagaaattagaagtatgattagtggttcttttatttgtaatttatctcacctaacaaaacttgatgcagctgaggatacttctagactagaaactaatacacatatagtatagtgtaaataaaaccaacatactttttggtattggcaaatactttctccttttggaacttgtttactgtctgtaaagtggggaatttgggattaaattatcttccaagatctttcaagaaatacagttcagtaactatatttctaaaaataatttaatagcttttaaaatgttattaacaggaaatatcagtatttaaaaaagagattagaaaccatatggaaaaagtttttaaaaatttacccaaagctatcaaactcaggctttaaatctacctcagtgctgcctggcaacaaagtctctctgattatatcttatataaactcattctcatgaagtaccacactcaatgatgaggtccttccagggcacaccaacttgtacataccaatagatgtatataggttggtttgttttaatgtgctattatactacttgtatgagtggatctaccatctgacaaatcatgatagaactcctctatcattttctgaacctgagagaaaataatagttctgaaaataaaactctaggatgtcccagtaaagttgagctacatacagtataaatatctagaaatgaaaactacttcttataagttcccataagttcttctgttctttctttatctcattcagatcttagtaaatattttactttctaccctttgtataaccctataacataggcagttaattttttttaatctactttcatattgatttctgttcttacaaatgtagtctacttggaagtctctttaatgtcacaaagatggtgcagataagactagaggagaaaggaagtgatcaagttggaaggctcacatgttgagctaggacaaactgtaagcaccatcatttttcattaggatcctcttcaaagagcctctccaggcctgtgaggttgaaagtaatgggtatgcccggtgtctcataaaatggttgttccagagaagtggtgaaggccattttattttgctttgctttcgtgtcagggtcttactatgtagaccagactgaccttgcatttaacctttgcctcctgaatactgagatgtcaggtgagatgcacatggccttagtgtgtaggataaaaacttgactgggaatagtggttagggatagaagttagttaaaattaatagggatttctagatgtcatggtggcacatagtagtcacctttatcgcaaatggactcatccatctatcattttcttttttaaaatttttttattaggtattttcttcatttacatttccagtactatcccaaaagtcccccataccccccactcccctacccaaccactcccacctcttggccctggcgttcccctgtactgaggcatataaagtttgcacgaccaatgggcctctccaatgatggccgactaggccatcttctgatacatatgcagctagagacacgagctccgggggttactggttagttcatattgttgttccacctatagggttgcagatccctttagctccttgggtactttctctagttcctccattgagggccctgtgatccatccaatagctgactgtaagcatccacttttgtgtttgctaggccccggcatactctcacaagagacagctatatcagggtcctttcagcaaaatcttgctagtgtgtgcaatggtgtcagtcagcatttggaggctgattatgggatggatccccagatatggcagtctctagattgtccatcctttcatctcagctccaaactttatctctgtaactccttccatgggtgttttgttcccaattctaagaaggggcaattctaaaagaggcaaacactttggtcttcgttcttcttgagtttcatgtgttttgcaaattgtatcttgtatcttgggtattctaagtttctgggctaatatccacttatcagtgagtacatatcacgtgagttcttttgtgactgggttacctcactcaggatgatgtcctccaggtccatccatttgcctaggaatttcataaattaattcttttttaatagctgagtagtactccattgtgtaaatgtacgacattttctgtatccattcctctgttgagggacttctgggttctttccagcttctggctattataaataaggctgctatgaacatagtggagcacgtgtccttcttaccggttggaacatcttatggatatatgcccaggagaggtattgcaggatcctccggtagtactaaatccaattttctgaggaaccgccagactgatttccagagtggttgtataagcttggaatcccaccaacaatggaggagtgttcttctttctccacatcctcgccagcatctgctgtcacctgaatttttgatgttagccattatgactggtatgaggtggaatctcaggattgttttgatttgcatttccctgatgattaaggatgctgaacatttttttcaggtgcttctcagtcatttggtattcctcaggtgagaattctttgtttagctgtgaaccccattttttaatggggttatttgattttctggagtccaccttcttgagttctttatataaattggatattagtcccctgatttagggtaggtaaagatcctttcccaatctgttggtggcctttttgtcttattgacaggtgtcttttgccttacagaagctttgtaattttatgaggttccatttgtcgattctcgatcttacagcacaagccattgctgttcttttcaggaatttttcctctgtgcctatatcttcgaggcttttctccactttctcctctataagtttcactgtctctggttttgtgtggagttccttgatccacttagatttgaccttagtacaaggagataggaatggatcaattcgcattcttctacatgttaactgccagttgttcaatatacctaatatctaagtaagtggggaaaaactacaagcttcttttcataaaatctagatcttacttatgctcacatttttaaaatcttgatgtgttttaagagaaatggttgtcaaaattctattgaagtcatatatataagtcaagaaattaaggtatcttctacctctttcaatttcagaaataacttaaaattatcctagactttactttgcatctttcctaattgggcaactttgaataatatggttgttaataggaaatatgtaccttgcatagtaggtgtaagctatttaataaaaacagaagtaatgaagccagtctagaaaacagatcccagggagcattttataaaccctatagctgaaataacatgtaaaatacaaaataagacaaactgaatgactgacactgtatatttcaaatgtgcaggttggacaacatttgaaattggaatgaaacagtaagaggctacattcatggataaccaacaagataaagttattgctgcctcagccaatggagacaacaatctgattaatggggtcaaaaacaatggtaagaaagtttaatgatgatatacattctcttttctggtagtcttttcttattaatgtggattttgagtatagaaacctgagataggttgaatccaaaatgtatctgaagttgatgtaaatctaaacttttttctaccagatctttaactcaactagaaggatctctgtaagatctcagataaatttctcagattcatttgttaaaaaaaaacttgtcaaaattactagtaaattataagtatgttctgatgtgagacttttatagtttcactatgaacttctctaacttaacttttcaagtatgggcacgtgtcttaaagcataaatcatgaatagccccctgtgcatcttcccctctgaaagctttgactttccaatcgactgatcagtccagttctttcctgacttctgatggggactctaccttttcctgggctgaaaaaaatgattatttttcacatatatgaatgtttcggtatgaaattagaattgtttttataatgtttaggtggtaattcataaagctaagaaacagaagcttagtttattatatgatgttcacatatcagaaactaatcaagggaaagagatttgagtctcatctaagagccttaactttattcctgcctttttaccccttttttctagactcagaggaccaggaagtggcaatgaagtcattcgtagctctagaagctactactccaatccagcctataccagtgatacaaaaagagtccccgatgtttcccaggggccttcttcctccgccatctaagaagccgtgtatgcagagccctccatctcctttggccctgattgaagcacccgatcattctgctaatagtgcttctgtgaatgccatctccctcacatctggagttgcaaaaggcctgaacacatggtcactgcccaacgagtgtgagaaagctccatttgccataatggaacctgcaggcatgtcagctctgaacggagactgcctcatgcagccaagcaggacttgcttaggttgcttcatggaatcaaaagaagcagtagatcctgaaccagggatcagtctgaaagtcagtgatctaaatcgagattatgaaacatgtgcagtctctgacatagggattcaatgcattaatgctggggaaaacattaagtatggagagcagctgctttcagaccagctgttaggcttccccctgcataagtcaagggcaggagatagacgagaatctgagaaacctgacatcgacttggaagatccaactcagaaaagttattatgaggcattactattagataagtgcaacacggaagaagctttgctggcaaattccaatcaggattggggttactttgagacttttattagtgagagtaagattgagctacttgacctctgttccaagaatgaactgtctgttaaccttttctctgaagaagatgtggagaactatatgttcgatgatgatgagtcaaccctgggcagtgatgtctgctccctcaaaattcgatatgagtcctttcaggacaatgttcgagacaagaccactcttctgatgcaggaagatgcccaattcaattttttccccagtgtctttactacgtgtcccaagcgggaatctaagagtggaatcctcaagcagagcagtgatctttctcaattcaaggtccctgatgtgagcatcatctggggagaagaagataaaaacttggacaagaagaaaggcaaagaggaagtacatgaagacaaaagcatagagacaaaagatgaaaaagataatggagaaaagcctgcattaaacaataaaccatgtggtggtcttgaggtagagcaatttaagaacctaaaggctgaccaacttactaattccctggagacatcagggaatttcagtgatgacagttccttcattgaggtctcatatgatgccatgggggagatcaaagactgtagccgctatatggctcgggacactaattctggaagttcatcctcccagcagaactacggactgcgagccaagagaaaagtcagatacagcgaagattatctatatgatgttgactcgctagagggggaaaaagtaaatgagagaaaggaatggcctccaggtggttccaaagaagaagatgatgatgaatggtgtcccaaaaagagaagaaaagtaacacgtaaagagccccctgttattattaaatatatcattatcaatcgttttaaaggtgagaagaacatgttggtgaagctaagtaaagtagatgccagtgaaacaacagtaaatctgagtgagaatcagctcagtaagtatgccaagctatcacctttgaaaggattctggcaaaagaagaaaaagcagaaaaacagcaacacagactcagtcaaaacacccttatgccaaaagcaaagctttgaaccaggtagctttgaggtgtcattcctgcctcctgctcgtaaacgaaaatctaagcttggcaacagacacaggattcaaaggatccaatctgtggaaacttcagcaagtagtaagcaggtttcattctgcagtgatcagaaacaagcttgtaatcgcaaagaagacggtgtaaaagggacaccaaaatcagcacttcttactgacccaagctgtgccaatggatcacatttacgtggcctcatagtctccgactcggttaaagtcaaagctcaagatacagagttcaagggcccagagaggaaagtgcttaacaaaattaaatttaaaagtgaagctaggttaaaatccaaaaaaatcaaagctggacaagaaaacaaaccagttgttcaaatgagccctgtctcagaagacacatcctccaaggctaatttaaaaaatgaagtcactcctggaacctcaaacagttcccatatgtctgaatttcacgagacaaaagttaagaattccactttcctaccaaccacctgctcttctgaaatgcctctatcatctgctaatgttgccactaatatacctgttattcctggagggtatctgcaaacactgttagatgcttctgacttatcaaataatactagtatctcatacttcaccaaccattctgcagagcaaaatgaaggcagcctcactcaaacggaaaaagcatttgtacctctccagtctgctcaagactgtgtgctgtcttcatcttctgattctcagctgcaacaatcatctcagaacttcaaaatggaagcaagcaactttggaagtttgtggcccgacaaggatacatctggctcccaggaattcatgactgaagtctcaagggagatagccacaaaccaatctagtgaatttgaagcttcccaagttgtctccatggagaataacctcacagctataacatacagtcctgtatgcctcaatagtgatgccagtggttgcaacaaggttctgtatgcctctttgcaggactcacatctcccacctgaagacttgtatcaattgtgtcactttaataatggagagatctgctttccgttccagcagggcccactcagtacagatgatgatggccggctctttagctttgattcgatgacttcccttactgttagttcaagcaattattgttccttaagcttgaaatcctgtgaaaaggatggtgatgatgaaatcaatgatgactttctggcccactgcagccccaaactggtgatccaacagagcattgatgaaatagcaccactaaaggagtccactgacctccttgacatctccaacttcactcctgacaagttccgacactcttctctcttagaaatgtctcccccagacacccccagtctttctcctcagagtaccagatgtgagagtatcaaaacactaggaacaatgaaaggattccaagaaggtgtcccaggatcgttgagcaccgtggaaaaaatcaagtgggactgtaataccctttcacaacaggcccaagcagatgatggctttacattaaatagccatcagtttcagttccatatgttcaatgatgaggactctgttggcctgctccaaaaaagcccttgcctgtcaacatttgatgagccagctgggcaaattaataccaacagcaaagtgtcaaaatcaagaaagaaaacttcacctggcaagagtggggctgtaagccaaagttcttctcagaaaaattccaggaaaaaatcgccaaaagcaagcaacaaaggggttgaaaagccacctagcaaaacctcccgccaggttcctaaatcaacaaagaaagggaaatatgtggctgctgtcaatggagagaaaatgcaaattgggattggccatagtgggggccaacccaatagtacatcctccaatgcaaagacactgactgaatgtattcagcatggtggtcctgttgcctctatgaagataccaagtcagaagggactttctggagattgggctttgggaaaggaaagcaggccaggctggaatgacatgagtgtagtcactaataccaacaaccttctggatgatgaccaacgagagtttcaagagccttcctatatcttatccaatattgcctctggtatggcagatgtgcaaagattcatgatggcctccatggagcccctttgggaacccatggagcaccaaggggagtccaacacattctactcccctgattccaatagcctaaaattaaaaaccctcaaaatactggctggaacaccacaagaatctaagaaaaaggttactaatgggtcttcaggagctactaagaatcacaggtcagtcaaagctgtgagcaaaagcaacgggaaagcggcaattggtgagcctggtcatgcagatatgcctggttccagtgaggactctcgatctgccttctttgataaaaagtacagtaatgtgaacactttaggcaataatggaccaacacacaaaaaattatatcgtcacaaatccagctccaagggcctgcgagatgagaaatataagggaaagcgcgtggaacgagaacaggcccacaaggatgaggctggaacaacttcttttgaaaaactgaggtaatactgcaccaaaatggctcagatgagatgcgcccttggctttcctactacctgctgagcccagagttcctatttttccctcttgaaagcgaagttttgcatgagagactctttcccattctcctctttttttcaaattaaaaagaaaagaaaaaaatgcatggaaatccctgtacctttaagccacccaaaatattgggcaattttattgtggcttagctagggataagttctaacaaaggctacatttttcttctattcagcgttaatttttgcttattaaggaaatagaactaaaacatgctcttgaatgatttttggaatggaagggctttgcaataaagacagattctggacaacatattcaaaaagtcatgtagacaaaaagccaagatcatttaaacaaaagagcattagttgtcagcacatgacaattaggagtgctttctctacctttctgcatcatacaacatctagtatggtgttaatatatttacagggtatgatcccttcgtgggacatacactaaaacttactaagatggcataaattctttgatttttctgcagggattccaactacaatctcctaaaagcagaaacagcatttggggttttacctgtgtttgaagaagagactcacattttccagaaagacatttgatgtttgtgttttctttctttcaaaataagctttgtggtatgtatgttgacctgtaagtgcttacaagaaaagaattttaaatcgtgggaataagtctttgaaatcaaactttaatctgatgttctgtgtaaaagactttaaaagtcatacagttgcacgagtagtttatgcactgtttgcccacaaggaaaaaaatggaaaactttgtgccaaactacaaataagtaactgtattgtatatagttttacttctatatcaacatttggttgtgagtatttgggggacttgtccctgttaatttactagaaacattccagtgattcttgctattaaccacccccacttttgtggatagcacctatagatcacagtggaaaatatgttgtgttatacagtttaccaaaacaaaggataatgtttgaattgtgccaaattttcttacttcatctcacagattcaccccacagtttaaaactcattcatgattattaaatatatatatacatatacatccatacattcttttaatgttttaaactctactatcctgtgtggaaatatgaacagttaaacaaggcacaataaagatgtgtttgttccatcatctaaggattaaaatgttggaaaagcttaggtcacaacagctaagtccatcagggacagagtatacacatttacagaaccttgcacaaggaaatcaaacagctgctttgaaagttggttttccaaagcaaaatctgtagcagaaaagaatttaaagtgcaaagttatattgctgatactttatatctcagttttatatattttataatagcctgggataaattataaaataactataaaattgacactaataataaataaaatacatagattgcttttatttaagtagtttcctaaatgttttattccagttatgtcaaaagtgcactcacaacatggctttagtgttctttaaatgttgatcttgcaatgccaatgtcattttttaaaatgacatctcagattgacagaatttttcttcctatgattaaatacatataccaccaggtaaagctgaacaatatgtggaaataactaatttaggccatctacatatagtctgaggatgactactcttttgatatcacacactaaacataaatctcaatttttaattaccttttaaattcatatttttggttcaaccctccctttcactacttagaaacttcacagttcccacattcctcactactagccttttcttcccctttcttcaccacttgacttataccatttgatctcttttccttgcacagttaaggcctatgtgcctaatgactgatgcattgtggcacagatgagataatggatgtgaaagcgctttgtagatcataaagtgctataccaatataggggactaatattattaatgttgttggttgttgttgttgttactattcttactaatattgttactaacctattaacttgtgaatatagaggctggggtgggagggaggaggataagggggtgggagaaggggacttaataaaacagggaagatgtttcaaaagacatttttgaataaaatatgagcaacctacctagtcattgacacctaaatatattcacaaacagagaagcaatgttttcaagtagtcagagagaaatggaagggagcctatcatgtatataaacatacacatttcccagcccatgattcctttcaccagcttactctactacttacagctaggtaggaaaatgaacaagcccatgatctagattgtgtgtgttctcagcatcagtctcttttgtctgtggggatgagtgggtgaggagaaatctgtgaggagagttcaggcacattcctaggctttgacactgtgttcaatgagccctggaaaatgatttagtgggaaggcaccaactgaaacaagtctcttgccctacaatgaccatccaaaagagaaaataatcaaactagaacactttcttttgtttcttggtactctaatagctagctgtttgtattaaatgtgatggctacttcctaggaactggtctttgttcagttttggtttttgtcttgttttgcagctgaccttttgcttagaatcatcacctcagcctgtattgtgatccccaagactccagacctcaaactcatcttgcttggttttaggaatggagtgctttctatgtaaccaaaaagtggaaattaaagaagaaataaagaaaatgttctatgagtataatgtgtttttataaaagtaaatatgggagcagttgtcccagatttttttaaagtatcatgatgttcagctttggagaatggggtaagactggggtaggatagcttgaaactgtttctaacagtttcattgtcagaacttgatcatcagtcctttggagtggatactctttcagttgctcctatggagcccactaggggccaattttagggcatggttcatatctttctccaaagagaactgccattttaaagcacctttttatcggcctgccatgcattgtatgttcttaacatataaactagtgacttgtaaccagtcattttgtattgaaacataacaagaaagtgaatttgaggagtgtgcaatagaccaaggcagagatgttattgtacactatgctctacattgttgagcactttgcattctgttggtcctgcctctgctctcagaattattttcctttctgtcacaacatagtaggccaaacttactggagatctcttattcaaccagctgccttagtggagtgaggaccaatgtatgaaaatagtgttttgccctatcactgatttcttcaactcaaaaaccctggattttccttgatctgaaatttctgactacccccttctaacctctcctttctgagaagctgcatcctattaatgcctcctcattggagtctcatttaatctttactttcctggaaattatatcctcccttgttcttctttcttgacttttatcagtcttagaatttttcttcttgtgtagtattctattcaatatcccaaactgtcaaagtttaagaactacagctagaggctttcttttggaagtttagaggactaccttccctgtcttattcactcaaaatacaaatgcacgagcacatgcacacatagcattgagaaaagactgaaactgctttctcttgaaggtgtgtgataacaggtccaatctcttattgtggtcaggtgctgtactacatggagcagagtgcagatacaatggccccagccaagggtcttcaagacattgagggttgtgttgggactagagtaaatagcttgaacctgtggccatcctctatgcctctccagtgtctcagatctcagctgcttcacatatgctgctccctcacagctttccctactgacttcttgctgctctgtgcaattatatgttaaggccttatcttttcctatatcttttcaaactttctgcactacttcattcatcacttctttagccatctctctgaagtccttggtgctaggtgggcttttgtgacaaaaattttcaccttctctgactcttttctttgctgggaagaatcgttggggggtagggaacacaaaggagggtatgtgtgtgtgtaagagagaagcataaaggatgcttcaaatgctgtaatcaactcccatcctgtgttatttcacgtgaggtcttgcagttctagtgaatttccattttagtggctttgaaatagtgtttactgcgtaaaggagaaaagcatatccaaggacctctttgccttgctcttaccaaactgaactagtgttttggagatctacaatttatagatgcactcagaacagttctgagaaatgaggagagttagagttgagtttctatgctgaagaggtaaatggaacactagctagtcctagctgttgctagaactagaaatgtttgttttctcctgtttgactgaaaggttgtcaaattattcattttcatttagggcttttaatgctgccagtcataacagaaatatctccttttgtaaaataaaactaatgcaagttttgttttttaatcataaaattctctaagccaatattatgtttagaaggcttagtaccaaaatcaaacattttcatgacaaacagagatcttgtcaacataatgtaggccagggattttatagagatttctcaaagacccgagttaaggacagaaattagttgagatgtttagtttgggaaacactactaccatcagcttaagagtcctcagccagcatggagttattttggtgactatgcaggctaccctttaagacacagttttcactcaacattaaacagtagctacagtcatgatgcagagatcccattgcagctatatgatacttgaggtgtactcttggtttgagaatcatagctaaatgctaaaacactggggaaagacactataagagagtggcttagtggaaagttttaaggaatgaatgaggcttttaaaaatcagtgtttgggtaaatcaatactaaatacactaaagaaacactcacccatacaatatgaaaaggatgtctgtgtatccaacaagctcagggttctctgggcccactgaaaatgaagaaaggtaaccaggcatggaggctcatgcctggaaccctaggcaggattgttgggagttccagaccagtctggtctatagtgtgagacccagtctgaaaaataaaaatataaaagaaagaaggaggatgaggaaggaaggaagaaatgaatgaatgaacaaatgaaagaatcaaggaaggaagggagggagggagggagggagggaggaaggagatactgaaatcattctgcctctttgagagatgcctagttttacagcacaaaagaaaaaggcttgaatgaaaactaaaaggggcctttttgtttttcactcccagggaggtggagagcttcagagtctccactgggatagctgtagcactgactggagtttgctgcctacagagttttgaatgtacttactagactttagtttccatagaactgaatgcacctcttcagtaagtgaaatgctttatggtgctaaagaaaatgattatccccatttttcttcttcgccaagccccttaagcatttaagaaaatttaaagtaaaagcatttagagaccctttttatgaatgtaacctgtttctgtttgacacatgacactgcaactttaaagttaggaaattatttgcctttttcttttagaattaagctttataaataatctgtagagtcaattgaagtataaagcttaaggatcactcttaagacgcctacaaaatcttgtatatttttaagtgtgccaatttgtaacatattttgtaagtgtatatttttcttagaaaagtgctgtgaagtgtctgtatgtgagagttttccttttttctgcaccactatgtgctaataaaaggatatttacttcaaagtttctggttttagaaaccacaatacaaagaaaaaacacttttgttgggaattttgtaacaaaaaatatgttgtgaaagagtgtagtgatcttgtgcaaagaaaatgaacatttgtgagcttcttgctgttttatagaatttcttgtaaattattcttgtaacacctctggttttgttgttcttgttgaaaaaagttttaaatatttgtgactgaatgtatggtgaaactgtcataatgttacctagctgagttttgttattgtttatggaataaataaaagaaaagtttaaaa

SEQ ID NO: 660 - DNA, 123777 bp, mus musculus
ggggggagaacccgggaaggaaaaccagtagcatcagcagcagcagccaccgccgccgccaccaccacagcagtggcagtagcggcagtggcagcgtttagcagtagtgttcccagcgctagcggcagtcgcaaccgccctccgcgtctccgtctcgcggacagccgcagccaccgcgtgcagagcgggctccgggcaccgccgcgcgcagccggcgagccgggcagtgctggcgcgggcgagcggcgcggtgagaggagcgctgtcctgggagccggcgggcggctgtggagcctctgagtttcggcgcccgagcccgacagctctgcctccatctagtgcggcggctgcggcggagccagagtgagcgagcggagcgaggcgcgtccacctggcgggccccgcgcatggagcagaggcagaggagacggcagtgagcgggagcagcggcggcagctctagcagctccggcgacggcgacggcggcggcagcccagccttgactgcgaccgtcccagctcgggacgccggcagcaaggacccaccagcgacgtgcgcctcgggaggcggcctgcgaggtgagtctgagcgctgccatgcagcctcccccatcccccccgggccttctccctggctccccgggccggctggagccggcgggcggcagctgggggtgggggtggcggctgcgaggaaccgagggctagccgagcgaggagccgagcaagggatgccggcggggagagcgtgtgtgtgtgtgtgtgtgtgtgtgtgtgcgcgcgcgtgcgtgtgagtgtgtgtgagtgggagagtgtgcgaatggcgtgcgggtgctgtctgtgtgcgggaggcagcgaggccgccggggcgagggagcctggctcgcccgccgctgccgccgccgctgccgccgccgccgccgccgagcgtgcgctgcaatctaggaaaggcctgtgtgccgccgccgggggagggggaggggaagggagcgggccggagccgccgccactgccgccgccgctcacacacgcctgcctgccgcagggcagcggccgctagccgcctgccacctcccatcggttcggtgaccccgggggaacctcgggcgtctggggaaagtggcacggcccgaggcacgcgtccgagggagcgggaaaacgtaggcacgcggcgggcgccggctggcgtcccggccgaagctgcagaggtgcgaaggcgccgctggccgccgtacggacgcctcccccgcccgaggctcccgcgcgccccaggcgcctctggccaccccgcggtggcacgggcggctcgcagcacccgctccaagcagccgccgctggcgaccgacgagaagttaggggcccgagcgagcctcgcccaggcttgtcacctttgcaggaaattggcccgctgccctttcccgctctcccttgccgtcagattgacgctttcctccgggactcctggagctcgtcgctgctgcgcctgcagggacactgctgcggctcgatcttatccagccctgcgggctcagaggccgtggggcggccccgctccccgaaagtgtgcagaccgcgctgttcagctgaggaatccagtggtttcagcatgactgctcctgtctcattagtgagacaccgaaccacgggcgcaaggcttttagtctttttctgaagttaaaaaaaaaaaaaaaatcagttgacattcccattttgacaccagcacttcagatttttgtccagcttctggtagcattttggaatgaccaagtctcatattttgcttctgggctttggcttccaacatgttgttaaattctaggcgcaacagcatacttaactgtgtggctttttctaacgtttcattttgtagacttgtctgagaatacacaatagtgtgtggggttggcaggacttttttttaagtatctttataaaatactttagcgctgggatttaaaaaactgttttaattgaagaagcagagtgtgcttatagttctggaatattttgcttgctgagtaaaaggtgctctaatggtttcctctgaactgcaagagaccatttgggacttgcggggtgagtcgcacatctttatgcatggatagaatgaccaaacattttatttacagcagtgatgttctcatagctgaggagattttacacttattaaaaaatatttttagaaaggaacaaaaaaaaaaccttaagaaactgtcattttacatattaactagaaaaccggctaatcaaataaaactggctgagtgtctgaaactctatcccagtgaaatatgtggctgtgaatataattaaccatctgtctagtgagcaatttaaatttgggctggtacatttttattacagtctctaatttctggaagacttgtacattttacccagcactaacaacagaagcgtatttgcttactaggtcagaaatgtacttgtgtggtggtgggatttccctctatccccacccttacatcttatgtagtctctatactcttacatcttacatagtctccatactccttgaccagggaggtcaaataaacctcgggcttttttgcaagcaacatatttacaataggggaattcaaagcccctctggcagctagtgattagacattttgttgttgtttcttggaaatacttagcaaaaattgtctcccacagaacctagatagattgcatgtatttgagttgaaaagacataatttttgtgtgtgtgcccatgtgttcaaatagggtggggtgattcaagaaaatttgtaagacttgaaatttgatttcatttactttgtctttttctacttaattctttgtagagcacaccccccagcttgtcttcctgtctccatacccctatgccccacagaactaggctaagaaaaatcacactcttgtccctttagccagttttttttttacttcaatagtaccagatctgtgattattaacaatatgtcaagaaactaactttttttgaagaccaaacattcaaaatatcaaaacataaaatattgtgcacatttaaattcttcctgtggtatgatttttaacttgaaagtaattacttgaaaaaaaactgaaaagagtttagggaaaagattagatttcacagactccaaccaaatagctattgttaacataattaaaaagaaccactgattgtgcagcaagccagagaaagccatttaaaagaaaatacttttaaaacaaatatttgcctaaattacagctcggataaatgggtaacaattatataagcacatggcagaatttgacatatgtcaagtctgttaaataaatcagtctgttcaatgaataaatcttcgatgcatcaatgtttttttaacacacacatacacacatgcaggcacacgtgcaaacctgtaatatccctgttgccaaagtcaaacaactgcagaacactgctgctttctgttttactcactgtctttctcctgtctttttctttttcttttcttttcttttcttttcttttcttttcttttctttttttttacaatctgattacctgtaagctgcccagagagcaaagcgaactaaagatgtgctgttgattccctttgcttgtgtttacggaggtagaagagagaaagaaaaagctctaacagccggatttaaaacactcaaagacgtgctcatggcactctaacacaatcactgtggaggttctagtctcactgaagtatttgcttaggggagggactgtcttaaccaaagaagcatttattgcagtttctctgctcctaaatccagttctagagatttttttcttctgcaagccccttccattgtagtaagaggagattctagttggcctttgactgttatatgtaaactttttatgtgttagtatacccgtggtcaaaatgttcctgctggcagtaagcaaaagaagatagaagggtcaaacaagtgatacagaggagactgattcactgagaagcaggtcatttttggcttcattgtttttcccatgttggaggatttcagatttaaactttatattttcctttattattttacttcctctgaagagtcgagctccctagttaatagttcctcaccagagcaccctttcaaatccaaggtcataaggttggacataaagaacttaagctggttgtccaggacgctttgagaacaaaacaaagagccatgacaggagcacttcaggtgacctttaagtttgtaccttcactgctatccagaaaatgtattttgaggcagacatgaaacaacatcggcctcctgccacagtaagcatatcacaatttagggaaggaggcagttcagggaagctgcctttttgaggcctgctccaggtagaggcaaggatcttttgtctcttccctctgtcctgaatagtgattcacagactttggctatggaatgtgctccctttttcttgtaaatgctatgatctaatgtctttccttgttctccagccggaaaggatttctagcgtttgttttgcttttgttgtgttctgttccaagctttttccccttttccccccggagctgaagatggagcacagggccttggacacgctagagaagagctctaccttggagctacatttccagccatgagtgttttttgcttttgtttttcatttttagacagggtcttgtgtgtagcccaggctacttttggatttgtgatcctcatacgtccacctcccgagtactggcattacatacaatgttccaaaaacccctggcagaattcttaagagcatccacaacgcacacaattttttttccaaaatggcgtgtctatagatcatcttatttctctccagtaagatgactttgatttaagcaattatgtaccattttcctcaagtgtccccaaatcctatgaaaactatcagtttcattctcccattgtttttttcaagtgtcccacaaactagctggagaaagaagcttctgctgtctatctgcagattatctaaaggctggagaacaagatttgtacactgcatctaaacataggaattttgacccaccctccatcaagaacaagcataaacccagatgtggtataatcccccacacaagaggctgagaggcaagaagatcctgagcttgaggtcaaccttggaaacagagagttcgaggaaatcttgggatgtgtagtgagaccctgtcttgtttcagagacgggctgcataaaactccatgttcaatccttagtgccacctaaactggatgtggagctatgatcccagcattcaagaagaaaaggtaggaagacaagaagtttaaagtcatcctcaactagatagcaaacttgagaccagcctgggatacacaagagccttcccacagaaagatgacaaggaagagattcatttcatgtgaacaaagttaaagtatttttttatttgggattattggtaggttaccatatgttgtggcacacttgttttattctttaaaaattctatgattacttaaagtacagcacctttaaaagacatatttcctaatttgagttgatagttaattttcaaaacttgatagactagtgagcttctgagagacaatgactctttaacctagttcaccttacatttgtcagccaagaggtctttctgtagaagatcctcagaaagattgatgctttgtgtctgacagaattggaatattgtgttcaaagatatcgacacaaaatggaagtctatgtttgcacatacacatgtactcaaagaggtaccctctacacattggagagtgcttcttgctttcatgaaaggctggtaagagggaatatgttagggctggggagaaggctcaaaggtcaagggcactgcctgtttttatctagaagacaagaggcataggcatgtttagaggcaggtagatctgactaggagtttgattcccagaagccatatggcagtgcatggccatctgtaactctagttccaagggctctgacacacacttctggcctcctaaagcactagacatgtacatagtacacagacatatgtgtaaacagagcaccacacacatgaagtaaaataattttaaattttttgaaatacacagtgagttctaagtttatctggaaaccttagggttagaaagtacatcctgaccaccgtattcatgaagaaaatctttagcactaagggaagtatgataagagacaagatgctcttttaagttgtctgcctcccagtcctaagtctctgtgatggacttcattaatcgggagcaggagtgaatgaaaaggtggttccccaatctaaatctgacctatcatggaataataatgtaatcaagaaggaaaaaaatgaagctagttagaagtgatatttgtaaatattttcaagcttttattacctagttgagctttaccagatccattgttaatacatgagagattgtctaaagccaggaagagttgcaggggattacctaaacagccaaactggtaagtgaattttgttactgttgatgtatcgttaattatcacctttctctcttctgcagtaacctaagttttgtggcacgacgaagttctttccgactcctttcccattgtttgccatgttgttctgggcacatgtgatttattaacccagaagctggtcttgatgactcctataagcagaaactcactttctctttctttacttgttaataagtgaaccacacccagaagatacaccgccttactaagtagaggagtagaaaaaggaccaataccatttagatcagtgttccctaaccagtaatctctaattgcagcatgaattggtatgaaaatttgaaggccactgagtgcaggctcttcagagaactgcatgtttacctacatatataccatatgcatacatttcaggaagaccagtcgtgcattgtgagtttaaaaacctctgcataaccaggaggtggtgtcacacccctttaatcccagcacccgagaggcagagaggcaggtagatctgagttcaaagccagcctggtctacagagccagttctgggacagccaggaaacacagagaaaccttgtttcaaaaaacaaacggaagtccatcactcaaacactggaccaccaaacagacagcatacaccagctgatatgaggctcccaacacacatacagcagaggactgctgggtctgtgttcattcagagatgatgcacctaaccctcaagacactggaggccccagggagtttagaggtcaggtggggtgggggctgggggcatccacatggagacagggtggggtggggaggaggtatgggatggggagcagagggagaatggaggggggcagggaatggaatatggagtgtaaaaaatagattaaaaataaaataaaatttaaataagaacgaaagaaaaaacaaatggaaaaaaaaacaccgaaaaacaaaaacaaaaaaccttttccccagttgttacagagatcctgctatatgcctgtcatggtcacagcaacttgaaatgaaagccacggaaaggattctcaaaaatgcatgttgttgtatactcatggtctgtagccctcagctactgttccaaatatttttttctgattaactttcataggcacaatttcataggcatttttattatgaaaaagagccacttaatacccatttgaacattactgtccttactcaaaataagttgtctcattttaacaaattctagacttttcaactttaggcttcttaaaaatgctttttcatatacatgcatataataacaattaatgaaaaagaagctatgagagggaggaaaggctgggaagaaatgatggaattatattacaatctcaaaaaagaaaaaagatgaaaacaaaatacgcatgttcagctctcaccccaacaacttaattattaatgtattaattaatataacatttattacattatatcacataaaagctctaccttgcttacttttctcctgtctgtatctcttttgtgccttgctgtctataatatttcacttagccaagggattgagaaaaatagaagactgttcttggaaccaattgttaggtatggtgatagggtcagagacggaaatgacagatatgttcatgagacctttgggattcatgggctttttggactattagtcatcctggagtgagttaaaagatttcatcctggaactctagtatcatatattaaatgccaatctctgtaagcgctgcaaaaacaaacatatggcacatctgtgctttgcaggaggaatggtaatatatggaatccctatttatgaataaatgcttctggcatttttgtcttagcagtttggactattatagagtttgagggttagtagaatctaacactgaatgggtctattagttatcatttacagtacaattcatcaaatgtttttgagcatctactgtgtgctaagcattgggatattggggatagcaagagaaaaaaacataaaatgaattttcctgtcataggaaattaggtgattgggtcttctgactatttttttttaatttagtacaccttttctactgtctctgtattctatatctttgaaaaataagtacagttttcttaacagagcagaaaattcctcagtaaatagataatagatcccagactggaccgagacaagatttctagcttcttagctttttttttttttcttcgtttttcgagacagggtttctctgtgtagccctggctgtcctggaactcactttgtagaccaggctggcctcgaactcagaaatccgcctgcctctgcctcccaagggctgggattaaaggcgtgtgtcaccaggtccggctccgaattctagcttcttaaacctttggtttaataggctccattgaatcaagagcaacatgtttcttttccttgcagttctgaggaagatgtgctatccttggtttcattggtgatgtgggattgcaaaagtagcattcatcattatatattgatgattgccctgagagtacaaatctatacatgtttgtgtatgcagatgcatgtgagtatgcaggtatgagaaggacagagatggatggacattgagtgtcttcatcaatccttccccaccttgttgtgtctaagttttaaaattaaatttattctttacaactttatagatatatactgtgttctggttacactcaccctccaccctctatttattatttccctgtcatccttgccatgcactctctacaagtccctatttcacatttatgccctcttgtgcaccttattttttggaacagggtctcggtgaacctggaacttgacagttcactaagtggtcttgccagcaactctctgggatccttatgtcacctcttcttcagtgctggctttactgcacctgactttttatgcagatgctgaagatatgaactcatgtcctcaggattgtgcactaagcactttactgagtgctccagtgccccagtgccctagtgccctagttgcctgtctttgactgagttagtttttaactatgtggctggtggatgtgctgctatggatgctatttaaaaaaaaaactttcccaaaacttagtggtttaaaataaaataaatcggtattcagttgctgtggatgtcagtagtctaaaccgtgtttcactagactaaagtcaaggtgtgaaaatagctgtgttcctttcggaaaccataagagcaaaactctatttccagccattgtttagcttctggatactacttatatttcacattttgtgaagactttctatattcaatccttccagtggaggactgatttccccacatctcatcacttcaatattgtttctatctgcatctctgatttttactcttcctcctctcccttccacttataaatactcctataattgcattgcactgcctgaatagacagtctccccaactcagcgtagtcgatttgccgccttcacgatctacaaccttaattcctcttatgccatataacctaaagtattcacaggttctgggagtagcatgtggacctttttgcaataattaatagattagtaggttaataggacattaaaagacaaaggggccttgtgtaccactcgtccagttcttccagttgttcaaccttgcataaccatgcataatatcaaaaccatgaatttgccttagtcatactgactgtatagttccatcccgtcatatcccatatgcatgtttgcataactaccaacatgatcaagacaaatattattcatcacaagaggtttgcttgtgctttacccattgtagtttttgcacttttactcaatccatatcaaactttcatagtcactattccattttccatatctatagtttcctcattccaagaatgttacatgaacggagtcataaatgacatgagcttttcatggactcctttcacgcagcataatgccccagctccacccacatttttgtttttgttgttcttgtctgtctgtttgtttgtttgtttaagaaaggatctgactatgtaaccctggctagccagaactcactatgtagagtagaatggcctctaacttagagatctgcctttctctgcctcccgagtgctgggatcagaggtgtgcatcatcaggcccagtcatccaatttgttttgtatgtaaatagttcattccttcttgcaattcaaaagttttgtatagtatcactataccacagtttagcttttcacttgctgagagactttgcttatctacacgttagtctatcaacacacaaagctgctataaacattaatgtacaggtttttttagagaacacaaattttcatttttctgtgatgaattttcaggtatgatgactggtgtgtatggtaagtacctgcttagtttctttaaaagcaaaactaattttgaacaaactatcccaggttgggcatggtggcacatggctataatcttaacacttgggagcccaaggtaggaggatcttgagttggagaacaacctgagttacatgataaatttaagtctaggctgggctacatagggggacactggttcagaaagcggcaaggaaaggagaggagagagaaagcattttatagagtgccggtctataacttattatagcttaggaagattgacattttggcactctatattatatttataacctaatggttttaagtatttcttctttatgtatttatagctatatcagatattataatttttgcttcagctgtaaaacataattgagacaggttaaccttgctctttctgttgttattttttcctgagattccaagatcgtgtttttgcactttttttcctgtttagagaacatcatttaacaattatttcaaggcaggtttacgagcaagaaattctaactttcttccctttgaaaatttctttattgcccttccacagtagtatattttccgtaaagtatattttcatgggacctgaggttcaaggttgacagttctttttatgaatgttcttgagaaatatgtcattctattctagcttccatggattctgaggagaaatcagctgtcattgtaactattttcccttgttagtaaggttacatttctctctttactgctttcaaggtattattattattatttaaagaagtttgaccatgatccatgatgtggctcggcatgcagtttttgaattaacctactttgaaatatagttaggtttttgagtatgaaggtttgtgtgctttgccaattttaagacttaacaagaaaaagaaaagacaagacaagaaaaggaatatcatttgaaattcctgacccacctcctatcattcttggcttcctctgatgacaggaaactttttgctttagttctataattcctagaggctctggacattttcctgagtctagtcattcttttttacttggatgaaatgattcccatcattctagtatgttaactgattcatttcttggctctttccattttgcccaagagaaggtttttctgtattattgtatcttatctccaaaattctgctcttttctttatatgctctgtttttatattgtatttttctctttgttccaaaagtacttgtaattgctaattgaaccatttttgtcacaggagctttaaagtctttggtaattctatttattttattttttattttcttattttttgttttcaatacatcccaactgcagtttctttctcttcccaccccttcttgtttcttagtacaagggagggatgcctttccttatttaaattgtcttgttttgttcttgagccaaagctccatactgtagtagtgtaggttcctgtggaactcactgtgaaattcagactggccttggactcaccgcagtcctccagcattgaccacaagagtgctaagattactgagcttgatgaacaatttattttattgtttttatttctttttatttaaatgtacaggtgttttgctgtctgtatgtgcatcatgtgtatattaatgaccatgtaagggaagcagcttcctcttcactctgacttttgcataatggcaacattttccattttgaagaatcgagtctcagaaacattcaagtgagtttctcagagccacacaacacactactttgagccatagtgatgattataggccagaccatcatcttacttccaaatgcatgatgcctgtttttacccatagcatttaatactcagcttcacctgactcatttcccaacctgctccttctcggttctcaatagagcctttaactttccctttgatgttgtttgactgcagctgttttcctggtttattgtgtggctggagcaaggttagacaagagaggcttgagctcctttgtgggaaaggggatcagagagggaagaaatatttaaaacaaccattatattataaggtaccctcaaaaagcaaagagagcctagagtttatacctgagacataagcgaaaagggattacagaaggggtcaggacaggaaaccagaagacactggattgataaaagtaaatggattcaatgaccaataaatatgcaacaaagaggccaagattatagagatttcttccaagttgagataataaagattattttttgactatggtaataacttgggagagagagttaagggaggaaataaacagtgtctcttcattaggttcaactttcataacagaacaaagtttttaaaaatctcaaaagtttaagttattgtgagaaagtgaattcagaaaactatgttccctatatgattcccgggaaccagtgtgatattggttcaaaaaggaatgacagaatacatctgggtgtgtaacagataccatgaaaaggtaagtggagataagcattgtctgcaaaactcagttaaacaaaggaatttaaaagtcatacgacaataaagtggggccatccaggagccctaatcctgaaagagacacgtttgttcagtctctggcttacagaccagagcagaaatgtgttgagtttctttggtgactttgatgtatcaaggctccaggccctctatcttatctcactaactgtgtcttttttttttctctcttgttatttttttctcgtcttttcaagttctctggctttaaggttaagttcatttgtcatttatcaaaataatccctgaagggtaggagtgtagctcagtaatagaatgcattcaaggtcctagatttgatgcttgcactgcaaaagaaatccattaacattactgaagtatgtagaaaaattccaacattttttctttaaacttatatataattttgttttgaataagcaaaagtattgcaaaacactgagaatcgataatggatatatcctcagcttgacaaacttcaatactttgaatgtcagtttgctttcttttttggtttttcgagacagggtttctctgtgtagccctggctgtcctgaaactcactttgtagaccaggctggcctcgaactcagaaatcctcctgcctctgcctcccaagtgctgggattaaaggcgtgcaccaccactgccaagctgtaagcttgctttcaatttctatcagaaagagaaaatgaaacatagcaggcaagttaaattctgtccccaagcctaatcatatttaccttggtttccagggacaagcataaagataaatttggtgtgtattttctattttgtttttatacctctgtacatgtagttataaccataaataatatataaaactattcagtatttttaattttatgtaagcaaaatcctaaattatgtgccattctatttttttctattcaacaatttatttggagattacctttttaaaatgttctatgtcttctttgtgccttagagtcaatggtgcatgtacattatttttctttataaaatacgcacaatattgttatacaaaaattgaaaaattcaaccaattgaccaattcaacttgcaaagattctagacagctcatttagcccagtggttcttgcaataaaatactgaagagcaaaatgagaagggtcctgagagataactctttgccagtttcctaacacatttatgaaggaacaaatggaccaaatagaaggaaaaagaacttaacaagaacatacatccagtattatacttgagactccctggttccctgttctatacttgaaacttttcgaaaaacaaacagacaaagaagcaaacaggatagatagatagaaaaagaaacgtaaaattacaattttaattataaaatgatttattttgataaaatatgaggaatacagaaatgtagaaaaatgaaatctaggacttgctatattttagtatttttatttctttccctatacagtttccatatttctgtaattgctaattttttcttaaatagatataggttatatttattaattaatatatgtcttaaatagaatagtttaaaggattataatttcagaaagcatatttttcagaaaggtttttatgcattgaaatcttgtcagcaaatattttagggtatttgtttactatttagctattgcaatcatatagacagtaactacctgatcatacttgtctgcactattgtttgtttattcctgttcattgggcagatctggttactttaatttttaattataatttatctgtatgtgtgtttgtaattatatttattttatgtaaatgaatggtcctagatttgatactagcactgcaaaagaaatccattaacattactgaagtatgtagtagtatgaagtatttacttacatctacgaatatgcaccacatgtgtctagtatccgcaggtattagaagaggctgtcagatcctctggaactgagattatagatgattgggaaccactatgagggtgccaggaaatgaacctagaacttctgcaagaagaacaagttttcttttttgctcatttatatatatatgcatgtaatagtaaagatatatatgctttaatatgtttgtttgcttgaaagcttgcatagcaccttttggtactatgaaagttagtcaccagggttttcaggtgagatacagctaggatcctccaaggcttgtgtccaaagtacataatgttttcagtaataagagctttacctttgggaggtaaccaagggctacagcaatagcctgtattgtttggtagtctcttggactttcctgaccaacaattcaaaagaaggtttctagtgcctggtaatgagatttttgttagatggtctgtggctcttagggcagggagaatcattatcaggccaattgacataactttatttaaactatacttggataagtatacatgtaacttgtatatagtatatgtaattttgggtaagcaaagttctgagtctttctggctttttcaagcatccttagtgttatttttctcttttcttcctctccttctgtattgccctcctatcccgcccccattaaagctccaaccttttctcatataccccttcacatcacctgtaccctgctgttctcctccagcacaacccatggtaccttttgacttccatggcttctacatttataccaggttatctactcacatctgaagatttggagctaggaaatgcatatgagagaaaaaatgtgatgtttgtgtttctttttttttcttttttaaagactaaatctatttatttatttatttatttatttatttatttatttatttatttattatatgtaagtacactgtagctgtcttcagacactccagaagagggagtcagatctcattacggatggttgtgagccaccatgtggttgctgggatttgaactccagaccttcggaagagcagtcgggcgctcttacccactgagccatctcaccagcccagatgtttgtgtttctagatctaaattacccagtcagtatatttcctagttccacctctttacctaaaattttcatgatttattttaattttgtttgcaattgaatagtattccattgtgtataggtaccacattttcattatccattcattgactgaaggatatttagtttgtttacatttcctagctctatgactagagtggcagtgaatgtggctgaactagtatctctggaataagatgttgagtcctttgggcacatgccaaagagtgatagggctgggtcatatggtagatttatttttagctttttgagagttctccatactgatttccagagtggctgcaccatgataagatattcctaaggattaaatagtgccactcatatcttggcaggaactaactgctgtctagttggacttaaagcctgctcaacaggagggaaatcatggctgataagatactgtaaacctagccaactccctggggctagtgaagtcgtggatcttagaggagaacctactacaactactttaataaaccagaataactcctaactgaattctaaacacttatctctagacccacagataagtccaactttcacccttcatcaaagaaacttctgtcttacaatggacagagaccattatagaaaaccacattcagtcaaaatacagttaacaactaatctctggggtacccacttccagcaaatacatctacaacacaactcctgtacctaagactcaggaaacattggtaatgaaaggagcagaaagattgtaagagctagaagaccagggaatctgtgtgagattatgtctcctataaatggcagggaaggttcacgcatgatacatcagcaatactgctgcctaaacaagagctgaacaaagataataccaatagacatgttatcatggaaggggccaatctcatgggtcccatccattgacaaagaactatagataactaagaactgccaagagagggagacttagtcaccacacagatgagctgtctagttggttactaaataccaagtagtcagccctgaaatcatatacatacaaacaacactaaatggacccagaaggttgtattaaaaaaagaaaaagaatttgaaaggaagcaaggaggtagagatagggattggagggagaaaagggaagggggaaattatctaattctactttaattttcaaaagaagagtaacaagcttgcttaatccactgagccatcactctaactcccatcccagatctggttccttaaaagctgacatcaaaccttagattcctgaaaaaaatcattctggacaattagatagccatctggagtgcttgaggtctgaccaatgacatggaaggaaatcctttcacctctaaaataagcatgttttggagcacaaagggagttccttctagagctgctggttccatggaagtttaccttggggaataaatagtagtgatttattctgctccattaagtgggctgggatgcttaatttctccacagctggagaataaacgggatggaaatcattaaaatgtctttatcacttactaagagaggagaggtacatgtctagacaacttgtatgcatacatatacacacaattaaaaattgtttacagttttgtttttatcatttaattgtaatccatgcaaagtgcattcaattgtcaggaatttctggaagaagggagagtggtagtttattttgtttgtttttggggtgtgtgtgatatacatgcatgtatatgtgcatgcgtgttcacatgtgtgtggtggtacatgtgcacatgtgtgcatatggaagcccaaagtttgtatcagatgtcaccttcaatcatgtttgaccttatatagtgaggtcttgctaaatccagagctcattatttaggctattctgggtcatctgttaactccagggattatctgttccttatttgttccaccttttgtgtactggcattacgaaaaagccattatgctcttacctgctggtattatacacaggcaggtataatcatacccacttgacttttacatgagttctgggaaatctagtccttgctgagccatcaactcacacctggtgatagatttttgttttaggcagttgaacatactgagacaacaaagcatggagaaactgagcaagttgagtatcacacagcaaaaaggtatgatgttgatattaaaaaataaaataagtggggtacagagtggttaagatcagtggttaagagtgtagagacctggagtttggttctcagcactcatttcaggtggctcacatctgcctgtaactccaagtcaaagggatctgatgccctctttttgcctccatgtgtacaaacccacacttagacatacacatatacacatatttttaaaaaataattaaaataaaaatgaaagtgccattatcttttgtctcttaattcttacatttctatttttatttttcttctatttctattgtatgttgggcacatctatctatctatctatctatctatctatctatctatctatctatctatctatctatgtgaggccacatatgtgccacagtgagtatgttgagaccagaggacaatttttgagagttagttctccctttctgccatatgaggggatggaactgaggcatggcaacaagcacctttacccaataagccatcttggcagttctcctcccaggtcttggaccttgtaaagctgcatcttagcccacgacaactcacccatggttctacgttaatcaatttaaattggtgctgctttgcccttgctgccctgactgtcttaattttggccaaatggcagctcacagtagttgttatgaagccttgccaattttaattgttctgttcttatctccagcttttgggcagggctggaaaggtgctagagtcatgctagttggtagctacattttgaccccaaatttgtccaataatggtttgtgtttggaaggggatggtgttcatttactattgtaaatcagtgagaatcccaggattgagaacatcatgcttttattttttaatataatttattatttatttttagttattctctcacacattttcatccacattctagttttaaataaaattaaaaagactcctttatacagaatcatattccctattaaaaaagatttttttgtttaaatatacctatttctaaaaccgcatagctacagccacctactttttgacaaaggtgttaaaaatatacatcagaaaaagacagcctcttcaacaaacgatgctgagaaaacatttgcatgtgcaagaatagggctaaatacatatctcttatcttgcacaataaccaatttaaactggataaaagaccttaataaaagaatgaaatgctgaaacttcttgaggaaaacgtaggtaaaacacttgaagatacaggaataggtaaaaatttcactaaaagcaaaggaaataaacagcgagtgaagaaacagcccacagaaagaaaaaatctttgctaactatatgtctgtctttttttttttttgtaatcaacttgacacgctaaactcagttgagaaaatgcttccatcagatagcctgtagttaagtctatagtgcatttaaaaaattactgatgtggaaggcccatcgcattgtttgtggtacacccggggtggttggtttgtgggaatatatcagaaagcagactgagcaagccatgaggagcaaaccagtaagcaatattccttcgaagtctgcttctgttcctgccttcagattgtgccttggcttcctttgatgataggctgtgctatggaaatgtaagtcaactaaaccctttcccctccaagttgtttttagttttggtgtttatcacagcagtagaagctatagctaagacaatttcagagaggggattaatatctagaatatataaggaactcaaaaataggtgtcaaagctcacatcaaccgataagtgggctatgaattgaacagacttaaattaagtaaataattaattaactttacattatgacttcagtttcccctccccctcccagttcttctccccttccactcctcctccctttctccttagaaaagggaagacctcccatgaataccaaccagctttggcatatcaagttgcagcaagactaagcagctcttctcatattaaggctaaaggaggcagctcaataggggtaaagggtcccaaaggcaggcaacagagtcaaagacagtccgcattccagctgttatgagtcccacataaagactgaactacacgcatttcttgaaagaaacacaagggataatacatatttgaaaattttattatctttatccatcaatgaaaactacactgagattctatccacagtcaaaatagctgtctccaagaaaacaaataacagatactggtgagggtgtggagaaagaacctttatatactgctggtgggaatataaataaatgtagccactatgacaagctatatggagatgcattagttatttttgaccaaggcaactttagaagaaagagtttatttgggctcatggttccagaggcataaccatcatgatgggaaagcatgacagcttacatcttgacttaccataaattaggttttaataggaaatgtttatgggtcaaatatcccatgaagcataataacacatgtgagaaagtaagtctgaaatgcaagaattaaaataaaacctcggtttttttgtatggtggtagataatgattgattggtgaagccagaacctagaatgtgtgtggttagctttgggaataggagtgtgaacagaacaaaaattaatgttttctaattgtccttgcctgctgcagatattaagcagctagctctgtgttttttttttaaaaccatttatcaaatactaatggaaaggtgctgaggtgtcgctaatcccaaacagtatataatccccaagtcattttattgtaatatcctgtcatacatccacaccccagtgccccttccccgctgttctattttagaagattcggagactgcactgagagatttggcaaatggggtcaacttttattgctgggctgtctgtgtttattcacacacagggtaagaaatttgtaactgtcttgtcacatttcctttatatgtgctctagtgatctgggaagaacaaaaactctagagaaaacttttctcctttactatctggccactccatcaatcttaatatcaatttggacaaagtataaattgtggtgtgtacaaactatttcaaatcagctcctcgggataaaagattgccataccaaaagaacctgaggcttttaaagtgttttgtgctgaaacgaaatagccatctatctgtggtgccacctactggccagaataggaaggagaaaggagcaaatgggaaggactgaatttccttccagtccatgttggccttttcaacttcagtgacaaatggtgggaagaaacaggtgaatgtggacactatctatccctgcttggagagtagagcttgttgacaattgggagcacctcatttatgttaagtcttagttttaatgtgttatgggtctctaagaccgagaacttgggaattgtgatgatataattgagtctcctagagaggaagggaaaatgaggcagggttttaactatcaaaatgtatgagcactttttgtttgccaatatggagaaaaaactaagccctttcgaacataaataaataataaatgttataccccaaaattattagcttttggaaatatggttaatgtgtttttcttctaaattaggaagttaatggcacagccaggtcagctgtgaatataaattcagatgggtctgagtgatcttgtgtttaggcagctagaatctttacaaaatgtctgatgagcccaagatgaaactttgagggaaagcgtccacactacttgtagatgctatcagattttgtatagacatatgctgagtagttaaaaattcttccaatttgtttcattacagttttcatatcttactcttggatgaaatatcttcctattctttctctgacctcatcattctgcctcatatgtgttgaatggatgaaattaagtatagtagttttaatttgaataattttattgacttggcttgcctagctgtgactttacagctagacatgtggtagtatatataagtcttactaatcagatgtatcttttatgtctataaacacatgagggtaaaaaaacaaaatgcctggatttttagtcttctgtttgctttgtaccaagaggcctaagaactatgtctactttatcttctctaatggtgaaataaaacactttcactttttctattaccagaaattttctgctttttggattattcggttttctttactcctcaactgttcagtgccacatctaacaaagcatatggtttttctatcaaaggagcagtcattgctcttaggtatgcagggggaaagcaaaaattacaagggttaaaaaccaatccgttcctttctggtatttaacttctaagtcagcatctttttttttttttttcttaaaaaaaaaaaaacaactgtctggctttccctccttgcctaccctcactcctatacataaatattttctcctttttgtttctcctttcctcctttgctaatattatggatggactgacagctcaaaaatactctaattctttttttttttttttttagccctggctgtcctggaactcactttgtagaccagactggccttgaactcagaaatccgcctgcctctgcctcccaagtgctggcattaaaggcgtgcgccaccactgcccagcaaaaatactctaattctaaggaactagatttgttctttgatatttcattgcccccgtggttttaattaggtgtaaattctcctatgcttgctttgaaacatgcctcaggatcttagtgagattaatgcagggagatgtttctctcttcatggtgcccaggcaacatttattgtcattaaaatagtgtcattcaaatgaggtggctgatattggaaaataaatgcaaggttgtttgttgttctgggtctgagctatggtgaagaggtggaattggaggcaacacttgaaccctgcttatgcagtatgtatctatgtatctatagctcaatagaagactcctgacatgaggacaaagcttctaagactatattagggttggggcatgaagatacctgtctcttctgctttccaagctgagaggaaaatgtgaaaaaaaaaacatgcaaagtagccaatgtactcagaaggaaaaaagtgggtatcttctgagccctgggtaagatcctgggtaattccttttgccctgccaagtcctggaagccctataatatttttttctttcctaatcaggttttcttctggtggccaggttaaagagaaattgattcctttataggcagtgtttagcttttgtccttctgcattcaggctgtcaattgagaaaccctcttttagtctgtaggactgcctgctgatgtttaggcttaaacattaaacaatcttacagacctaattagtatttatggcttgtggccaagtcaactaattttgctttgtagaatttctgagaggaaaaaaaaaatcatacttagtgaaactcccttcatgatatctccttgaaaattgaagtgttgctgacctagtggaaatatttcgtcgtacactagattgggaacaactctcacaaaacatacctttttatactgtgttctttattacatcacactgggttaagctgtgaagagatgaggacgatagtggccattttttgaaaagtagaatagattgaatcaaatgtgtagagaacactgcttgattgatttgaaactgaaggtctagcctccccagccccttgctccatggcagcaatttcttcttggctagagacctaagcatctgtgtccaaatctcatatcctttcctggatggattcagcaaggcaaaccttgagttgcttagagttattttttttcaccattccctaatttaagttaaacttaaaaatgaaagccattaagtagcaaaacaaacaaatacaaggataataagagaacattttgtcctggccctcagaggtcactttaatgtgactagcagcataaaacttcacaaaggctttcgctggagggttaccagaagctgcatcattcagtgtgttgccatatactgctattctttcactttggcattatttattgattgtaacaggagcacagtatttgtacctattaagccttttagtttcctttcagcttttcctgagtaaaagtagaatggcacccattattgttgaactgttctcaaggctaaaaacctcctgaatgttgtttacatgcatggttacaaaggcaagtactgaggcagaactgctttgcctgatttgattcctatcaagggtaatgtgcgctctctctctctctctctctctctctctctctctctctctctctctctctctctctgtctctgtgagtgtgtgtgtgtgttcacacagaagaagtgagtgagtagagttttaaggaagggagactggaaagaaaactttcaatgaattaaaactacatactgagaagatcctgaaatttaattaggaaaagatggctgtgttttttctctcacctcctcctcctctctctctctcctttccttcctccatccttcactttgtaacagcaccaaagtgaaatgagactattcgattgaagctgcacacccactgtaggtctgttttgagaaaaggattttttttcctccccacatttacttggtggtagcagcagcagcagcagcagatctattgatgaatatagtcgctatgtggcatcatgccagtgttgtgctcatttccatctcttctgtactactctctggttgggtgagcagagtccaagctacaagtgtgttcacttttaatgtatcctgtggtttacagtgtgctcattcagtgttcaaccactaaaaccctctgcttgagagagctggagatttagtttctgactttagtcagaaactcagctttagtgtgactgtgcagtgggtttgcccttatggacacaggatctgttgggaacttttggaaaaggaatagaacatgtttttaacctaaggaataagaatgtgtttgaaaacaaatacacaattctaataatgcattttaaactacaattgcatgacttaacttcgagtttcctctttaaattttaaatttttgtctttagagtgcgtgtaccaaaatccattaataattttcaagtcagtaattaattgtcaacttatctaaaccagtgctttggcattttcttggtcttttctgactctggttttggttttgtttgtttgtttttttctagtatgttcttggttataaaattaagctggacagtggtggtgcacacctttaatcccagcactcgggaggcagagacaggtggatttctgagtttgaggccagcctgatctacagagtgagttccaggacagccaggactacacagagaaaccctgtcttcaaacaaacaaacaaacaaaaaattaaattataccttcttaagaatggtggatggtcatttggctttaatacattccatgaaacccctcctgtgcacattcgggtataacttccccacatgtgataaatacctctccagctggtgaagagaggcataaataccagaacatgattgaggtcactggatatgcacccaagttgggagaagagtaagaatatatatgacgatggtgagcctgcaagaggaactaggtacctgaggggaaatggtattgggtagcaaggacctagaatagtggttctcaaccttcctaatgctgcgatcctttaatgcagttcctcatgttgtggtgacccccaaccataacattatttcattgctacttcataactgtaatttacttttttgctactgttatgaatcataaatatcagatttgcaggatatctggtatatgccccctaagtgtgttgcaactcacagattgagaactgctgacctagaaggaagacaaagcaggctgaaaagcactgtgtacttagttatggtcatcaccaaacaacacttcctgcttcttgtttcttatttctgagatgtgtacactgtatagttcaatgcacagaagctctatacagcattgatcatttcattcattattattattattatttttttttttttggtttttcaagacagggtttctctttgtagccctggctgtcctggaactcactctgtagaccagggtggcctcaaactcagaaatccccctgcctctgcctcccaagtactgggattaaaggtgtgcgccaccacgcccagctcattcattactttaataaaattttatcactttcatgggctttattggctcttgttgatatcttttcaaatcttagaactagatgtaccatttctgggggtgtactcttggaagatgaatttaccattcaaccacatacacacttagcagacattttaaagacccacattctttattatcctttgtgatcctaaaattctctgttacatctgttactctgagttttatttcccttgttagataaacaggatcttctatttgcaactcagccttgtagcctaaaactggccaaatgacctagaacaacttttttttttttttccattttttattaggtatttagctcatttacatttccaatgctataccaaaagtcccccttacccacccacccccactcccctacccacccactccccccctttggccctggcgtccccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcgtttggatgctgattatggggtggatccctggctatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatccacgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcccattcttctacacgataacaaccagttgtgccagcaccaattgttgaaaatgctgtctttcttccactggatggttttggctcccttgttgaagattaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccatctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgtgttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctctcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggagggtctcagaccaagatggcgaccgctgctgctgtggcttaggccgcctccccagccgggcgggcacctgtcctccggtccggacggtggctggctgtccccggcccacaaagggtgctgcctcagcgcctctgtgcttccgcctgttccagaagctgtcaggttctctggcgcaccctctcacctgttcagactaatttcctaagttcggcgggtcccggaccaagatggcgaccgctgctgctgtggcttaggtcgcctccccagccgggcgggcacctgtcctccggtccggaaggtggccggctgtcccaggcccacacagggtgctgcctcagcgcctctgtgcttctgcctgttccagaagctgtcaggttctctggcgcaccctctcacctgttcagactattttcctaagttcggcgggtctcggaccaagatggcgaccgctgctgctgtggcttaggccgcctccccagccgggcgggcacctgtcctccggtccggaaggtggccggctgtccccggcccacacagggtgctgcctcagcgcctctgtgcttctgcctgttccagaagctgtcaggttctcttagaacaacttttaacttgcattattcctgcctcagtagtattgaaagtgtgcatcaccataccttagttttaaaataaacaaagctatgtgtttagataaatttaggaaataataaaatacacaagataaaatgatgtctttactacacatcttaaaatagtctttctggtatgcatattgtgattctggtacattactcaactaaatttgctgaaaatatctttagtaatactttttttcttttttttaaattagatttttcttcatttacatttcaaatgctatcctgaaagcccccaataaccctctctctgccctgctccccaacccacccactcctgcttcctgttttttgtttcaaggtgtgtagattggaactatcattaaaatttatagaacttggatatcttaggacacataatattgtatttgtaattatcgttcctgtgctcatttgcccattgccacttctgtgctccaacaaaaggaaacttttttatcctgatgtcagtacttccttccatgtcactggttttcattttcaaagcccaagaagttgctttcatatcccactccttcctttgctatatttctgctttagccatgctgaaaattcatatgtaccattctgatcctcacagagaagttctttctccgcttggcaggcttaaacattagtgggtataataagctctatataagcttgctgagacttctactttttaagcacttttatagccatcatctcatgggatccatgagaccaccctcagtaggtaatcagtgagtgaagattccattctagctcaaggccatgcagctaaacgtaggggcaatagtgtttatagataaataagttttactacttttaactcaccgtcaattcctcagtctaattccttttctgcttttcttttttgaaactcatcatatataagaattgcttggcaaatatgagaatttgctgagagagcaaatttggaaaactgagtggagattacacatggatgtctctggctgggtcactcagtgcttcagtattccatgggaagttatgatgaaaaaaaagtaccaaggcaaaccttgattgagccatcacaaagaagaatcattactagatatctaggatcctttgctcttgatgcaaaggtctacaaaatcatgaaaacccataagctcctccctgattgtcaaaggcctactggaagaactgagaaaggtaataactagttggtcctgtgtatgtttttcggacatgattattggagacaggctacggaaatcgttttggcacaagacatacattctcattgtgggaaagtttgcttttttggacatctggcaatgtctagagacatttttactaagaacttggttgctactgacatctaatgggaagagattaaagatgcttctaaacctacaacccatccctaccttacacacacaacaaaaactaatccaacccaagacagagaaattctggccttagcctctctttacaaaattagtttgttctctactttcacctccagtacctgtactatgtatgtacatgtgtggatatttcttaaatatccattttaaaagtctacccacctaagaatagccctcagatagtactgtgctccaaagaaatgattgtgcgtggacttgatatttacttggagtgagtattaggttcatgtgggatttcaggtataccgcacatataggacacaggatcacctgctaatactcatgtggatgttttctatagtttttcattactgtgataaaatactaaccaaaagcaacttgggaggaaagctctttccttttatactcccatgcccagtccatcactgagtgaagtcagggttagaactcaagcaggaacctagaggcaggaactgaaacagaaaccatgatagaatgctgcttactggcttgcttcctgtggcttgctcagcttgctttcttaaataacccagagcaacctgtcagaggtggcacagcccactataggctaggcaccacttctacgtcaatgattggtcaagaaaatgcctcacagaaacaaccacaggtcaatgtaatgaagtcaattctcaatcaaggttccctagtttgtgtccaggtgactcaaactaactatcaaagtgcttcttatcttgttgattttccagtaattcccaaacttcataggcctcaggtactactttggagtaagcagaaggggttgtggtaagctttgagatataaacctagtggggattgcttttaagctctctgaatgcaggtggcttgaattctttttttaaaagatttatttatttattatatgtaagtacactgtagctgtacttcagacactccagaagagggcgtcagatctccttacggatggttgtgagccaccatgtggttgctgggatttgaactccggaccttcaaaagagcagtcgggtgctcttacccgctgagccatctcaccagcccaattgggagcttttgtttgtttgtttgtttttcaagacagggtttctctgtatagctctggctgtcctggaactcactttgtagaccaggctgacctcgaactcagaaatctgcctgcctctgcctcccgagtgctgggattaaaggtgtgtgccaccacgcccggctcaaattctttcacttaaataagttgagctaagaggagtcggtgaggagatagtttcagtgattgttgtctgggtttttttctcagttatcttacatgtaggaagatattttaaccaattcagccactacagctgtcaatgtggaagaatctaaggagaaagccatgtgcatgagcagaagaagtatagacatttggtgagcatccaggtatgtttgatcttttgaatttgggcttcaactcagtgtctttcatttgtataacagtttctttccactcttaatttctcttgactaagtggtgattaagcatttcaattttggcattatagataataaaatggaattcattcttttatactttactgtggtactggtgcctgagtaccagacaccaatgggtattggactccacatgtgcacatgccctgtgtgatgggttgaacaagaatggaagctataggctcatagatttgaatgcttagtccccagttggtgaaaccatttggtaaggattaggaggtgtggcctttctagaggaggagtggccttattggaggtgataggtcactgagagtgggatttgatattacaaaagtccatgccatcccagtctccacccccctccccttcatcttgatccacaggcagcagaaggggactatgtgactgacttgagcatatgaccacaaagctctgcctccacagtggcacactgcctctaacaaggccacacctactccaataaggccacacttcctaatggtgccactccctatggccaagcattcaaacacatgaatctatggggacaatacctattcaaaaaaccatcactaggtggtagaaagagtgtaagagtcaggggggatggaggactccaagaaaacaaggtcctctaaatcagcccatatgaactcagagaaactgagacagcatgcacagggcctgcacaggtctgcaccaggttctctgtgtagaacattttcttggtatctacatatttatatcgataaagatatgacccttcgttaaatccccagcactaaaagaacagattagctgaatggtggcctaggaaaatgactccatttctcctttatttcaaatttgtcaaaacaaattatcaggttggttaaagggggaaactatgtagccctctgaattcagttatcttctcagaatccttcgcaacactggcgttcttttgattgtctcctttaatgactgtctcaagcctgtcttcttttcttctgagtagtatccctttggtacctaacacgcgacagataggaattgtttgggtttaatctgtcaaagtacatctaagcgagaaccatcacaggatagctggggaccacaaagagatttccttgcaggaaagaccctgttaattaaattttgtataaagactcaccagaaacatctttttttccaagccaaaagttataagaatttcccagagagacctcaactatgggcttttctgtgaaaatcaattagtgttatgattatgaaatagctttcctttaaaaaaaaacatttgtcacaacgaaagtctacaccttatcataaagagaaaaaaatttgccttcacttttttgcctttcaattctctttttgaatagtctacaacaaatagttattttgtgtgtgtatgtgagtaaaactagaacctcatatatactaggtaagtgctctgtcactgaaatgcattcccacctaaaatatatttgaaatggttattttctagtggatagtacaatagatccctttcctatgctgaataacctagtcctctaaatgttgtttctacctttagtcacacacacacacacacacacacacacacacacatttttgtgtcctaaaccaaaaactttcttggtccaggagcctattatctacttatctgcattaccataaccttctaatttcttaatttatttcaactgataaacattacttaatattagtctattttgtgttaaagtgtcttaaaattattttttctttttacataattttggttgaacagtacaaatttgttaacagaattctttacttttaacttaaatatttcaactaaattcaagaacatttctaaatgctatttctttttttggataatttgctctttattgatctttttttttccttttttctgcctattggctccatacctaccttctatttctacatattcaaatcttccccattcttatcctacttaagcaagtgtatatcttgagaagacaaagactttcttatttatgccactaaataatgccctgtaactgaatacactaaacttttaaaaaatgaatattacataactaacttataaagagaagatgaactatgcatccaagaagcttttcttggtcattgtcttttcttttttgtcaacttatacaaactagtatctgggaagaaacctcagttgagaaaatgcttccattagattgcctataggcaagtctttagggcattttcttgatcaataattggtatgggaggcccagcacattaaaggtgggtgtttccactcctgtgcagatggtcctaagaaaggagactgagtcagccccagaagcaatccagtaagcagcattgctactatttcagttcctgcctccaggttcctggcttgacttcctgttctgactttcctcagagattgagtgtaacctgtctgatgaaataaagcattttctcccaaattgcttttggtcagacagaaattggtcatgaggtattgctataatagacatagccttgttgttttggagaggattgtagcaggagtttggaatttgggggtgggaaatctgtgactgttcatatcataatgggctattctgttggggcttggaagatacaagtgttgagattaatgtagatgatgggggcctggcttgtgacatttcagagggaggcaaagactatattagggtcatgtgatatatttgaaataagaatctgtggtgtctctcagctggagctgaaaaaatcggctgtgattaacaagacacaagcatcattgaagtgaaacttacattgctgggacaattgatgctggttcactggggcatagaaatcagctgctattaagaacagacttagatcatgaggtgaattcttctgggagtatttccctgggatcagcacggagaagctgtggtccagagtagacaaaggctgcaaataatggaggcataaaaacttgataatgtgtaaagtatctcccgtggggtactagttttgaagacataagagggatcatggagaacatctgaactttagcactgtttgagagactagaaagtctgttggggaaagtgccaccgagtcccagtggggaccccagcatattggagatgacataactgtggaaaaaccatcaaggatagcagtacctatgagtggaactggtccgagccaacaggacaaaaactgtgttgtggatgggaaagccagagaagtggagctgcccagggtttggagtttagaggattttgaatgggtaccagatgcaaagcactgaacttttacactggtgaagcttggtttgctttgatttggttgtgactataccctgacttctccctcttgtagtaagacattctgtaatttccttttcattttttacaagatcccacaatttattttggattttaaaggagacatggatattttaaagagactgaactttttagcatgtttgaatttttaaactggaacttttaaagttatttgtgttttgtgatgttcttgtgtttattggcacaataatattgtgatgttaacattaatatgagatattggggattgattaaaaaaggaagacttactgcaagtggctgtggttttgttatccaaacttctgtatcccttttacctttcaggcagatcaaatttaggaatgtgttcatatggaaactggactcctttaaaactgtcctgctgtccatagctcttttaaaaaaaaaacttaattatgtgggccacagttttgaaatttttctatttggcatgctgtgtttgctgaatgctataaagaaatggatgaatgcctatatttgttagaactgtgaaatggaattatactatgagtatttttatgctgaatcatcaccaccaaggtgggttgaagacccaccatattcagcctaacatgatgaaagattcacctattacaaagacatatttaaaacaaagatgctccggattcttcctaatttcaattagtatgttaggttgggttactataaagctttatcatagtctgagtgcttataaacaataaagtttacagttcaggatgctggaaggtcaaagccccaagagactgaaagtttgatgggggcttcctttctggttcacagccaactttgaagtgtaccttatttgtagaaaagtccttgtgaatgaaattttaaaatatcaaaatgaaaagattattatgaattatttttgtgtgtcctgtgtgtgctgtgtgtgtgtgtgtgtgtgtgtgtgtgtgtgtgtgtgtgtgtgttataagaaaggaagaatctccataggtctacagagagtgcagccctgctctaccttgattttagacttctggatttttgaactgtgaagaataaattgccatcatgtttttaggaatttgttacaaaaccataaaaataaaaacaattaatgtttcaaatccatgataatttgaggttaacatatatccagtaaaaagcaaacaaacaaaacaaacaaaaaccatgaaatttctgtcagctcatttgaatttgatttgtttatcatggaagaaaaatagcttgtagtgttgattaaagtattgcttttattacatttttattcatcttgtgggaagaggcacacataacaggtgaaaaaagtcagaagacaacccacaattgtcagttttctccttctaccatgtgggtcttgaggaataaacccaggtcattcagacttacttactgactactaactactaagctatcccaccagccctgatagtataatttttaagcaaataagagcactttttaccacaagagaaaaaaatacaaatatgaaaaaattaataatcctgaaatattatttaataagctataatattttgtctgtgaacaaaaaatttagtaagtaagcagtctaggtcagacatgagctatctattggtgattataagacaaataattcttccttagaatgtattcagttgataggaggagtgctcagtcaagcttggaacttaattgtctgatattttcattgataagagtcatttaatgagatgaataaagtgaacttacatgtcgtgtatactcaaatttttaattcatattaatattctattatatgctgttattgttaataatgtgtagtcttgaatagacaattttttgaaagaatagtgtgtgtgtgtgtgtgtgtgtgtgtgtgtgtgtgtgtttgtgtgtgtacctgtggaggccagaaaaggatgatacaaggtatgcactcttaaaattatatttcccaaaacgcacttgtaattgagggagtgagacaaggcctgtggactgtgattttgaagtaatgaacattcgctttaataaatcagcacttagtttatgttttctcccagtagtgtgcgtagcatctttcagcactttcaaagctatccagtagggatgaaatgtctagtagagtaccagtgaaatttctccttgtttcataattcaagaatatagtgtcttcagcaagtcattttatagagggtaatctatatcaggggcaatagcctgtagtatatgggtctacatattttatattttatagaggggtctatgggaacccattgcttagcatgttcagatgtggtaacccattccttgtagagggttggttgtcgtttttcccagtgtctgatgtctactttgggtatttctccccattacaggccaactgcattttagtgtttcatatatatatacatatatatataatatatgtatatattatacatatatacattcaattttaccatgcttaccataaaaaataaatcagcacttaaatattaaaatggatattgtcttctaaattggtcacattaggaaatatatacattagtcttacgaaattgacattacttaaaagtgttttggaattgtccagtaatattttcttcagatactgcaatatgttgctcagaactctatgagtagaagctatgtcacttggatcctgcctgcttgttcttttataaattaacctctttaaagtagagcacatgtgtgcaaaacctcagatttgttttcttttttttttctttttttctttttttttggtttttcgagacagggtttctctgtatagccctggctgtcttggaactcactttgtagaccaggctggcctcaaactcagaaatccacctgcctctgcctcccaagtgctgggattaaaggcatgcaccaacacgcccagctctcagatttgttttctaaagacaagtttgtttcaatgctttatgaacatattttatcagcattgaaataggacatctagacttttctattgcaatctacctcagcatacatggcttccttgcttccaatttctgatgagaagggttgattagaaagaaattgctatggatcaatatcttctgtgtgtttcctaatctctttatttttaagttaaagaactttctggccaatataccattatatatcaagtatatgtatgggttatgtattttgcatgtttaggcaaaagtccctggatcagaagaattgtttccaaggagcagtgtttgcaagaattcatctgcatacatattctaataacatcttcttaccacttttccagcctctgcctcctgcctaattctataaattagtttgactcagttcagttgtttgttatggcaacactgtactaggtacaaatttctgtttcatttagtctttgttgcataagaaactaccccaaatgtattcatttaaaataaaaaaaaacaaaatataaagagccaattaatatctgagacacaactaatccactagtaaccatttatattgttagacagtcctgtatagctatgagataaaatgtggacatggccaatatagtacatgaaacatagagcaaatatatgataaatatttattatctgcttatgtagcttaaaatgtagctaatttctaattgtaccccattctgcaacaaaataaattattattattattattattattattattattattattattggtgtttcaagacaggttttctctgtatagccctggctgtcctggaactcactttgtagatcagggtggccttgaactcagaaatctgcctacctctgcctcctgagtgctgggattaaaggcatgcaccaccatgcccggtgaattattattattttttatctatatcatgaagcttcatttatattaaaactgttctaatcattaaaataattctcctccaagatcaacacaatcaggtccttttgtcatcctcacatgtcaggatttatagataaagtatttctaagggagaaatgagtagtaccagaagtttgttagagtccacagaccagatatccatatggcacaatgagcttgaaaaggttgagtgatgaaagtaaaatatatctatctggaccttaaaatataagtagaattcagatggactgaaaaaggacttgaatggctaagatcaaaaattcaggtgacagcagatgctggcgtggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatttacacaatggagtactactcagctattaaaaagaatgaatttatgaaattcctagccaaatggatggacctggagggcatcatcctgagtgaggtaacacattcacaaagaaactcacacaatatgtactcactgataagtggatattagccccaaacctaggatacccaagatataagatacaatttgctaaacacatgaaactcaagaagaatgaagactgaagtgtggacactatgcccctccttagaattgggaacaaaacacccatggaaggagttacagagacaaagtttggagctgagatgaaaggatggaccatgtagagactgccatatccagggatccaccccataatcagcatccaaacgctgacaccattgcatacactagcaagattttatcgaaaggacccagatatagctgtctcttgtgagactatgccggggcctagcaaacacagaagtggatgctcacagtcagctaatggatggatcacagggctcccaatggaggagctagagaaagtagccaaggagctaaagggatctgcaaccctattggtggaacaacattatgaactaaccagtaccccggagctcttgactctagctgcatatgtatcaaaagatggcctagtcggccatcactggaaagagaggcccattggacttgcaaactttatatgccccagtacaggggaacgccagggccaaaaagggggagtgggtgggcaggggagtgggggtgggtgggtatgggggacttttggtatagcattggaaatgtaaatgagctaaatacctaataaaaaatgggaaaaaaaaagaaaaaggacttgaattcatcctttatatgctcttaaagggctttgaaagggtgcaatgatgaatatttattactggctctctctgcctaaaaaaagaagagagatttttaagagtggaggtagttgcaaataatcttgaagataggttcattctttaaggctataccctttaactagctcctgtagcagctataggagctgaggatggctatgaggagaatcagtagtttctgccaaagtagatcctcttgcttttggggaaaaaaaaggatactaattactgtggatgctaattgtttctatttgaaaattcttatagtggtttttctgaaacacactaagtgagcattaggttggtaagtaaatcactgccagtaaagaaccttcttccctactagtgtgaaaagactgagttgcataaggaaatgagcttggtaccacctcttctattatgctcttcttgggagctgataattgaaaatattttaagagaaaaggttataattagtgttctggagttgtgacttgcagcttttttttcctttgagattttatgtttattttttcagtgactcacttggaggaatatcagttgccaaaactcaccaagtatattatccacttgtattcttgagttataacacaaatggggtgggtgtgatggcatatacatttaatctaagtacttgaaaggcaggcaggcagatctccacaagattgaggacaaccttgttagtttttggacaaccagatctatacagtgagatactgtctcaaaaatatcaaacaatagcaacaatgtttggatggtattagattatctctatatgtaccgacagtagtagattgcaggtcatttgttgtttcattggccatacaagcccagtaaaagttagcatcttcactctctgtcttcccctcttgctcaccttcacctcgtttttctgctcaaatataacttgagatcttggcctataagctaatgaagtttttgaatcccatggagtttctagccaccacctaaaacaaagtcatagaatatgagtaatttgatgacatctcaattgagacatctgcttgtttagatttaaaaaacacaccttactttgtatatttttcagttaggtatatcctcatagtagattgtcaatattctgaaagataaacaagataaaggaaaaggcatagattctttttttataccatagtgaaaatgttatttgattatttttatttatcatagcttctatttttaaatatttctccttctctgcagtactgattactaaggtatgtatagtggacacttattttcaaaaatgttcaaattttagggtttttattttctaaagtcagggagcatctattagctaacagatgacatgtgtctatgaccattaattctgcaaacaaatggcttctctgtgtgagcttgttcagtaaaataattatttagctataaccactgctaaaaatgtgaatagtaaccaatcaatgaaaactctggctcatttgaaaagtgaatgtccagctggtttcactaaaaactagttttggatttattgctagatattattacaggggtgttccagttctctcatgcctatgttgcagaatatcctataatgtacacgagacgaagtctaaaagtgttgaattaatgaattaaatcagaggtctcaagaactaagtcattagcagctctccttccaaaatgttttatatctatgatatagttatagccaaagtatagaaaggatatgtttttatagtttaaaaatgaccaaggctctttagctgaacaggagaaatcaagcctaccatggaggaattcactagaaacctcagtttcttctccatacaccccatctattaaacagtcattaggattgccatgggaagtgaggtttactgtaagcaaccattccttgttatgtgagagaagagggacttgggaggcagggagaactcctgaaaatcccaaacatagcccattattctggagtacttatttatgtatagatcatgttagccatgtagcctaagctggctttgtcttttgagtccttgcttagtttgggggagtttaatgattaatggtaacttatatttttccaggacaattattttgatggtaactgaacttagtttatattgatgatagataacacaccactgagagagataattatatcctaaggactgagcaggttactagagttttgccacaaaaattcacaaaggaatacaaattgtaggagtatatgtgtttaagcttctttacgtttccattagtttgggggcattgccatattctgtgcatataacaatgaacaactgcatatgtgggatacaattacgtgaggggtagtgtagttcttcacttttgctgtgattcagcacctaaggcaaagccttaaaccccaacagtttaaatactggagcagagtaaaatctttgtctactgcctggtgtcttcaaaggatatcaatgtattgttgatgtgttaataatgtcatagtgccatatggcaaactggctgaagggggttagcaagctcaaatatataaggatctccattaagaacattatgaattattagtcataataattcatagaaatgcatgcctgcaatctcagctttgagagaccaaggcaggaggactgactttggactatatataacaagacactatctaaatcagcagacaatatacaaaaatttatttcatttgaaaagcaaagtcagtgtaaaaatcatcacactttagttattttaaactaaatttccatttaagttaatacattatttcatagaaatttttcctttctaaaatgccacttaaaatgttcataaattgaaatttggatttctagaagcctcagcgttctctgtgttgaagctgattaaaattaccacataggttgtttgcatcaagttcatctatatatataggcttagcatagtttgcatatacataaaaccacatcagcatatcaagattttatgaatttctgcattggaaatatagctggaatgtacaatgccataggttcaatctctgtattgtactccaaaataaaaaaggacatgagttccattttgtattctttgaactaatatttatatttagattcaaggttactctgaactgaaagtagtttttccttttggtctaaggcctaaaaccatgatatcttatttgaggtctgtttagattacttcttccatatacagcatccctctcttctgttctttttcaccacttattggaaaattcacatccccacacacacatatgtgcatactcacagacttacacacagacagaccactgtgctattccctttcaataggaaattgcaatgtcttttacattaactcaagaattactttttctgttcgatgttggatttattcctcactctcataagaacttgatctggtagttatatacagtctttgtcttccaggggactagtatctaatggtgcctttgaaaaataccttgaaaatgtgtaaatagtaggaagagagtaaagagattgctcttttataatctaccttttggggcaacttaactgtagactatgttgaaaacaaaaagattataaatgtatgatctttattagttaatattatcttccctcttgggtaaataagaagagtatcttgtctgtccaagaaggaagaaaattacatttcttatgtttgctggtatatagaactattagaatatatagaacaattgggtatgctgaattctgttatgttttatgctattatctatcaccttttctggatatttgtgcaaggtaggtttttttttttagcacatatagatattgtctatattgagtgctttagtttagatacataggagaaaaatgtgacccttaaggttgattgttagctgctaacccatagtataagtaaataaattaattagaataagatttcaggacatgtaaacatgaagattttatgttcctttttgagtgctgggataatgaaaatgccagggtaaccctgatctcagggagtgacctcttgtacacgtacacgtagcctcacatatttctacatattgtctcatagttgcttgctacacctgaagattgctaaacccagaacaaatcataagttagtttatttgtgagggaagggacaaaatactcctgatctgttctactgtagtttttaggtatcattttcctgtcctcattgaaaattattgactgtcatcttcttccttttcctcttcctcttcccttatccatattgtctttcaccctcaccttcttatcctaaattcaatgtggttgtttgaatgggaatgacccacataatctcatatgtttgaacactttgtccacagttggctgatcagtttgggagggagtaggaggtagaatcttcttggaggaggtgtgtcactgggaacatgcttttaggtttcaatgggtttgtgtcattcccagtgtgttcattgccttctgtttgtggttgtggttgcaaatgtgagctctcagatattcctgttaccatgcttttgtctgccatcatggaccttaactctatggaactgtaagctcaattaaatgcttttttaaaaaaataaattgccttggtcgtagtgttatatcttagcaatacaaaagtgattagtacagaagttggtacaatagagtgggatgtttctgtgatagacattgccatatttgtgtgatgttttgttttgtttgtttgattgttaagaatgtagaagcctttgggactttggactagaaaataattaaataatgcaagcagagattactggactgtcttagtatgggcttagaagactgtagtgctgagagttacacaaactgtggaggcccagctcaagacgttccagagaggaacatgttagcaactagagtagatattgttcttgtgatattttggcaaagaatgtggctgttttatatccttgtcctaataacttacctgaaacaaaatttaaaagtaatggactaattttttttttggtggagcagatttcaagatagcctaatattgactcttatcatgtgattattaataattactcatatgtaggactacagtgaaaaagaacatatggtacagaaggaaatgaaaaaatgaacagtttgaaaaggagcaagccttgtgctgaaagaaataacattaaggagaggtcaaatcttaggcacccttggggcaagacctcacccagctaagcatctgacttgtaaaaggaagatgcctaaggaattaataaagtttctgtaactgtgatagggcaatagggcaaggattcattgcaagcaggcaactgaacttggcagggtcattcacacgattttttgctttacagccataaaggatatgtgagtaaagggtttgtggactcttctgcagtttagtgattgctgcctaggccaagcccatggctgaggaatccatgcatagaatccctctgagagaacattgtgtaaactgtgaaagtgaactctggattgtaatagagaaccaaaagtgtgttagaggtgccacagccttgagacatctgccaaggcaaacatacagggagtgcaaacagacagagagacagggatatatacatgttgctggcaacaaagctggaaaggcagagccatctaagccttctaacacaaacatgaaactacaggattcatactgagtttgccctgctgggttttgggcttgttttatagtccattatttcaacactataccctaattcctcccttttgaattggtaatgtgtgtgtgtgtgtgtgtgtgtgtgtgtgtgtgtgtgtgtattctgaccctttgtatgttggaagtatgttacagataatagattggtttgagtctcagatgagattttgatctttggatttttaaaaattcaaacagtgacagtgtcaagagtgaaagaatatggagacttttgaagttgaactaaatgccttttacattatgatatagccatgaaaatatgggggccagagagtgcattgtggtagtcttggacatttggatagttaaatcctagtgttggtggctattaggaaggattaggaaatgtggtattgctggagtcaatatgtcactgggggaggactttaaggtttccaaagacttgtgtagttttgagttagcttctacctcctgcttgctgtttgagatgtgagctcttagctattcctaccaccatgcttttgcttcaccactctagactttaacccactggaagcataagtctcattaaatcctttcttttataagccagtccttattctagtcaatgagttgcttcaaccttccttacagatccccgaaaacatttaaatcccattgaattaagtcactaatcaggaagagtctatttaatcagtattctataaagaatatatacttgtttgagttgctgctaataaataagcttaataattcagacaggtgggttttatgtttagaagatatgggagtacacaaataaagtagtgatttatactttacatttttaaatcttgagcttcattgtgaaaatatataattttttattttgtgtatcaaaatgaataattttataaaaagcaagtccaaaggtaacaaatgttttcagggtcaccagaaaagatctacaattaaaggcccatttgtagtttgtaaaggcatgatgatttcagaacgacaagtataattgactgggaggaatccttaaggcatttcttatactacaactatagttgcactatctactgtaatcgatttaaatactagcaatactatttgtaaatctctcatctcatatttagtttaaagtagttgtttggtaacagaacatcccttaaagatatatcctttttgcacatgcccttatttctcactaaaaaactcctaatgattcccactaccattaatgaccactagcattaaggaacttcatgatccaactctagtacattttaacatcctctatcattatttcttcagagaaatttctgtcttctaataaactgttccattaacttttgccccatatgtctgcatttctatttctgtcttaactccattcattaaccacacatggaattcaattttactagttacctttggctagcctattcaagtcccatcattttcaaagagttttttttttcaactactatagctcagatgacctctttatttaaaccacagctcacctctattttttgttctttaagaaatattttgcctgagtgtatgtatgtggaacatgtgcatgctcggtgccagaggaagtcagaatagggcatcaggtcctttgaaactggagttacagatgacttcaagccaacatgtaaggtgccaggtattgaacccacctgagtcctatacaagagcaaccagtgctcttcaccactgaaccatctctccggcagtagtttttgttcttatatacattagctactgtacattgttttacgttttgtttaagtagaatatatatacctagacactctacactacaggataagtatcaccacacataatttcaggttataccacagaaccataatgacaaaaccaccatggttatggcacaaaataagcacatagatcaatgggacatactagaaatcattcatatatatcagcacgtgctgttactcttttagccatcttactggttcgagtctcacatagtttgtaactgtttgtgtcaattgcatatttagttgtatgttgttagctaattagtttgtgtcagttacatattcttccttatattcttgtctagttgtttcatgcacaccagaaatagcatccttaagataatcagaagcctttttgggactgagagtatacttctctttttagtcccaccagtaagtgtcatgaaacacttacaaccgaaataagatatttctggatatttgagtctggatccattgtactattgtgggcctctataacactttagattccatggtagtactgtgaatgttgactcaaatccagaacatgatgttatattcctaatagatgttccagaaatgttgttagaatattataattcaagattcaaactataaagtagaaacaaataattacctgaaaattgagatcagactggctaatggattattttttacttttccatttgagtcttccaattaaattttctgacttcagagtttcctatatgaaaaatgagacagtaattaatacattggtaactgttgtgatggttaaataaaattatatgtaaatatcctcacagtaccaatttcttgaaagaataggtaacccattgtctgagaggggatatgctagagcattgacactctttctgacaaatccattgaaaagttatagttctgtgtagtagcagccataactgatgatactcaagttactgtcaagctctgaaatgctctaattataacatccataatctttttcatgtgtattgatatttatgataaaaaagcttttacacttacctcatttgaacctcaaactagaaataaaagtatgaaaatatttatttgttgagcctctaatatattctaaacttcagcatatactctagcagctgtataaacaatgtgtgctcaataagaccaagtgctagcaatgatatatcagagacacagacagatgaaggtccttgccctcatggagcttacattctggtggattgaattctgagtgaagccacctgaattctagtcctgatgtagctactaacttaacagtaagaaaaaaagtgtgctggtggaagtggtggtgtggtgtgtgtggggtgatacccagagggcgctccccttctcagaggagaaggaaaggggagaatctgtctgtatgaggggatactgggagctgatgttaggatgtaaagagaataaataaatttttaaaaagaaataaataaaccaattttgaaaacgaaaccaaaaaaggagagaaaagtgtgtgtgtgtgtgtgtgtgtgtgtgtgtgtgtgtgtctatttgcacatgttcttacctagatgttttcattgggcatatattgttgcaaataaattatagttcaactttactcattctcaaagctcactcagaatatagattttctgtggtctctgtttggtagcacctgctgtgtctcatagaaaatcactttatacaatctgaagagaaaccagatgtacctaaccctcaggagactggaggccccaaggagtttagaggtcaggtggggtggggatgggggcatccacgtggagaaggggtggggtggggaggaggtgtgggatgtggagcagacagagggtggatggggggcggggaatggaatatggagtataaaaaaataaattaaaaagaaaatttaaaagaaaaagaaaatcaatttatatcaaggagagacccaagaaaattatttaccccttttcagcatattagcttactcatctgcttcttactttgatttttgttttgtttaaaccttgaatttaatacagagtaatgtggagtctgagtcgtttgctttctatctgtttaatcaaggctatgccatctaattcttgtaattctttacaggctccctcactgaaaggatgctttctttctaatgttttcttacctcttttcttacactcacatcctccctgggaatattaggcctattagtattattgctctttgactgcaggagaaactaaggcataacgggagaaaatagctaagcctatattctctggaatttaaaatagtgagtgtacattcctcttggtcttggaccttattcactatcccagaattcagtcagttcagttagccatcacattagaaaaagctacatttgttctgaacttggactcagaagacttgttctttgatcctgagtctgtttctttcatgaccttgaacaagcatctaagccccctaggtttctataaaactagataaaaaatagcttttcttaagcttctcatattttcctattctttggaagtctttgcccatcttatcttcttttctccactacttttaatttcagcttttattccttttccttcagagatgtccactctcttgcagtactgactcctattatcttggaccaatctcatatttatttcagtcttacattgtcctatgtaatttcctgcattctccttgaagtaagagaaagtgagcataatataccatcttcagatataccggaagagggcattggcttccattacagatggttgtgagccgccacatgctttctgggcattgaacttaggacctctagaagagcagtgttcttaatcactgagccatctctacagcctgtagggtactataacttaattcattacttgttggaagaatatcaagtactaaatacaaagacaattaaaaatcctaaatagctaacaatgaacttcatttaaattatttttaatgaagaggctatcaagctgtggaaactacttgttaatttggtatggagtgtgtgtgtgtgtgtgtgtgtgtgtgtgtataagtttgggtagtgtttggattggatatcttaattgtgtataccaaatgagttgttgcttgtgattaatagtgagtaaaattgcttctcggatgtgctagttactatttactgaggctgaatagtagaaatactgataaaatgaaactctcctttctaattactcccagggtccaattctgccttctatctaatcttcactaaatcataacagcctgcttttcagcaaattattatttagacaatctgtttgggagaggaaagcatacttgaatcatgcaaatgctctctttgaagctatattttttcttttatgttcagatgggaatatattatatgcaccccacactgttttttctccatgcttggaaatcaaggacaaagagtgcaaaagttatcttaccacatcacccaagaatgtagcatattagagttctatgaggaacaagagaatccagttatcatcccaaagaaagcaaataaaggaggaagctggctgtataaagcagcttgtttattcttcaagttaggagactgtggattagaggaatcctaactagcctatgcctaaaggttcagaggaatggttaagtgacatcattatgcttgaaggaataggtgagtttttctaagaacaaatgaacactctttgaattttttatttttttatggcatttatttttattttaagaatctctattccaggatggtctcaaacatgctacattgctgaagattaccttgaacttctttttttattttttaaaatagtatttatttatttttacttatacaagtacactgtagctgtcttcagacacacaccagaagagtgcatgagattccattacaaatggttgtgagcccatgtggttgctggtaattgaactcaggacctactggaagagcagtcagtgctcttaaccactgagccatctctccagccctacaaatcaacattattaacttctatttattagtcttttcagtctaggctaggtaacaactactgctagctgaggaatatagatgcaagaaaataccttaagctaatagagaatttttgtttatctatgcattgtgctaaaaatatgaattgtagttttaacttagggaaaatggcatactcaatcagtaagacttcaaaatggagacaagcatgagtagagtacttgcttgtgtgtttcttttgggaaagaatgagaaagacctatagaatgcatatgggaaagaagggaaaatgaaaaggaaaatcatatttggagataatattgggaaaatagtaataaaccttatcttggaagaccttcagtgctggactgagttgattgaaactttaccgtgtataaatacacctagagaaagtcttatggtctgaactaaaaggggcccaacaatacaggcttagaatttaaacaaaagtgactttgaatttctttccctaatgcttactgatagaccttaaatatactgctgcttctttcgcatgcctcactttcctcctttcatggataacagtaattgtcttagataattttcagtcttaagtgttataaatgtaaagtgaaatgatgtatataaaactgaatgcctggctactcaataaataaatgttatgaataatccctttgattctagtttgataatgataattggttttgtttgtttgtttgtttgtttttggatttttttgagacagggtttttctatgtagccctggctgtcctggaactcactctgtagaccaggccggcctcgaactcagaaatctgcctgcctctgcctcccaagtgctgggatcaaaggcgtgcgccaccaccacccggcaatggtaattgttaatgaatatgaaatgtagaatggtttgctaaccttcatatattattttattttattttatgctaatctatggagttcattagtactattatactagggaaaacatgcccaggccaagggtttctctagttataaaataatatcagagctaggatagaatccagattatttaaagttcaatttggtattctttttattatacaatactccaaaaactgagtttagactacttttactttgatttgtttctaacaaacttttggtaaatcatattgggtgtttttaaagttaaaactacatacttaggcacggtggctcaaggctgcaattaccagtactcaggaagataaagtaagactattgctgtggatttgaggtcaactttggctagagaccctgtctcaaaataatgaataaataagtaaataaatacactaatgaataagtaaatgtacttgaatggaacaaggttgttacagatatactcccaatccagtattgtatgtaagaagtccctacacctgcatctttccctgtcaaatccttgagatctagtatttattaaaaattaagtgaacaaaatacccattgtccttttaaaaaaaaaaaagatttatttatttatttttgtgagtacactgtcactgtcttcagacacaccagaagtgggcatcaaatcccattacagatggttgtgaaccaccatgtggttgctaggaattgaactcaggacctttggaagaccaatcaatgctcttagcctctgagccatttctccagccttaccccttgttcttgagacaagcttttatacttttctttttaaaaattctgattagaagggaccccccccagtaaataggtacagtccccaagttgagggatggtgccacccacccctctcaaaattgttaacccagaaatgttcctgtccaaaggaaagacagggacaaaaaattgaacagagactgaaggaaaagtcatctagagaatgccccaccaaggaatccatcccatccagacaccaaacctagacactattgctgatgccaagaagtgtttgctgacaggagtctggtatagtgctgtctcctgagaggctgtgccagagcctgacaaatacagtagtagatgctcacagccaaccagttgaagagatgggggaaggaatgaaggagctgaaggcgattgtaaccccataggaagaacaacattatcaagtagccagatcccccagagctcccagggactaaaccaccaaccaaagagtataactgagtgcgtctatggctccaaccacatatgtagtagaagatggctttatgtgacatcagtgggaggggagacccttggtcctgtggaggcttgatgccccagcatagggggatgttagagcagtgaggcacgagtgatgggtgaggtggaagagcacccttacagaggcaaaggggaggagggagaggggatgggatgggtggtttgtggatgggtaaccaggaaaggggggatatcatttgaaatgtaaatgaataaaatgattaataaaaaggaaaagaaggaaataaagagaatattggaggaatacaaatgcccaatggtaaaataaaataaatatgtaaagaaattttaaaaagaagggattgtagtatttaagcaatagaaagctggttcaatttacaacttgcaatcactatcttactctatctagagaagaaaacatattgaaagtttcttcttttaaaaaaaaatactaaattcatatggatttattttcttcctcttgacagatcccagtctattagaattatttttttgtgatcttgcttaagagtcagtgtaagtgtaccagtcatggaatttggttttcagggtcctcctgtttattattttagctatgttatttttttcttcaatgtaatttacaaatactactctattaaatatcacacaagatacaagcataactgacaccagaattccatgggtttggtgactggtgtgaatagtggtactcttgatgctgtgacagaaggaagcttgagggagagaaggtttacctttgctccaagttttaagggaagagtgcatcatggtatgggatgtgtggcttcaggagcttgaaacaactggtcacgttgtgtctacactaagaaagtacagaaggatgaacaatagtactccctacttgcttgctttttcctccgcccagggtgccaacccatggaatgttgtacaacctacattcagggtgggtcttcccatctcagttaaacttctctagaaactctcacagacgggcctcattcagaggtgactatcccattaagacaacaatcaaaattaatcgtcattgtgtgtgtttagagggggtgctgcaaaagtaatgttttatagttcaataggaaaaaccctggttttagcatagaaaatctgggttcatgcttaagcatgtcacataactcagtttcctccctctgttaagagaggccactaaactcagctagtttcatctctgtatttgtggaaccaagtttctctacaattcttagttggatgcattgaacttttaaggtgaaatttgcaaggtgaccgattgtacaatttttccattatcttaaattttttcattgtaaagtttttcttgttgtttgttttgtttgtttgttttttgtcactttggttaaataaccctacaggttttatttgaaagtattgtgaaagtgttttccttttcttgatttctttctgggcgaattctattagtatatagaaaggcacctgactttttttttctttcctactaaggagagatgtcagattagtatgcaaaataatgggtttcgccatgggctattggtttttatatactgactttggaccctgctgttaaaataaacccttcaagatttatggtggagtcatcagggttatttaaatatagaattgtgtcatctgcaaataggagtactttgatttcttcctttcctatttggatccattttatttcttattgctgaagctaagacttttgagcattatgtcagataagaacagtggcaatttacattttagcctcaattctgattttagagcaaatgctttcatgctttctccactttgtaaaatgttggctgcaggtagccttttatgccaatatatgttttatctattcctagtttcttcaggacttttatcagtaagggattttgaactttgccaagggccttttctgcatctataagatgattctttaattttgtccttaatatttatgtattatattacatctattgatttgcatatttcaaatcaatcttgaatccctgtgagaaaaccaacttcttcatggtgtatggtcttaatatgtttttgaattcaatttgcaccatttttattgcaaatttttgcgtttatgtttgccaagtaaattggtacatagttttccttaagttataaaattctctagaattgaaagatcagggaggggccatatctggcactcttgctggtagtaatgcggtcaagcagaattagtttgatagtgtgttctttacccttctgttttgtggcaatctttgaggaatattactctgttaaagatttggtagaattcagtaataaaggtgtctaaccctagacttttcattggggggtggggggtgtactttaattaatactttaatttgcttgttagaatatttgtatattacttactaaattctaccaggtggtatatgtgtaggactttgatcatttcttctatattttccgggtgttttgaaacataaattttgaaagtatttcccaagaagtcctctgaatgccatcaaaaaatgttgaaacatccctcctttaacctctaattttattaatttgaatttttctgttttccttttagttagtttgcctctatgctcttcctaacttccttacctttccaaacaattatattttaatttgattgcttttgtgaatggttctttttgatatttttactaatttattctctcatctcctacatcctgtccacagttttaccccctcctgtcctctcagtctctgtcacctcctccctccccatctgttcctccttctcccatttcccttctgaaaagagaaggtcctccagggatatcaaacaaacatggcatatcaggatgcaagaagattatgtacctcccctcatattaaagctgggtgaagcaacccagcaggaagacagggatctccaaactatacagttttcaaagcctatttcagtagtttctttgatgacttgtgaaatttcttgccattgtttttttggtttcttcatttttttctaagaccttgggggaacatcattaggtaatttatatgtagtctttctgattttctatgtgcccatagctgccaactttttcttagagctgccttatcatctggttatatatcttagtttataaagttattacctaatgtggtggtttaaataaaaatggtccacaaaggctcatatatttgagtgtttggttcccaatgggtatgatggaaagtttaggaagaattagaaagtatgtccttgttggaggaggtgtgtcactggggggggggggctttaaggtttcaaaacctcaccccaggcccaatcttgctctttttctgcctactacctgtggatgaagatgtaagctcctggctaatgatgtaccaccgtggctgtctgcctgttgccacgctccatgccatgatgaactaaccctctgaaactttaagcaagccattaattaaatggatttttttaaaaaataaaagttgtcgggggctggagaaatggctcagcagttaagagcactgactgctcttctagaggtcctgagttcaaatcccagcaactacatggtggcttacaaccatccgtaatgagatctgacaacctcttctggggtgtctgaagacagctacagtgtacttacatacaataaataaataaatctttaaaaaaatacataaaagttgtcttggttatggtgctttgtcacagcattaaaactctaagacagcaccgggtcaccttggatgcggattcagtggatactcccaaggtcctgagaggactctccatgtgatcttaggaccaccggtgagtgtaacacaacttctgttccattccaatcacgcaggacctgagacagcattagggaagcagaaaacccggcctgaccaggatcacaagacccttccagtctgcgccagcaccaggtcacctggacacagagtcggaggacaacctcaaggtccctagaggacagcttctgaggcagacccctttttgggctccagacattcggacaccttccctgccagaggagaagtgtccagcccgcccgggagggctttgctggagcacctggtggagccatcttggttcccagatcccgctgagagtagtggactacagaagcagacagcttcggggacaggccttgtccaccccacccagtactgggcaccccagcacacccaaaaagctagacccggatttaaaagcatatctcatgatgatggtagaggacaccaagaaggactttaataactcacttaatgaaatagaggaaaacactgctaaagagttacaagtccttaaagaaaaacaggaaaacacaaccaaacaggtaaagtccttaaataaaaacagaaaaacacatccaaacaggtgatggaaatgaacaaaaccatactagacctaaaaaaagaagtagacacaataaagaaaacccaaagtgaggcaacactggagatagaaaccctaggaaagaaatctggaaccatagatgcgagcatcagcaaaagagtacaagagatggaacagagaatctcgggtgcagaagattccatagagaacatcggcacaacaatcaaagaaaatgtgaaatgcaaaaagatcctactaaaaacatccaggaaatccaagacacaaagagaagaccaaacctacagataataggagtagatgagaatgaagattttcaacttaaagggccagcaaatatcttcaacaaaataatagaagaaaacttcccaaacctaaagaaagagatacccatgaacatacaagaagcctacagaactccaaatagactggaccagaaaagaaattcctcccaacacataatcagaacaacaaatgcactaaatagagatagaatattaaaagcagtaagggaaaaaggtcaagtaacatataaaggcaggcctatcagaattacaccagacttttcaccagagactatgaaagccaaaagaacctggacagatgttgtacagacattaagagaacacaaatgcgagcccaggctactatacccagccaaactttcaattaccatagatggagaaaccaaagtattccacgacaaaaaccaaattcacacattatcgttccacgaatccagcccttcagaggataataacagaaaaaaacacacacacacacaaaaaacaaaaaacagtacaaggatggaaaacacaccctagaaaaagcaagaaagtaatccttcaacaaacctaaaagaagacaaccacaaggacagaatgccaactctaacaacaaaaataataagaagcaacaattactttaccttaatatctcttaatatcaatggactcaattccccaataaaaagacatagactaacagaatggctacacaaacaggacccaacattttgctgcttacaggaaacccatctcatggaaaaagatagacactacctcagagtgaaaggctggaaaacatttttccaagaaaatgatctgaagaaacaagctggagtagccattctaatatagagtaaaatcgtcttccaacccaaagttatcaaaaaagacaaggagggacacttcatactgatcaaaggtaaaatcctccaagaggaactctcaattctgaatatctatgctccaaatgcaagggcagccacattcattaaagaaactttagtaaagctcaaagcacacattgcacctcacacagtaatagtgggagacttcaacacaccactatcatcaatggatagatcgtgtaaacagaaactaaaccaggacacagtgaaactaacagagttatgaaacaaatggatttaacatatatctacagaacattttatcctaaaacaaaaggatataccttcttctcagcacctcatggtaccttctgcaaaactaaccatataattggtcacaaaacaggtctcaaacagatacaaaaatattgaaattgtcccatacatcctatcagatcaccatggactaaggctgatcttcaataataacataaataatagaaagccaacattcatgtggaaactgaacaacactttcctcttggtcaaggaaggaataaagaaagaaattaaagacttttttgatttaaatgaaaatgaagccacaacatacccaaacttatgggacacaatgaaagcatttctaagaggaaaattcatacctctgagtgcctccaaaaaagaaactagagagagcacgcactagcagcttgacaacacacctaaaagctctagaacaaaaggaagcaaattcacccaagaggagtagatggcagggtgaaatcaaccaagtagaaacaagaactattcaaagaatcagccaaaggaggagctggttctttgagaaaatcaacaagatagataaaaccttagccagactcactagagggcacagggacagcatcctaattaacagaatcagaaatgaaaagggagacataacaacagatcctgaagaaatccaaaacaccatcagatccttctacaaaaggctatactcaacaaaactggaaaacctggatgaaatggacaaatttctagacagataccaggtaccaaagttaaatcaggatcaggttaatgatctaaacagtcctatatcccctaaagaaatagaagcagtcattaatagtctcccaacctaaaaaagcccaggaccagatgggtttagtccagagttctatcagatcttcaaagaagatctaattccagttcttcacaaactattccacaaaatagaagcaaaaggtactctacccaattcattctatgaagccacatttactctgatacctaaaccacggaaagacccaacaaagatagagaacttcagaccagtttcccttatgaatattgatgcaaaaatccttaataaaattcttgctaaccgaatccaagaacacatcaaaacaatcatccatcctgaccaagtaggtttgattccagggatgcagggttggtttaatatacggaaatccatcaacataatccactatataaacaaactcaaggacaaaaaccacatgatcatctccttagatgctgagaaagcatttgacaaaatccaacatccattcatgataaaagtcttggaaagatcaggaattcaaggcacatacctaaacatgataaaagcaatctacagcaaaccagtagccaacatcaaagtaaatggtgagaagctggaagcaatcccactaaaatcagggactagacaaggctgcccactttctccctacctattcaacatagtacttggagtcctagcaggagcaatttgacaacaaaaggagatcaagggaatacaaattggaaagggagaagtcaaaatatcactttttgcagatgatatgataatatatataagtgaagtagctagatataaaattaactcaaacaagtcaatggcctttctacacaaaggataaataagctgagagagaaattagggaaccaacacccttctcaataatcacaaataatataaaataccttggtgtgactctaactaaggttgtgaaaaatctgtatgataaaaacttcaagtctctgaagaaagaaattaaagaagatctcagaagatgtaaagatctgccatgctcaaggattggcaggatcaatgtagtaaaaatggctatcttgccaaaagcaatctacagattcaatgcaatccccatcaaaattccatctcaattcttcaacaaattagaaagggcaatctgcaaattcaactggaataacaaaaaacctaggatagcaaaaactcttctcaagcataatagaacctctggtggaatcaccatgcctgacctaaagccgtactacagagcaattgtgataaaaactgcatggtactggtacagggacagacaagtagaccaatggaatagaattgaagacccagaaatgaacccacacatctatggtcacttgatctttgacaaggaagctaaaacaatccagtggaaaaaagacagtattttcaacaaatggtgctggcacaactagcaattttcatgtagaagactgtgaattgatccattcctatctccttgtactaaggtcaaatctaagtggatcaaggaactccacataaaaccagagacagtgaaacttatagaggagaaagtggggaaaagcctcaaagatatggatgggcacagaggaaaattcctgaatagaacagcaatggcttgtactgtaatgtaagattgacaaatgggacctcataaaattgcaaagcttctgtaaggcaaaagacaccgacaataagacaaaaggccaccaacagattgagaaaggatctttacctatcttaaatcagataagggactaatatccaatatatataaagaactcaagaaggtggactccagaaaatcaaataaccgcattaaaaatggggctctgaactaaacaaagaattcacagctgaggaataccgaatggctgagaagcacctgaaaaaatgttcagcaccttaatcagcagggaaatgcaaatcaaaacagccctaagattccatctcacaccagtcagaatggctaagatcaaaaattcaggtgacagcagatgctggtgaggatgtggagaaagaggaacactcctccattgttggtgggattccaagcttgtacaactactatagaaatcagtctggcagttcctccgaaaattggacatagtactactggaggatcccccaagacctctcctgggcatatatccagaagatgttccaaacggtaagaaggacacatgctccactatattcataacagccttatttataatagccagaagctggaaagaacccagatgtccctcaacagaggaatgaatacagaaaatgtgatacatttacacaatggagtgactactcagctattaaaaagaatgaatttatgaaattcctaggcaaaaggatggacctggagggcatcatcctgagtgaggtaacccaatcacaaaagaactcacatgatctgtactcactgataagtggatatcagcccagaaacttagaatacccaagatacaagatacaatttgcaaaacacgtgaaaatcaagaagaatgaagaccaaagtgtgaacactttgcaccttcttagaattggtaacaaaacacccatggaaggagttacagagacacagtttggagctgagacgaaaggatggaccatctagagactgccatatctggggatccatcccataatcagcctccaaacgctgacaccattgcatacactagcaagattttgctgaaaggaccctgatatagctgtctcttgtgagactatgccggggcctagcaaacacagaagtgaatactcacagtcagctattggatggatcacagggcccccaatggaggagctagagaaagtacccaaggagctaaagggatctgcaaccctataggtggaacaacaatatgaactaaccagtacctgccggagctcgtgtttctagctgcatatgtatcagaagatggcctagtttgtcatcattggaaatagaggcccattggtcttgcaaactttatctgcctcagtacaggggaatgccagtgccaagaagtgtgagtgggtggccaggggcgtggggggagggtatgggggacttttgggatagcattgttaatgtaaatgaagaaaatacctaaaaaattttttttgttaatttttaaaaattaaaaaaatactctaagacagaagttggtactagggagtcaggtattgctgtgacagggctcaccatgctgtcctttggagaaatatgaaagagtttgagactttggactaaaagcagtttgatgctttaagtagggcttaatgggtcatctagtgggatggtcatggtgaaagcaatgtagactattgaggcccagctcaagaggttacagagaagaatattagagatgattcttgtgatactttggcaatgaatgtggtttttttctgcccttagccaaaactctgccagactcaactgaagagttttgtaccagtattgttagcagaggagatttcaagacaatgtagcattgactgtcacatggttattattgatctctcttatgcagaactacaaggaaaaagagcaaagaaggaaaaaagaaatatgaaatgtgtactttgaggagaaaaagaacaccagagaatatgataagctcaaagagatatgaagtttttaaaaaggcctgatgctaattgtaataaagggatgccaccctcagggtaagaccccaccagctaattgtataatctgtgaaagagaaatgtccaagggatttccttggtctaaacaacagcaatccaaagtttatgcaaatgtaattcaaaaagggggctgagttccagctgcagcaggtagcagaatttggctacatggttctggatttagagccaagaaggaaacaggaaatgggttgtggagtcttcctccatggtaaaggaacgccacaaagaccagacatgtgacagggtagtcccttcctgaaggccattgcatgaagctgtgaaggtgaaacctggattgtgttggaaacctcaagatgtgggaaagagcagaagcatgccagtgagagctgcataaaggatgtggaaccagctcaagagaaaggagtgtgctacagttaacaaagctggaaggagcaaaagataggaagagccatctaagtcaggatgtagagttaggcctgctgggtttccgaatagctttcatccagtatttcctttctttccatttagaatgtatattctgtgccattgtatgttggaagtatgaaactagctttttgatgttacagggtgttactgttaagagattcccttgagtcacagaagagactttgaactttgcattttgaaacatacctgatactgaaagactatggggacttttgaagtttgattgaatgcattttgaattatgatatggccataagcctatggggagctaggaaatgaaatgtggtgttttgaataagaatgagccccatagtcctccctcttctcagagaagaaagggagagggacatgaagagaggggctatgtgaggggggacctggaggagggggttacaattagcatgtaaaatgagtaaataaattaattagtgaaaaagggctcatatatttggaagtttgtgtcccagttgatagatggtttagaaacaattaggaagggtggccttcttggaggaggtatgtattagtcagggaatcctagaggaacagaatttatatataggcttgtagttactgctccagcaccatgcctacttgccaccaaattccccaccataagatcatggactaaccctctaaatatgtaagcaagcccccaattaaatgctttcttttataagttgtcttgctcatagtgttttgtcacagcaatagaacagtaactaaggtacgtactatgcacagagtcctgagttcaatccctagtaccgcatatatttagcacagttgttggttgcctgtaatcttgggaggtggaaacaggaggatctgacctgcaagggcatcctaagctacacagctaaagacttgtctgggatacatgagaccctgtcttaaagaaagaaaaactgcggggctaatatccaatatatataaagaactcaagaagttggtctccagaaaaccaaataaccctattaaaaatggggtacagagctaaacaattctcaactgagaatactgaatggctgagaaatacctaaaaaaaaaagttcagcatccttaatcatcagggaaatgcaaatcaaaacaattctgagattccacctcacaccaatcagaatggctaaggtcaaaaactcaggtgacagcagatgctggcgaggatgtggagaaagaacaacactcactcctccattgcctcaggctcagtacaatcaaactccagaattcttttcaattgataagatctgttcctggctaccaaagggaggggtgcttttgcccatgcatttaactatctaagccagattcctgccacttaatgctttctggcttttcagtatctgtcccttttctcttttccaggctgtctcttaccttcagactttggcagattgcattcaggctccctaaatgataggtgttcccaattctcagacccctagcatagtaaagtttcaagcagtaggttcttctttaagatggtgcttgaccctgaattctgagtcataccaagtattaaaatgtaatctctccctaatactcacccaccagacaaaggaatccttgtaacaaaacctgcatattggttttgactcatgtacgggttgtgggattgtcctgggagtagaaccaccagtctctgctctatgccagggtcttctggctctccttttggagagggctcttatctacctcccagtcactcctttttttttcaattaggtatttatttcatttacatttccaatgctatcccaaaagtcccccacctgctcccccacccacccactcccacttcttggccctggcattcccctgtactgaggcagataaagtttgcaagaccaatgggcctctctttccactgatggccgactaggccatcttctgatacatatgcagctagagacacgagctctgggaggggggggggtactggttagttcatgatgttgttccatctatagggttgcagctctctttagctccttgggtactttctctagctcctccattggggaccctgtgatccatccaatagctgactgtgagcattcacttctgtgtttgctaggccctggcatagcctcacaagagacagctatatctgggtcctttcagcaaaatcttgctagtgtatgcaatggtgtcagtgtttggaggctgattatgggatggatccccagatatggcagtctctagatggtccatcctttcgtctcagctccaaactgtgtctctgtaactccttccatgggtgttttgttaccaattctaagaaggtgcaaagtgtccacactttggtctttgttcttcttgagtttcatgtgtttagtaaattgtatcttatatttcccagtcactcctgacagggaaccacacacctaacgcttgggtttggcttcttttttatatctcatctgtctttcttataacatattttcaggtatcctatcactgcctttgtgaatttcataagtcattttctgtctttgaaatagagtctacttttttcttatcctttattttttgagagggaataatatttttttgtttcaaaattagctgacaaacaggaatgatttcctatggcatttgcatacatacttcatttttgttgagtccctcctcatttcttccccaacatcttcctccttctgtttcctctgtaccctagtcagccatcattgggaagagaggcccattggtcttgcaaactttatatgccccagtacaggggaatgccagggccaagaagtgggagtgggtgggtaggggaacagggtgaggggagggtatagggaactttcaggatagcatttgaaatgtaaataaagaaaatatctaattaaaaaattggaaaaaaaacatacacatactgtaaaagaaaaaaaatccagtggtaaccgtggtcctattgttgtcctagttctctgtcctgatttctacagtggctgtacacttttaccaacagtggataaaaatttccctttcttcacatctttgtcaccatttataatcagttggtctttgatggtggccatactgactgaagtgagtgagtagagcctcagtgtaattttaatttgtgtttctctggtgactagaaaagctaagcactcttttgaatatttgtatttcttcttttgagaactgtctgttcagttcattgatctatttatgtattgtcatttttttgtttgtgcagggtcttgatttttacaattgtttatttattctggatattcaccccttgtatgaagcgtgactggcaaagatgttttccccattctgtaggcctcctgtcccctctgttgatcgtttcttttagtatgcagaagaagcttttacagttcatgcaatcctatatttcaattttaggggctatgtcctgtgttgttatggttgtattcagaaatgtgttgcctgtacctgtatcctctgactgttcctcattccatactccctcccccatctccacgagtgtgtctccaccccacatgacaccccacaccccaccagacctcctcacactccctggggccttcagtctcttgagggtcaggtgcatcttctctgactgagtgcagaccaagcagtcctctgatgtatatgtgttgtggggcctcatatcagctggtgtatgctgcctggttggtggcccagtgtttgggaaatctcagggatccaggttagttgagactgcaggttctcctacagagtcaccctcctcctcagcttcttccagcttttccctaattcaaccacatgggtcatcagcttctgtccattggttgggtgtaaatatctgcatctgactctttcagctacttgttgggtctttcagagggcagtcataataggcccctgtttgtaagcacaccatagcctcagtaatagtgacaggtcttggggcctccccttgagttggatcccaatttggatctgttgttggacctccttgccctcaggctcttctccatttttgtccctgcagttctttcagacaggaacaattatgggttagagttttgactgtgggatggcaacccccttcctcatttgatgctctgtcttcctgctggaggtggactctgttccctccccccactgtagggcatttcatctaaggtccctccctttgagttctgagagtctctcacctcccaggtctctggtacgttctggaggatccccccaccttctacctcctgaggttgcctgtttccattctttctgctgttttttcaacctatttttgagattataatataattacaacatttctcccttcctttcctcccttcaaacccttacatatgaccctaccttctctccttaaaattcatgacctccttttcattaattgttattcatgcatacacacacacacacacacacacacacacacacacacacacatatacactaaatatagcctttcagtccatataatgttacctgtatgtttgatagaacattttgctaggtttgtttttaattacttactatcaaggcttgaaatctatctttccatgttttcctggcttttagggatgctggaaacaaatgtgatactctaatgtttctgcttctaaatgttagttggcctcttttctttatagttcgctccttgtgtttggatgtacatttctgtctctatgattgggaaattctcagctatattttcactgaatagattgtctaagccatttgactttgttttagatctgtcttctattctgtgaattcttgggttttgtcccttgaatgtatcccagacttctataaagtttcagtcatgcttgttgacttatttttatttctatatgtcaatgtgtattactgtcccatctttctcttccatctttgatagtcattcttctgatgtgtcttatctgtttgatgatacattatgttgtgtttatcatttgataaattgattctttcatttccaaaatttctgtttggtgtttttcagtgtctttatatccttgctgaatttttcctcgattttaatttcattaatttttattgtgtgtgtgtgtgtgtgtgtgtgtagaacaaaagttgtagttgtcttcctctatcactctccaccttattttttgagacattgaacttctcaccaaacctagtttgctattctgttagaccagctagccagtaaacccagggcatacgagattcacccaaatggtagaagagtctcaattctcccaagttgccctttgacttccccacgtatgtgtgtgtgtgtgtgtgtgtgtgtgtgtgtgtgtgtgcgcgcgcgcgcgcgtgtgtgtcccaaataaatacaagaaaatttcaagactaaaaagaatttgaaacaatgtataagcataaatgaacagtaactagaaatatgctcagtcactgcttcatcctggttcaggaagagcctgtcctctgtgtttatattaggtccacctatcaggacacagcattggtacagtcacaaccttggtctattggtttggctccttttggctatggcataagtggggaatgttggtgatctcttggcccagactcccttaccatccttctgctagttccacagactatgtgctttgggacctgtagcatatacctagatgcaggagtacattccccattttgcctacgtacttccctttcactggatttgtgtggtttgctgagttgttcatctttgccaggtggtcaattcctttgaagctcttatccccagtagcagtcctgtcatattctgcaatgccatgggttcattgtttgttcctctaggttaaggtgtgtgtcctctgcactatatggagttctggggccattacagcattttctttagggtcacacatagaactaggctcttggataccaagccagtggcattttctctgcttggccagaaggattagtgcagctttgtaggttgtttgtgttgtctctctttgtttaggtattctttcacttattaaaaatgtaatatttatattaatgttttgataatttcatacaatttattttgatcatatttactttggaccctactcctccccttaactcccagatcaatccctacctcccatctttctttaattattactattataagtatatacatataaatacataaatacaactggttcattcagtgtcacttgtgaatatgtttcttattttaattttaatgaaatataattacattatttgccacctctgtcttcttcctcatactcccacctctcctttatagcctcttccgaattcccaaggcctcttatatatatgtatatgcttttagtgaagctctcctcagtcattttggagtattctctgttattccttttgcaactctacttaacagctatcattgctctgaagactctagtctaccatcttacctgaaattacatttttcttattctggatgttcttttctccaggtaacacctaggtagcatctagtctaccatcttacctaaaaattcttttttagtgttttgagatttgagtattgagtgtaactctgtagctgaggctagccttcaaattcactatctaactcaaactggcctcaaactgatatgataattcttttccttaggatttggaagtcctgggatcacaagcaggcaccacaaaatcctagcccacttcttctatttaatgcaatatttggatgagtatttgtgttacttcttttttttttttataagactgatagtattcagcagagtatccatctggttctgggcttctgtttgctcagttctccatacgtattacttatatagatctgtttaagttgtttatatcctcttggtataattttggaaggccatatgtttctagaaatgtattcatttctttcagattttccaatgtattggaatacaagtttcccttgtactctataacaatcccctggatttcattgatatcccttataatgttctcattttctttcttaatttggggcttcctccttctccctcctccttcctaccttccccatctccctctttttctccctctcccttcattcttttggttgttatttaactggttaaaagtttataactcttgtttgtccttttaagaattctttacttcattgactttatttttcatttactttacatttctataatgatcttcatttcttgcttcctaccaagtttggtttagcttgttcttatttttctgaccttgaggtatatcataaaattatgaattctctttgaatttttagagtaggcactcatacttacaaacttccctatagcaactgcctttgcagtatcacaaatgtcctgataaagtatagttttattttaatttgattctatgaatattaaaatttcctccctcattttttccataaaaccaattgatcaaatgggcaaaggataaaagtggaaagtggtggatgtaaattaagagagagaataaaaaaattgactattagaagatgaaggagaaaaataaaaacacaaaataataaaagaaaattattacaaatacaaaaataaatgtatatatatgtgtatatacatacacatgcacgtatgtaggtattatatgccattcagcaatactagggggaaagggcacagtagcacactattataaaaccagaactgtaaaggtagagctaagaggatcaccagtttgaggaccagtgtggcctacaacgtgatttctaagccaacttgagctaccttgttaaaatgttccaaaaaatgttttagaaattaaaatgttatgtcctctgggtagtcatgtgaacaatagtggctgttcattatgtctaccagttggcacttatatgtccatatgtctagaacaataagcttattggagaaagcaaatgcaggtgatggtcacctttccttttctgttgtcagccaatctgacaatgtgagtgttttagtactgcatatattgttttagtagtggaatacctttgttccatgcttgctagtatgaggtggtataaaccaaagttccctcagtcagaatttcctccaaatatattagttgaacatactttccacacccccagccagagcctgcctgaccctgagatccacatagataatggggcaacaaactatacaaggtagagtcatagagcaaatctcatgtttttcttactcacaactgtagtttcccgagtaccagtctacatatgtgctttctcagccactgagcatttttatctgaccactgcactgcttatctaaaaggggaacatctcccacctgaatgtactacatgtatttttcaatgagctttccttagcagcattcggctgggcctacactggatgctgcaagggacagagtagaaaaattcaccacgagttttatagggaaggaaactgtagggagatatttctcaaagcaagcagcttgaacatgaccttttaaagatgtgaaatgtggaacacttcccaagcaccagcatgctatgtagctcccagcagctaagttcagactttctgctctgcatctgtctctgtgcaagttatgcccactaaatctttctccttttctgatagtacctctgacatgctgccaagccactacaggctcagtcaggatgcaaccttttcaccctctgctccaatagccagaggctctgcatttccccaactgtgtgtctgtctaatagcttcagtgcatcccctccctcactttctgaagaagctattttctgactgttctgatttctagctgggaaaagtctaaatattctgtttgcttctaacacaaaagtttggcataaatatatttccatattattgtataaacatcagtgattagcaacaaaaacatgtattttaaaggaggtataagcaactcaaatgttcattgttgtgtgatagataaatagaacatagtgtatatctgtaatgaactagtatgcagcttcaaaaaggggatctagtcacatgctacaaggttgatggacattgaagatattgggataagtgaaataacccaactatataacacagtaagtgttgtatgatggtggaaaggaagacaataaaggaaggggtaaaaatgttcatgatacctctgaatggtgggctagaaggggggttgaaacatttatgaaccctaaataaagtaggtgttgaaaaatataggcctacatacatgtgtatgaaaatgccataacggagccattattttatgtgtaaaccttaaaattggcgataataaaaatatttagttgcagtgcaattgtattaaaaagtatataccgtaggaaatgattcatctgtgagctgtacctttatagatgaaattactgctcttgaaaatcaagctacaactgagctagaaacttcctttatgctagataactttcatagtgccagaagaactatgtagactgctagaggagcctagcctgctaggcctgcatgctataccacagacctacaagacaagatgtgcccactgtggcaatagtggcataactgttgagtatatccagccacattctcatttgatttgaggaggaaattcatgcctattactgtaaacctggtaacaagtctgtagctgtggaggccataagccctagaaggtaaatgtttatttttattttgctaaatggacatgttatatccatcaagttatcatctaaagacttacggttgtgctcatacatgagtgctgttgtctgttttgataggggaagcttccttttgtagtgggcagcgttactgcagagattcaaaagtactcaaggtgctgagaataagtgacttatggactgcccagccctaaaggaagcatcgctatcatctgccccaaggcttgaggaacttttcagaaaagggagcagaaggaattgtagcagctagaagaaaaggaagagtgttgtcgactgctctctcctgcctatgacatggttgtagcactattgaagtataaactgcacaagattgggcctatcaaatttcatcatgggtggggaaggggatcacaaaggcccactcctcctagagaatttattggctatgacagttgctatcaggaagaggcttcaccccttcctgcagcactattggtagtttgattgctgaaggatggaaagacatttttttcatagatgataacttgctcctctaaattaccctcatccaagcaaccctatttaaagtgatggggacacccaaaaccaagaaagagagttggtacttgctaggaagatatatatatatatatatatatatatatatatatatatatatatagagagagagagagagagagagactttacatatatttgtttttaaggcagggtttctctgtatccctagatgtcctggaactcattgtacaccaggctgaggtcacagagatcacctgcctctgcctcctgagtgctgggattaaatgcatgtgccaccatcagctgtgtttctgctcagatgaagaggtaccccacctctctgaggtgggacagtgtcccagtggaagggcatcctgagacatggaagctcaggaaccgcacagctttgagaggaagcctcctgagcagaggcattgcagcgcccaggagagggtaccaccagcttaagctgaggagctcaggaccctcaccagagagtcacaacaggcaaaataatcttatgaaagagattgaagggtctagggtataaagggacgaatccaaggatggatgccctctgcttcctagagcagacagaagagaattggacaaagggacacttgcttatacaggatttctgagggggcggagcttctcagggcagagatttccagattgaagattggtgggatttcaagttctgagcttgggcaactcagggattggaggattttcctgttcagagattgtggcttttttttcactcccttctacctgcatcaggctcatgggttaaggtgggaagtacttgtctactgcaatcagcttttgctgaggtatcatctgtgtgtggctgctccagggagactggagaggaggtgctgccactgtggatagctcctgtgagacagcgcctacagtttcaccaagaaggtattgtcaccgtggacagctcttcatgctgcagtaggctgaggcaggaaaggtgttgccactgtgttcctggggagcaccctgcttaggcaggaaaggcagtgcatcactacaggcagctcctgtgactgctgcaggctgaggagatgtcctggtgccaccattttaacagctcccgctggggcatctcaccacagccttgggctgagtgggaagtggggggccagtcatcactttgactgcttctgcagcatggcgggccacttaaggattacatcacccagcaacaaaatatagaatgacataatgaaacccattattgtatataattaatatattttaataaaaacaaattattagaatgcctttaaacagtgagttcattctttaatcccttttgttttatcatgtcagaaacagaacaagctatcatctattgaacagaagttagccttcaccacacaataagtctacttttgtaccttgattgttttatcccccaggtctataagaaacaaattgttactcacaaattacccaaggtattttaaggcagcataaaagcattatacaaatattagaagagcaaactccaaaaacaatgacaggaccaaattatgatgaagatatcaaataataggaatttttgtttgttgctggagatacaaaattggtacagccattttggaagaaagttttttcataaaatcgagtgtacccacattaaatggtctagttatcatgctatatgtacttatccaaatgagtttttgaaagcttagacctacacaataattcacatcttattcagttcattaagatgtccttcatgggtcagtgagtaaacaaacaaatgtgttggatacacacaatagactattcagcctttaaaagaaataagctttcaagccaaaatgacacaaagaaatcttaaatacatattactgaataaaataatttagtctgaaaagtctttatactgtataattccaactaatacaatatgcttgaaaactaaaactgtggtgacaataaaaattttcataattgcaggatttggggggaaggaataaatactgcacagggaaattttaggacagcgaagtcatacgaaagtgggtccatggcatatgtcaaagctgttagattgagtgaacattaaactgtagaacttaggggtatgtgtacttcagaggatggccttacgaattgaacttagagtaggtttttttttagcattatatgaaattgggaggggatgggctggtggatctggaaggctttaggggaacaagtgggaatgaatatgatcaaaatacattgtgtagatatatgaaattcttaaagaattacaaatggtttatttatttatttatttatttacactccagattttattccccctcccagaatatgatcaaaatacattgtgtagatatatgaaattcttaaagaattacaaatggttttatttatttacttacttacactccagattttattccccctcctggtccaccctctgacttctccacatcccatacctcctccccaccacaccccgtctccacgtggatgtccccacccactaccccaccagacctctaaactccctaggacctccagtctcttgagggttaggtgcatcatctctgactagacccagacctctgctttatatgtgttgggggcctcatatcagctggtgtatgctgcctggttgttggctaagtgtctgagagatctcaggggtccaggttaattgagactgctggtcctcctacaaggttgccacaaaaatccctgacatagtagtgcatgcctttaatcccagcacttgagaggcagacatgggcagatctctatgagtcccaggacagtcagggctacatagggaaattctgtcttaaaaaatgaataactaaataagtaaaaggaggaatttagagatctagagagatggctcagagattaagaagagaaaacttgctgttgttgcaaagagctgaagttgggttcccagcactcacatgaggcaactcacgacatgtaacacgtttcttcactatcccttagtttattatcttttttgtttctttttatgtttcctttttttcatttatgtacactgtatgcatgtatatctgcatgcagcttacatgtgtgagtgggggtacaggtccacatgtgtacacatgtatgtggaggtccaagctcaatttgatattcaatgttctttcaccacaactcaagtcaaggtctctgaatcaaatccaaagctaaaagatatggctaccctcactagccagcttgctctagggattatgaccacacccactaagtatttccatgaattctaagaatctgaaatctggtcccagcgtagccatctctccaccccacctttgaaattattattgttgttatttggcaagttcatatataaacataatgtattttggtaatttttacctcattttgtactgttttttttttctattttattttcctttttctgaccagttttcctttttttccttctatctcccttttctttatacttctcttccaggcatctttccctctgatttctccttttacataggcctgttattgttgcaaacggacattgaaactaaatattttaagttattataattatggatttattaataaaataaacaattacattttgtttttaagtagcatgaccaagctacttggagaggaaaggaatttttggcttatagcttgtagtcaatcatttaaaaaagtcagggcagaaactaaagcagaggccatggaggggtgtaacttactggcttgttcagcctgatttcttatacaacccagaaccacttgcctagggatagcaccaacaaccatgtcctgggccctcttatatcagtcattagtcaagaaaatgcccccacagacttgcctaaaggccatattaaaggaggcattttcttgatcgaggttcccagcatatcatataattgaagcttctgtgctggaagaagatgtattcgaagaaagtaaacaaaaatatattgtgaaagaaattatagtaacttgtcctaaatgttcgccttgctctttattacagttatataaatgtatacagggctggagagatggttcagaggttaagagcactgactgcttttccagaggtcctgagttcagttcccagcaaccacatggtggctcacagccatctatagtgagatccgatgccttcttctggtgcgtctaaataaataaataaataaataaataaataatcttttaaaaaagatgtgtacaagactgccttaataagcaacctttggccgggcggtggtggcgcacgcctttaatcccagcacttgggaggcagaggcaggcggatttctgagtttgaggccagcctggtctacaaagtgagctccaggacagccagggctacacagagaaaccctgtctcgaaaaaccaaaaaaaaaaaaccaaaaaaaaaaaaaaaaaacaacctttgaagaaaaaccctttggtttcaagttcatgaactctagatgaattgcagagtgtctgtggttgtttgtcacacttagagaactgctaaaagttctgactgagggaaactgttgggtttaagcgttactaagtttaatgtgttagtaataaccttatgtttcttagaattctggctttcctcctcccctccctttcctctcctccccttccttcccctcccctccccttcctttcccatcccttcccttccaaaatattatctcatcacgcagcctagggctagcctctaactcattgtgtaacccactctatcttcaactcacttcctccattctgagtgttggaattacaatagcactccaccatgcccctctgtagaagagcctctttcattttcttgcaggctgataagatttggacatctctgctgaattttagatttatttccttctctaatctaatctataggcagctagagtagactagaaaacgtttggtgctttaaatgttgttcaaggatgacatttgaaatgtaaataaagaaaatatacaataaaaatatttaagatggtgatctagccctttagttttgaggttggtgtactgtgtgtgagtatacatatttatcacacacagtcactatcttcgaaagtgagggtgcacatctttctcagccatctcttattaagccattaaagtaatgccaacatctgaagctagcacattctggttctagaaggtcgagtttttccttggaataaactgagtttagcctgagcagagaaagaccttcatttttaaagttagtagtagtaatagtaatagtagtgtgtgtgtgtgtgtgtgtgtgtgtgtgtgtgtgtgtgtgtgtgtacagcggccaaaggagggcatcaaatgacttgtgttatcactctctgccttgttcctgttttaaggtctctcacagaaccatagagtcaggacgagagtcagaaaacctgactgactgattctcctgtgcctacctcactagggtttctggcttcctcccagccatgcctggcttttattgtatacatgctgagagcccaagctcaggttctcactcttatgcagcacagaagaaaataaggaagttaggtgacacatcagccaaggtacattgaggttacctgatgcttaatgactctttacacaaaacagaggaatgcctacataaagaccagcaggaactaggcaatgtaacaactgagacaaagtcagctctatctaaggtcagctatagtcttagaagccaggtgtgaggtcgttacactcctggggcaagggctttcacgcccaagccatagttctaattctgatttattgtttagcccaccaccacccagctcttagtaaatacctaactatgctattccccagggctagtgaaagtatgtgctagggagttccgctctagctaaccttctcatgaataatgcaacacactagttcctccttaaatcacagcccgatcttcttcctaaacaattgtaaattcctgtatgtgggagttactcgcctgttattctaagtgattttgtgagggactttcttctattaagtaatgtagtctgacatatataactataataagaattctaaacttactttgctaagcttgccctgaaatttctaactatatgtagtagatagtaacgcccgatttcttttgctatctctctttcaatactggaggcaattcgtctgaatagataacattcttactaaattccaagcccagggtcagctcaaggactgcctaggacgttggtgaagaccaggaagcaaagttcaacctaatttaggtatttgtcaaatcattccttggaggcacctataataaaacaatactgaaagaaagcacacagaaccattcgccaactattgcaaggacgaatctgaaacacatctgtttatgggacaccagaaactttccaggagacaagtttccataaaactttatgcctcatgactgtagccaagcttttgggcctgtcaggcagtttttactggagtgggtgtggcacactgtagctgtcttcagactcaccagaagagggcataagttctcattacagatatttgtgagccaccatgtgtttgctgggatttaaactcaggaccttcggaagagcagtcagtgctcttaccagctgagtatctctccagctccccattttcctttcttaaaccacgcttatatattggctttcactttgccctcatttcctagtgtactggctggtattgggtgtcaacttgacacagctggagttatcacagagaaaggagcttcagttgaggaaatgcctccacaaaatccagctgtaaggcattttctcagtgatcaagggggaaaggccccttgtgggtgggaccatctctgggctggtagtcttggttctgtaagagagcaggctgagcaagccaggggaagcaagccagtaaagaacatccctccattgcctctgcatcaactcctgcgtcctgacctgcttgagttccagtcctgacttccttggtgatgaacagcagaatggaagtgtaagctgaataaaccctttcctccccaacttgcttcttggtcatgatgtttgtgcaggaatagaaatcccgattaagacacctagagaacacaaaacagataggagatttaaaaccatagaagtttcattctgcttcttaacaaatcatttctataggattcctggtggctggaaggcaaattgaacattctactttgatcttgtattagtaaagcagatggttttgttaaacaactccctagggaagatttgggtctctgttccagcttctgacatagccaaaaagaatcccagagtggatagagctgaattggcctttcagacatttttgttcaatcccttatggtacatattgaaaattcaagcctagaattggatattgttcaaggtcacagtcacatagtgaatttctggcttcaagagagattattcttccctcctatgcaaagggggaatctaacagatactgtttaagctatgaactcttgtgagtgtgaatgtttcatgtatgccattatagtttaatttttaataattggaataattctatatttataaaaaattgcaatgtacaaaaaatcatgatcattgtctcttttctcttatattgctgtggtataatttcaaaataaaaccccagattttatcagttttctatgctagcatctagaaaatcaggatcagagataactgaaaatctttgatcttcctatttccttagttttctcatctgtgccagttttttaggtttacctgtaagatgttttgtacaatgtccctcaatttgttgtgagttttgaaaaaaatactacagagatgaagtgtcattactatcaaggtatatataaagtggtacacagtatcagtagttaactttgataatatggtttgccatgttcacacaatagaaagttgaagtttttttcttttctgttctctatgcttcagaaattcactcacacctaagttcaacctccttgaaataaagaatacttgtatatatttacatgtgtagaaatataattcatgtttttctaagacaatgtcttactgtatagttgtgactgtcctggaactcactactgtttgaaactcactttgtagaccaggctgacctcaaactcacagagatccacctgcctctgcctcttaagtgctgggattaatagtgtgcaccgcttttgtctaaagcaatttataaaaaataaatatagaatttggagttctttttaaagaatatcaacttttgttgactgctatttgattcctgtgcatgaaggtagaagtgttttggatgttagcttatctgttctgttgctcacaatgttcttactttgaccgtaagtgattctttcagattagcttctgtagcctcttgacatgcagcttgaattttatcttcttagattgataattttctggtacttcaaaatactccaaactcacaccagcagtttctttaaggaatattaattgattgggggggacaatgtatttgaaaaccaagatctgagccaatcttaccaactatcattgtttctgtactttctcaatggacaacttaagtaatatatagctgaactattctatatatacatatgcatctataattgtctatcaatctattttatgtatattaagctaaatatgacctcatatcaataccatgaatgaatccagtactagtcttctattcctgtttacctataaatttcttctctaacagtgagaaaactgtgttctaacacctactatacatttgtttatttcttcaataccaacacatataaaacagtttcagaattgacctattgtccctatgagaaccaaatggacaagaataatgtttatgttcagttatttatccttacaattttgtgtcaaaacataattttctcaagtaaaatctgctttatatccctcagtgcagttacatcatttatgttttatatagttaaattcattttcacagttttcattccatcttatgatcttccaacatcttggttgatttttaaattttcatatactaaggctaagtctttgtgaataggaggtacataatttttggcagagtgttatatactctttactccagcatcattgagaaaagttctatcatttttaaacttctgttgttgccaaccaggactccttctcctaacattctgaaattactcatgggtttccatccctatattccaatctgttttacagaatggcataacaatataacaatataatatgtggcctatttgggtatagtttctgtttctcagcaaagtttaatttaaggtacagttcatattgtgtgaattggtaatgcatttaaaatgttccgttttgggggctggagagatggctcagcggttaagagcactgacggctcttccagagatcctgagttcaaatcccagtaaccacatggtggctcacaaccatccgaaacaactatctggcgccctcttctggagtgtctgaagacagctacagtgtacttacatatgataaataaataatttttttaaaatgttcccttttggtttggggagcaggatgggggttatagggggctttggggatagcatttgaaatgtaaatgaagaaaatagctaataaaaataaaaaataatgatgaaaaaatgctcccttttgtctttggccatgttacccctaatacgcctaatctcaccgagtgttttgttttattattgactagtattccattgtagaaataactagccaatattttgttaaaagtcattttgagtatttctaactttgggaaactatgaataatgttactataaacatgtacttataggggttttgtgttaaatatacatttctaatttattttggtagactactagcaatatagttggtggatcatactataagcctatttacatttgtgcttttaacatatatttccaagaagtttgggttgaagttgtttgtagggtgtaataggatctctgcttgtaagctgattggaataattatcattctctaagcatattctgtatggatagaaaatacaatatccacaagaagatagctacatttaccagaatgatgaaatttctgtaaaatgaccaagtatttgctaacatctagaaagtcataaatctttacaagattatggaagcattaaaatttggtcattttatatacaaagtagtgaaacaattaaattagaaaacaaacaactcagtgtttttaaaaattagctaaagagagaaacagaattcacagaaaattaacttttcaatgagttcaacagccttagtcatcagataaatgcaaatttaaactactttgaatcagaatagataacatcaagacaacaaatgacaactaatcttggtgaggctgttggaaaagaggaacattaacaccattgacggaaatgtaaactggtacaaccactgtggaaatcagcttggatgtttgtaaaataactgaaaatagaacgattgcatggcccagtataccactgctgggcatataccccaaagactatatcccaccacagatatatgcacaaatacatgtttactgctgcactattcatagtagaaaggatatggaatcagcatacatgtccatcaacagctgaatggataatgaaaatgtggtacatatgcacagtggaattattcagtcatgaaaaatgaaattattgattaaattttcaggaaaattgacagaactaggaaaaaatattaattgaagcaacccattctcagaaaggcagaaacctgatgtcgtgcccagtattcagatcctagcttctagcttttctctatgtgtagttatgtgagaatgagtgagtataaacaccagaaaactagaaactggaaggaggagctataagggagaaggatgaggagagcatcagaatacatgtaatatgaaagtggaaggagggagggatctgggcagcagggcatgtggaagacaaggagaatagggagagaagtataaaggatcagggacttggctgtgggatttttgtcttctaataacttcagaagctatacccataagttacacactaccaacatgtctaccaaatgtgagctaaacaagattgaaatcaacaaatttgccaaattgcatgggaaaagcccaggaggcttcaactctacacaaagatctgcacaggcaacttagttaagctgggagcatgagaggtagtcctccccaaggaagagcataccaattggttgtccagttccagtcagccatcctcacaactgatcctaccccagtttccctccccacctactctcccatctatccacctccttccattaacttccctccttctatccatcttcaatgtctattttatttccccttctgagcaagattcaagaaacctcccttggattttccttgttacttatcttctttggatctgtggattatagcatagttattctgtaatttatggctaatgtccacttagaagtgagtacatatcatgtatgtctttctgggtctggggtaccttactcagaatgatactttttagttccatccattttcaccatgtcatttttttaatggctgattagtattctattatgtaaatgtaccacattttctttatccattcttctgtaggttgccgatttgtcttatcgactatgttctttgccttacagaagctttccaatttcatgagatcccatttatcaattcttgatcttacagcatgagccattggaattctgtttaggaaatttccccctgtgccaatgagttcaaggttcttttccactttctcttctattagagtcagtgtatctttttttgttgttgtttttttatttttttgaggcagggtttctctgtatcacctggttgtcctagaactcactttgtagaccaggctggcctcgaactcagaaatcggcctgcctctgcctcccaagtgctgggattaaaggcgtgtaccaccacgcccggcagtgtatctggttttatgttgaggtccttgatccatttggacttgagctttgtgcaaggtaacaaatatgggcctattttcattcttctacctacagacagtcagttggatgagcaccatttattgaagacgctttttcccccattgtgtatttttggcttctttgtcaaagatcaagtgtccgtaagtaactgtttaaaaaaattctgaggattttacttttctctgtgattagaaataatttcatcaacagtaccattgtgttccttactagtttcacattgcagtttcttatcagtaactgtatatttcttggtggattgtattgtagggttgttgttttgtttgttccaattatttttcatacaagctacattgttcaacaacggggggggggggggaggcggttggcaaagatgttgacctctcaaaaaacatacagaactgaaatagtggagcagagcacagccagattcttcccagcaaacctcagggaagtctctgtgaagaacggtttctctggtgactagtacctgtaggagatttgaaaaagaatcgaaatggaaatgaattaatgtgaccctaaatatggctgaagtgtacaggttttttttagctaaatactggactttatttccagccagccttgatggttcttccaaagggcagaagtggggagggagcgaggtttgcaggggatggaggtggagtgtgctctaaggatgaagaaaaagaacataaagagactgtgccggggcctagcaaacacagaagtggatgctcacagtcagttattggttggatcacagggctcccaatggaggagctagagaaattacctaaggagctaaagggatctgcaaccctataggtggaacaacattatgaactaaccagtaccccggagctcttgactctagctgcatatgtatcaaaagatggcctagtcggccatcactggaaagagaggcccattggtcttgcaaactgtatatgccccagtacaggggaacgccagggccaaaaaaaaatgagaatgagtgggtagggaagtgtgggggagggtatgggggacttttgggatagcattggaaatgtaattgaggaaaatatgtaataaaaaaaatcaattaaaataaaaaaaaaagaaaatccatgcaattagtgacacgtgaaaggatagtctgttttctgtctgaacccaagtagcaacggcaaacaagactgttaaagagcttccagagggaccactagcatcataatggaactttgttaggaaagtgggtgtcaaatatattttatctcccttcaatctcttcctctgctttaagctccatccctaaagtggatcttgaggcagttccctttagtttgcatatgagcttaaattggctcatttgtttatctgatacattaattttactcagtatgtcagagcaatgtcagtgattcttctttgactggccttatgctgccagaccttagcagccctggaaagctttcatatataatgtaatatggtctctttagattgctaaaggaagaagacagaaataaggtgtggagaccctgaaatcaagggaactcataacttcttttgaagtaaagtattttgaggttgtgcataaagaaataagggactgactcattccttgtcttactacaactgcttcttttacccttttctagcagttaaaatagcatttgcataatttttatactaatgctttcctatgtattattggatcctcacactatttttattgatgcaccacggccaaactcaaatgttttttctacacaaacattgaatttaacttcccgtgacatctttagaaattttatgaaatgctctgttgtattaagtcacatttctttctgttttaaattatagttattcatatatacatatatatacatacatacatcatttattatattcaaaaatggtcaatggcgtgttctagataagacttactcatgactgacatagtgagcaaataatgaataatggaaaagaaatagagtagagggctgaagagatgactcagtggcgaagagcactgactgcccttcctgaggtcctgagttcaattcccagcaagcacatggtgactcacaaccatctgtaatgggatccaatgccctcttcttgagtgtctgaagacagctacagtgtactcatataaataaataaataaataaataaataaataaataaataaataaatcttaaaagaagagagagaagaaagcaaatatttaaagcttagataacattgataatcatttaattacagacatagaatttaaatatgatttttttctaattttgtattaacattttgtattattattttaaaatccctcaacagtttccttgaacacacttactcttcacaaaaatagagatgatttaaagaagtgatagaccatgagagattggcataaattgatgagataaagtacgtaggattgttgtacagtatgcaacttagttggtaaagtgcttccctagcaggctgaggctctaggcttgatcctagcattacattaacatagtatgcatctgtaacccaatattggaaaggtagagggaagaagatagaagcccagagtcatcattggctacatgcatgtctgtctacctgctccaattgactttgtctcaaaacaaaacaaaatgaatagagaatggtattctgaacaaacaaatcagtgaaactcataaggagggtgggagggcatggtttgtagagtgacgaggccacatctaacctttggatcacgtcttgaaaaatcatgcagaattctgggaacatttagtggtaggaaataaagcccatgtcgaaggccttctaagagggagtgagggaggtggtagagatggctcagcaagtgcactgactgctcttgtactcagttgctgagtgctcctgccttctgccttgatcaactcagaatatgaagtatgtcttattaaacataatctaatgtgtgtaatcccagtacttcagaaactgagggaagatgatcataagtattatcctgtctcataaaaaggtttaaattgctcagtagcataaaatcttagttgccaaattttcaaaccaaaactcagagaatgccatttttcaggttccctcctccgctggggcactgtgttatcctttctctgtccaacttctctatactggaatcagatttatttttaactacttcctagctttacaagtttggtaggtttctttccttttttctttttcttttcagatgtaatgtcaatttttttaaagatttttttctttttattctctcatacaatatatcccaactgaagcctccactcctccaagcctccccacccagcctccctctcccccagatccactgctcttcccttcagaaaagtgcagatcttatcaactgaacacagcattaaaggatgcaaaaagagtgggcacaaatcctcatatccaggctggacaagacagcccagtaggagaaaaagggtcccaagaacaggcaaaagagtcagagaaagctctcactcccactgttcggagttccacaaacaccccaacctaaacaaccacagcatgtatgcagaaaacctagtactgacccatacaggtttcctgattgtcatttctgtctctgtgagccctgcttagttgattctgtgagctgtactctgcaggcatcttcaaccccactggctcctataaccactcctcccattcttccacagaactccctgagcttaggataatgtttggctgtgggtctcagtatatgctcctatcagctgccagaggaagattttctgatgatgactgagctaggcaccaatctatgagtgtagtagaatattaggagtcattttattgatttgggggggggggtaagtcctgtttagttttaccctaggtctctgcaccatccagctttcagtttctggccatccaggcagtactggacatgggctcctccttgtggcttcagcctcaagttagagtagtcattggtgggccattctctcacagcacatcttgcaggcaggacaggtgtgggtggaaggttttgtggctgggttggtgtgccagtcccaccattggaagccttgcctagttaacagaagatgaccagttcaggctgtatatcctctattactaggagtccccattagggtcaccctcataggtttcaggaagtttccgttgcactagatttccacccactaaatacccccctatctcatctctccctctttccctccttccataccggaatcagatcttgttttttcaacttcctagcttttaggatttgtcgggtctctcttaattcatctgattcttaagattatttctcctcccataaaagataatgcccaatttataattttattgcacagaccaaataaaataacagatgtgacatctttatagcctataatatactgtgaaaataaaaggtagttttatcatgttagtcaagaaatgccaaaaggcacaaaattttatcacatctatgaagcatgatttttcactagatcatgtggtatattgtttcaagcctatttatagacacagatttgcttaagttcagttcacttggacactttgagtaaagttaacattagagaaaaaaatctagtctttttctgattgatacaaaggccagtagcaattatatcacatggatatagttagattttttttcagttggtatcttactgaaatccctaatgaatgcctaatgaatcacctaatgaagagtgattaaaacagtcttcctttaacagaagaaatattttataggcaattagtaaaatgtaagaaaattagatgaaaactgaatttacattcccctagctacttctaagtgtgaaacataaatctgtgttccaaatctcccagtatgtagaagtatctttaaggaggtgacaagaaagtattgaataatccttcattgcataccattgtaagaattccttcctaggaagatgtaagcaaaggattaccttcctcttaacactcccaggacaaaccaaagtaagtttctatcaaagtctaacttagacaactagtgagtatttttttacttacagagaataggtgacttcagaaagtctcacccaacagagatgatgaactcttcagagatacatagatggaggagacacacacatacttcatttaacatttcccagtctgtataatcccaaaccctaatggcacatgcagttaaggtagaatttcatgcaaataactgggaaatgaaggaaagaatcaggattttcaatgagagtgcaatgactctccctatccccaccttctctgagagaacaccaacagtcaaaaggccagtcttgatgtctttatggtctcctgcaagcaggcacagctcatctgatgaaagtagcagctgttgtctttggagtaccacattctataacatatattcagatcactgtgtaggggcttagtgtggtagtatacgtaaaagtctaaggtaatgtagcatcctgtattaaatggtatggaacagaagacattctggagaagtgatttcagaagactgatagaaagactgcaaggggatttttgtgtatgttcaggcagaaagagtaagaatgtcttccaaatagaaggatcatgtcaggtatggtgcgtgattccaggtaaggctcttgagatatggcagggacagtttcgacagaccgttcttgaaattctgacagagaacactaagttggatatggtaggcagtggtgaccctttgtgaattcctgagtcagaaacttgaagaggaaataatgtgttaagcagtgcccagggcacgttatcgtagacataagcacttactatcaaaactcgcttgtaagctttcattgtgtgatgtaatagtaggtataaagaatgtagtgttccatgcaagatatggtcaaaaagagagaacaataagaacactggggttcagaaaattcttatcaataagtcagaagtctggcataatagggactttttagatatgctatagatgaacctgaaattcaataccttcctagagctaaatcagtgaatggcttctggatctgaccaacttccaggagccaaaatgtgcaacaatctttcctctccagactttctcaaagcatatgaactcaacatttgtgttagtgtgtgtgtgactgggtcaaaataacctctgctgtctgaaaagaaagacaattcaaagaaaaactgaacagactcaccaccaaaagacgatacacaaagaagttaaaggaaaacaagagaaaagtcagttaagtagcaagctgtttttactcaggaaaatgttcactttgacacacacaaacgcactcaagcatctgcatctgtccctaccctaaaatacttacatcacatactggactagaatgataaggctctgtgactttaagaaggtttcttaaaactctaagaaacctcaggcttctcatttgtgcaatagaaatgctaattcctttctacttcagaggattttttttgtaagggtaaaataatacaattcaatataacgtttctagaacatagcatgaatttaataaacttagtataattattagatattaagaggatactggtcagcttattattggttcttaaacttgagttcatttacaaacagcaaacatttctctcagctttgttgttaagtggtggctaaagggtagaatttaacctagtgtgatagcagctgcttaaatagcaactgggttttagtttattcgactagctacagttgaatagaggttatgttggatgagtggtcagcagctaataaatctagtatgcaacttgttttggtgaaatactatacctttccctttctttacccttcctgtttgtaatcatattttctgtaaataaaataagtctactcctaagggtaatgtgactttaatctaactggtacaaaatatgcattttctcatagagtttgcttatgatgtagcttcacttgagagaacttaagaaataataaaagataccatatggaaatcattaaaaataagagctatttattgccattcacctgcatatgctgtctgtggagcctattggtgcataccaaacacaaggatactgtccattcatacagtacatgtgatggcatgcttatatttttggctatgcttgggttctcgtatgaattgctttctttgttcagtaagactgggatttaatctaaagaagtacaaatactactatgacttttccaggtgaggttatgtgtacatcttgctcctttacctttgttcacttttatgtagacaaacaaatagtcctttttaagcataaataaattagacaaaaataactaagactatagctactattaggtatttgtggataattggatctaagatgtcacaatattctccagagtaatttagcaagtgataaaatgtttagcctaccttggctattccactataatggaatcaaattactatggtaccttgcattaccttgtcatcccatagcttcttggtgacaactatttggataaccaccaagattttagtgtcagagctatagctatgagttggcatggcagactgaacccttatactctggctaatattgtgaacaaaaattagcattcaattttgtcatgttaactcacctgaaaattttatagatttcagccctctattcctatttatgaaaaaacagctccttggtctcatttcttcatattataaagccatacgtttgtttctctggcaagtaagttcagtacttgccagtattagcaaaattaccaactgattctgtgatgtgtttgcaaataacaaggcacattttattaaatagtctctgtaggggctatggatctttaattacaggatcatatttagagcattatctttataatgctagctttttaccttttcaagagccagcatcttgggggaaaaaaagcctgccagttattcatattatagttaggatagagattggaatatcttgtctgaatatggtacaatttctccagaactgtataaatatactggaatattttgagaacaaaagaagtgagtgatagcacagaactagttgggaaaactaaaaaattggagcaaaaatgaaaagaggccaataaaaatgaagaagaaagagtgaacaaaaataacttgagccagaataatagtccccctccaatcttttaatatgtgtcaaaataacttgtctataatccacaggttgtctcattatatagtaggttcatttgatctagtaagatttttatctaggtgtatattaagagataattaggctgtcttttacactgaaaaaaaaggccaaaatgtaaatttttttctttaactcataatggaagatgttggaagacattttgctacagctctctcctatgactcataacccatattcctgccatcttactggtatcttagttttaagtgaggctgaatctttgggccctaatggtttcaggaagtaaaaaggaaatgggttatgcaataagaaaagtctaatgtcaccacactcatcttcccttctaatccaagcgtagtacctaccttatttacagagcatattgtatggtgaattttatatctgcattgacaatgttacaggtcaatatatttatcataaatgacaatagaatggatgatccattgaatatttatttaaaacttctatgtaacaaaggtttgatttatttcaagaaaaccaatcacggtctctctctctctctctctctctctctctctctctctctctctctctctctgtgtgtgtgtatgtgtgtgtgtgtgtgtgggtgtgtgtgtgggtgtgtgtctcacattggggtgattaaaccaagcatgtcatgcatgttagtcaagctgactgcactctcagaccaaagtatcttatttattttcttgaggtcctggggattgaacctaagcattcttgaatccattgtttctctcatctgagctcccaacaccttttaaatattaaaagcaggaattgtcttcattttgcataattgcataagaataattagataaagccatgatttaaacttgggcccttgctgcttgtccagcattcctcttgtttcccactatgacctcttgtgattcaacttaagttgactaacctaatgtgccactttgatcacttatcttttctaccaaaaactgtattgaataaactacaagattcaaagccctcagggcccaagcaaccccattacaacaacaactttatgctattgtttccctggcccttgctttttctcatcaataaaccaagatgacagttactttactgacacgtggtatagtgatattcaagtgtaagaatgtatgtggccattttgttaaattgtaaagccatctgtaattatttatttatttattccttaaatttaactgaaagcgacactagaaaagcagactgagaccctccctcaaaaccaaaccaaacaaagcacaccagaatttggggagggaatccttcttactgtatttcttttgattaagtttcatctgacaaaaatatattgattataatgctaactcttgatttcaggtgctctgcaagctgagaactgacttcagtctcctctacttttttattagtttcctgtaagtagatattatatatataaagagttcaatggaattgtttttgctacagcagcatgttaatgagttcaagattgttgtttaattcttttttaagatttatttatttattatatgtaagtacactgtagctgtcttcacacactccagaagagggcgccagatctggttacagatggttgtgagccaccatgtggttgctgggaattgaactcagtatctttgaaagagcagtcagtgctcttacctgctgggccatctcgtcagcccatcgtttaattcttttttttttatttatttattatacataagtacactgtagctgtcttcagacacaccagaagagggcatcagatcttgttactgatggttgtgagccaccatgtggttgctgggatttgaactccggacctttggaagagcagtcgggtgctcttacccactgagccatctcaccagccccatcgtttaattcttataatcagttagtccacatgtttgttattaatcttttggttatcacacagagaaatgagttgcattgcgacatatccattatattttgtttatttttgcccactactttctttgcttgttcttgctggtcctctatccactcaaatagtaccactttctattttcatggcacacatattcctgtatctaatcttgttcttcctacccctcttcttcctcacctctcatagtaccctttctactttcaaagagagggagagggagagagagaatgagagaattgttttattttcatactgggaatgtctcacattgatgtggcaatgcatttgtgtatcataaatggtagtagaataaatgatccactgaatctatgtttatgaccccatcaaagagcctttgccctcagccctagtatattaatacaagataggaccatgagctttaccaggaataacttagtgctggacctaaaccctgattcccttcctgttagttagatggagttcaatgagttaactttttctgagatttttttccatatttattaaagaaaataataatatatgtttaacaaggctgctgtttgcataaagtaataaatatatttaaagtgcttggtaaagtatcactcaatacatgttagtcttcttttatcacactgtaaatgtaaagtataactaggtgagtttgtggatggatcagtgtagaatacatccccactcctatagaaagtccttctgagaacatatcttaagaatggagagtgtttccagcatcctatctgaacactaatggcagcattattacagatatacaagcaagtaaatactccatctttagcagctgtgtttagttaaggaacagatttagaaagtgcagactttaatctgtgttttctctttggattttggcaccatctgatttacttttttctggataaaaagtgtaattgtagcttgatttttttcccctccctatacacgtatttctgccgtcctccaaagaaaaagctgccttttaaaaagcctaaataggacaacgtgtaaatatttgaaagacatggcaataagtggatacctgaagaggactttagagtaaaaactttagtgactaatgcctttttttctttaatgcccatgaggaacagataactatagaggcaccacatccgaaccttatttctccctgtttgaataactgggtgagttaatagtcaagaaagaagctgttatagagtacaaaaggatgatagaagtgtccatggacttagaagcatttctctttcctcaagtaggagctggaggacagagcaggtttctggaacagaagccattggttcttctgacctctctcttccacctaaaaacttttgattcgagattctaccttgggatttgaaatttgatagcatagagttataaagatctgaggacagggaccaaatgtggtcttcagggtagctctggggatgctacgtgaaagcattaaggcttcaaccatgaagaagcttcactactgagagggcaaaggttttcagtgtatcctaaaccatgtccctctacaatccacagcttcccttcccttactgctgctcagcaataggcaggttgtatccccagtgttctcacagggaagcagagacaagaaaattcctggaagctttcaggccacctagcttgttgtgcacagaagcaaatgagactctgtatcaaacaaagtaaaaactgaagacccttgtccaatgttgtcctctgatgtccaaatagaagttgtctcacgtgcatgcccatacatatgcacatatgtgtgcgcatatacatgcgtgtgcatgtgcacatgtgcattctctctctctctccctctctccctctccctctccctctccctctctctctccctctctccctctctcccccccctctctctctctccctctccctctctctctctccctctctctctctctctccctctccctctctctctctcttctccctctccctctctctctctctctctctccctctctctctctccctctctctctctctccctctctccctctctccctctctctccatacacaaatatgtacagaggtaaaagagaattcattgtatatataacccattcacctgtgctaagactcagaaaccaacttgttgatttaattcaagactaattcctttttctccatactcttgcttctacctatatataaaaaatactacttaagtatttttatatcatgtatcactagctttatgaacttgttgggtcaggaggagaaagaaactacatggatttactaagttctatgcttagcaccactaaagggatgtataacagtaacaagtagctgttgttggaccatagccccctaaggttgatttgggatctttgattctacagcccagacttaatagggttgtgaaatcaagaatttaaaaccagtcaattctaattaagtatcctttatgttggagccattccatgggccatgaagtgcctctagtcctattaagatctgaaacttgtggacataattttctggataggtagggcaaagtatatttttgtctaggaaacctaaaagtcatgtgccaccaaataaaatttgtgaaatcactgttaagacatcttgattataaatgtgttgaaacataaactgtgctagaagtatagcatgtgcagatgtggcagatgatagaagcttacaagattgaagatacatagctaagcctaaaagaaggttctatttttctttctgcctttattttttttcatatctgaagaagctcttagtttcttttcatagagttggcatttgattttcattttaattttcatggtgtgtttgcacttaattagtgctgtggcaggttggctgcatgttgtttgctttccacaaggcttgattgtaatctagcctaggttagaagggaaattgtagagtgccgcaggcaataatatacagccaagtggaatgaagtatcatttcatttggcttttagacagtgcagaaacttggaatattgtggccgttcatttttgaaaaagcatgcctttttaaaaatgattgatttattatatatatataagtacactgtagctgtcttcagacacaccagaagagggcactggatcccattacagatggttgtaagtcaccatgtggttgctgggaattgaactcaggacctctggaggagcagtcagtgctcttaaccactgagccatctctccagcccaaagcatgccttttttaagatggagaaaatataggaccgagataccaaaggcagagaatgctcatctaccttggccaatttacacatattttaattgaaaaatctccatgacttcagccaaggggagagaagaactatctatggattgggtgtttaagaagtttgcaacctaccacactcctccactgcccacagtttcttgtctttgacagaatctccctgtcctttataataatgtaacccaaatatggcacagtatgcaaatggcttctgttattccctttctcattcatggctgaacaacttgagtaggaactaatttgattggatttgctgtgggttttttgtatatcttcttagaagttggccaaatttattttagatttgtgcaactgattctcttgatgtcacataaagcccaccagtctgttttatccatccattacttaaatctgttctttaatgttgtcaaattgttgcccagctagtgacagaaagcttactttctccttatgcctctcccttagcgttcattttatctttatatttttctcttagtattatgagctaatctttctccctcaagttagttccttttgtggtctaacaaagtcaacctttgtgatagatatatttaaagacaaaaatcacatttcttgaatttactcccctaaactactattttgaatgttctagacttttccttcttaataatttctagtttgcctgcattgctcatcaaagctaatcggaacatatattcttttcctttctgccaacttaatgataacctgtgttccttgttcaattacttatttatatttctgtatatttatttgtttttgtttgtttgtttgtttgtgacagaatcttactatgtaaccctgatctgcatggaactttctatattgatgaggctgatcttgaactcacagtgatccgtctgcctctttctcctgagtgatagaaggcatgcttcactactcctgtcctagtttctgatatattttttagagattgttcgtatttttaatgttagatcattagcactgacaaattattttagtttaaacacttgccatcaacaccttcttcctacccatcctccctccctcaagagataaacattctaatttggcatgacattatctggcctaacagtacctggaatatgaaggacctaaaaggtcatcttccactgttttagccttccagagtggttgaattaagttcaaactcgggatgtttttgaaatcttaaatctctctggagatgtttttcataacatctttgaactggataatgctacaataaataaaatatgctgcactggattaaaaggttatttccctagtgtatcaagttaacagacaacatgaaacttcccattatgctttggacatctctggctgtcagtgtagtaaccctgcctccattaggtccctaacccctgctgttccataaaaaccttagcttgtaagctacctttcagagtgaatgctgaatggcagcaagaccaaggaaacaagacataaaaaaagtctaaaataaacaaaagatatgagatacttcataagctcataatctgagtccagagaatcagagccaaagaacaatggaaacccattatttgaaattaagattgggaaataaaccccatttgagacaaacaaaattgacaatgatagcaacaatcaataattaacaccagtaaattaaaataataaagggcagggcaggttagaataccttcagttaaaagtgagatcacatagccaaatgctttcacttatgagtctcttaaagtctttgtgtgtgtgtgtgtgtgtgtgaaataaagaatttccatacaatgctaggctgtgtattctgagtatctatcaaaatgaaagtagaagtacaaactctggtaagtatataccatagagcattctgtagcagataaaaatttaaagcatgtaatatttgcatagaagtgtgaaaaaatcttacaaatgtgttatataacaatgaaaataatgaggcctagcatggtggtgcagtcctgtaatgcagcacttgtagaagaaccactgcaactttgaggccaccctggtcagcaatgaatagtgagaccttagcttgaggaggaaaaacccttaaatggtgagatctataacatgattccattcacatgtgaactcaaagcatgaacatctaacagcactcctttaaatgggtatgtggacatgcacatttagcacattggtagggttacctgtgacagagattaggaataagcgtgagcagctgagtggtttacgagaggaaagttttgcttggttcattgagaccaacaaaataataaaaatcatgcaagcctgcacaaacagagaaaacgactaggtgattagcaagtaagaacagcagtgctgacctgcttgcatctgtatgataatggaaatggtctgtcttggctacactagccacgtgtcattactgaacatctgaaatatgactagaatggttgatgagctgcttttaatctaatcgtatttaaatttaaatttactgctgactactagccacagtgtcaaaaggtaaaatttagatgttccaaaaaagtagatggatgttacagttttaaaaaaaaaagtcattataatacttggctctattgatagataagtggataataaaagaatgtaagaaaaccaggaagaatgtgattgtccttgctttctcagaaactatttttctcattaataagtgacctacaagcctagtccctcactattcttccctgtgtttaaagaaactgaggtcacaagactctctcccaagcactcagaaatctcacactacttcatttttgaactgtgttccaacaatcactgaaaactcttaatatttttcatttgtaatgttgtctctagtccttcttctcactccaaaatttttccaacgctgttttaacttggtcttactaaatagttgaattcattttagcactttgagattaaatgaatccctaggtccagtcatcttccaacttttggttctctgtatagtaacctgatttcacactgggaaaaacatattgtgcttttacttcaggatatacatctctctctctctctctctctctctgtgtgtgtgtgtgtgtgtgtttgtggtgtgtgcttttacttcaggatatacaactctctctctctctctctctctctctgtgtgtgtgtgtgtgtgtgtgtgtgtgtgtgtgtgtgtgtgtaataggaactaatctgctttattgtacaacacagaactctaaaatctgaaagctggatttagcagaacctttgtcccaggtgaatgagaacttttttctcccacccctctttatttcatcttgagataaacaaggatggctcttggatttgtaacaacatttctgccaataaagaaaaacaagaaattagaagtatgattagtggttcttttatttgtaatttatctcacctaacaaaacttgatgcagctgaggatacttctagactagaaactaatacacatatagtatagtgtaaataaaaccaacatactttttggtattggcaaatactttctccttttggaacttgtttactgtctgtaaagtggggaatttgggattaaattatcttccaagatctttcaagaaatacagttcagtaactatatttctaaaaataatttaatagcttttaaaatgttattaacaggaaatatcagtatttaaaaaagagattagaaaccatatggaaaaagtttttaaaaatttacccaaagctatcaaactcaggctttaaatctacctcagtgctgcctggcaacaaagtctctctgattatatcttatataaactcattctcatgaagtaccacactcaatgatgaggtccttccagggcacaccaacttgtacataccaatagatgtatataggttggtttgttttaatgtgctattatactacttgtatgagtggatctaccatctgacaaatcatgatagaactcctctatcattttctgaacctgagagaaaataatagttctgaaaataaaactctaggatgtcccagtaaagttgagctacatacagtataaatatctagaaatgaaaactacttcttataagttcccataagttcttctgttctttctttatctcattcagatcttagtaaatattttactttctaccctttgtataaccctataacataggcagttaattttttttaatctactttcatattgatttctgttcttacaaatgtagtctacttggaagtctctttaatgtcacaaagatggtgcagataagactagaggagaaaggaagtgatcaagttggaaggctcacatgttgagctaggacaaactgtaagcaccatcatttttcattaggatcctcttcaaagagcctctccaggcctgtgaggttgaaagtaatgggtatgcccggtgtctcataaaatggttgttccagagaagtggtgaaggccattttattttgctttgctttcgtgtcagggtcttactatgtagaccagactgaccttgcatttaacctttgcctcctgaatactgagatgtcaggtgagatgcacatggccttagtgtgtaggataaaaacttgactgggaatagtggttagggatagaagttagttaaaattaatagggatttctagatgtcatggtggcacatagtagtcacctttatcgcaaatggactcatccatctatcattttcttttttaaaatttttttattaggtattttcttcatttacatttccagtactatcccaaaagtcccccataccccccactcccctacccaaccactcccacctcttggccctggcgttcccctgtactgaggcatataaagtttgcacgaccaatgggcctctccaatgatggccgactaggccatcttctgatacatatgcagctagagacacgagctccgggggttactggttagttcatattgttgttccacctatagggttgcagatccctttagctccttgggtactttctctagttcctccattgagggccctgtgatccatccaatagctgactgtaagcatccacttttgtgtttgctaggccccggcatactctcacaagagacagctatatcagggtcctttcagcaaaatcttgctagtgtgtgcaatggtgtcagtcagcatttggaggctgattatgggatggatccccagatatggcagtctctagattgtccatcctttcatctcagctccaaactttatctctgtaactccttccatgggtgttttgttcccaattctaagaaggggcaattctaaaagaggcaaacactttggtcttcgttcttcttgagtttcatgtgttttgcaaattgtatcttgtatcttgggtattctaagtttctgggctaatatccacttatcagtgagtacatatcacgtgagttcttttgtgactgggttacctcactcaggatgatgtcctccaggtccatccatttgcctaggaatttcataaattaattcttttttaatagctgagtagtactccattgtgtaaatgtacgacattttctgtatccattcctctgttgagggacttctgggttctttccagcttctggctattataaataaggctgctatgaacatagtggagcacgtgtccttcttaccggttggaacatcttatggatatatgcccaggagaggtattgcaggatcctccggtagtactaaatccaattttctgaggaaccgccagactgatttccagagtggttgtataagcttggaatcccaccaacaatggaggagtgttcttctttctccacatcctcgccagcatctgctgtcacctgaatttttgatgttagccattatgactggtatgaggtggaatctcaggattgttttgatttgcatttccctgatgattaaggatgctgaacatttttttcaggtgcttctcagtcatttggtattcctcaggtgagaattctttgtttagctgtgaaccccattttttaatggggttatttgattttctggagtccaccttcttgagttctttatataaattggatattagtcccctgatttagggtaggtaaagatcctttcccaatctgttggtggcctttttgtcttattgacaggtgtcttttgccttacagaagctttgtaattttatgaggttccatttgtcgattctcgatcttacagcacaagccattgctgttcttttcaggaatttttcctctgtgcctatatcttcgaggcttttctccactttctcctctataagtttcactgtctctggttttgtgtggagttccttgatccacttagatttgaccttagtacaaggagataggaatggatcaattcgcattcttctacatgttaactgccagttgttcaatatacctaatatctaagtaagtggggaaaaactacaagcttcttttcataaaatctagatcttacttatgctcacatttttaaaatcttgatgtgttttaagagaaatggttgtcaaaattctattgaagtcatatatataagtcaagaaattaaggtatcttctacctctttcaatttcagaaataacttaaaattatcctagactttactttgcatctttcctaattgggcaactttgaataatatggttgttaataggaaatatgtaccttgcatagtaggtgtaagctatttaataaaaacagaagtaatgaagccagtctagaaaacagatcccagggagcattttataaaccctatagctgaaataacatgtaaaatacaaaataagacaaactgaatgactgacactgtatatttcaaatgtgcaggttggacaacatttgaaattggaatgaaacagtaagaggctacattcatggataaccaacaagataaagttattgctgcctcagccaatggagacaacaatctgattaatggggtcaaaaacaatggtaagaaagtttaatgatgatatacattctcttttctggtagtcttttcttattaatgtggattttgagtatagaaacctgagataggttgaatccaaaatgtatctgaagttgatgtaaatctaaacttttttctaccagatctttaactcaactagaaggatctctgtaagatctcagataaatttctcagattcatttgttaaaaaaaaacttgtcaaaattactagtaaattataagtatgttctgatgtgagacttttatagtttcactatgaacttctctaacttaacttttcaagtatgggcacgtgtcttaaagcataaatcatgaatagccccctgtgcatcttcccctctgaaagctttgactttccaatcgactgatcagtccagttctttcctgacttctgatggggactctaccttttcctgggctgaaaaaaatgattatttttcacatatatgaatgtttcggtatgaaattagaattgtttttataatgtttaggtggtaattcataaagctaagaaacagaagcttagtttattatatgatgttcacatatcagaaactaatcaagggaaagagatttgagtctcatctaagagccttaactttattcctgcctttttaccccttttttctagactcagaggaccaggaagtggcaatgaagtcattcgtagctctagaagctactactccaatccagcctataccagtgatacaaaaagagtccccgatgtttcccaggggccttcttcctccgccatctaagaagccgtgtatgcagagccctccatctcctttggccctgattgaagcacccgatcattctgctaatagtgcttctgtgaatgccatctccctcacatctggagttgcaaaaggcctgaacacatggtcactgcccaacgagtgtgagaaagctccatttgccataatggaacctgcaggcatgtcagctctgaacggagactgcctcatgcagccaagcaggacttgcttaggttgcttcatggaatcaaaagaagcagtagatcctgaaccagggatcagtctgaaagtcagtgatctaaatcgagattatgaaacatgtgcagtctctgacatagggattcaatgcattaatgctggggaaaacattaagtatggagagcagctgctttcagaccagctgttaggcttccccctgcataagtcaagggcaggagatagacgagaatctgagaaacctgacatcgacttggaagatccaactcagaaaagttattatgaggcattactattagataagtgcaacacggaagaagctttgctggcaaattccaatcaggattggggttactttgagacttttattagtgagagtaagattgagctacttgacctctgttccaagaatgaactgtctgttaaccttttctctgaagaagatgtggagaactatatgttcgatgatgatgagtcaaccctgggcagtgatgtctgctccctcaaaattcgatatgagtcctttcaggacaatgttcgagacaagaccactcttctgatgcaggaagatgcccaattcaattttttccccagtgtctttactacgtgtcccaagcgggaatctaagagtggaatcctcaagcagagcagtgatctttctcaattcaaggtccctgatgtgagcatcatctggggagaagaagataaaaacttggacaagaagaaaggcaaagaggaagtacatgaagacaaaagcatagagacaaaagatgaaaaagataatggagaaaagcctgcattaaacaataaaccatgtggtggtcttgaggtagagcaatttaagaacctaaaggctgaccaacttactaattccctggagacatcagggaatttcagtgatgacagttccttcattgaggtctcatatgatgccatgggggagatcaaagactgtagccgctatatggctcgggacactaattctggaagttcatcctcccagcagaactacggactgcgagccaagagaaaagtcagatacagcgaagattatctatatgatgttgactcgctagagggggaaaaagtaaatgagagaaaggaatggcctccaggtggttccaaagaagaagatgatgatgaatggtgtcccaaaaagagaagaaaagtaacacgtaaagagccccctgttattattaaatatatcattatcaatcgttttaaaggtgagaagaacatgttggtgaagctaagtaaagtagatgccagtgaaacaacagtaaatctgagtgagaatcagctcagtaagtatgccaagctatcacctttgaaaggattctggcaaaagaagaaaaagcagaaaaacagcaacacagactcagtcaaaacacccttatgccaaaagcaaagctttgaaccaggtagctttgaggtgtcattcctgcctcctgctcgtaaacgaaaatctaagcttggcaacagacacaggattcaaaggatccaatctgtggaaacttcagcaagtagtaagcaggtttcattctgcagtgatcagaaacaagcttgtaatcgcaaagaagacggtgtaaaagggacaccaaaatcagcacttcttactgacccaagctgtgccaatggatcacatttacgtggcctcatagtctccgactcggttaaagtcaaagctcaagatacagagttcaagggcccagagaggaaagtgcttaacaaaattaaatttaaaagtgaagctaggttaaaatccaaaaaaatcaaagctggacaagaaaacaaaccagttgttcaaatgagccctgtctcagaagacacatcctccaaggctaatttaaaaaatgaagtcactcctggaacctcaaacagttcccatatgtctgaatttcacgagacaaaagttaagaattccactttcctaccaaccacctgctcttctgaaatgcctctatcatctgctaatgttgccactaatatacctgttattcctggagggtatctgcaaacactgttagatgcttctgacttatcaaataatactagtatctcatacttcaccaaccattctgcagagcaaaatgaaggcagcctcactcaaacggaaaaagcatttgtacctctccagtctgctcaagactgtgtgctgtcttcatcttctgattctcagctgcaacaatcatctcagaacttcaaaatggaagcaagcaactttggaagtttgtggcccgacaaggatacatctggctcccaggaattcatgactgaagtctcaagggagatagccacaaaccaatctagtgaatttgaagcttcccaagttgtctccatggagaataacctcacagctataacatacagtcctgtatgcctcaatagtgatgccagtggttgcaacaaggttctgtatgcctctttgcaggactcacatctcccacctgaagacttgtatcaattgtgtcactttaataatggagagatctgctttccgttccagcagggcccactcagtacagatgatgatggccggctctttagctttgattcgatgacttcccttactgttagttcaagcaattattgttccttaagcttgaaatcctgtgaaaaggatggtgatgatgaaatcaatgatgactttctggcccactgcagccccaaactggtgatccaacagagcattgatgaaatagcaccactaaaggagtccactgacctccttgacatctccaacttcactcctgacaagttccgacactcttctctcttagaaatgtctcccccagacacccccagtctttctcctcagagtaccagatgtgagagtatcaaaacactaggaacaatgaaaggattccaagaaggtgtcccaggatcgttgagcaccgtggaaaaaatcaagtgggactgtaataccctttcacaacaggcccaagcagatgatggctttacattaaatagccatcagtttcagttccatatgttcaatgatgaggactctgttggcctgctccaaaaaagcccttgcctgtcaacatttgatgagccagctgggcaaattaataccaacagcaaagtgtcaaaatcaagaaagaaaacttcacctggcaagagtggggctgtaagccaaagttcttctcagaaaaattccaggaaaaaatcgccaaaagcaagcaacaaaggggttgaaaagccacctagcaaaacctcccgccaggttcctaaatcaacaaagaaagggaaatatgtggctgctgtcaatggagagaaaatgcaaattgggattggccatagtgggggccaacccaatagtacatcctccaatgcaaagacactgactgaatgtattcagcatggtggtcctgttgcctctatgaagataccaagtcagaagggactttctggagattgggctttgggaaaggaaagcaggccaggctggaatgacatgagtgtagtcactaataccaacaaccttctggatgatgaccaacgagagtttcaagagccttcctatatcttatccaatattgcctctggtatggcagatgtgcaaagattcatgatggcctccatggagcccctttgggaacccatggagcaccaaggggagtccaacacattctactcccctgattccaatagcctaaaattaaaaaccctcaaaatactggctggaacaccacaagaatctaagaaaaaggttactaatgggtcttcaggagctactaagaatcacaggtcagtcaaagctgtgagcaaaagcaacgggaaagcggcaattggtgagcctggtcatgcagatatgcctggttccagtgaggactctcgatctgccttctttgataaaaagtacagtaatgtgaacactttaggcaataatggaccaacacacaaaaaattatatcgtcacaaatccagctccaagggcctgcgagatgagaaatataagggaaagcgcgtggaacgagaacaggcccacaaggatgaggctggaacaacttcttttgaaaaactgaggtaatactgcaccaaaatggctcagatgagatgcgcccttggctttcctactacctgctgagcccagagttcctatttttccctcttgaaagcgaagttttgcatgagagactctttcccattctcctctttttttcaaattaaaaagaaaagaaaaaaatgcatggaaatccctgtacctttaagccacccaaaatattgggcaattttattgtggcttagctagggataagttctaacaaaggctacatttttcttctattcagcgttaatttttgcttattaaggaaatagaactaaaacatgctcttgaatgatttttggaatggaagggctttgcaataaagacagattctggacaacatattcaaaaagtcatgtagacaaaaagccaagatcatttaaacaaaagagcattagttgtcagcacatgacaattaggagtgctttctctacctttctgcatcatacaacatctagtatggtgttaatatatttacagggtatgatcccttcgtgggacatacactaaaacttactaagatggcataaattctttgatttttctgcagggattccaactacaatctcctaaaagcagaaacagcatttggggttttacctgtgtttgaagaagagactcacattttccagaaagacatttgatgtttgtgttttctttctttcaaaataagctttgtggtatgtatgttgacctgtaagtgcttacaagaaaagaattttaaatcgtgggaataagtctttgaaatcaaactttaatctgatgttctgtgtaaaagactttaaaagtcatacagttgcacgagtagtttatgcactgtttgcccacaaggaaaaaaatggaaaactttgtgccaaactacaaataagtaactgtattgtatatagttttacttctatatcaacatttggttgtgagtatttgggggacttgtccctgttaatttactagaaacattccagtgattcttgctattaaccacccccacttttgtggatagcacctatagatcacagtggaaaatatgttgtgttatacagtttaccaaaacaaaggataatgtttgaattgtgccaaattttcttacttcatctcacagattcaccccacagtttaaaactcattcatgattattaaatatatatatacatatacatccatacattcttttaatgttttaaactctactatcctgtgtggaaatatgaacagttaaacaaggcacaataaagatgtgtttgttccatcatctaaggattaaaatgttggaaaagcttaggtcacaacagctaagtccatcagggacagagtatacacatttacagaaccttgcacaaggaaatcaaacagctgctttgaaagttggttttccaaagcaaaatctgtagcagaaaagaatttaaagtgcaaagttatattgctgatactttatatctcagttttatatattttataatagcctgggataaattataaaataactataaaattgacactaataataaataaaatacatagattgcttttatttaagtagtttcctaaatgttttattccagttatgtcaaaagtgcactcacaacatggctttagtgttctttaaatgttgatcttgcaatgccaatgtcattttttaaaatgacatctcagattgacagaatttttcttcctatgattaaatacatataccaccaggtaaagctgaacaatatgtggaaataactaatttaggccatctacatatagtctgaggatgactactcttttgatatcacacactaaacataaatctcaatttttaattaccttttaaattcatatttttggttcaaccctccctttcactacttagaaacttcacagttcccacattcctcactactagccttttcttcccctttcttcaccacttgacttataccatttgatctcttttccttgcacagttaaggcctatgtgcctaatgactgatgcattgtggcacagatgagataatggatgtgaaagcgctttgtagatcataaagtgctataccaatataggggactaatattattaatgttgttggttgttgttgttgttactattcttactaatattgttactaacctattaacttgtgaatatagaggctggggtgggagggaggaggataagggggtgggagaaggggacttaataaaacagggaagatgtttcaaaagacatttttgaataaaatatgagcaacctacctagtcattgacacctaaatatattcacaaacagagaagcaatgttttcaagtagtcagagagaaatggaagggagcctatcatgtatataaacatacacatttcccagcccatgattcctttcaccagcttactctactacttacagctaggtaggaaaatgaacaagcccatgatctagattgtgtgtgttctcagcatcagtctcttttgtctgtggggatgagtgggtgaggagaaatctgtgaggagagttcaggcacattcctaggctttgacactgtgttcaatgagccctggaaaatgatttagtgggaaggcaccaactgaaacaagtctcttgccctacaatgaccatccaaaagagaaaataatcaaactagaacactttcttttgtttcttggtactctaatagctagctgtttgtattaaatgtgatggctacttcctaggaactggtctttgttcagttttggtttttgtcttgttttgcagctgaccttttgcttagaatcatcacctcagcctgtattgtgatccccaagactccagacctcaaactcatcttgcttggttttaggaatggagtgctttctatgtaaccaaaaagtggaaattaaagaagaaataaagaaaatgttctatgagtataatgtgtttttataaaagtaaatatgggagcagttgtcccagatttttttaaagtatcatgatgttcagctttggagaatggggtaagactggggtaggatagcttgaaactgtttctaacagtttcattgtcagaacttgatcatcagtcctttggagtggatactctttcagttgctcctatggagcccactaggggccaattttagggcatggttcatatctttctccaaagagaactgccattttaaagcacctttttatcggcctgccatgcattgtatgttcttaacatataaactagtgacttgtaaccagtcattttgtattgaaacataacaagaaagtgaatttgaggagtgtgcaatagaccaaggcagagatgttattgtacactatgctctacattgttgagcactttgcattctgttggtcctgcctctgctctcagaattattttcctttctgtcacaacatagtaggccaaacttactggagatctcttattcaaccagctgccttagtggagtgaggaccaatgtatgaaaatagtgttttgccctatcactgatttcttcaactcaaaaaccctggattttccttgatctgaaatttctgactacccccttctaacctctcctttctgagaagctgcatcctattaatgcctcctcattggagtctcatttaatctttactttcctggaaattatatcctcccttgttcttctttcttgacttttatcagtcttagaatttttcttcttgtgtagtattctattcaatatcccaaactgtcaaagtttaagaactacagctagaggctttcttttggaagtttagaggactaccttccctgtcttattcactcaaaatacaaatgcacgagcacatgcacacatagcattgagaaaagactgaaactgctttctcttgaaggtgtgtgataacaggtccaatctcttattgtggtcaggtgctgtactacatggagcagagtgcagatacaatggccccagccaagggtcttcaagacattgagggttgtgttgggactagagtaaatagcttgaacctgtggccatcctctatgcctctccagtgtctcagatctcagctgcttcacatatgctgctccctcacagctttccctactgacttcttgctgctctgtgcaattatatgttaaggccttatcttttcctatatcttttcaaactttctgcactacttcattcatcacttctttagccatctctctgaagtccttggtgctaggtgggcttttgtgacaaaaattttcaccttctctgactcttttctttgctgggaagaatcgttggggggtagggaacacaaaggagggtatgtgtgtgtgtaagagagaagcataaaggatgcttcaaatgctgtaatcaactcccatcctgtgttatttcacgtgaggtcttgcagttctagtgaatttccattttagtggctttgaaatagtgtttactgcgtaaaggagaaaagcatatccaaggacctctttgccttgctcttaccaaactgaactagtgttttggagatctacaatttatagatgcactcagaacagttctgagaaatgaggagagttagagttgagtttctatgctgaagaggtaaatggaacactagctagtcctagctgttgctagaactagaaatgtttgttttctcctgtttgactgaaaggttgtcaaattattcattttcatttagggcttttaatgctgccagtcataacagaaatatctccttttgtaaaataaaactaatgcaagttttgttttttaatcataaaattctctaagccaatattatgtttagaaggcttagtaccaaaatcaaacattttcatgacaaacagagatcttgtcaacataatgtaggccagggattttatagagatttctcaaagacccgagttaaggacagaaattagttgagatgtttagtttgggaaacactactaccatcagcttaagagtcctcagccagcatggagttattttggtgactatgcaggctaccctttaagacacagttttcactcaacattaaacagtagctacagtcatgatgcagagatcccattgcagctatatgatacttgaggtgtactcttggtttgagaatcatagctaaatgctaaaacactggggaaagacactataagagagtggcttagtggaaagttttaaggaatgaatgaggcttttaaaaatcagtgtttgggtaaatcaatactaaatacactaaagaaacactcacccatacaatatgaaaaggatgtctgtgtatccaacaagctcagggttctctgggcccactgaaaatgaagaaaggtaaccaggcatggaggctcatgcctggaaccctaggcaggattgttgggagttccagaccagtctggtctatagtgtgagacccagtctgaaaaataaaaatataaaagaaagaaggaggatgaggaaggaaggaagaaatgaatgaatgaacaaatgaaagaatcaaggaaggaagggagggagggagggagggagggaggaaggagatactgaaatcattctgcctctttgagagatgcctagttttacagcacaaaagaaaaaggcttgaatgaaaactaaaaggggcctttttgtttttcactcccagggaggtggagagcttcagagtctccactgggatagctgtagcactgactggagtttgctgcctacagagttttgaatgtacttactagactttagtttccatagaactgaatgcacctcttcagtaagtgaaatgctttatggtgctaaagaaaatgattatccccatttttcttcttcgccaagccccttaagcatttaagaaaatttaaagtaaaagcatttagagaccctttttatgaatgtaacctgtttctgtttgacacatgacactgcaactttaaagttaggaaattatttgcctttttcttttagaattaagctttataaataatctgtagagtcaattgaagtataaagcttaaggatcactcttaagacgcctacaaaatcttgtatatttttaagtgtgccaatttgtaacatattttgtaagtgtatatttttcttagaaaagtgctgtgaagtgtctgtatgtgagagttttccttttttctgcaccactatgtgctaataaaaggatatttacttcaaagtttctggttttagaaaccacaatacaaagaaaaaacacttttgttgggaattttgtaacaaaaaatatgttgtgaaagagtgtagtgatcttgtgcaaagaaaatgaacatttgtgagcttcttgctgttttatagaatttcttgtaaattattcttgtaacacctctggttttgttgttcttgttgaaaaaagttttaaatatttgtgactgaatgtatggtgaaactgtcataatgttacctagctgagttttgttattgtttatggaataaataaaagaaaagtttaaaa

SEQ ID NO: 661 - DNA, 17844 bp, mus musculus; identical to SEQ ID NO: 94

SEQ ID NO: 662 - DNA, 33711 bp, mus musculus
agcagacggagcctgagctcccagcggcaaggtgaggcagagctgcgctccgggccgaacggcgaccgagctcttcggccgagggggagacgcgccggaacccagagcacgaccgagagcgggagcgaggcgggcggcggtggcggagggggagcacgcgagccgccgggcggagagcccgagccgcgctgtcgccgcggagggacgacttggccaacacactcgctcacacacactcacacacacacccagcccgagcgggcgctctcggcgaaccgtcaacatggcgctggggctcttgcccgagcgcgggcggcagcggcggcgcgggagctgctgagggtgacagagctcgggccagctgcgggaggagaggatcgcgcggggccgtcgccacctgccctgaagctcgcagcccgccccgccccgccccacccccacgcggcccagagcccacccctccgccgggccgaccccgagggcagcagagcggctgcagtcggcggcgagcgagcgcggcgctgggagtggactgcgggcaccagaggaagccaaactttgctgctcgctgcgctttcccggccgggctccttcacgtagccgccctctcccgaccccgcacacattcacccagccagccgcccccggatcttcctcgccgcctggactccgctccggggaaaacttcaaagcgccggatcgcagggctccctgcctacttcccgactggggatttcaggtcagtgcccggaacacctttccccgggggccgcgggcgggctggcgcgccggggactgcagccgacctcctccctccgagggtttctcctccgacttcggtagacccccgttgggaggcttagctaccttgctcgctttcggttttacatcagagctgcaagttattaaaaatgcagccaacctaagcggcccccgcatgggcaccagggagggagggactcgacggaggacctgccgcctcccgaggggttgggaggatcgggagttgaacgagtggaagtttgcagcctctgtgtgtctgcgcgggagcgcggtcgtcgccgagcgtcgggagtcaggcgggggggggggtgctgggctggaagctgggaacctcgtctcggcgttacctcgctagcaggaaggggagggcggcgggttcccgtctgctttctttttcgactcggaaaagaactgtaaaaacccccagccgccgccgcttcgtctggcctctcctggggcccggcggtgcctccgagtggaacgccggcttgagcgtgcgctagtgtgtgcggcgggcgcctcggaccgagccgagctcgacctgccgtcgtcgctcaactccggaggggagtcccgggtttttccttggcttgccccaaagcgtgaatcacgtggaataacgggggcgggggggggggcctactaggaaacagcggagagccggagattcggaatgggccagtccggcgacccgtcaggtcagatgcattgttttgtaaatgttcttttaagattctaattcgaccccccccacctccatcccttcccttcgggaggcgtcccaaggcaggttttaagttcggagcctcctggagcccttgtagactgcttgtttagggacggcgtgggggagcgagcagagccctcggctctccgcttggctgtacggagcctggtgggaagccccgatgggcgtgtgaaagtctgcggccccgggaagttggtcccactcggagggagggcgacgcggaggctccaggcgaagaggaactcgcgcaccgggcgcgatcctcggctgaggcggggagggcgaggcggcacagggccagcgcttgaagcaggcgggaggctgcgctacggagccgccacaaactcgggggctgcgggctgcggcgaagagagcctgctattttcgaagagagcctccgagcgccctgaacggagtagggcggctcgtggcacgtgtagtcccggcggacttctggctgcccggcggctcaatggaacacgtacccacgtcccgaagacgaccgaacctgtccccttgtaggccgaggccgagccaggcttaatttgctgttaatgaatcttttccagaaagtctgcgacctccagctagactctgaatacccgcgcgcgaagacgcgcgccgccggcgtctaaagggtgggggttgggggaatagaaaagcgaagaaggaactggaggagggttatgtttatttaaaaacaaaccttaaaaagaaaccagcgcgcctcaaataggtattcgtcctgcctggttgcgtctagactagacagaccggggttttaactgtaaccccctccctgcgcacccttattgagagaatgctagggatgagtactgctatttggttctaaggttagttccttggacggaaaaaaaatactttaaaatggaccgggaggaaaaaaaatgaggaaatagcccaccccagaaggtggtgggtggtgagcagacagacttgggtatttctagccatctgacacttctgtggcattggaaacggacaccaccaccgggagagaccgacctgtacacggtactggattttgctaacagaattgcttgtgtggaaggtatttcaattgtcgacctcagagacacctatatgtggactcttggggggaatactctcttctcgacctttcccactccatccccgactagttacctggtctgggttgcagtgtcgcctctggtgtttatttgggattgaattgtgtcgtgtagacctacgcggagccgggatgattaatatgccgtccaggtttaatctgaggctggcctttagtgtgcggagtacaccaccacgtacgcgaattgcctgcggtggttaggggatcacgcgggtttcggtcaccaggcgctgggcgggtaggtctggactggggctcgatcggccccagctctctcctttgaggcgctgtcaccagtaggtgactgagagttaattaggaagtgttctctggatcaatgggccgcacagctcattagcgattctttccagccctttgcagggccggcctggcctccgcctcccacacagcccgggcccccgcggtccctgctgcggagagtgccgctgggaagtggggaggggtggtcagtgagggacagcgggcaggccagaacaacttcgcagggccgtgtgttgcgtgcgccgccgcgaggtccccacagcccgctctttcttcctgctcgcggccgcctccactgtgtctttaactcgctctagctcgctttgctgcctggctgctcctccccgcctccctcgcctatctcttgttctctaagcacgacgcctgtgctccccgcccagtttgggattagacaagataaaaataggactgcccagcgcgcagagctgtgacagtgcccgggtagccgggctgatgcgagcgcaaggggtagggtctggggaagactagcagggtgctcgggtcggccagattcttattggaccctcacctcctaccccgcaggcgccgtcacgctcgctggactccttccgctgtgaaccgtgcgggccagggggacctgagcagggtctccgcgctctcgcgggtgttgttggtgtgcgggtgatagatcggtctagacaggcatgcagactccctcccggctgaaggacggggggtggggggcagtggagtcggcagccgactccggagagctgtgagctagcaagctaaagctagcctgccgacccagcaagccgggcttgcttgccgggtggaaggcagattgagggggtgtctcttaaccctttaagtgcggtaaatagtttaatggggggagggacaatgagtcttgtaaaagtgacttattagagtggtctgcggggtgggggcctgggttctagacccactcgtgttttcctttctcttctgtgtgcatccgcccattctttcacaaatcgaatgcagctgctcgacagagtactagcttgacctagtactcctgattctgggaactttgacctcaaaatgggcaccctcgcctaagaatctgagtttctgagcagactatatagacctctctgtttccaatggggacctgaagcatgtagggggatactcaaagtgagagaaggtctctctgacccagacgcctccagattaaagcccccccccccagcctgagatgccaggccagcaaatacagcatgtatgtattggtggcagaacacagcattccttgagttgtccataaatacttaaccacgaacttgtgaatagttataatcagacatgtgggagagacaatccaaattggagatggtctggacacttaaaaaaaaattctatcattcgtgtatcgatgacctaaaatttactgcagctcaccataagttagtctagttctattcggggctggatattgataggtaggttcccctatatagaattaacttattccctccctcctttcccccttaaaaatgtgtggcctaaggttcctctgtttacatttaaactgcaaagccatgctggtcaggccaggaaatgaacttcattatatggctagccaaagaacctaagcagtagaaagggaatctcagattaagatgtatctctgaatgacaagtgctgggacaaatctagagactttggtcccaatgtcctagtagaagagatgcccaggagataaagaactggacaagagcagagtaaacacgggtatgtaaatgtagaccatgtatagtggtattctaaaagaaaaactgtagatgtcatgaaactggaaagtggggcagagtttccatgtgttgcaaagacaaaacccatttaaagaagtaaagagggtcacttgggaaagcacaaaaggcacgcatatgcatacataccctgtgcttagatacaggggcctaattaccaagacctcccctttgccttgagatggacttttcactagtgagactgattgaaagtaagaggggagccagggcgtggtggcgcacgcctttaatcccagcactcaggaggcagaggcaggcggatttctgagttcgaggccagcctggtctacaaagtgagctccaggacagccagggctatacagaggaaccctgtctccaaaaaccaaaaccaaaccaaaccaaaaacaaaacaaaaaaagaaagtaagacggggcaactctattgacacattctcggggagataatgtgtttgggcagtagaaaatggcaaagcagccttccaaataggtggctggccctcggttaggatcacttctagttagttcttgccctgctggctaggtagcaggaatccaaagaggctgggagttcttgaccttggagaggtgagggaaaaggcagcagtagtggccaggagaaagatgtaagggtgtggtaaatttggtgaaggtggagcaaggcttggactgacagagagaattgacagaaggatggatgccctctgggaagaataaagggagcgaatgctttcatgttggtatgctttcttatatattttccctccctgctggaagagactctgcctgggacagccagtgcagggtgcattagcaagcacctcggtgaccccagacatgtaaactcctgctagggtttagtttgctcggggcacttgtttgcctggtccctctttgtctaagcccagtcaggaattccagtttttattgggaagatcacacttgggtagagcccaggctgggtggggcagagctgtgctttgaggaaggctggcagcttcctaaaaggcccaaatgctgccccaaccctaacacaggcctcaggagcaaccagtggcccttagaaatgccaccctggtttcctcaaggattcactgttcagacaactagccaggcagggtcagggaatcaaatgtgccaacctctgggctgagtccaccgctacagctaggaaggccctttgttaggccctaatgttctaggaatcagatgaagagtgtaaatgcaagtgtgtttgcttaggagtctcttgggacactctggatctggtctagaggggggggtctccccaaattaggcgttggttggccaccatcagaggaacttggtcagtgttgatggccaatgggattctctctctctctctctctctctctctctctctctctctctctctctctctctcccctccctccctccctccctccctccctctccccagagttggtcttcctgctgagccctaggtggtaggtctgggaaaatccaaataagctggcacaggaagtcctgtccacctccatggtagcccaacagagcttatccctgggcacttggcctaaggatggacctccttaacagatccccaacatgtccctcaagaggggacatgtatattttgtggggtagcagtttttatgcccttcccggatatttctgaaggttcccattccgggctgactgacgctcaattccgtgtgtcctcaatccgtatccgtgtggtatggccccatttattttttttcagggagcaagtatcactagccagcacccacacaggctgggctccccatgattagacaaatggagaagtccactccgagaagatcctgacagcataaaatataatttgtgatctaaaagacagtttccagtataatctcattatgcaccacagactcccggtgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactattgggggggagggaggtgagtcaggttaggttgctaggggcagaacaggtaagaggctagctgagcttggggggcaatttacaactttcccggatagctttgccttgatttcaaaatgtgggaaaggggtcgagtttaggagaaagttataaaaaggtacagttgcagtgaaggccctgggtcttttaatgccaacggtaactataagggagaggggaggtttatagggttacgggggtcttcctgcacccttctcggcactcccaacccgaatttctattgttttgattctacggggccttcgctatggtgccagggacatcaaaatctaaagagagaaaggaagcgtggaggtggggggaacccttctctgttcccgccttgctccttcccctcccccctctacagcgagagaccttgtggtggaggtgaaggtgttagaggctaagtatcccctccaccttggagaggcctggtgggtccccacggatgggactgtgggcagttgtctcatcacgatggaagctaaggtcacaggctcagctggatggcaattgcctgggaagccgcagactccaggtggccgatgtcgaagtagaggaggatgggtggattggactggagtgggagagagtgtctgttggagcttcgggcctgcctagtgccagggtcagggggtcgctgctagaaattctggcatgctaggccagttccaagccaggccaggcaggagctggaaactcatctggctagccaaggctggaaagttttaaaaagagaaagaaagccacttgctggaggtctggctgggagccaggtcagctgtacagcatggccactcggagtgggggtggggtgaacggagggagtgtgcgctccttctgtccacctggaccctctccctcgtgatggctctgccaggtctatttcagaggtcctggttgagctgcagaggctggcaggggtgaccagatgtgtggtgcctgatccaggcctcactaggcaaaggtgaagattagtaaatctttgatttgagagctcctaaaggaaatgaaagcctgggctaggcctagagatgaggaggaagtggggagaggatctttaggccatatcctggttggggaaaggaaagtcttccagcttgcctcggtggttggcttttggtagggatgttggggtgcccaaaggggcctgatttagaagtcactttgctgatcttccatctggtccctagggtttctcttccatctggtccctagggtttcctcttggagcgttaggagatgtagacagatgtaggattcccttccagaggccctttgcttgatctagataatggattgcatgatgtgacaagtctagggtggccatctcaatcataggaccagtccagaagtcagcatttcccctgagaacagagagtccaggccacctactacttactgatgtttggccctccaagcagggcatctcattgtgagagatttgtagtatgtagtgggagattgtgaaatctccatttcagtgaccttagagattgcagtgatgtttaggggaaagtgggctctggcttcctactggatgaattacctaagtttcatgtgctggctcttgcagttgacacacaaagccttaagatgtcttctgcacttacctgaggtgaagacaatatgtgaaagtggggatttcaagtgacacaattaggccaataattggctcctctcctgcaactccaggactgagtttgaccatggcccatttttactagctgtgtgaccttgggggcaagttatttatggcctctgagcctctgtatgtttcttcatttgtatgactgggaataattatctacctttaggatcaaagacactgtttggcacatagtaggcccagagggttaataattgccctgaatgactggtcatgtttctataagttgctccttagctctgcagtgtcccagggaccaaggatgcatgcaggttagctgccccctccagggacattcctctggttgggcctataggggctcctctctttgtttagagttctttgccttatgcctttaagggattccatatgcaacgacttggatccccccccccccttaagtgggatcattatataggtcagaattgattccagaactggtatctaggtgccatttggcacgttttccagtcattatttcagaggaggggacagggctgctggagaggacctagctggaagaggtgcaggaatggctgctacagcagccagaggtgctgtggcgtgatagggattaggtccggatgttatgaaggctcactgtggttttcaataaagtcagccagagactgcttcttttatatcgatatgtatttaaaagaaattactagcacgagaagaaaaccagacctgtatggatccaggccggtagtaagctactgtgatcaggttccctcttcgactcccagaggggaagtcagcttttgattgaagctacacttggttcttgactctcaggggatgcctgctctgaaacaggagctcccccccttctttccctaaaagcctttgtgctgaaagagcttcagtaggcatgaatctctggtccctctgaagaaagccttgcggcctttgctgacgttggtttgtgaacagtggagcagtggattttaccaggccagcacccccccccacacctccaccccaccccctgatttagctcactagttagaggtagtatatgggcagggtgctcctgactggtggtggctgcagcgtggagcccagctgcctggaatctgaaggctctgtaacctttgaagggggccccctcatgagggggcagaggtgcggagctcgaggacccagggttgttttggagggtctgtttgttttctccagtctccgagaggctgagggtggagacggacggacgggcaagagtgtgttccagctttgagtctgatttaaaaaaaaaaaaaaacaaacttgatttaattggagaaactcctaggcatttcacagttctgtacaaatgcaaacttgaaatagcttgagacctacgtcatttttaggaaaggataaatgaagtacaaaagtgttcaaactatgtaaatccttggagttgtctgccctcccataaacacatgacaagtgccaaggcatttccagtcaaaacatccatggacccagcagtctccttcctttgtatttattattttattaacagcattttacacagcatttaacaagcccagactgcccgctttccacagtgcctgggtggaagatgggtgggggtgggggaaagtggtctacaaacccactagagatctcccgatggacaggcagtctatctctactggccagcaaggagccaaaagtagtactgaggagagagctcccttcctatcctaggagtgtttttgggcttctagaatgtgtctgctcccatagtctacgtggaaggtaaatcagggtctactcctggctactctgccccttggttattagtgatcttcaaagaatgagtatttgtctgtcgttattctatatcctggtggaaagtttctaacgaaaagtaatgcctttcttaagtcataaaatgagccttgtatgattatttaattaaaatctatttaaggaccgattaggcgtgtaatttgcgctaataatgacgattatggaaatgttcaacttaaccaaaaagcataaaggagacattttgatcagtggggcgaccagtaagtattcaatgagttgggcaatttctgaaagaccagaggcggacctctgtggccctgcacagaactgcagacatgtccagcctctgtgacaacctcggggggctgcaggcctctctatcacagccccagcctacccactttgtccagtggccaagtagcgtgagcagccatctcttcccatccagcgcctccagactctaccagaggcacaaactctgggagagggctgataaaccacagcgaaatcactgcgaaatggcggtgctcttgggcttaacaaactgcaccgagaaacgcacgcttccttggctggccttggatagagcccggaggggtggggtgtgggggggagccagggtcccttgttccggagaaagctgccagctgctggtcttggtgcgaaggcgaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagccgcgctgcgcctcctcagcactcacacaaagcgcgcactatgcaggcaggccccgtggaggagctgcagaggtggccaccactttgtggctggcgctttcggatgagagaaagctgggtcacatcccgtcaccagtcacatccccagcatgcaccttaaggactgcccaaagggtggggtaggggtgtgggagggtttatatgttgtggttgagggatcttgttagaccgaggtgtcaggagaaggcctggggaaggtgggggtggggcccggagtgtcactgtctagaggggtttggccaagatccatgaacctgggtcctcagctgcttgcggcagagtttgcaagattcgggaaaacaaccagcagccccaaataaagcttgtcgggaagaattaagtgaaggccttctggggatcccgcaggctctgaaggctgttcttcctttgcaatggctctattcagataagttagagagaggcgcggctgtgttctggccactgttcttcagggtggaaatgcaagtgtgtgggttcaggatccaaaggcgtttgcattttccgggaaaggggtgcaggttgacttggagccacacggtctcataagctccccctggcagagcacaccggccttcagctacagcctccaaaggcctggtagaagaggcaccacccgctgggcactagggtgctgtgataggagagcaggagaaaggtgatggtgaggaccagcactctgtccaatcctggtgatgcatcgcataggatgcatagatatagtctagaacttgggtcagtctcttgggtggcctggggcaagctgggaggaaagggtcaccccaactcctcaggagtcccgaggtcgaaaggagccttcccaggatatagaaaggctgttcccgggctatggaaaaccttttcaggctgacttaattctacagcctccttctgggttactttggcccttgtgtggccagccgacaggctgtctgagtctagaaactccccaccccccaggtaggacttctttctacatattcccctcggggagctgggagatgcttctggagtgatacatgaacttcggtgccagttctataaattggtctctttttatgacgtgtgccattttctgtaggaatgttgcttgcaaaacgagtttcgccttggaggaaaggcggaaagataaacaagcctgtaacgccaaaacactggcagtctttccttccttccagctcccttaaagcagccgggctgtatttccaggattagactcatgcttgtaaggagggactctgttggctttttttccccccaagcaaatgcaaattagagaaaaataattttctttcaacgatatgcaatgtattagtcacttggtatcgtgctctcaggcaggcctcatttgcgcgtctgccagctcgctcacatctgcttggcgctgttggggcattttaaccttggcggtgtcgtgtctagtcccatggatcaagaaagagtaattaagctctgaacagccacaaaaattcgtgggtccccatctatatggctttgttttggggtgctttgagttccaaggctgagtagcagacctggaattcttattgttccttgtaaagaccatgaatctggctctcctgcccatcccagccccccagccttcccaggacgtccaggctctgcacagtctacaagaagcgtgcatgcagatttcaggacccttgcatgttgcgccttacttccttaaaaagtttctttgtgtttcctaaggatagccttttgtataacttgttactttctgtagcaaatgtgtttagtttatacaaagccttagtggaaactaagtactccactacttagccgagtactactacggccttgattgacatgggccatttatttaggattcctctctaggttgtgtggattccccagtgggggacagaactctgttaggctggatcaagtgttaggtgggggcggggcggggcggggcggggtggtggtggagggggatgggatgtgaaaaggagtgctggctttcttcctaagttctgggtgctggtgctgggtccacctccttttcaaggacctcttgcttccaaattcaccccagtgcgctttggatgcagatatagttcactgactagtttatctggcgcagcctgaggtaatcggaaagaacaaaaggcagggaagggagtctctggccattcctgtagaagggagggggaaatagccatccctgtccttgggttgggagcggtggtaaatctgatccccatagctgggattctgcctcgggtagaggatggatgcccagcaacccacttttagtagactcttggggtctgccctacccagggctccgtgcctgtcctattttacagtataccaccacactcagctctcagcttaggggagagtccagaggtacagtctgaccgaaggaagctcaaagtgaaggtagggtttgcagtcctaactctaccggtaagctcgggagcatgtcccttgagggctcaaattccgcctgaacccactcaaaagtttatttttgtttgaaatttgatgatgaagaccaaaggagtagtgaaggctcccgcagcggaactctggaagttcccgtgagaacgcagggttccaggggttaactagggtctttggggagggtggctgcccaaggggagaactggcagtttctggaaggcctgagggggtttctggccaggtctgctacctctccctgctgggaccttggcagggagctgtaaggaggggcagaaggggctagtgagctctgagcagggagcgagtgctgggaaagacaatccctttgttgcagactcctcacatcaggctctgcagaggcatggagagggggccgcccctcctcctttctccctccgctgccactgagggtcaagtttattccctatcccgatggctctctgccgtgaccctggagcttcaggaagaaactagaaaggttctgtatgctgggaaggtcaggtctgtgtgagcatggccatcgtccgtctcctccgcgcctgctccctgactttagtcttttactaatgtaaaatttggggttgtgggtggcgacacccacagagccagtggttgtggtttggagtgtgcacctgggcagcctggctcacacacctctaaccccacacctcagatagatgctaaatggctcaggacctgggagcaatttgagggtcccttgctcatctgggaaagcagcccaggaggacccgccctgcattgcatatccgggaaagcattttcttttcatttcccacccccacataggccctccccccaacattctaaaataggaacgtctttcccctcccttccttgacacccagagcgtggtgctgctgtgactcagtctgcttttggagcaaccccaggaagggctggcgctagctttgggcttgggtgaaatccacatcagttgtgttttccccctcctggtctggcccctctgtatctccctcgtcagctccccacccatgatagataggagaccgcatcaccattctgaacagcgtgtttagtggagtcagatgctgttggatggggttaacgggctccagcgattgccaggcaaaactcaagtccagagtgcagccaaagtctctagaaaacacagggccaaatatttacagagggggaccaaggttggagagattcagccacctgcccagggacacagggtgggtgagggtgagagccaaagagaatggacactgactgggaccaggctacccatgtgccacctaagcttcctattgtgggtgcagtgctacagatggacctgttcaatctttggctgctgcccacataactgcccgtagggtggtggccagaagggcctagggaaagaacttaatcccaaagaagggactgccagtgtttgagaggtttcatctcttcctagtctctggaagcaatatttttcctattgtgggtgcaggggtcaccggtggcagtggaagatgatctgccactatggggtggcagtggggacaacagacagttgagcctagtgttgctactgccttcactgcctcctccccgttgtctgcagggggagatcttaaatgtccttaaagaagaaacaagtaagtgggctgcggtggcatatgactttaagcccagcagagacacatccatctcttgagttccaggctagccacgacagaaagaccttgccttttagaaaaggaaagagtatgctcttctgcatctctatgtgctgtcttggcagggatcgactaaacggtgttagtaggtacaccttgggggtcacctgatgtcttttcagaacatgaagcaattgggctcctttttagagatgcctgggttggagggacagcacctaatcttggtcctgctcaaaccaagcatgggtactctagccactctttggctcaggagcaaatgattgttcaccaagtctgttcaggtgagtcctccggctctccgttaaacacagtaagttctaaggactgcagccacataccaatgcatgcttgccacatagaggttcccccagacctcggttccagcaggcagatactgcacttagcaatcgacctgttccgtaagactcagacagccatccctgcctggctcacctctgagccaccttttctttgcgtttcctttcttatccttggttttctctccatggctggcagaaagggttaaaatccagagcaaggttaaagctagcaccttgccctcagaacaggccggtgcttgcttgtaaagtgctttctcatgagtgatgtcccacattttggcacttctagaggcaaacatagcctgcatgtggaagaaggggcaaagaatgagcctcttccttatatatagcagccaagtgccttgaggcactccgtattccagccaccatttcccacagccaagggtcagcaaagtcacctctttgctttagaggtagagaaaaagtcccggctacttcactaggactttctagaaactggaagggctgagatgttcttctcttctgctgcttggtctctctttgttttttcacccagaggtttgggggtgggtactccctgctcctccatggttgagtggcaacaggacatttctcctgagtgtatttctgctgggctcttggacttcccttgtttgtcaccctagagaagggccggcctcctgcctagcaaggcccacagtcatcgaccctttctattttgatcacttgctctttagccaggcacctgaagagttaaaagtccttagcttgttgcaatgaaattatggctggcggtggcgccactgttcgttcaacagacctccacttttaagcagttcaaaaaaagttcacagggcagctaaagattttaagtgtgggttcacgagcgtgcacaagcactcgtgcacaagtgtgtgcagtccacagtgcaactcctggcttagcctactctccgaaaccatacacacaggagaatgaactgcactccaggccttaactctcagtctgtccctgtgtctgtgacacttcattctgatggctagtgttatttatctgtgacaatgctattgaaaaaaatgatgagtggaccccagagaggggttaaagtttcagttctccatgccgtcccaggtccctcacagtcccggtggcattttctgggcggggggtggggggaaggactgaagataccactgggctttcatggggaagaggtcaggccttccctaagctgattctgattgtccttgagggtccctgatgtactcttcccaaggtggccaactatgtaggaggtggctgggtttcaagactgaggaactggggccatggagatttgacttttctcaggcccgttcttctgaccctttttcctggggggattaattgtggagccctgctgtccccagtaggatttctatacttccccagggctctatgagggtgtgatctggtccctcctgcggcttgctgtccaggacccctgtgccaaggaacagcgctctacttgctcagtctgcctgcaatgtcttccctttgttgtgagagtgggcaggagatgcccactcaggaaagggacacttgatgaagtgggtcttgaatctttccagtcccggtgacttgacattccttgcttattttgtacatcaaaaaggggggagggacacagtgaacagctcccacacagtcttccccggtaccccagtctgtcgctccatgcaccgtggctaggccatttggagtttccctgtctgaagaaagagagacccttcccaggaaaccagcttcaccaaagtccattcccatgatgccttcaggaattccagcctcttcagggccctcccctccctgcttcattgttgagctctaactgtgcgtggtgtgttggtgcgtgttgttctatggttgggggccggtgggggttgctggtggacaaaaggcctacttaggacaaagaaaggagcatagctgagcttctggattcaggcctcccaagcctttcccacccccaccccagtccctggcagaagagtccctggacggggtgcctccacccaaccgacctggcagtctgcttctcgtgtgctaaagtgtaaaagcaagcatttgcatattttctcctgctaacaaaggaaatgtgtcgacttaagggaacatttgggctttcggaaactgtgtgggtgggtgtgtgagggaggagaaagaaaagttcccctgatgatctatctgcacaccaattatttcacactcggatttgggtcccgtggaaaaatgccgtggcctgtcctggagaagggaaactgagatgtgtttgtgagcagggaattgcccagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcggcgtgataatcctgttaataaactgcagcttgtcctgacccttcactcatgcagcaaactagaatgtgctgtgggtaggggcggtgggctgagaaggtaagtgggggaggtggtctgggccccttcgcaccctcccttccgcagcctccccctcccacgaggtggaaaatgggtggcttttgcctgttccctgtgtgccagcagctcggagcccatcagcgtcagccctggctgcagagacttatgcgctaatgatttcttgtccccagcgagcaggcagtcattgaattactcagccgcctccccctgcagctcccaggcaaaaccacccctgttaggtgcttaatctaatccagggctccagtagagaggttcaccagcccactggtctctctctttcaccctccagctttcgggttgggcacaggacagcttggaaattcagccgtcccaaacctgctgtcgccaccacctcactgtttctgcctctaccaccccaagagagatgaatgtgccagtgatctagcaacctgtgtctttctggtccctcctcaaatatggcttctttctctggcaaaagggtgggcaggcccagacctgtgactaggatgggtgtcttcctgtttgttagcttgagtctggtctcctccgtcgccgtgggacaggtgtgttcttggttcatggacattggtggacagcgtcaggcacaggctacgtcgtgtatgaattaccttgaaagaggctttgctttctcagtgcctctctcctttacctaacctcacggggccctcccccctttctttttttaaacagactagacgcttgaagccaagctgccatccaaggggcgacatgctttctgcaacccctctgtatgggaacgttcacagctggatgaacagcgagagggtccgcatgtgtggaacaagtgaagacaggtgaatagtctccagggccaggcctggtgagggagaacgggcgggtcttctcctccacactcctgagcagagcccatgcatacccaagcccccctcatctcctcacagccagagaggggcccaaaaggtctggacaagagagatctcctagctggtggcccttgatttacagttttaacaggcagcctggttcagcgaagcattgccgccctttaaaagattagcccctaaagcggcctttcagtgcgctttcgtccttaatttattatttcatatttatgaaggagaattaatccccatctatatgctgctttaactctaaatgtcaggagtgtgggcccaggtggatcggcattcaatgtgcttttaaaacaaatagtttgcttagtaataaatgaggaggtggctaccctttccttgggtccaacccaaggtttcaggttgccctatgctgcccttctgtgttgttattggccaggattctgatcactggacagcccagttaggctttcttctaatccatgatgttggactggggccgagacaactgaacaggaggtgatggaagcagctttggggtactggtgaatctctgcctctgctgctcatcagtgctgttatcctgaggatttggaagttggcgtggaacactttctttatcaatgctctctgataacaagtcccaggacagccaacagcagcctggcacagatgtgcggcttcctctcctgcctgaagtagctgacatgtctctgatactattgtacatccccacacagctccacattgttttgataaaggctgcaaatataacttcaccatcaccatggaaactagatgggtccctaactttgtttgggggaaagaaagttttgaaagcctaccctcagggttaatgcagatgtggataaatgaaggggctagcctgtagacttctagcctgcttggtccatggccattttatttaatttctgccctccagaacagctcgtaagggttagctaagacagcacttggcctctgtagaaaaggtcacgtgagagaagtgtgcttaatttctggcttgcccacctctgggacatatgtgttattcatgtccccacacatgaaaggcctgcctttgctttgttctgccagggtaatattgaatcaccatttgggagcaactttcactataggtcatggcagggagggttaagacagttcaaaaaaaatgaatgagattagtagaaactggtctggtccggggagatagatgaaagatatattcagcaagaaatgttttcatgaaattggtgtgtctttttaaataggaaaattcctgtgaatgatggcgacgcttcaaaagccaggctggagctgagggaggagactcccctgagtcacagcgtggtaagggatggatggtctctcttgatagggtggctctcagtgatttgtaatcaactatgcattagtttgtgtgtaattagggagtgtgtgtgtgagtgtctgtctgtgtgtgtgtgtgtgtgtgtatttgcttgcgcgcacgtgctcactcatgcacacaatgtgaggagggggaggcatcagggcctggctatgtattgtttttaatatactctgccctcacaagccctcgttccttggtcacgtggaagcatgggtcttctataaccatctatcccgttaatgctccaagctgtataattctctagcctccaagtagttcctagggctttgctttgccagtaaaatatgaaacactggactgtcctttaaggcaccagggaaaggaagtcaaaaatgcaaccatactttgaccacgccccctccaagcccctttattgatttagaactaagacaagctagaaagttcctcatatccattgtccggaggaaaactgtttcttgtcctgttcaataagacctttctgtgtccaagaaatgaatgcccctctccccagtccaacctgacaggttccacagagtcagtgtgtgtcctgtaccccggaggagtggtgcagagaatgtcttatttggtgttgtctgtgccacagcatggtagggtttgctcacagatgagcaaactaatgacttggtttctagtctgagtggatctttcagtgcttgtaggatctcagttgaacagaaatgacaaaaaatgaggcttcaaaaggatttgcatgtgggaggaggcggggcactgggcacagcaaagctatctttagccttttctgttggggtgttaagggtgatgtcatgtgacccagtgggtggtctttcttctggaccagggctgctactgtgacaggtgtcccaagtaacttgtgttattcttttacaaaggtggataccagtggagcccatcggatcgatggcctggcagcactgagcatggaccgcacaggcctcatccgggaagggctccgggtccctggaaacatcgtttattctggcttgtgtggattgggctcagaaaaaggtcgggaggctaccccaagctctctcagtggccttgggttttcttcggaaagaaatccagagatgcaattcaaaccgaatactcccgagacagtggaggcttctgctgtctctggaaaacccccaaatggcttcagtgctatatacaaaacaccgcctgggatacaaaagagcgctgtagctacagcggaaagcttgggtttggataggcctgccagtgacaaacagagccctctcaacatcaatggtgctagttacctgcggctgccctgggtcaacccttacatggagggggccactccagccatataccctttcctcgactcgccaaataagtattcactgaatatgtacaaggccttgctacctcagcagtcctacggcttggcccagccactgtattctcctgtctgcaccagtggggaacgcttcctctacctgccacccccacactatgtcaaccctcacatcccctcctccttggcttcacccatgaggctctccacaccttcagcctctgcggccattccacctctcgtccactgctcagacaaaagcctcccatggaagatgggcgtcaaccctgggaacccagtagattcccacagttacccccacatccaaaacagtaaacagccccgggtgacctctgccaaggcagtcaatagtggcctgccaggggacacagctctcctgttgcctccttcacctcggccctcagcccgggtccaccttccaactcagcccgctgcagagacctactccgagttccacaagcactatcccaggatctccacctctccctcagtcaccctgacgaagccatacatgacagccaatagcgagttctctacatccaggctgtccaatggcaagtaccccaaggctctagatgggggcgactgtgctcaatccatgcctgggcacacccggaagacaacggttcaagacagaaaagatgggggctcaccacctctgttggaaaagcagaccgttaccaaagatgtcacagacaaaccacttgacctgtcttctaaagtggtggatgcggacgcttccaaaggtgaccacatgaaaaagatggctcccacagtcctggttcacagtcgggctgcaagtggcttagtgctctctggaagtgagattccgaaagaaacactatctcctccaggaaatggatgttctatctatagatcagagatcatcagcactgctccctcatcctgggtggtgccagggccaagtcctaatgaagagaacaatggcaaaagtctgtcactgaaaaacaaggctttggactgggcaataccgcaacagcggagttcctcgtgtccccgcatgggtggcacagatgccgtggtcactaatgtttcagggtccgtgtccagctcaggacgcccagcctctgcatcaccagcccccaacgccaacgccaatgcagatggcaccaagaccagcaggagctcggtggataccacgccatcagtcatccagcatgtgggccagccctcatccacgcctgccaagcacggtggcagcaccagcagcaagggagccaaagccaacccagaaccgagcttcaaagcgagtgagaatggcctcccgccaacctcaatatttctatctccaaatgaagcattcaggtccccagcaattccctaccctaggagttacctcccttacgcagcaccagaaggcatcgctctaagtcccctctctttacatggcaaaggacctgtgtatcctcacccagttttgttacccaatggcagtctgtttcctgggcaccttgccccaaagcctggcctgccttacgggctgcatacgagcaggccagaatttgtgacctaccaagatgccctgggcctgggcatggtccatcccatgttgatcccacacacgcccattgagatcacaaaagaggagaagccggagagacgctcccgctcccatgagagagcccgttatgaggacccaaccctccgtagccggttttctgagatgttggaagctagcagcaccaaactgcatccagaagtccccactgacaagaacctgaagccaaactctagctggaatcaagggaagactggggtcaaaagcgacaaactggtctacgtagaccttctccgagaagaagcagacactaaaactgatgcaggggcacccaaagcaggccttgtagccgagaatgtaggtcaggacaccgaggccaccaagccctcagctgaccctgtgatccaacaacgccgtgaattcatctccctcagagaggagctgggccgaatcactgacttccatgaatctttcactttcaaacaggcctcaagccagccagtgttcagcttaggcaaggatagtggtgcagcaggaaccaacaaagagaacctgggtgtgcaggtagcaactccattcttggagacagctctgggcagtgagggccctgctgtgacttttggtaaaacccaagaggatcccaaaccattttgtgtgggcggtgcccctccaaacatggatgtcacccccgcctataccaaagaaggaactgatgaggccgaatccaacgatggcaaagttctgaaacccaagccatccaagctggcaaagagaattgctaactcggcaggttatgtgggcgaccgattcaagtgtgtcaccaccgaactgtatgcagattccagtcagctcagccgagagcagcgggcattgcaggtgagccccccaacccgaatttcactaactttatcagttgtcagtttttgtaatgtacaaaggggatttgggggaacgtggtaggccagagcaccaggcagatttggttaatgacacttatgataattggaatgtatgaaatgtgttcaataaggggacggcagtagtagcttttaggaggttcatgtgtcagatactttaagctattctgtagactatatgagaactctactggaatgctgataacaagttgtaattattatgaaggatgtctaaagactgcatgacgtttacctagcaattgctttgatgtctctgcctgtaagataacaaatataactagaagcattgcttagaataccttacttgatacttggtggagatgtgtagcagtcgcatgtctgtgggaatcgtgcaatttttttcaccaaaaagaaagaacattcgtttaaagggatagagtatgtatttgatttgctagtgaattatgatagatgttgtataggaatttccttaagatattttacttttaattaaaagatgaataaagccaaattgttttgcaattgttaagaaaaaaattggtttatgctgataaaaatggatgaagttatctaaatgatccattgagtgcccattttaattacatagatggaaggattacaagaggacagtattttatgtctacccgctgcttactgtgaggtcagttcttcaaatttttattactagaatcttccataaaccttttgagttaaatttcatttccaaatatacaaagggaagtttgtgggccatggtcgtctttgttcattgtacattttgtttcttttctgttgtgttttccttttgtttttctttgcactgtggctttattttattttatttataaccttcaaaagagaatgtctgtctctatgcaatcgtgtatgtatggctatacatacacattgcgtctatatctctatacacacgactttatggataaagaatgtgtgactactcacatatagacactcttaaattttatctgttaaactttaaaatatctgagttgtatctcataaattgtggttggctttgggcaagcttttctctgaaaacactttcctttatagtataaggcacatgaaatagcctttatggtaagatgttgtgtttttttttccatcttcgttttctttctagcgtgcaatgatgcgcttctcagagttggagatgaaagagagagaaggtagccacccagcaaccaaagactccgaggtgtgcaaattcagcccagccgactgggaaaggttgaaaggaaatcaggaaaagaagccaaagtcagtcaccctggaagaggccattgccgaccagaatgacagtgagagatgtaagtaacccgagcagctgggctgtagcatcacattggtgagagcagagccaccctgcttccaaggcctgagatggtgagaggaagagggatttgtggataatggctcaaggtccagttggggactgctctgagaaagaggctgctgtgtggcccttactgtagtgatgtctgcttacatgcagctgggaatctggtgtctatgagatttttttctaggacttggtcttcatttgcaaaggaacaccaggctcaaagtgaatgacagcccaatacaatgtagcagtagaaagcaggtggtaaggatcagttctttttttttttcttttgaagcagctagaatgatactctttagccttgcacctctcccacatggcagtctacgctggaatgggaaaagtacttaggtttttttctatctaggtttttttgaggtgggatgaaggttggtcaaagcaccagaaagatggcaacaggtattagctgagtttgttgtcattggaagttatcaatagaacccaagaatggggtatgggaccagcctacaagacagatagatggtggtttatggtctcgggtaaatgtgggaaaaggtaagcaagcgccttttgggggatctttcagtctaaacgatgggttccctgttgggctgggcttttggagagttttaagggtgtttgctgtgacacttcgtgaaggtctttaggttcctcgaatgtctatgcttaaggtttgaggcctgctctggccttcagaaaccttgctagggaaggcgaattaggatgtcaggggaaacatggaggagagttgttgcagaagcctcctagacaagccagtcagtggcattgggtgcttgagagccctctattgttgcccttgaaggtgtaacacacctggcacagttcttggtgcgccgtctttccttcactacctccagttcatctttaaggtccagaaaacgctctggctggcctgcagcaacagtcagacccaagaagatttgctgtgagctagtcctaaagaaaaaggtagtttttatagcaagcaagtgacgcccttgcccaagggactcaaacggtctctgtcaaaagatgtgtacgtgactgctcttgggccaagtggcaaaggtactccgagtgagcacagagcaatagaatcgccagtgctttgtgaggtgcttggcgaggaaggcagctgcgaagtaggcaaggtgtttccagaagggaggagctagctgcaagtgggagtcccctttgttctgagtgaacgctgagagatgccataagagggtgagaggttggatggcttccagcctttggcctttttttttttttttttttaaagttttcaagtaatggagccaggccccaagtggccactgccctcagataagaatctgtgaggcctcccacctacctgcctgggaggtccacctcctccccacttgttctgcttttggagtggcttgaggggcccctccaaggctcagacagtgggctatttggggggtaccagaacagggctcccgccacttgtaagagccagaaattaccatcaagtgctttggaggttatgtgtaaaaggcttgcttttcaagaaggaaaaatgttactatccccatacttgcctgcctttacaactcatagatgtgacgggagaggggcttggtgggggggaaatcacggctacaagagccaagcttaggagaactagggtagggatttggagtagaggggacaggattctaaactctacctatttctttatgttgttgttgttgtttggttttgggggggttgtttgttttggggtttttttttgtttttgtttttttgttttttgttttggtgggaatggagtaacacaaatcttaccaggtagctcaggctggccttagtcctcctgccacacccttttggatgctggggttataggcatgtactgtctctgctcccttccccttctgagggagcccctctgctctgagatggtgggggcatcttgttgggagggggcatggtcaggattttcatttgccctctttggctgaatgatggtagaagttgcttgaatgagttcagtgcttcccttcacacctgacagtgcatgggaaggacttcgccaggacattttagagatgtggaagggcaaggaagcattaacttggtctttgctgaacatgagctactttaccagtctcttgggtggggtagacctggaacctgctaaaggagagtctgagcaggaactggagggaacttgagtcaaggggctttgtgggaatgtctcatctggggagtttttcccccaggacagcaccagcatcccttatgaactagagagatgccttggcactgatcacctactctgctcagctgtgggtgacagagctagctacctgcagaggggaatgacatctaggatgaccctcagaagtcttgtttagggctcactgggcatggctgccacagtgatgaagttgctttgttgccatggtgatttgtaaatgttgccatggcgatgcttctacaaggtatagtatggcagcacagtcatgataaattatgggatatatgtgctgcaagtcatatgaccatgctatagggagcagatgtcaaacagccacacccacatccgcctacatggcttgacctagaggccaacagtaagagtagtggtaggtagtagagcctggtggttagggcctctgttgcttgttctcttttagcctatcttttttttgctctaagggtaatcttgctggtagtggttggactggccccatttgcagaggtccaagtgaaaaagtatttgggaatgatgcggagcatcctatcgctgatggcagtaggggtatgtttgcttcaagattgttattagttcctggaagaccaccctagtgcaggcctttgggggcttctctgaagggaatgagaatcgttgccctaagaggcttggagaaaggatgcacagaggtttctaagggtttgaagaatggaggagaagctggctatgttgatggtgtgtggactaatgtgaatctcagatttattagtgagactgcttgatggtaattgggatgtagagagaacaataggccctgctgtggagtttcctcaggatgaggtagagagggacttgccatacagcaattcacagtccccgagggtcaggaatacagtggccagatggatgcggaatgatgagttgaaggagccagcctccctgtcaaggaggcgtggatggtaacggggtggcgggggcacccactgtgtgcaggtttgctcaaatgggaaaatcccagaaagggatgagctagccaagcctttagggatgctcttgtcatgtaaggaactgaggcaggcccctctcagctgatgccagcccatgcagcagtcttccgggtggttttaccagggcactttgtgcataaggtcaactgatttgagataagcttcattccactgttgtgagttgacagtgaggctgaaagtgtttcgctctccaagaaagatagcttagacagtgatgcaggcgcctcctcgaaatccggagttcaactgttaagactaggaagtgaatgtaaaatactcagggcagagagagtcttagcgattgattggcgggggaggggggtgatgatggaacaggataagacagggcagtgggatctgggagcggccccccactgaacatgctgctgtctgatagtgattgattccacctataggcagttatgacattacccagttacctccccttcacatcacctacaaaagggagaggtgaacgaggtacacattaagattctggggtaaatttgagctggtttaaggatcctgcataaataatttctctggcccttcccttttccctgagcagccagggttgaggaaggaagaggagaggcagctggtcatcatgttcccactttatagcccagcgcggccaagttgtaaagtggtgtactgttagtggcagagcagttaagagggtcacagagtggctagcacaagtgataccccggccatgctgagtgcagtggtctttgacagtctgcatgccttcactggttgccgtcaagccttagggctggacactgacattgccgaagacccacttggaccatgtccttgagttataaagtactcagagaactgcagtgacatggcatacaagggatccagccgctggctgttctgtctctgccaccatgaggagggggagcggttggggacatgtagccattccttagctcagattggatccagtcccacgttccctaaggtgctgctcacccgcacctgacagccactcaatgctggattgcccttgagagaagtcgatgatgcatgagcagagctggtcggaagtaggggtggaatttcaaatgtattgagctcatcctatgaggtgaacgtttatttcaccggcaaaatgactcctgcggtgctaccaaaatgccagacccacatcctcaggagaccgccacccccggggaacctgtggggtcatgttagtgatctatgggcaagcactgagccttatggtggttgctacatagtgggttttgttgttgttgtttaggggatttattttctctgtgtgaacacatgtgtcacaatatgtatgtgtaggctagacgacaattcttccaccatgtaggtctccaggagtggagcccacttccccggcttacctttacccactgaggcagctcactggttcctgtagtgtttatattttgttggatattgggaaaactgccaccccagagcaagttgtgggctagttcctggttacaacaatttggaagtggtgtagggctatggtggctcagggagagggtaggtgccataggtgtctactggtcctcttgtcccttggtctgctacagagaactgaaggagccctggggagctggagccaacagtttatgcttgcctggctacaaaagtctgtgaaggtggtgaggtcttgtctatagatgtttgcatgacagaaagagcacaggttaggtgacctgagtccccgtggggacccctattttggacattaaatggaagcagcagcttgattcagtgataggtatttctgtgggcagccatcagattgagccctttgaagttgtagcatccttgcccttggctctgcttggtcctcttctcccagcagccctggctctgcagggttctttgccccctcgtgcccatccaggtcctgggcttctttcaacactctcccatccacattcctcagttttcatcatcttttgtctattcaagtaaacatagatgtcgccccttggggatatgacattttggggatatttcatcttttactacaatcctctgtgtctccaaatcatgacctaagagatgcttccccaaagattttttagtttaagcagacttggttgagactaggttggggtagctcagccctttctgagttcccctggctcccaactacaaaaaggttagcaagacaaagtgcgtagcttgctgacttgttttggcatgccctttctctggaaagttctggttatcctgcttccatgttcccaatgggcgaggatctctgtctcccaagacctgtgaggtgttcatcaccatggccttggccaaggctagcctgcctacgccccatagcccgcctccatgtagggagctagatcctgatttctgaatttttttttttttgtctgttctcacaggtgagtatagcactggaaacaaacatgatctctttgaagccccagaggacaaagatcttcctgtggaaaagtatttcttggagaggccacctgtgagtgagccacccagtgaccagggggtggtggacacgccacacagccccaccctccggctagacaggaaacgcaaactgtcaggtgacagcacccacactgagaccgctgtggaagagctagctgaggaccctctgaaagccaagcgaagacggatctccaaaggtgagtgtggtcagctcccactgcctgcttgggaggcctttgcatgcagccgcagagggcgcaattgagtgtgcttgtgtggggtcacagtggggttattgcagcacctctccccctccttccatagacagcttgccactcccacaacgcctcccgaagccctggggaggcggcacccacctcccctccctccaaacccagaggcggccaaagaaaaataaagtgacctgccaagcagagacagtggccacacccttcccctcccccaccccattggtgctatgtaagacaggtttttttcctccccatggggctttttgattaatttgtagttatttctccattagatgactggcctgagagggaaatgacaaacagttcctctaaccacttagaagacccacattgtaatgagctgaccaacctgaaggtgtgcattgaattaacagggctccatcctaaaaagcaacgccacttgctgcaccttagagaacggtgggagcagcaggtgtcggcagccgagagcaaacctggccggcaaagcaggaaggaagtggcccaggctgttcagcctgaggtcacctcccaggggactaacatcactgaagagaagcctggcaggaaaaaggcagaggccaaaggcaacagaggctggtctgaagagtcgctcaaatcctgtgacaatgagcaaggtatgcagagaccacctcttggctactcactgtgcttctagaggataggtcatgcattccatgggaacacggggacttgggccatccaaggttgtggctttttagtgatgtcctcgaacacccccattgcccgtctttccactttcctcctgatttcccagtatatggctgggcaggaagggaaggctgggtggccccacaaccttgccaacgaaccttccaggctcccgctgcctcagtcatcaggatttgtgagcacctgagcccagtgggtgggggagagcaggaagaaccagtttctgtcctcttgtcctggccctttgaagaaagttaccacttggcattttgagggttaacctatttgccatttgaatgtgggataattaaaatattaatgctttgaaaacataattgttatatctttaaaaactgaagccgctccagtgatcagtgctaacaatgggcttttctttctgcatcggctacaactgtgtaacgcctgcttcttctgcccctcccccgcccggcaccgccccctccccctccgtatttaggcttgcctgtgctctcaggctctccgcccatgaagagcctttcatccaccaatgcaagtggcaaaaagcagactcagccaagctgcacgccagcctcaaggctgcctgccaaacagcagaaaattaaagaaagccagaagacagatgtgctgtgcacaggggaagacgaggattgccaggctgcctccccgctgcaaaaatacacagacaacatcgagaagccatccgggaagagactgtgcaaaaccaagcacttgatacctcaggagtccaggaggagcttgcagatcacaggcgactactatgtggagaacactgacactaaggtaccttctgccctgctccccaccttgtgcctgcttcttatgaaggaagctcccatcttcctggactgcactcccttgccaccgctcctgtcttagaggggcatgtgcactgggtggccatgaagtttcaaattagtaagagtgaaaccccaccccacccctcctctgaccgaccatccccccccccccaaaaaaaagacaagtgtctttctctgtgggtttatcacttgaagaggaaagggagaagaagcaatgggggtgttaaagggtcacagtcttacctgtgcatactgcttactctcgtgacagatgactgtgcggagattcagaaaacgacctgagcccagttcggactacgatttgtcaccaccagccaagcaggagccaaagccctttgaccgtctacaacaattgctaccggccacccaggccacccagctgccacgctcaaattctcctcaagagaccacccagtctcgccccatgccgccagaagctcggagacttattgtcaataagaatgctggcgagaccctcctgcagcgggctgcccggctaggctatgaggtgagtgtat

SEQ ID NO: 663 - DNA, 33711 bp, mus musculus; identical to SEQ ID NO: 662

SEQ ID NO: 664 - DNA, 32486 bp, mus musculus
cggcgtgcggcagcagacggagcctgagctcccagcggcaaggtgaggcagagctgcgctccgggccgaacggcgaccgagctcttcggccgagggggagacgcgccggaacccagagcacgaccgagagcgggagcgaggcgggcggcggtggcggagggggagcacgcgagccgccgggcggagagcccgagccgcgctgtcgccgcggagggacgacttggccaacacactcgctcacacacactcacacacacacccagcccgagcgggcgctctcggcgaaccgtcaacatggcgctggggctcttgcccgagcgcgggcggcagcggcggcgcgggagctgctgagggtgacagagctcgggccagctgcgggaggagaggatcgcgcggggccgtcgccacctgccctgaagctcgcagcccgccccgccccgccccacccccacgcggcccagagcccacccctccgccgggccgaccccgagggcagcagagcggctgcagtcggcggcgagcgagcgcggcgctgggagtggactgcgggcaccagaggaagccaaactttgctgctcgctgcgctttcccggccgggctccttcacgtagccgccctctcccgaccccgcacacattcacccagccagccgcccccggatcttcctcgccgcctggactccgctccggggaaaacttcaaagcgccggatcgcagggctccctgcctacttcccgactggggatttcaggtcagtgcccggaacacctttccccgggggccgcgggcgggctggcgcgccggggactgcagccgacctcctccctccgagggtttctcctccgacttcggtagacccccgttgggaggcttagctaccttgctcgctttcggttttacatcagagctgcaagttattaaaaatgcagccaacctaagcggcccccgcatgggcaccagggagggagggactcgacggaggacctgccgcctcccgaggggttgggaggatcgggagttgaacgagtggaagtttgcagcctctgtgtgtctgcgcgggagcgcggtcgtcgccgagcgtcgggagtcaggcgggggggggggtgctgggctggaagctgggaacctcgtctcggcgttacctcgctagcaggaaggggagggcggcgggttcccgtctgctttctttttcgactcggaaaagaactgtaaaaacccccagccgccgccgcttcgtctggcctctcctggggcccggcggtgcctccgagtggaacgccggcttgagcgtgcgctagtgtgtgcggcgggcgcctcggaccgagccgagctcgacctgccgtcgtcgctcaactccggaggggagtcccgggtttttccttggcttgccccaaagcgtgaatcacgtggaataacgggggcgggggggggggcctactaggaaacagcggagagccggagattcggaatgggccagtccggcgacccgtcaggtcagatgcattgttttgtaaatgttcttttaagattctaattcgaccccccccacctccatcccttcccttcgggaggcgtcccaaggcaggttttaagttcggagcctcctggagcccttgtagactgcttgtttagggacggcgtgggggagcgagcagagccctcggctctccgcttggctgtacggagcctggtgggaagccccgatgggcgtgtgaaagtctgcggccccgggaagttggtcccactcggagggagggcgacgcggaggctccaggcgaagaggaactcgcgcaccgggcgcgatcctcggctgaggcggggagggcgaggcggcacagggccagcgcttgaagcaggcgggaggctgcgctacggagccgccacaaactcgggggctgcgggctgcggcgaagagagcctgctattttcgaagagagcctccgagcgccctgaacggagtagggcggctcgtggcacgtgtagtcccggcggacttctggctgcccggcggctcaatggaacacgtacccacgtcccgaagacgaccgaacctgtccccttgtaggccgaggccgagccaggcttaatttgctgttaatgaatcttttccagaaagtctgcgacctccagctagactctgaatacccgcgcgcgaagacgcgcgccgccggcgtctaaagggtgggggttgggggaatagaaaagcgaagaaggaactggaggagggttatgtttatttaaaaacaaaccttaaaaagaaaccagcgcgcctcaaataggtattcgtcctgcctggttgcgtctagactagacagaccggggttttaactgtaaccccctccctgcgcacccttattgagagaatgctagggatgagtactgctatttggttctaaggttagttccttggacggaaaaaaaatactttaaaatggaccgggaggaaaaaaaatgaggaaatagcccaccccagaaggtggtgggtggtgagcagacagacttgggtatttctagccatctgacacttctgtggcattggaaacggacaccaccaccgggagagaccgacctgtacacggtactggattttgctaacagaattgcttgtgtggaaggtatttcaattgtcgacctcagagacacctatatgtggactcttggggggaatactctcttctcgacctttcccactccatccccgactagttacctggtctgggttgcagtgtcgcctctggtgtttatttgggattgaattgtgtcgtgtagacctacgcggagccgggatgattaatatgccgtccaggtttaatctgaggctggcctttagtgtgcggagtacaccaccacgtacgcgaattgcctgcggtggttaggggatcacgcgggtttcggtcaccaggcgctgggcgggtaggtctggactggggctcgatcggccccagctctctcctttgaggcgctgtcaccagtaggtgactgagagttaattaggaagtgttctctggatcaatgggccgcacagctcattagcgattctttccagccctttgcagggccggcctggcctccgcctcccacacagcccgggcccccgcggtccctgctgcggagagtgccgctgggaagtggggaggggtggtcagtgagggacagcgggcaggccagaacaacttcgcagggccgtgtgttgcgtgcgccgccgcgaggtccccacagcccgctctttcttcctgctcgcggccgcctccactgtgtctttaactcgctctagctcgctttgctgcctggctgctcctccccgcctccctcgcctatctcttgttctctaagcacgacgcctgtgctccccgcccagtttgggattagacaagataaaaataggactgcccagcgcgcagagctgtgacagtgcccgggtagccgggctgatgcgagcgcaaggggtagggtctggggaagactagcagggtgctcgggtcggccagattcttattggaccctcacctcctaccccgcaggcgccgtcacgctcgctggactccttccgctgtgaaccgtgcgggccagggggacctgagcagggtctccgcgctctcgcgggtgttgttggtgtgcgggtgatagatcggtctagacaggcatgcagactccctcccggctgaaggacggggggtggggggcagtggagtcggcagccgactccggagagctgtgagctagcaagctaaagctagcctgccgacccagcaagccgggcttgcttgccgggtggaaggcagattgagggggtgtctcttaaccctttaagtgcggtaaatagtttaatggggggagggacaatgagtcttgtaaaagtgacttattagagtggtctgcggggtgggggcctgggttctagacccactcgtgttttcctttctcttctgtgtgcatccgcccattctttcacaaatcgaatgcagctgctcgacagagtactagcttgacctagtactcctgattctgggaactttgacctcaaaatgggcaccctcgcctaagaatctgagtttctgagcagactatatagacctctctgtttccaatggggacctgaagcatgtagggggatactcaaagtgagagaaggtctctctgacccagacgcctccagattaaagcccccccccccagcctgagatgccaggccagcaaatacagcatgtatgtattggtggcagaacacagcattccttgagttgtccataaatacttaaccacgaacttgtgaatagttataatcagacatgtgggagagacaatccaaattggagatggtctggacacttaaaaaaaaattctatcattcgtgtatcgatgacctaaaatttactgcagctcaccataagttagtctagttctattcggggctggatattgataggtaggttcccctatatagaattaacttattccctccctcctttcccccttaaaaatgtgtggcctaaggttcctctgtttacatttaaactgcaaagccatgctggtcaggccaggaaatgaacttcattatatggctagccaaagaacctaagcagtagaaagggaatctcagattaagatgtatctctgaatgacaagtgctgggacaaatctagagactttggtcccaatgtcctagtagaagagatgcccaggagataaagaactggacaagagcagagtaaacacgggtatgtaaatgtagaccatgtatagtggtattctaaaagaaaaactgtagatgtcatgaaactggaaagtggggcagagtttccatgtgttgcaaagacaaaacccatttaaagaagtaaagagggtcacttgggaaagcacaaaaggcacgcatatgcatacataccctgtgcttagatacaggggcctaattaccaagacctcccctttgccttgagatggacttttcactagtgagactgattgaaagtaagaggggagccagggcgtggtggcgcacgcctttaatcccagcactcaggaggcagaggcaggcggatttctgagttcgaggccagcctggtctacaaagtgagctccaggacagccagggctatacagaggaaccctgtctccaaaaaccaaaaccaaaccaaaccaaaaacaaaacaaaaaaagaaagtaagacggggcaactctattgacacattctcggggagataatgtgtttgggcagtagaaaatggcaaagcagccttccaaataggtggctggccctcggttaggatcacttctagttagttcttgccctgctggctaggtagcaggaatccaaagaggctgggagttcttgaccttggagaggtgagggaaaaggcagcagtagtggccaggagaaagatgtaagggtgtggtaaatttggtgaaggtggagcaaggcttggactgacagagagaattgacagaaggatggatgccctctgggaagaataaagggagcgaatgctttcatgttggtatgctttcttatatattttccctccctgctggaagagactctgcctgggacagccagtgcagggtgcattagcaagcacctcggtgaccccagacatgtaaactcctgctagggtttagtttgctcggggcacttgtttgcctggtccctctttgtctaagcccagtcaggaattccagtttttattgggaagatcacacttgggtagagcccaggctgggtggggcagagctgtgctttgaggaaggctggcagcttcctaaaaggcccaaatgctgccccaaccctaacacaggcctcaggagcaaccagtggcccttagaaatgccaccctggtttcctcaaggattcactgttcagacaactagccaggcagggtcagggaatcaaatgtgccaacctctgggctgagtccaccgctacagctaggaaggccctttgttaggccctaatgttctaggaatcagatgaagagtgtaaatgcaagtgtgtttgcttaggagtctcttgggacactctggatctggtctagaggggggggtctccccaaattaggcgttggttggccaccatcagaggaacttggtcagtgttgatggccaatgggattctctctctctctctctctctctctctctctctctctctctctctctctctctcccctccctccctccctccctccctccctctccccagagttggtcttcctgctgagccctaggtggtaggtctgggaaaatccaaataagctggcacaggaagtcctgtccacctccatggtagcccaacagagcttatccctgggcacttggcctaaggatggacctccttaacagatccccaacatgtccctcaagaggggacatgtatattttgtggggtagcagtttttatgcccttcccggatatttctgaaggttcccattccgggctgactgacgctcaattccgtgtgtcctcaatccgtatccgtgtggtatggccccatttattttttttcagggagcaagtatcactagccagcacccacacaggctgggctccccatgattagacaaatggagaagtccactccgagaagatcctgacagcataaaatataatttgtgatctaaaagacagtttccagtataatctcattatgcaccacagactcccggtgttattttgtggaaggcggacaatgatcaatttacattgacccggggctgggcgagcttttagatggtaattgccatattgatttgcatgcaaaaaggagacctgctaaaattaaagaccggaagctaaattaaactaaatttattgtctaggtgcaaaccaggggaactattgggggggagggaggtgagtcaggttaggttgctaggggcagaacaggtaagaggctagctgagcttggggggcaatttacaactttcccggatagctttgccttgatttcaaaatgtgggaaaggggtcgagtttaggagaaagttataaaaaggtacagttgcagtgaaggccctgggtcttttaatgccaacggtaactataagggagaggggaggtttatagggttacgggggtcttcctgcacccttctcggcactcccaacccgaatttctattgttttgattctacggggccttcgctatggtgccagggacatcaaaatctaaagagagaaaggaagcgtggaggtggggggaacccttctctgttcccgccttgctccttcccctcccccctctacagcgagagaccttgtggtggaggtgaaggtgttagaggctaagtatcccctccaccttggagaggcctggtgggtccccacggatgggactgtgggcagttgtctcatcacgatggaagctaaggtcacaggctcagctggatggcaattgcctgggaagccgcagactccaggtggccgatgtcgaagtagaggaggatgggtggattggactggagtgggagagagtgtctgttggagcttcgggcctgcctagtgccagggtcagggggtcgctgctagaaattctggcatgctaggccagttccaagccaggccaggcaggagctggaaactcatctggctagccaaggctggaaagttttaaaaagagaaagaaagccacttgctggaggtctggctgggagccaggtcagctgtacagcatggccactcggagtgggggtggggtgaacggagggagtgtgcgctccttctgtccacctggaccctctccctcgtgatggctctgccaggtctatttcagaggtcctggttgagctgcagaggctggcaggggtgaccagatgtgtggtgcctgatccaggcctcactaggcaaaggtgaagattagtaaatctttgatttgagagctcctaaaggaaatgaaagcctgggctaggcctagagatgaggaggaagtggggagaggatctttaggccatatcctggttggggaaaggaaagtcttccagcttgcctcggtggttggcttttggtagggatgttggggtgcccaaaggggcctgatttagaagtcactttgctgatcttccatctggtccctagggtttctcttccatctggtccctagggtttcctcttggagcgttaggagatgtagacagatgtaggattcccttccagaggccctttgcttgatctagataatggattgcatgatgtgacaagtctagggtggccatctcaatcataggaccagtccagaagtcagcatttcccctgagaacagagagtccaggccacctactacttactgatgtttggccctccaagcagggcatctcattgtgagagatttgtagtatgtagtgggagattgtgaaatctccatttcagtgaccttagagattgcagtgatgtttaggggaaagtgggctctggcttcctactggatgaattacctaagtttcatgtgctggctcttgcagttgacacacaaagccttaagatgtcttctgcacttacctgaggtgaagacaatatgtgaaagtggggatttcaagtgacacaattaggccaataattggctcctctcctgcaactccaggactgagtttgaccatggcccatttttactagctgtgtgaccttgggggcaagttatttatggcctctgagcctctgtatgtttcttcatttgtatgactgggaataattatctacctttaggatcaaagacactgtttggcacatagtaggcccagagggttaataattgccctgaatgactggtcatgtttctataagttgctccttagctctgcagtgtcccagggaccaaggatgcatgcaggttagctgccccctccagggacattcctctggttgggcctataggggctcctctctttgtttagagttctttgccttatgcctttaagggattccatatgcaacgacttggatccccccccccccttaagtgggatcattatataggtcagaattgattccagaactggtatctaggtgccatttggcacgttttccagtcattatttcagaggaggggacagggctgctggagaggacctagctggaagaggtgcaggaatggctgctacagcagccagaggtgctgtggcgtgatagggattaggtccggatgttatgaaggctcactgtggttttcaataaagtcagccagagactgcttcttttatatcgatatgtatttaaaagaaattactagcacgagaagaaaaccagacctgtatggatccaggccggtagtaagctactgtgatcaggttccctcttcgactcccagaggggaagtcagcttttgattgaagctacacttggttcttgactctcaggggatgcctgctctgaaacaggagctcccccccttctttccctaaaagcctttgtgctgaaagagcttcagtaggcatgaatctctggtccctctgaagaaagccttgcggcctttgctgacgttggtttgtgaacagtggagcagtggattttaccaggccagcacccccccccacacctccaccccaccccctgatttagctcactagttagaggtagtatatgggcagggtgctcctgactggtggtggctgcagcgtggagcccagctgcctggaatctgaaggctctgtaacctttgaagggggccccctcatgagggggcagaggtgcggagctcgaggacccagggttgttttggagggtctgtttgttttctccagtctccgagaggctgagggtggagacggacggacgggcaagagtgtgttccagctttgagtctgatttaaaaaaaaaaaaaaacaaacttgatttaattggagaaactcctaggcatttcacagttctgtacaaatgcaaacttgaaatagcttgagacctacgtcatttttaggaaaggataaatgaagtacaaaagtgttcaaactatgtaaatccttggagttgtctgccctcccataaacacatgacaagtgccaaggcatttccagtcaaaacatccatggacccagcagtctccttcctttgtatttattattttattaacagcattttacacagcatttaacaagcccagactgcccgctttccacagtgcctgggtggaagatgggtgggggtgggggaaagtggtctacaaacccactagagatctcccgatggacaggcagtctatctctactggccagcaaggagccaaaagtagtactgaggagagagctcccttcctatcctaggagtgtttttgggcttctagaatgtgtctgctcccatagtctacgtggaaggtaaatcagggtctactcctggctactctgccccttggttattagtgatcttcaaagaatgagtatttgtctgtcgttattctatatcctggtggaaagtttctaacgaaaagtaatgcctttcttaagtcataaaatgagccttgtatgattatttaattaaaatctatttaaggaccgattaggcgtgtaatttgcgctaataatgacgattatggaaatgttcaacttaaccaaaaagcataaaggagacattttgatcagtggggcgaccagtaagtattcaatgagttgggcaatttctgaaagaccagaggcggacctctgtggccctgcacagaactgcagacatgtccagcctctgtgacaacctcggggggctgcaggcctctctatcacagccccagcctacccactttgtccagtggccaagtagcgtgagcagccatctcttcccatccagcgcctccagactctaccagaggcacaaactctgggagagggctgataaaccacagcgaaatcactgcgaaatggcggtgctcttgggcttaacaaactgcaccgagaaacgcacgcttccttggctggccttggatagagcccggaggggtggggtgtgggggggagccagggtcccttgttccggagaaagctgccagctgctggtcttggtgcgaaggcgaaggcagacacaatgctgctgttgttggtttgatctctaactgtggattgttagtctggctttaactatgtggtaaggggggaatgtgaaggctgtttacagcgagtgcaaataatgtgacagctgttggcgcgcgagccgcgctgcgcctcctcagcactcacacaaagcgcgcactatgcaggcaggccccgtggaggagctgcagaggtggccaccactttgtggctggcgctttcggatgagagaaagctgggtcacatcccgtcaccagtcacatccccagcatgcaccttaaggactgcccaaagggtggggtaggggtgtgggagggtttatatgttgtggttgagggatcttgttagaccgaggtgtcaggagaaggcctggggaaggtgggggtggggcccggagtgtcactgtctagaggggtttggccaagatccatgaacctgggtcctcagctgcttgcggcagagtttgcaagattcgggaaaacaaccagcagccccaaataaagcttgtcgggaagaattaagtgaaggccttctggggatcccgcaggctctgaaggctgttcttcctttgcaatggctctattcagataagttagagagaggcgcggctgtgttctggccactgttcttcagggtggaaatgcaagtgtgtgggttcaggatccaaaggcgtttgcattttccgggaaaggggtgcaggttgacttggagccacacggtctcataagctccccctggcagagcacaccggccttcagctacagcctccaaaggcctggtagaagaggcaccacccgctgggcactagggtgctgtgataggagagcaggagaaaggtgatggtgaggaccagcactctgtccaatcctggtgatgcatcgcataggatgcatagatatagtctagaacttgggtcagtctcttgggtggcctggggcaagctgggaggaaagggtcaccccaactcctcaggagtcccgaggtcgaaaggagccttcccaggatatagaaaggctgttcccgggctatggaaaaccttttcaggctgacttaattctacagcctccttctgggttactttggcccttgtgtggccagccgacaggctgtctgagtctagaaactccccaccccccaggtaggacttctttctacatattcccctcggggagctgggagatgcttctggagtgatacatgaacttcggtgccagttctataaattggtctctttttatgacgtgtgccattttctgtaggaatgttgcttgcaaaacgagtttcgccttggaggaaaggcggaaagataaacaagcctgtaacgccaaaacactggcagtctttccttccttccagctcccttaaagcagccgggctgtatttccaggattagactcatgcttgtaaggagggactctgttggctttttttccccccaagcaaatgcaaattagagaaaaataattttctttcaacgatatgcaatgtattagtcacttggtatcgtgctctcaggcaggcctcatttgcgcgtctgccagctcgctcacatctgcttggcgctgttggggcattttaaccttggcggtgtcgtgtctagtcccatggatcaagaaagagtaattaagctctgaacagccacaaaaattcgtgggtccccatctatatggctttgttttggggtgctttgagttccaaggctgagtagcagacctggaattcttattgttccttgtaaagaccatgaatctggctctcctgcccatcccagccccccagccttcccaggacgtccaggctctgcacagtctacaagaagcgtgcatgcagatttcaggacccttgcatgttgcgccttacttccttaaaaagtttctttgtgtttcctaaggatagccttttgtataacttgttactttctgtagcaaatgtgtttagtttatacaaagccttagtggaaactaagtactccactacttagccgagtactactacggccttgattgacatgggccatttatttaggattcctctctaggttgtgtggattccccagtgggggacagaactctgttaggctggatcaagtgttaggtgggggcggggcggggcggggcggggtggtggtggagggggatgggatgtgaaaaggagtgctggctttcttcctaagttctgggtgctggtgctgggtccacctccttttcaaggacctcttgcttccaaattcaccccagtgcgctttggatgcagatatagttcactgactagtttatctggcgcagcctgaggtaatcggaaagaacaaaaggcagggaagggagtctctggccattcctgtagaagggagggggaaatagccatccctgtccttgggttgggagcggtggtaaatctgatccccatagctgggattctgcctcgggtagaggatggatgcccagcaacccacttttagtagactcttggggtctgccctacccagggctccgtgcctgtcctattttacagtataccaccacactcagctctcagcttaggggagagtccagaggtacagtctgaccgaaggaagctcaaagtgaaggtagggtttgcagtcctaactctaccggtaagctcgggagcatgtcccttgagggctcaaattccgcctgaacccactcaaaagtttatttttgtttgaaatttgatgatgaagaccaaaggagtagtgaaggctcccgcagcggaactctggaagttcccgtgagaacgcagggttccaggggttaactagggtctttggggagggtggctgcccaaggggagaactggcagtttctggaaggcctgagggggtttctggccaggtctgctacctctccctgctgggaccttggcagggagctgtaaggaggggcagaaggggctagtgagctctgagcagggagcgagtgctgggaaagacaatccctttgttgcagactcctcacatcaggctctgcagaggcatggagagggggccgcccctcctcctttctccctccgctgccactgagggtcaagtttattccctatcccgatggctctctgccgtgaccctggagcttcaggaagaaactagaaaggttctgtatgctgggaaggtcaggtctgtgtgagcatggccatcgtccgtctcctccgcgcctgctccctgactttagtcttttactaatgtaaaatttggggttgtgggtggcgacacccacagagccagtggttgtggtttggagtgtgcacctgggcagcctggctcacacacctctaaccccacacctcagatagatgctaaatggctcaggacctgggagcaatttgagggtcccttgctcatctgggaaagcagcccaggaggacccgccctgcattgcatatccgggaaagcattttcttttcatttcccacccccacataggccctccccccaacattctaaaataggaacgtctttcccctcccttccttgacacccagagcgtggtgctgctgtgactcagtctgcttttggagcaaccccaggaagggctggcgctagctttgggcttgggtgaaatccacatcagttgtgttttccccctcctggtctggcccctctgtatctccctcgtcagctccccacccatgatagataggagaccgcatcaccattctgaacagcgtgtttagtggagtcagatgctgttggatggggttaacgggctccagcgattgccaggcaaaactcaagtccagagtgcagccaaagtctctagaaaacacagggccaaatatttacagagggggaccaaggttggagagattcagccacctgcccagggacacagggtgggtgagggtgagagccaaagagaatggacactgactgggaccaggctacccatgtgccacctaagcttcctattgtgggtgcagtgctacagatggacctgttcaatctttggctgctgcccacataactgcccgtagggtggtggccagaagggcctagggaaagaacttaatcccaaagaagggactgccagtgtttgagaggtttcatctcttcctagtctctggaagcaatatttttcctattgtgggtgcaggggtcaccggtggcagtggaagatgatctgccactatggggtggcagtggggacaacagacagttgagcctagtgttgctactgccttcactgcctcctccccgttgtctgcagggggagatcttaaatgtccttaaagaagaaacaagtaagtgggctgcggtggcatatgactttaagcccagcagagacacatccatctcttgagttccaggctagccacgacagaaagaccttgccttttagaaaaggaaagagtatgctcttctgcatctctatgtgctgtcttggcagggatcgactaaacggtgttagtaggtacaccttgggggtcacctgatgtcttttcagaacatgaagcaattgggctcctttttagagatgcctgggttggagggacagcacctaatcttggtcctgctcaaaccaagcatgggtactctagccactctttggctcaggagcaaatgattgttcaccaagtctgttcaggtgagtcctccggctctccgttaaacacagtaagttctaaggactgcagccacataccaatgcatgcttgccacatagaggttcccccagacctcggttccagcaggcagatactgcacttagcaatcgacctgttccgtaagactcagacagccatccctgcctggctcacctctgagccaccttttctttgcgtttcctttcttatccttggttttctctccatggctggcagaaagggttaaaatccagagcaaggttaaagctagcaccttgccctcagaacaggccggtgcttgcttgtaaagtgctttctcatgagtgatgtcccacattttggcacttctagaggcaaacatagcctgcatgtggaagaaggggcaaagaatgagcctcttccttatatatagcagccaagtgccttgaggcactccgtattccagccaccatttcccacagccaagggtcagcaaagtcacctctttgctttagaggtagagaaaaagtcccggctacttcactaggactttctagaaactggaagggctgagatgttcttctcttctgctgcttggtctctctttgttttttcacccagaggtttgggggtgggtactccctgctcctccatggttgagtggcaacaggacatttctcctgagtgtatttctgctgggctcttggacttcccttgtttgtcaccctagagaagggccggcctcctgcctagcaaggcccacagtcatcgaccctttctattttgatcacttgctctttagccaggcacctgaagagttaaaagtccttagcttgttgcaatgaaattatggctggcggtggcgccactgttcgttcaacagacctccacttttaagcagttcaaaaaaagttcacagggcagctaaagattttaagtgtgggttcacgagcgtgcacaagcactcgtgcacaagtgtgtgcagtccacagtgcaactcctggcttagcctactctccgaaaccatacacacaggagaatgaactgcactccaggccttaactctcagtctgtccctgtgtctgtgacacttcattctgatggctagtgttatttatctgtgacaatgctattgaaaaaaatgatgagtggaccccagagaggggttaaagtttcagttctccatgccgtcccaggtccctcacagtcccggtggcattttctgggcggggggtggggggaaggactgaagataccactgggctttcatggggaagaggtcaggccttccctaagctgattctgattgtccttgagggtccctgatgtactcttcccaaggtggccaactatgtaggaggtggctgggtttcaagactgaggaactggggccatggagatttgacttttctcaggcccgttcttctgaccctttttcctggggggattaattgtggagccctgctgtccccagtaggatttctatacttccccagggctctatgagggtgtgatctggtccctcctgcggcttgctgtccaggacccctgtgccaaggaacagcgctctacttgctcagtctgcctgcaatgtcttccctttgttgtgagagtgggcaggagatgcccactcaggaaagggacacttgatgaagtgggtcttgaatctttccagtcccggtgacttgacattccttgcttattttgtacatcaaaaaggggggagggacacagtgaacagctcccacacagtcttccccggtaccccagtctgtcgctccatgcaccgtggctaggccatttggagtttccctgtctgaagaaagagagacccttcccaggaaaccagcttcaccaaagtccattcccatgatgccttcaggaattccagcctcttcagggccctcccctccctgcttcattgttgagctctaactgtgcgtggtgtgttggtgcgtgttgttctatggttgggggccggtgggggttgctggtggacaaaaggcctacttaggacaaagaaaggagcatagctgagcttctggattcaggcctcccaagcctttcccacccccaccccagtccctggcagaagagtccctggacggggtgcctccacccaaccgacctggcagtctgcttctcgtgtgctaaagtgtaaaagcaagcatttgcatattttctcctgctaacaaaggaaatgtgtcgacttaagggaacatttgggctttcggaaactgtgtgggtgggtgtgtgagggaggagaaagaaaagttcccctgatgatctatctgcacaccaattatttcacactcggatttgggtcccgtggaaaaatgccgtggcctgtcctggagaagggaaactgagatgtgtttgtgagcagggaattgcccagggccatcggtcccaggcattaaaggctcccctacttattaacccagcatttaacagcaggatatgggctgaagcgcagtcaaaagaaacggctcaacctccaaagagcaattaaaatcctgcacgaggataaatcacgcggcgtgataatcctgttaataaactgcagcttgtcctgacccttcactcatgcagcaaactagaatgtgctgtgggtaggggcggtgggctgagaaggtaagtgggggaggtggtctgggccccttcgcaccctcccttccgcagcctccccctcccacgaggtggaaaatgggtggcttttgcctgttccctgtgtgccagcagctcggagcccatcagcgtcagccctggctgcagagacttatgcgctaatgatttcttgtccccagcgagcaggcagtcattgaattactcagccgcctccccctgcagctcccaggcaaaaccacccctgttaggtgcttaatctaatccagggctccagtagagaggttcaccagcccactggtctctctctttcaccctccagctttcgggttgggcacaggacagcttggaaattcagccgtcccaaacctgctgtcgccaccacctcactgtttctgcctctaccaccccaagagagatgaatgtgccagtgatctagcaacctgtgtctttctggtccctcctcaaatatggcttctttctctggcaaaagggtgggcaggcccagacctgtgactaggatgggtgtcttcctgtttgttagcttgagtctggtctcctccgtcgccgtgggacaggtgtgttcttggttcatggacattggtggacagcgtcaggcacaggctacgtcgtgtatgaattaccttgaaagaggctttgctttctcagtgcctctctcctttacctaacctcacggggccctcccccctttctttttttaaacagactagacgcttgaagccaagctgccatccaaggggcgacatgctttctgcaacccctctgtatgggaacgttcacagctggatgaacagcgagagggtccgcatgtgtggaacaagtgaagacaggtgaatagtctccagggccaggcctggtgagggagaacgggcgggtcttctcctccacactcctgagcagagcccatgcatacccaagcccccctcatctcctcacagccagagaggggcccaaaaggtctggacaagagagatctcctagctggtggcccttgatttacagttttaacaggcagcctggttcagcgaagcattgccgccctttaaaagattagcccctaaagcggcctttcagtgcgctttcgtccttaatttattatttcatatttatgaaggagaattaatccccatctatatgctgctttaactctaaatgtcaggagtgtgggcccaggtggatcggcattcaatgtgcttttaaaacaaatagtttgcttagtaataaatgaggaggtggctaccctttccttgggtccaacccaaggtttcaggttgccctatgctgcccttctgtgttgttattggccaggattctgatcactggacagcccagttaggctttcttctaatccatgatgttggactggggccgagacaactgaacaggaggtgatggaagcagctttggggtactggtgaatctctgcctctgctgctcatcagtgctgttatcctgaggatttggaagttggcgtggaacactttctttatcaatgctctctgataacaagtcccaggacagccaacagcagcctggcacagatgtgcggcttcctctcctgcctgaagtagctgacatgtctctgatactattgtacatccccacacagctccacattgttttgataaaggctgcaaatataacttcaccatcaccatggaaactagatgggtccctaactttgtttgggggaaagaaagttttgaaagcctaccctcagggttaatgcagatgtggataaatgaaggggctagcctgtagacttctagcctgcttggtccatggccattttatttaatttctgccctccagaacagctcgtaagggttagctaagacagcacttggcctctgtagaaaaggtcacgtgagagaagtgtgcttaatttctggcttgcccacctctgggacatatgtgttattcatgtccccacacatgaaaggcctgcctttgctttgttctgccagggtaatattgaatcaccatttgggagcaactttcactataggtcatggcagggagggttaagacagttcaaaaaaaatgaatgagattagtagaaactggtctggtccggggagatagatgaaagatatattcagcaagaaatgttttcatgaaattggtgtgtctttttaaataggaaaattcctgtgaatgatggcgacgcttcaaaagccaggctggagctgagggaggagactcccctgagtcacagcgtggtaagggatggatggtctctcttgatagggtggctctcagtgatttgtaatcaactatgcattagtttgtgtgtaattagggagtgtgtgtgtgagtgtctgtctgtgtgtgtgtgtgtgtgtgtatttgcttgcgcgcacgtgctcactcatgcacacaatgtgaggagggggaggcatcagggcctggctatgtattgtttttaatatactctgccctcacaagccctcgttccttggtcacgtggaagcatgggtcttctataaccatctatcccgttaatgctccaagctgtataattctctagcctccaagtagttcctagggctttgctttgccagtaaaatatgaaacactggactgtcctttaaggcaccagggaaaggaagtcaaaaatgcaaccatactttgaccacgccccctccaagcccctttattgatttagaactaagacaagctagaaagttcctcatatccattgtccggaggaaaactgtttcttgtcctgttcaataagacctttctgtgtccaagaaatgaatgcccctctccccagtccaacctgacaggttccacagagtcagtgtgtgtcctgtaccccggaggagtggtgcagagaatgtcttatttggtgttgtctgtgccacagcatggtagggtttgctcacagatgagcaaactaatgacttggtttctagtctgagtggatctttcagtgcttgtaggatctcagttgaacagaaatgacaaaaaatgaggcttcaaaaggatttgcatgtgggaggaggcggggcactgggcacagcaaagctatctttagccttttctgttggggtgttaagggtgatgtcatgtgacccagtgggtggtctttcttctggaccagggctgctactgtgacaggtgtcccaagtaacttgtgttattcttttacaaaggtggataccagtggagcccatcggatcgatggcctggcagcactgagcatggaccgcacaggcctcatccgggaagggctccgggtccctggaaacatcgtttattctggcttgtgtggattgggctcagaaaaaggtcgggaggctaccccaagctctctcagtggccttgggttttcttcggaaagaaatccagagatgcaattcaaaccgaatactcccgagacagtggaggcttctgctgtctctggaaaacccccaaatggcttcagtgctatatacaaaacaccgcctgggatacaaaagagcgctgtagctacagcggaaagcttgggtttggataggcctgccagtgacaaacagagccctctcaacatcaatggtgctagttacctgcggctgccctgggtcaacccttacatggagggggccactccagccatataccctttcctcgactcgccaaataagtattcactgaatatgtacaaggccttgctacctcagcagtcctacggcttggcccagccactgtattctcctgtctgcaccagtggggaacgcttcctctacctgccacccccacactatgtcaaccctcacatcccctcctccttggcttcacccatgaggctctccacaccttcagcctctgcggccattccacctctcgtccactgctcagacaaaagcctcccatggaagatgggcgtcaaccctgggaacccagtagattcccacagttacccccacatccaaaacagtaaacagccccgggtgacctctgccaaggcagtcaatagtggcctgccaggggacacagctctcctgttgcctccttcacctcggccctcagcccgggtccaccttccaactcagcccgctgcagagacctactccgagttccacaagcactatcccaggatctccacctctccctcagtcaccctgacgaagccatacatgacagccaatagcgagttctctacatccaggctgtccaatggcaagtaccccaaggctctagatgggggcgactgtgctcaatccatgcctgggcacacccggaagacaacggttcaagacagaaaagatgggggctcaccacctctgttggaaaagcagaccgttaccaaagatgtcacagacaaaccacttgacctgtcttctaaagtggtggatgcggacgcttccaaaggtgaccacatgaaaaagatggctcccacagtcctggttcacagtcgggctgcaagtggcttagtgctctctggaagtgagattccgaaagaaacactatctcctccaggaaatggatgttctatctatagatcagagatcatcagcactgctccctcatcctgggtggtgccagggccaagtcctaatgaagagaacaatggcaaaagtctgtcactgaaaaacaaggctttggactgggcaataccgcaacagcggagttcctcgtgtccccgcatgggtggcacagatgccgtggtcactaatgtttcagggtccgtgtccagctcaggacgcccagcctctgcatcaccagcccccaacgccaacgccaatgcagatggcaccaagaccagcaggagctcggtggataccacgccatcagtcatccagcatgtgggccagccctcatccacgcctgccaagcacggtggcagcaccagcagcaagggagccaaagccaacccagaaccgagcttcaaagcgagtgagaatggcctcccgccaacctcaatatttctatctccaaatgaagcattcaggtccccagcaattccctaccctaggagttacctcccttacgcagcaccagaaggcatcgctctaagtcccctctctttacatggcaaaggacctgtgtatcctcacccagttttgttacccaatggcagtctgtttcctgggcaccttgccccaaagcctggcctgccttacgggctgcatacgagcaggccagaatttgtgacctaccaagatgccctgggcctgggcatggtccatcccatgttgatcccacacacgcccattgagatcacaaaagaggagaagccggagagacgctcccgctcccatgagagagcccgttatgaggacccaaccctccgtagccggttttctgagatgttggaagctagcagcaccaaactgcatccagaagtccccactgacaagaacctgaagccaaactctagctggaatcaagggaagactggggtcaaaagcgacaaactggtctacgtagaccttctccgagaagaagcagacactaaaactgatgcaggggcacccaaagcaggccttgtagccgagaatgtaggtcaggacaccgaggccaccaagccctcagctgaccctgtgatccaacaacgccgtgaattcatctccctcagagaggagctgggccgaatcactgacttccatgaatctttcactttcaaacaggcctcaagccagccagtgttcagcttaggcaaggatagtggtgcagcaggaaccaacaaagagaacctgggtgtgcaggtagcaactccattcttggagacagctctgggcagtgagggccctgctgtgacttttggtaaaacccaagaggatcccaaaccattttgtgtgggcggtgcccctccaaacatggatgtcacccccgcctataccaaagaaggaactgatgaggccgaatccaacgatggcaaagttctgaaacccaagccatccaagctggcaaagagaattgctaactcggcaggttatgtgggcgaccgattcaagtgtgtcaccaccgaactgtatgcagattccagtcagctcagccgagagcagcgggcattgcaggtgagccccccaacccgaatttcactaactttatcagttgtcagtttttgtaatgtacaaaggggatttgggggaacgtggtaggccagagcaccaggcagatttggttaatgacacttatgataattggaatgtatgaaatgtgttcaataaggggacggcagtagtagcttttaggaggttcatgtgtcagatactttaagctattctgtagactatatgagaactctactggaatgctgataacaagttgtaattattatgaaggatgtctaaagactgcatgacgtttacctagcaattgctttgatgtctctgcctgtaagataacaaatataactagaagcattgcttagaataccttacttgatacttggtggagatgtgtagcagtcgcatgtctgtgggaatcgtgcaatttttttcaccaaaaagaaagaacattcgtttaaagggatagagtatgtatttgatttgctagtgaattatgatagatgttgtataggaatttccttaagatattttacttttaattaaaagatgaataaagccaaattgttttgcaattgttaagaaaaaaattggtttatgctgataaaaatggatgaagttatctaaatgatccattgagtgcccattttaattacatagatggaaggattacaagaggacagtattttatgtctacccgctgcttactgtgaggtcagttcttcaaatttttattactagaatcttccataaaccttttgagttaaatttcatttccaaatatacaaagggaagtttgtgggccatggtcgtctttgttcattgtacattttgtttcttttctgttgtgttttccttttgtttttctttgcactgtggctttattttattttatttataaccttcaaaagagaatgtctgtctctatgcaatcgtgtatgtatggctatacatacacattgcgtctatatctctatacacacgactttatggataaagaatgtgtgactactcacatatagacactcttaaattttatctgttaaactttaaaatatctgagttgtatctcataaattgtggttggctttgggcaagcttttctctgaaaacactttcctttatagtataaggcacatgaaatagcctttatggtaagatgttgtgtttttttttccatcttcgttttctttctagcgtgcaatgatgcgcttctcagagttggagatgaaagagagagaaggtagccacccagcaaccaaagactccgaggtgtgcaaattcagcccagccgactgggaaaggttgaaaggaaatcaggaaaagaagccaaagtcagtcaccctggaagaggccattgccgaccagaatgacagtgagagatgtaagtaacccgagcagctgggctgtagcatcacattggtgagagcagagccaccctgcttccaaggcctgagatggtgagaggaagagggatttgtggataatggctcaaggtccagttggggactgctctgagaaagaggctgctgtgtggcccttactgtagtgatgtctgcttacatgcagctgggaatctggtgtctatgagatttttttctaggacttggtcttcatttgcaaaggaacaccaggctcaaagtgaatgacagcccaatacaatgtagcagtagaaagcaggtggtaaggatcagttctttttttttttcttttgaagcagctagaatgatactctttagccttgcacctctcccacatggcagtctacgctggaatgggaaaagtacttaggtttttttctatctaggtttttttgaggtgggatgaaggttggtcaaagcaccagaaagatggcaacaggtattagctgagtttgttgtcattggaagttatcaatagaacccaagaatggggtatgggaccagcctacaagacagatagatggtggtttatggtctcgggtaaatgtgggaaaaggtaagcaagcgccttttgggggatctttcagtctaaacgatgggttccctgttgggctgggcttttggagagttttaagggtgtttgctgtgacacttcgtgaaggtctttaggttcctcgaatgtctatgcttaaggtttgaggcctgctctggccttcagaaaccttgctagggaaggcgaattaggatgtcaggggaaacatggaggagagttgttgcagaagcctcctagacaagccagtcagtggcattgggtgcttgagagccctctattgttgcccttgaaggtgtaacacacctggcacagttcttggtgcgccgtctttccttcactacctccagttcatctttaaggtccagaaaacgctctggctggcctgcagcaacagtcagacccaagaagatttgctgtgagctagtcctaaagaaaaaggtagtttttatagcaagcaagtgacgcccttgcccaagggactcaaacggtctctgtcaaaagatgtgtacgtgactgctcttgggccaagtggcaaaggtactccgagtgagcacagagcaatagaatcgccagtgctttgtgaggtgcttggcgaggaaggcagctgcgaagtaggcaaggtgtttccagaagggaggagctagctgcaagtgggagtcccctttgttctgagtgaacgctgagagatgccataagagggtgagaggttggatggcttccagcctttggcctttttttttttttttttttaaagttttcaagtaatggagccaggccccaagtggccactgccctcagataagaatctgtgaggcctcccacctacctgcctgggaggtccacctcctccccacttgttctgcttttggagtggcttgaggggcccctccaaggctcagacagtgggctatttggggggtaccagaacagggctcccgccacttgtaagagccagaaattaccatcaagtgctttggaggttatgtgtaaaaggcttgcttttcaagaaggaaaaatgttactatccccatacttgcctgcctttacaactcatagatgtgacgggagaggggcttggtgggggggaaatcacggctacaagagccaagcttaggagaactagggtagggatttggagtagaggggacaggattctaaactctacctatttctttatgttgttgttgttgtttggttttgggggggttgtttgttttggggtttttttttgtttttgtttttttgttttttgttttggtgggaatggagtaacacaaatcttaccaggtagctcaggctggccttagtcctcctgccacacccttttggatgctggggttataggcatgtactgtctctgctcccttccccttctgagggagcccctctgctctgagatggtgggggcatcttgttgggagggggcatggtcaggattttcatttgccctctttggctgaatgatggtagaagttgcttgaatgagttcagtgcttcccttcacacctgacagtgcatgggaaggacttcgccaggacattttagagatgtggaagggcaaggaagcattaacttggtctttgctgaacatgagctactttaccagtctcttgggtggggtagacctggaacctgctaaaggagagtctgagcaggaactggagggaacttgagtcaaggggctttgtgggaatgtctcatctggggagtttttcccccaggacagcaccagcatcccttatgaactagagagatgccttggcactgatcacctactctgctcagctgtgggtgacagagctagctacctgcagaggggaatgacatctaggatgaccctcagaagtcttgtttagggctcactgggcatggctgccacagtgatgaagttgctttgttgccatggtgatttgtaaatgttgccatggcgatgcttctacaaggtatagtatggcagcacagtcatgataaattatgggatatatgtgctgcaagtcatatgaccatgctatagggagcagatgtcaaacagccacacccacatccgcctacatggcttgacctagaggccaacagtaagagtagtggtaggtagtagagcctggtggttagggcctctgttgcttgttctcttttagcctatcttttttttgctctaagggtaatcttgctggtagtggttggactggccccatttgcagaggtccaagtgaaaaagtatttgggaatgatgcggagcatcctatcgctgatggcagtaggggtatgtttgcttcaagattgttattagttcctggaagaccaccctagtgcaggcctttgggggcttctctgaagggaatgagaatcgttgccctaagaggcttggagaaaggatgcacagaggtttctaagggtttgaagaatggaggagaagctggctatgttgatggtgtgtggactaatgtgaatctcagatttattagtgagactgcttgatggtaattgggatgtagagagaacaataggccctgctgtggagtttcctcaggatgaggtagagagggacttgccatacagcaattcacagtccccgagggtcaggaatacagtggccagatggatgcggaatgatgagttgaaggagccagcctccctgtcaaggaggcgtggatggtaacggggtggcgggggcacccactgtgtgcaggtttgctcaaatgggaaaatcccagaaagggatgagctagccaagcctttagggatgctcttgtcatgtaaggaactgaggcaggcccctctcagctgatgccagcccatgcagcagtcttccgggtggttttaccagggcactttgtgcataaggtcaactgatttgagataagcttcattccactgttgtgagttgacagtgaggctgaaagtgtttcgctctccaagaaagatagcttagacagtgatgcaggcgcctcctcgaaatccggagttcaactgttaagactaggaagtgaatgtaaaatactcagggcagagagagtcttagcgattgattggcgggggaggggggtgatgatggaacaggataagacagggcagtgggatctgggagcggccccccactgaacatgctgctgtctgatagtgattgattccacctataggcagttatgacattacccagttacctccccttcacatcacctacaaaagggagaggtgaacgaggtacacattaagattctggggtaaatttgagctggtttaaggatcctgcataaataatttctctggcccttcccttttccctgagcagccagggttgaggaaggaagaggagaggcagctggtcatcatgttcccactttatagcccagcgcggccaagttgtaaagtggtgtactgttagtggcagagcagttaagagggtcacagagtggctagcacaagtgataccccggccatgctgagtgcagtggtctttgacagtctgcatgccttcactggttgccgtcaagccttagggctggacactgacattgccgaagacccacttggaccatgtccttgagttataaagtactcagagaactgcagtgacatggcatacaagggatccagccgctggctgttctgtctctgccaccatgaggagggggagcggttggggacatgtagccattccttagctcagattggatccagtcccacgttccctaaggtgctgctcacccgcacctgacagccactcaatgctggattgcccttgagagaagtcgatgatgcatgagcagagctggtcggaagtaggggtggaatttcaaatgtattgagctcatcctatgaggtgaacgtttatttcaccggcaaaatgactcctgcggtgctaccaaaatgccagacccacatcctcaggagaccgccacccccggggaacctgtggggtcatgttagtgatctatgggcaagcactgagccttatggtggttgctacatagtgggttttgttgttgttgtttaggggatttattttctctgtgtgaacacatgtgtcacaatatgtatgtgtaggctagacgacaattcttccaccatgtaggtctccaggagtggagcccacttccccggcttacctttacccactgaggcagctcactggttcctgtagtgtttatattttgttggatattgggaaaactgccaccccagagcaagttgtgggctagttcctggttacaacaatttggaagtggtgtagggctatggtggctcagggagagggtaggtgccataggtgtctactggtcctcttgtcccttggtctgctacagagaactgaaggagccctggggagctggagccaacagtttatgcttgcctggctacaaaagtctgtgaaggtggtgaggtcttgtctatagatgtttgcatgacagaaagagcacaggttaggtgacctgagtccccgtggggacccctattttggacattaaatggaagcagcagcttgattcagtgataggtatttctgtgggcagccatcagattgagccctttgaagttgtagcatccttgcccttggctctgcttggtcctcttctcccagcagccctggctctgcagggttctttgccccctcgtgcccatccaggtcctgggcttctttcaacactctcccatccacattcctcagttttcatcatcttttgtctattcaagtaaacatagatgtcgccccttggggatatgacattttggggatatttcatcttttactacaatcctctgtgtctccaaatcatgacctaagagatgcttccccaaagattttttagtttaagcagacttggttgagactaggttggggtagctcagccctttctgagttcccctggctcccaactacaaaaaggttagcaagacaaagtgcgtagcttgctgacttgttttggcatgccctttctctggaaagttctggttatcctgcttccatgttcccaatgggcgaggatctctgtctcccaagacctgtgaggtgttcatcaccatggccttggccaaggctagcctgcctacgccccatagcccgcctccatgtagggagctagatcctgatttctgaatttttttttttttgtctgttctcacaggtgagtatagcactggaaacaaacatgatctctttgaagccccagaggacaaagatcttcctgtggaaaagtatttcttggagaggccacctgtgagtgagccacccagtgaccagggggtggtggacacgccacacagccccaccctccggctagacaggaaacgcaaactgtcaggtgacagcacccacactgagaccgctgtggaagagctagctgaggaccctctgaaagccaagcgaagacggatctccaaaggtgagtgtggtcagctcccactgcctgcttgggaggcctttgcatgcagccgcagagggcgcaattgagtgtgcttgtgtggggtcacagtggggttattgcagcacctctccccctccttccatagacagcttgccactcccacaacgcctcccgaagccctggggaggcggcacccacctcccctccctccaaacccagaggcggccaaagaaaaataaagtgacctgccaagcagagacagtggccacacccttcccctcccccaccccattggtgctatgtaagacaggtttttttcctccccatggggctttttgattaatttgtagttatttctccattagatgactggcctgagagggaaatgacaaacagttcctctaaccacttagaagacccacattgtaatgagctgaccaacctgaaggtgtgcattgaattaacagggctccatcctaaaaagcaacgccacttgctgcaccttagagaacggtgggagcagcaggtgtcggcagccgagagcaaacctggccggcaaagcaggaaggaagtggcccaggctgttcagcctgaggtcacctcccaggggactaacatcactgaagagaagcctggcaggaaaaaggcagaggccaaaggcaacagaggctggtctgaagagtcgctcaaatcctgtgacaatgagcaaggtatgcagagaccacctcttggctactcactgtgcttctagaggataggtcatgcattccatgggaacacggggacttgggccatccaaggttgtggctttttagtgatgtcctcgaacacccccattgcccgtctttccactttcctcctgatttcccagtatatggctgggcaggaagggaaggctgggtggccccacaaccttgccaacgaaccttcc

SEQ ID NO: 665 - DNA, 32486 bp, mus musculus; identical to SEQ ID NO: 664

SEQ ID NO: 666 - DNA, 84462 bp, mus musculus
ctgtcccccagaacagcacagcgcggggaacggtcgcaggttgcctttggaaagggcctcccgcgggttccccttccgttctgcctggcgacttccgctctcggcccagcaacatggacgctataacccgccggccgggcggccgctgagcagtcgcggaagcttccccacttgagtggcggccggcccgcctctctgccctcccgccccacgctcgcctccctgcggccggccggcccggccctacatgggggcgggcctccgcagcttgggctcggcttcctgttcagaggcggcctggcgctaggcggcggccactctgcccgcgcccgcctcggtgcggtcaccgagcccgggaggaggctccagggccgcatctcaggcggttgccccgagccgggctgtacgccgccatggccccagtgcagctggacaaccaccagctgatccctcctggcggcggcggtggcagcagcggcggcggaggcagcagcagcggctccgcgtctgccccggctcccccgccgcccgcagccgctgtggcggcggcagctgcggcggcagctagccctggataccggcttagcacgctcatcgaatttctgctccaccgggcctactcggagcttatggtgttgacggacttgtaagtgctgcgaacccatgcctgcttcccggctcctcacttgcccttcccgccttcaagagaggcttatgcttgccatttactgagctaggctgctgagcgtagaatttggaaattcatggggtttaggttctggggacagggaggaggtaactattggggatctggttgacgatgaaagcacggagactggttagtttcgcatgttaacacttgcgctgaagattgtctttgggatttttgtcttgagttcccaacagaagtgtattaatttctatgtggaatattttctaaaaacctaagtcgaagagtaagcattgaggactacgtagaattcgaactgaacgggattttcaacgaagggaaatgttttacatcttttttgacaatgttttaaatgaaggttgcaattgtttctcttaaaatgccggaggtcgattctgtgtaaaacaattacattataaattctgattctttctgcaacatttgaaagcgtgttaagtctttatggatgtagtgaaagtagaatactttttttctaatgagcctccgggtttcagtctagttacctatgaaatgccttggggcgtgattagggtgttaataccttcagagtacaagccgactacacggatggttcactatgtgaataaaaggtactaggaaaatttgaaactctttagcatcttctacctgaggtccataaaagttttctttttacctattgttaggctccctcaggtttccagggaaatacgttagtatgtagacgctaggatgtatcttgcaatactttgttactggagaattacattgtacatgactaaaagaattagggcgggcttcacttactcttgtaaaacattccctttcagttttgatgtacaatattttattgaatgagacaaagcttaaccttatcaaaagtggtggcggtattactattctccttactattgagacggggtcttcctgtgtaatcgggctggtcgctaaccttcagttctggctcagccgctttagtgttgggattacaagtatgagccactacacctggctgagattttttttttttaacacacgatttcctcatctagtaagagctaggattacaggtgtgtgtacgtccctcaccccgtatggcttctgactgagtgatctgtcaagcttagttcttgtagtaatgtacgtatattgcatgtgttcataagaattcaagacagtttaatatatgtcctgtgcgtagctgtggtaaaaagactgatcatggatcatgtgattggttttctgtaaagaatttgtaaaaatgtattgaattgtgttctatttttaattttaggatttagtttatggagagagatctgttttattgatatagaataatctatgtttagtcccccccccccatcatttgtatgactcctaaacatatctcaagcacagccctcagctgaattccacattctgtgtccagatccttacagctcaatatctaacccagaagctgtgttcagtgaaaaataagagatttgtggcccagggtttcggaaggtaaaagcaagaggatcacaagctttaggccagactcaaagtacaaagtgaaactctagtttcaaaaaagattccatagccaaacatggtggtgcatggctttaatccctgcagaggccccacgtgcatgccagtcttacgtttgagactagcctggtctatatatagccaattctaggacattgagggctacatagtaagaccctgtctcagactaaccacccccccacccccgtctagaaaaaaaaccacagggaaaaaaatgtttagaatcgcttctctatgagagagagcataaaatttgtggctaaaccaggatacctttgaacatggggaaaatgttataaatatagtagtgtatatctgtagccctagcacttcagaggtcaaggcaggagcatcagaaattaaagaacagcccgtaggcaacataggaagtttgatgtcagcttgggttgcctggcattatatttcagtagtaataatgataatgcacattggttagggaatgtagcctagtggtagagcgcttgttaggtcctgactccctctctccagtgctacacattttttttttttaaagatagaacagcaagcctacactgggactacgctgtaccaaccagaacatctttaaggccttgggaactttgccttacctactttacttgtttaattcatatgctaatagtctcattctgttctgtcaaccttcttgctgtttctcatagttcttcacacaatttacaattggataataatgccttttgttctttttccagaaatataagtggttttccttctcttttcctttaggtcttagctcacatagaacatagatcaaagactttctccaagtgctcacagaatagtatttgcacccatcctcctcttttgttttctttttttcctacagtgctcattccttgagacatcattaacatattgtgccttctccttggaataggaaattcaggagaacaaggattttgatttgttttgcttttccacatgacaagaccaatgcctggcatgtacttgggggcttttatttagtacacgaatgaacgaattttcagatatgtctcaatttttttttttttttttgtttttggagacagggtttctctgtgtagtcctggctgtcctggaactcactttgtagaccaggctggcctcgaactcagaaatccgcctgcctctgcctcccgagtgctgggattaaaggcatcagctatgtctcttaaaccattgatgattatgggaaaagcaagtgctattcttgatacttaaaacaacaacaacaacaacaacaaaaccctttccaattaagtgtcaactaagatgacagggttttgtttctgagacagttttactcttctctaggttaggttggcacagaactttgtatatttttctgccagcatatttaggtgatttggtttagcatcaaatttctagatttttttttttttatgcctgttcacctccaacatacaccgatgctttctgccttaatattttaggggcatagattctattctttgctttttaccgcttgtttgtttgtttgtttgtttttgagacagggttctctgtgtaaccctccctgactgtcctggactcggatttgtcgaccaggctgacctcccaactcctgtctgcctctaacatggcctgggattaaaggtgtgagccaccacacctttgaaccttttaaggtcagaaaatggacataaacgtttactaaaatgtggcataaatatgcttgttctgtactttttttctttcatcatttgtatctaagagctttttctccatgtggtgggttttcataaaggaatttaaaatagaagtgtaagcattgggagaaaagggaggcaggcagcaagtcccgtcttttgttttagaaatgcggacctttgttggtgggagctgatcctttcgggtctctggggacaggtaggagctggaaggatggtttctgccttcctatttacccctgagctctactctacccccatcccccaatcctcacttttgtcactcttgagaacaaggcttctctgggagtactgtgagggacttttatcatgtagaggaacttttccagggcctgcttttatttgcaatctttgagactgggtcttacttcacacatctttggctggccttgaggtgtagtcctctcctctcagcctcccaggtgcttacgatcacaggtgtatgaggtaccatatctggttcttatttgtagccttataataggcccttaatttctacttggctttgtgatatactagcctttttagtctctacttagtttaagccttcccctgccccggacctctggcttggtgttcatcagtgtcctaaagcccacctctctcctagaaattgaaccctggaatgtgctatgcaggttctttaccactgacctatacatacccgtactccctgcctaggttctctttcattctgctcatacctgtagcttccatctacctcaatgtcttccctgagaataagacaactcactttagtagtttcccctccctctattctttcctgtttgggtggttgtgtatgtggggggaagaacattaagcagctgggtgcatttttcaggatctgataattgctgggcaggtttgacaggtattcaggcaattgagtcttgcaccatgagctagaagatactggaatgctggggggcggggggggtgttcagaaatctgtttcagacctttccaagcattaatggagtagtataatttatgaaggagaaagttaacataggttgctagcaatcagtactgaagaactagcaaaaaggaaataaacactattggagctacttaaaaatagtataaacccttcatctaaccaccatgcaaagttataactgccataaaaccttgattgtacccttaacttccagattcacctactataacacaacagaatgggattactgctaagagtctaaaagtgttcacaagttcagagacactgacaactaagcactattccagcaactgtagccattttggtcttaaaagatatttttctgcctctggtatttacttattggagacagggtctctatgtcttggaactcactatgtagatcaggctggctttaaactgactcctgagcgctggggtcgaaaggtgtacaccacctaaaaccccaagacttgagcttttaaactgttaaagggtcacactgtatcttctgaagcattttgaatggcaagaaatgttactttttcagtttttactttgcagccatattgttgctaatttatcagtgcagagagttagcagccacttgagcctgtggttactgtttggtcaatttttctgaaacatgaagatgaaacaaaggccaaataaaggccaccattgcagtttgagaaggcatacatatatttaatccacttttttttttccttagattgccaaggaaatctgatgtggaaaggtgagtatgaaaaaacttaaatctgtctccttattgattttttttttttttttactccgtgagcatgagtatggtgctatttattgatgatgaagaacctaggtccaaagaaacttaggactgtgtattttcttgggagcatcagggagtgcagtttttgtgttcttggtacttggatgtagaccctttcttttttaaatctttattgatggctgaccaaggcaagtccttgggaggaataggaaaatgtaactgcatagacactaatagaagttgagtcgactggctttgggcagctggctgttaatttaccagttgctgtaatgatgctgttagatcctgttattgctattttatagttgaaaatttttatttcaatttaagcttgggcttaaaatttaacactattatgtttccataagccaaagaaaaaagttttttaaaaagatttatttacttaatatatttatatgagtacactgtagctgtcttcagacactccagaatagggcatcagatcttgttaaggatggttgtgaagccaccatgtggttgctgagatttgaactcgggaccttcagaagagcaatcagtgctcttaaccactgatccatctctccagcttggttttggtttttttaaactaagtccctggggaggtttgtagtattcattagtagttacctcttcattaccaacaccaaatgccttatttgtagacttacacgggaatcaaaaagatagagctggaagacacaattgaaacttaacctggtttgtgacttgattggttagttttaaaacaaggaaacaagctaggtttattttgcctgttgtggagtaggaatgaacactgggcttttgaagaactgactcatgtatactatcagttgagacactgtggtgtcagaaaactacattagagtagtttacagagaagggcatatttctgatagaggagcatatttagggaaaaaaatcagacaaatcttgctgcttgtggtaagagagggacagcactggaattccaagtcctgaggtcggtggtgtccaggtggttgtatatttgtgttttgtgccttacattcttgagctacaaccctagccctgtcagatcttaatgtacttttaacacttgtgctcattcttgttttctttaataatccttgacagacactgaccaagagccataagtgtgccttggcttttttcttttttgtttctagtattcatggtgttgactgttcttaaggaagctttttttaggttgtgtgtggtcttttcacactctcaatagcagcttgactttgacatattcagtcagtgatagacttcagcaaaaacttacgtgggtgcgttgcatcagggtgatgttattggcaagatggagagatattggttggatgtgtaggtcattgaaaggtcacattaaattaataaatagcttcgattttacttggagttaggttagtattcttctgggtcttgttattaattagtcctggcatgttgaaatttttttccagtgtcttaaaccatgagaggtatgattgtcagttgtagtggtcctgaagaaaagagggctagctaatatgtagagggtagagaatttttaatgatgctcttaaagctttatgagatgataaatattggcaattgctgggcagaaaaagtatagaaatgaatacaatataaaaatagatattgacagacctaccttttaccaatctttaatttgggtaaggtaatatattcaactttgtcatcaaaatcatcagagtttttgtttgtttgtttgtttgttatgctattgtaagttgggaaataactcttgattttatagaaaggacatagtttcaagctttggtaaagagtatattttaactcctctaaccaaaatggtaacttattaccagtaacttcagttaggaagtttatactaactttcactactacatatccatacgtttagtatattttaggaatcatttagtataatagtttcaagttttaattcattgtggaaaaattcctattggatttattgctctgtggtaaaggtatgagaacacaaaaatgagatgaaattaatatttgtgtaaaaattttaggttaattttgttgtgcttgtaaatgaatgcttttttatttagatgaaacaagttatgaaaaataatgtgctgctggttcagatgaagaattgttttattttataggaaaatagaaattgtacagtttgctagccggacacgtcaactcttcgttcgattattagctttagtaaaatgggccaatgacgctggcaaagtagaaaagtgtgcggtaagttaaactttggtttttacgttgtatagaagaactttgagagctgcacattcgtacatgtgcctgtgatcttagcactcaggagtctgggtaatgatgatcatgagctctaggttagagactacatggcaagatgctgtctcaaaacaaatgcctttaaatgttacatgcataacttagaaatttaactttaacatttgttgatttcaaagttattactgatgtcagtaatcatgttcctttatgataatacataatgcgtctatctgtggaaggctagtatttgtatatggacacttgaccaaaaggaagaggaggggatatgtggaagatttacatggggagatggaagatttacatggggagactttagatagagcactggagaaactaaaaggggagaaatggttggcttcaaaactttataattcttcagagcagtggttctcaacgtgtgtgtcaagactcctttggcaaactttcatctccaaatatatttacattacaattcataacagtagccagattaaagtcatgaaatagcaacaaaacaattttatggttagggtcagcacaacatgcggaatggtattaaaggtcacagcattaggaaggttgagaagtactgctttggagttaggaagattctcttcaagtttacttattgattttttgatgtccttatgagaatgacagagtctgtattttctgttttacggatgagatgattaaatttctagaaaatatgtggtttcttcaaggtcacagaactgatgacagcaggtatcagtcagttcagttgcttgttcatttactcgtgctcaaagactcctgagcataagggatggtagggagacttgagtaaagcctcctatactgcctgctttcagggacacttaagagtctttggactggtgaattttgtgtgttttttttttttttttgagatagggtttctctgtgtagccctagctgtcctggaactcactgtgtagaccaggctggcatagaactcagaaacctacctgcctctgcctcctgagttttaacgtaagaatgttaagagaacagcctagaggggccttgggtgagttcactgtgagaacttagggagtatgatttggttttcagagatgaggaacactggctcttgttttacttcaatcgctcctaaagagttatactggaaagggcaattaaatagtgaataaagtcctgaaatgaagacagcgtgcccccactttcattgaggtgccctttttaggctcagctctacaagaccaactatatgtctacctgctgtcaattaaatttgtgaatggaaaggaagtgcagagatataacttaccagtgattctcacattccttttttggatttttttttttggtttttagagacagggtttctctgtgtagcactggctatcttagctcactttgtagaccaggctggccttgaactcagaaatccacctgcctctgcctcccgagtgctgggattaaaggcatgcaccaccacgcctggctccttttttgttttttattctatcctgtattgacatttttttttttttggtgtattgacatttttaaaaggttcctagtgttcatagattaaagcagattaacaaattagatctggctaggttaagtttgagagcttcaaaagttctctgtagcctggcagtggtggcgcacacgcgcctttaatcccagcactcgggaggcagaggcaggcagatttctgagtttgagaacaacctggtctacatagtgagttccaggacagccagggctacacagagaaaccctgtcttgaaaagccaaaaaaaaaaaaaaaaaaaaaaaaaaaaaaaaaaaaaaagctctgtagtttatcaagcttcttccataaaaatcagcagggtaatgatggtgcacccctttaatcccagcacttgagaaacaggcaagtgcatctccatgagttcgaggacagccagggctacacagagaaaccccgtcttgaaaaaccaaagaagagaaaaaaatgaacagctacctgccatgatggtactgtagtatatttattttagcactctgataaattaaaaatggagaattttctgtttgtaagctggcgagggttcttattccacaaaagccctattttacaaagcaatctacagcatagctatatttctggcctgatttctctgacattttcaccttggttttagcctgttttagtctttgcttaacctgtttcactagattgccaaaactttagggaaagttgccaaaccaaaagaaggaaaaagatcataaaattggactttggaaagttctagaatataagtttgcattttgaagcatatcctgttagtttctattgtcagtttgacacaaactatagtaacctgggaagagaaaactcccccagttgatagttgattaagatagataggcttctggtcatatttggagcattttcttgattgctaagtagtatgggaagcccagcccactgagcgtgatcttccctgcgtagtataagaaaagtcttgctatgctatgtaagaaaattagctgaatataagctagtgagtgagtcagcaagcaacatgtctttgtgtcttctgcttgagttcttgtcctgccctcctttaatggtgtattaagatagaagtgtgagctgtacaaatcctttcctgtatgcttttgatcagagtgttttgtcatagatgcagaaagcaaactagaacacagggggaaatgatttttttattgacattagtatgtagttctagttctggcagcttagaccatgagagctgtagaccagttttgtcagacatgtttatctgtctctgagtaagctaatatacccttctctgtaatattgatcaaaagcatatttgacttaggttggccttaaactatcagtcctcttgtcttcttgagtgctgggattacagatatgtatgtaccaccagcacactcagtttttgaggtagagtgttttgtatgttacatctccctttagctgggagggtgggctggagagatggctcaggggttaagagcattaactgctcttctgcaggacccagtttgactcccatcacactcaaggcagctcatagccatctgtaacttcaatttcagggaatccaatgcactctgctgtttttgtttttttttaacctctttgtgtaccagatatacacatggtacatagacatacttgaagatgcagacaaaacacctatgcacaaataaattaagaattcaaaaattttcctcaagggagaaaagtttccattgtctataaatgtgattgggaagttaaaatttgcaaacttttgtacagtaagcaatattcaatgtactgtggttagtgtattttgagtctgtctcattacacagatggagtagtgtaggccggataaactgatctctcagtttatctctcatcttcccagagggaggtctctggttttcttttcccttaacttggtctcaagaacattttctgttgattcttaaaaggcttaaatcgctgggcggtggtgatgcacgcctttaatcccagcttttgggaggcagaggcagatttctgagttcaaggccaacgtggtctacagagtgagttccaggacagccagggctacacagaaaaaccctgtctcgaaaaaaaacaaaagcaaaaccaaaaaaacccaaccaaccaaaccaaaaaaaagccttaaatcagagttaaaaccagttcagcaattgagactattttagtagtatcatggctatgaataagaagttagagttggtgacattgatagaacattgcatcagttataaaaggtaacatttcaagatatacactgggtctaaaactatgagaagaaaacccattttctggttctagcttctctaattattaagctatatttctttggaaaaaggtctttacctgtgaatcagttttctcatctctaaggtgatagtaactatctggttttgttttctagagttgtagaaatgagacaataaaacagctgtggaaaaaagatcatggtctatgtatggtgccttcttacattagctctgggggactggttttaagttgttcaccagaaacctttttgaaggacatgaaagaaaggaatgttagatattgatgtaaaacagaactaaaggtttgaaggagatggttttcagccctgtgatgactttaactgactagaaaactaatagaatgtctgtattgggcagatagttggcttggatctcatattgggcaatatgtaccgtttcctgtgttctaggcatggttctgaaggctagttatgtaataccctcagaacaactttattcattaggttgagaatcatctccattttactgttgaaaacctgagacacccatgggcagtggtggcacatgcctttaatctcagcatttgggaggtagaggtcaaggcaggcagagtttgaggtcaacctgctctacagagttccaggacagccagggctgtctcaggatgaaaaccttaggcatagaacttgtttgcccaagtagacatggctagtaaattataaagttaaaaagatcgaggcagtctgggagtccatgattttaactatttcattgctatccaacactagaagtctgttaggataatttttactcttgatatttcatccgataaataagaagccacatatattaatttctttttaagtttgctttggagtgagtaaatgatgtatttaccctttgttttaaagatgatctcaagctttttagatcagcaagctatcttatttgtggataccgctgaccgcttggcctccttagctagagatgccctggtccatgcacgcctgcctagttttgctattccatatgccattgatgtactgactactggctcttatccacggcttccaacctgcatcagggtaagtgttttgcccctttactcagaaaaggctttgggtttggatagcacagtatagaagaaactgttttgggttatttttcccttaaaaaaaaaataaaaaaggtaattcaatttttttcctctttaagtaaaagtgtgatagtttgaaataaattggggccaattgaaccagggaatctgttttttcctccttttttcttttttctccatttccttccctttccccatccttgttgggagtgagtagatgtacaaatataatttagtgtgtatttcagatgtgaacatgactccatagcagtggtattttggaagtgcttaaaaatgagttgttgctattgtattctgtacatttaggaaatagaggaagtcatctagtgacatttacttggtgtcataaatggagcaccatgcagaacatagccggctttagcaaggtggctgagaattatttacagtcaaatgtatagtcactagttttggatgcagagaacagaaatgagtgttgtggttgtcttgagtacagtaagaagtactcacgtgtacagttgggtgcaggtaaacatttacatcttttgtatattatttaaaaatatttttcatttttttgtaggacaaaattattcctccagacccaattaccaaaattgagaaacaagccacacttcatcagcttaatcagattcttagacataggcttgtaacgacagatcttcctccacagctagcaaatcttacagtgggtatgtacctgagattgtttttgtaagactacttttttaagtgaccttttgggttttgttcaaagaacaagtaaatgaagttttgattttgtggtggttgaacctatgttttgccatccataattgttctctctttggtacctaaaagtaatgtggtgatctttgcactgaggggaatgagtgggattacctgagactggaagagaaaagaggttccaaagttgagcctggaggacatgctttggtgtttattcataatgtaacaagaggtgcctttggtttcttaatgacctggacattggtactctctctgtttgaatcactgacttgtttcaacaccaggatgaaagtctgtttaaaatgtcttataagtgagactgaaacttggaggttagccagaagcttattgtttgaaagcagtacattttcctcttctaaaagcaaatggccgtgtgaagtttcgagttgaaggagaatttgaagcaaccttgacagtgatgggtgatgacccagaagtcccgtggcgtcttctcaagctagaaattctagttgaggataaggaaacaggaggtaagtcatcatagtaatggtttttggcattcttctatttgtgaagtatttctgtgggaaaatttgtgtagcaattctataatttgaagcaaaattttgataagcataactacctactgatggaagaattttcagtgtgtaagctatagttttctcaaaatcttaactcttttttttaatttaaatttatttttagtgtacactttctcagttaatgctatataatgctgacttttctaattaactcctttcttttcttctgccaatggaagatgggcgagctttggttcatagcatgcaaatcgattttatccatcagctggtccagtctaggctctttgctgatgagaaacctcttcaggacatgtacaactgcctacgtatccttctgatatttgagacctactgcttttgtgtctccctcttctacattttctgtttatcctttgtgtagtagtttggtctctccttcccacatcctaccttttttgggtataaatagacattgagagaacatgaatagacattgtgtgaacattaatggtatatctataagatttcaaattttaccactgctttgcagacaactcctaaaagtgattgcttcggcaaggtgtggtacataatcccagcacctgagaggagaggcagcaggatgttgacttcgaggccatcctgtgcaacatagctacttcaaagtcagtctgttgtacataatgagaagctgtctcaaaaaaggtaccattttgatctggaaatatgttatttgttcaatttgtattttccaaacaatgatcaattaaggggcaaacctagacattagttttggttatttaggccaaaattatcagccctttttctaaaattattccacacattctactactactacttgtgatgagtcatttgagaagataattcagaaaaccacaaattctgtcatatttaggatgagtcattagacaaagatgattctagaaaatttctccatagccagctttttcgagatagattccttgttagatgctgtttacctgtgcttagtagctgcgtgagtaacatactgtattttgcttaacaagataaatcagattgtttctgcttatcgcttcaactagaagtattacattcccagacactaatgttaatccgagagaggtggggagaccttgtacaggtggaaagataccatgctggaaagagcctctccctctcagtttggaagtaagtaaaattggttctggtaggtcattgtgataagtgaagcctgtctttttggtttctttcccttgtacaactgacttattacatatgaatagctatgtgcccatagtaatgtgctcactatcatgtagaccacctgagacatccattactttactgtgggctcatgctggattgttcaaaaagctatgagctttgggtgatgctggcgatcaatctagggccttatgcatgcaaggtcagccctctgccagtggagctagatccctagtccccaaaggttagagtgttgagtatcactttgtaaaacatacttgcttatttatcacagtttccccttttaaattgtatctttgaaaacttatttggagaaaattgctatgagcctatttatcgtctttatttcctgtttgaaattgactacgttctgattttctgtggataaatcagagacaaatatttattagacggtttctgtttacaggtttttttttcttttttgtgagtgcatgtatcttatttttaaattcagtatctatttctaaaatgcagtagaacaaatgctgaattggattatgaaatgtcttctcagtattaatgtattccctgcacaaacactgagggcctgctatgttcaaggttctgactcagcataatgcatgtttctatttgactgtaaacgatgaaaagctgtgtttatatgttattctccccctgccccctttcagtcaacaggttctagggagaaaaacaggcacagcatctgttcacaaagttacaattaaaatcgatgagaatgatgtctccaagcctttacagatttttcatgatcctcctttgccagcttctgattctaaattagtagaaagagccatgaaggtaaagggttctcagtgtattttaatattgatttgattaaataaatataatttagcacatataaaacatttagcaaaaattcttcaagatacgtaatttttaaaaccctgtgtgaaacttgttttatacttctgtatttgtttttggtcttttaaacatctaatagaatataacataacttttcatatctttcagtttcagttcataggagaatgctactggttgcatctgagcgtattctttgatgctgaactatgcccctagcctagtttaagttttatagtttaaatcagactattttgtttttaaggtctggcacctgagaactgtgattactgatatgtatataaactctagatttacatttatcaaagtgtagccttggctctcttggaacttgctatgtagaccaggatggcctcaactcatgtagatggagctgcctacctctgcctcccaagtataaaaggaaggatctcaaatgtcacccagctggcctcaatcttgttatgtatctgagaatgaccttggatttctgatcctcctgcatgtacctcctgaatgctgggattatagtcatgctccccccctgccccccagttttcaatgagctggggaatcaaatccatagctacctgcattctgagcactcaactaactgaacccccccccccgtctcctataccttgcaaaaaaaaagaaatttagtttgaacgcttccaatgtaattaaatacaattaaaataattaaaagctcagaatcattaagttatatttttactttatctaaatttgcttatactggataatttccaatactgaaaagaaacatcttaaggcatagttgtgtccattcacacacgtacaataaaaatatttgaattgtacattggattttattgttgctgtttatgcagattgaccacttatcaatagaaaagctcctgattgacagtgtacacgcaagagcccaccagaggctgcaggaactgaaggccattcttagaagcttcaacgccaatgaaagctgtaggtgttctcagttgatactctgctttttcttttatttaagactttctcctgatgtatggttttgttgaggatgctggacatttgttgcatttaacctgaaatctaccaaattagtcctaattttctctctctcttacttagcttgtcttaatttttaaactgtttgcatgttatctctcctaaaaaatttaaacttatggaaatagaaacattttaatatgacttgtaatttagtgtttcttttgacaaagtagtactgcaaatgcttttataatgtatttaaaaatatggctgagtaatgcagaattcatgtctttagttttgcattataacagtattgagtaagaaatgcacatgtaaagagtaattgtaagtcatgtaagacatgtaagtcttccaagttttaattacctatctagtctattatgaactttagaaagcaaactctagtatttcatgcgcttctctatttactattcttacctccccccatgctcccccccaccccatacagggtatcactatataacctagactggcttcaaatttgtggtctttgctacttcagtttctcattgcccaagataacaggcatggaccagtatatccaactccttcaattggttttgaccatagttaccttatgttcaaagttcatagtgtaataaaagtagaaactagtagtaggggaagtacagagcctagatcactccattacactcccagaaaattgacttcttagatatgtactagtaagtgtagattaaggtcattttgataaaagataaaaactctgcccatagcaaagataattttgaaaaatggacagtacatattcaagaatgctgtgttctcttgaatagttagatatactagttaataacaatgtacttgtagtatgtactttaaagtagctacaaatgaagtttttgactgttctcatcacataaatactaaggtgatggatatactaattactgacttgatcattgcacaatttataagttattgtaatatcacataatctataatatataattattttgtcagcaaaacattcaagggctggcgagatggctcagcagttaagagtgccgactgctcttccgaaggtcctgagttcaaatcccatcaaccacatggtggctcacaaccatctgtaatgaaatctgatgctctcttctggagtgtctgaagacagctacagtgtacttacatataataaataaataaatctttaaaaaatattcaatgaaaattaaagaatagatgtgaaaagtaggactgacaagtcaatattaatgcatgaatatattaaaaattttttttaaattagtatgcagaataataggtctctttctttacatcatattttttatgtgtatggatgttttgcttgcatgtatgtctgccctcagatgccagaagagagtatagaattccctagaactggagttacagactattgttaactgccattaggtactgggaattgaacaagggtctactggagaaataggcagtactctgaacagctgagttctctctccagctccctctttcccttccttcactagctttgtggaccagactggctgtgaacttgcagcaatcctgagtcagtgccttctctccttaagtgctacgacaacatatacgcacccttggaatctatatgatttcattgtgacatttcaaatgtgtatgttgtgctttgctgagagtcactcctactattactacctcttgtccccttttctcctctctgatggcttcccttctcccctcaaatagccccacttctgctttcatgtcttgtgtatattgttaaatatctcatttgaattcttcttaccaaagaaaacatacttgtctgagtctgccttattttggttaatatgatgttctccagtttcacccattttttttctaaaaatgccatagatttgttgttgttctttataactgaatgaatttccattgtatatatattccacataattaaaatacattcatctgatgatgggcatctaggttgatttttttcagtcttaactctagtgaatagtgctgtattaacatggtgtacatgtgtgtttgtggcaagccaacttaggctcctaactagtactgatgtagttgggtcatacaatactttgtagtgatctccccattagatgtattaatttacagtccgatcattgccagcatgttttgtttgctttgtagtagacattctaattatatgggatcgcagtgtatttgcatttattaagagccaaggatgttgaacatttcacatattcattggtccttgtttcttttgaaaactctccagttcatttgctcatttatcctttggatgatttttctgtatttaattttttgagttttttttttaatagattctagatactaatttccttttcatatatagctggcaacaatttttttcttgtctttttttaaaagtccagtccttactccctccaagtttgctctttcacagttcctcatccccttcccgcaacccccagtgtccaagaggatgtcctccccactccccaaccaggcctccccactccctggagcctcaagactcttgagggtcaggcctgttttatctcactgaggccagaccagacagttctctggtgtgtgtgtttcgggtgtcttggatcagcttgtgtatgctgcctggttggtggctcagtgtgtaagagattttattctatagtctaacctctttaggctggtaattgtttactgtgtatggaacccgtttaattccatacaatcctgtttgtcaattcttgctattatctcctaatccactggagtcctttctgtaataaaatatttttcctgtattttatttttgcagtttcaaagtttcaggtcttcaagttttaggttttaaaacattttgaattgaagtcttagagatctaatttcattctatacacaaatgttaaatttttccagcaccattttgatgaagtctccccatatgtgtttttggtttatttctggggtttatattttattccattggtttacaagtctgtgaccataccatgcttttgtttctacagaagtactacagtttagttgtatggtttgaaatcgggcattatgatgcctctaaccttaattgtgtgttggggggtgcaggctatgggagagtttggcccttgttctttaggaatgctgttttaccataggatttcattgttttggttttttatttttatttttcgtttagacagggtgctaggatcacaggcatgaatcactatgtctgcttcaacatggatcttgcagttcaggattgatttggttgtttgcctgtttgcttctgaatagattttaagattatttattataattctgtgaagaatggcattcagatttttagtggggtcacattaaaactacatagatttcagtaatataaccaccttccagaattagtcctattggtgatgtatgagcatgttattccgtcttctagtgtggaggttgaatggtggatagatacaggttcttgctctgcagcacagttgttgtaatgtgcaatgtagtctaagctggccttgatcttgtagcagtcctatacccaggttttgttttgttttgttttgtttttttgatttttcaagacaggttttctctgtgtattcctggctgtcctcgaactcgctctgtagaccaggctggtcttgaactcagagatctgcctgcctctgcctcccaagtgctgggatcaaaagcatgcgccaccatgcccagccacacccagggttttgtgtgtattaggtggcacacactaccaatttagctacagctcctctccagggcttttcttttgaagggatgttgagctttggaggcctgttgtttatctattgagaagatcatatgatttctgttgctagtctgcatgttgtattatattgaataatttgcatttgttgaactgtatttgcacttttgaaatgagaacaacttgactaacttgatcctgagcattctttctttttttcttttccaaagttaacaatctgttattattcaacttggacagggttagttcattcaactataaaaacagcacctcccttgagacccaggctggaggtacaattctcagaaaagatttagaacatgtctgtctgcctaaggactgtacaaaaatatgacattctccagtgttgcagatgaaaatatctctacaagcagcttcatgagttggatctgcagcactccagacaacaaaaaatatggatgctttagaaaatgtgaactctgctgtgcagtggtcgtatctatctatccagcacttgggaggcagagttccaggccagcctgctctacagagcaagtttcaaaacagccagggctacatagagaaaaaccctgtcttggaataaccaagcaaattaaaaaatctctcctcatttcaaaatgaaacaagatagtaccctttcttcctcttggctcaatttccatccatttcttggaagaaagacccaagaataggatgggaaacagttgttttcctccctgtccacaaagaatcataccaattgtgggaggaaacagatctctactttctgagctggatttctagaaactaggaaactccctttaagctataaacagggagggtctgagggctccttgaaaggtggttttttttttttttttaagataaaaacatttgaagctgtggtggtgcacgcctttaatcctagcactcgggaggcagaggcaggtggatttctgagttcgaggccagcctggtctacaaagtgagttccaggacagccagggctacacagaaaaaccctgtctcgcaacatttgagatagccttataacctataggtctaacttaaattaagtaaaaataagtagccattgacactatattgagctggccaaaaaggtataggatccttttaattgatgtcatgtgtcttggaagaagtagctatattttgggtcaggtcatctctgttggttagagctcacatcctgtattgcctggagggctcaagtatggaaactgaaagatgagggttgaacagagctctcatgctgtgtagcctgaattttggctgttttatagatggttctctgcgtagaacagagaacttttcagacacttcctaactgaggaaggcttcctaggagccgaaaaccactgcctgaaacaggctactcccgagaggtgatagataggcttcctgtcaaacctcagcagcaactcactggctttaggaggaggtctgtctatatctaaagaatcatctgtctaccgacttggagaggattgaaccgtatgtagaatgtggtgacatttctcattggtgccattggtaagcacccttccacctgccagcattagagctgcagggtagcagatagggttctgaaaaagaaaaaacccaaacccctaaagaggttgtgatttaaacagcacatagccgtttgaactgctcgaactgttcccaactccttgctttataggaattgacttgatgagcccagagaacaagggcaatatcaaaaaggaatacattctttgaaaggcccatgaaaacacatctccatggctaggatgaacaaaaccatctcttggttgacagctcttgacgaagttttccaaattcggctgaggtggaacttgtgcctggatggaaaagcagagcctgtgcacttgagtatgctcttggttaggtcatgactgatccctgttccagactgagcctcacatttcatacttcacacatttggggcttggtatgcgagtgcataaacaacaaatccccttacctttatacaataggttcttcaaacattgttgaggtatttttaattcttttttctttttcttcttctgtttttttttggtttttctgagacagggtttctctgtatagtcctggctgtcctggaactcactctgtagaccaggctggcttcaaactcagaaatccgcctgcctctgcctcccgagtgctgggattaaaggcgtgcaccacccccacccagcagttgaggtatttcttaaagctttcacaaaaaacccttgaacgtgttgcgggctgagtaaagactgagtaaagctgcagtattagtcttttccattcagaccagctagctctttgaggcttgaggatggatggtgaaggaggtgttctgggtccttttgacagaagtgattaacgcacctttatggccttcatcaatgatcaccacgttggttcctttgttgggaactcagggctgaaggcaggtcaatttctctttaggtttggactgaaatagagaatattatcactgaaggtcctggaatcacacatcttttgtgttgctaaatttgacttgcaatcattgaagtacctttatgtactcgggttcatcagaaaatttgttgtgtgttcatccttgtttgatcttggtatcagggtaatattgacttcatggaatgagtctggtaatactccctcccccttctattgttatggattagtttgacgagtgtgtgtttttttaaactccagtacaatttggcagtgattaatccatttgcttcttctgatcttttttagctaagaaattttattcttcagtctcattgatctttgtaggtctgtttaaacattttctattctcttggttttaattttgtaggcaatgtctaggaactttcttcttggtaggccattttttcttggtttttgaatacaggttttcaaagtatttcctaatttgcctctggatttcattgatattttttatattttctcttttctatgtctaatttttctgatttgcttcttttattaacagtatttgccttgaagaaccaagtgtttgtttcaatgagtctttgtttttctttgttttgtttggttttttcatttccatcttcctatttctgccctgagcttgattaggctgttggagaagcatttgttgtttttgtaattttgttctgttgaaatttgccatttagtactggactatgttccttttctttttttctattgaggcaggatttctgtgtatagccctggctgtcctggaactcactctgtagaccaggctggcctcgaactcagaaatccacctgcctctgcctcctcagtgctgaaattaaaggggtgtggcaccactgcctggcttggaatatatatttttaaattaaatttatttacttatttagtttacaaccccatatcagcccttcctctcctctcagtgtcctctcatgtaagttatccccacaatccccccctaatctccatcccccaccccagaatacacacacacacacacacacacacacacacacacacacacacacaatttagtttttattcatgtgcgtggggtgggaaggcatgaatgacaacatatttgtggaggtcagatgacaacttaaagaagtcactttcttctccccttggagtcctagggattgaactcaagtcctcaagcttcgtggtgagtgcctcactagccctgacataacatttcagtgtgcatttctttctttctttttttttggtttttcgagacagggtttctctgtatagccctggctgtcctgaaactcactttgtagaccaggctggcctcaaactcagaaatctgcctgcctctgcctcccgagtgctgggattaaaggtgtgcgccaccatgccggcttcagtgtgcatttcttatttcatgtttttggtaatattggaatctgttatttatatttgtcttataccatgagaatgctagataaaatagaaactctagtgcttttcttgtgttcagagttggttgtaaagcattggaactgacttgcaactttgacagtgcatttggaactgcaaataaatgcgtagtagagtagggatttaatgtttacaaagcctggaagtgcttttaaaaactcagtcatctttctccttcattccatgaattcttaatttggctttttgttatgctgatctatttattttctttgctgtctgatagaatttctttacccttgtcttccatccctggtattgttttctgcttggtttagtctattgttttatttacttatgtaggaatgtttcttgttcatgtttatcatgtgtgtgcctgatacttgaggtgtcagatgaaggcatttgatcctgtagaactggagttaaagactgttgtacgccacgtgtggggttagcaagagctcttaaccactggatcatctccagccttttgattttagtgtattggttggtgaaactttccattctggttttctgtctccccttgcccactctcaaagtctctttttttgctgaactttttatcagtcttgttaatttcatgtctgtatttcaggcctttgaaatctggatctataattgactttcttacttacttcatctgttttgttttctaaaaatatttttactggcagaaatcctttttccagtattggaactaccttaatatctggatttgttgattgaggaattagcttttgtatatgctatgctgatttgttttttcatggttcttgatgcacctgtctgtatgggatatctcttccagttttagtggaggattttttttttttaaactgagaaactttttcttgagggatcaacctccactatcgttcagagaggagaaaactgaggtgctataatcaaacctgatatgggaatacagttaaaatcaatgctaacttgtataattcctatgaccacagaacagaaaataactaaaagagagcagaatacattatcaccttaaattttttttaaagatttatttattatatgttaagtacagtgtagctgtcttcagacacaccagaagagggcgtcagatctcgttacggatggttgtgagccaccatgtggttgctgggatttgaactcccgacctttggaagagccgtcaggtacttttactctctgagccatctcaccagcccatcaccttaaattttattaaggataaaagtaaaagtagtaaatgaacaaaataaaggtcaaaagaaagcagaaccaaaactaagagaaaaagaaagatgaatgttaggaagacaaaaaaagaacaggaatattaaagtattacacattaaagaaaaatgcataaacaaaattagataaatgtaagaagaataaaaaaagtttttctgggagggaaaagctaccattatgtagccttttaaatctgtactatggctatatttttgtgattatttttctgtaatgagagcaactaaaattaaacaagtatttacctgttttgtttgtttgttttattaaaaagactaaagttcacacttaaaatgccagcactgaagaggctgaggctggtggatctggagttgaaggccagcctggactatatagtgagctcaaggtcatctgagctactcacgtaggcaaaccctgcttaacccccaaccccatatatgaagtaaaaataatactcaaatttataataacatgaaacaggtagtaaagatggaaaaaaactaaatggcaaagtgtcagtacttttttctgtatactctaatattagaatcttccaggtaggaagagtatgcaattgaagttggagtttctttttcctatcatttaggagggcgctgagcctggaccagtcaagtgtcagatgtccgacagagctgtcttcattttaggagcttgccttccttgcatattagaaacctcttctggccccttttagatttgcagcctgtggtctatgcaggttatcccatactccagagacttcctagttgaatgcattgggggagtcaagaaagcagagcactgacatctgtactggaagactatgtgtctcagtgctttgagtacagcattaaacacccttcgggagggaggaggctacagaagttgagagaatgctactggacctgagcttcagagttctcagtcccatcagcagagagccttacagctgacaggtggctccagaggttgggggttgcctgctgaccttgggctcatgggctgtaagactctgcatctatcctcagatgaatgcttatcatggattaccaccagacccttcaacgcccaagcttcctgctgcctcaactcaacatgtccacatctggctctcctcctgttcacaactgcccttcactgcagccttcacccaggagctgtggcatgttgcccccccccccccgccagatcccttgacttctgattgttccagaatagtttgtgttttatatagtaggccttttcaatcacagcccttcaagacatgagtgagagaacggatctcatctccactaccaactcatcacacagatggagtcattcccttaacaaatcctgagctaagaacgtaatcctctgctgtgggtagactctccagtcactctatcagggcttcctgcctcacttttttttttttttgggggggggatgaggcgtctgtgttgggtcttgtccccacccaggctctccccaccagggagtcctagcatttctcagaactagggaaaaggaaacgtagcaaaaagtgcaaatgtgagccttagggaagaaagacaggcagggaagaactggggtgcatgtgttggttaaattttatttctgcgtgtatgtgtgtgtgcgttaattgtcagtgttcactaactttaattataagaagcttatctctctcatctttcaaaataaaagtagtgattaaaaagtacaattgaaactaatgggaactagaaagggcagtaatcccccattcttttttcttagcaatattgttgaaatattcatgtacacttaatgggatttttagtatattttgaacagtccaattttagaatatttcagtcatcccccaaagaaccattatatctactagggggtcattctgtattctctctagcttctgacagctactcatccactatatatatttatatgtataagcatttcatataaatgaatcatgtaatgaatgttcttttgcatatttgtttttgaggtctatccatgttatagcatgtttttaataattgttatatatgccatatattatcagttcattgataaacattgtggttacttttaattttcaactattgtgaatatagctgtgaacatttgtctaagttttcatgtgggcttatacttacttgtatatatgcctatgaatatgatggctgggtgatctggccactctaatcttttttcatactgaaactatttcacaacctcaccaacagtgtttaagggttctgccttctccatattctcactgatactggttgttttttatgtttctagctgtcctagtaagtgtgagatttcattatagttttgacttgtatgttctatgttgagcatctttccatatatctgtctgttcagatcctttgtccgttttataattgcatttatcttttccttattattgcatatattttggatataagtccctttttataaattatgatgtgtaagaatttttcccatgcttgataacttttttatggtatttctactactgacttcctccctgcctccctcccttccaataggatgctatgtggtttaggtcggccttagccctgatatgtagttgaaaatggctcaaactcttgcttctcctacttccattttccaactggtaggactaaaggtgtatagtaccatgcctggtctttttttttttttttttttttttttttggagataggctctcatcatgccccctgttgatctattactctgtatacatcaggcaggctttgaacttgaggcagtccttctgccactactgtcctagttctgagattaaaagcatataccactatgctctgccttttttttttttactttaaatggcattcagtgtacactttttttatgcttctcatgttatacttaagaatccatgtcttataaacctgagatcctgaagacatacacttacattttctttaaatgttattatttagatctgaatcattatgagttaatttttgtgtatagtatcagataggtgtcaaagaagatatgcagttgtaccagtaacattccttcttaaggaaaactcttagcattctacaatctttttttatccacaccgagtcaggggttcgcaatgtaactctggctgtcctggaattcactttgtagaccacggtggcctggacagagatctgcctgccttgtcttcctgagtgttgagattaaaggcatgagccgctatacctggctaagcattttgtaatctttatttcttcttatttccaagtttacaaagtagtaaaattctaaaattttgttgttggagctgcagaaaatgaagatgtgtgatgttttcagtaaacaaagcttagtaagtaaaaacctgtcagaatgattgcccatgggatattattttcaaaaataatctctagggctgtggctgcagttcagttgatgaaatgcgtctctagcattcatcaaaacttgaggtcaaccccagcacccaccacataaaattcagtgtgtttgccgatgcctgtaatcttgacagtgggaggtagaggcttagacgtggacggagtgggttaggaattcaagattatcgtcaacctcattggttagcttatattaagccaaatgtagacctgcctggtttggaaatcggtgtgtagtaatttatgtagtgatttgaggatagcctcaagtacagagttctgtctacctctgcctccagtttaaacgtgtataccatcacacctgggtaaactctaaaacacatgttctggtagtggtagtttggtgtactgacttaagttctcagaatttcttttacatgcatattgtagcggtgtctctacctgaatagccggaaggtcttgagttcagctgcatgctctcaaacatattatatacatgctttgagctccattctctaactgtaattggaagtggttgttagcatatcttctttttagatctctagttccagtcgaaacgtgtgctacctcagttacttcaagcccttgttcctactgtcctaggtgtttgagaataatcttatagggacttttgaaattggtcccctcaagtcctgttttatcagcatttttctacaagggaaaaagggtctgtttatctagctttttagggtataaattgtttctttttggtttgagacagtttcactatgtagtcatgattaccatgaaactcagattatcttggctctgcctccaagttagtgctgggaataaaggtgtatgtgcctggcctatagaagaactgtagcccattctttgaatctgttagtgctgttgctctcagtccgttgcatttttccaagcttctagctggaatagcctaaagtgagtaattgagagattagaatatttcaagaaaggcctgggagaaggcacagctgcagggatttgaaatagcacagatagaagcatacagtttgctcagggtcaagttgcctcaagggcaaccaggtgcagagaagaccaaaatagtataaggcagggagatatgatatggctacttttcaataatgtctttgagtcttaggagtctccacccattaggtctgaattggcattatcaggtggaagcagtctatggcaaataactttttaattgtgcttaatttcatatttctcttcattttctcagaaaaccaactaacaaacaaacccaccaaaaatagatattgttggccataggatatattcaaatatatgtattgatgctattttctcttgaatgtatatcttttgattcatgtctgtatgagatcattcattcttgttaattagattgaaattataattgttatccctattggcagttgtacttttattattatagtttaaaaatgatttttgattagagactgcattgttttgtactctaacacaaattataactgtatagaaatgttttaaaattagtaactaattttttatttagatattttctttatatttatatttctttatatttctccatatatttttctttatatatattttctttatatccactatatacatttatatacatttcaaatgctatcctgaaagttccctataccctcccccgccctgctcccctacacacacactcccgcttcttggccctggcattccaagaatttcataaattcattgtttactaatttttaaatcaggtgatgtgattcagcaattgagtataggcttagcatgtttaaggctctgggttctgttcccaaagccacataaacatacacagccagcaaccctgtttcaaaactgaaaatacttttgattctgctgcatagtgtactgtgtttaagacactattgctttaatttcatttgttgtgctggtgttggattataaaatactgtatcaaaaatttttagtctccttcagttttttacctttaaaatttacattacattttgtttgcatagataataataatggtatcttcacccattttaaatattgtcaatttataagaggtgacagaccaattctgtgaatggcggacttgtaaaagtatcttttattcccctggctcagttgttgtcttagaggcttactgtctccatctgctaacctaggcctagtcctggaagcttctagcctccatacaatggaatccaggcctagaatgttttcagcctctgagacttactgctgaattagctcaccctttctagctctttctgagctctggctgcctggttcagatcagctgttctgactcaaaactcttctccaagctgacagactcaaactagcttctttttgctgcttattgagttgctctgcttagcctaaaactaactgtagccatcttttctaatcttctggcttctcctcctccggctctttttgtctttccctgtgtttcaattgttctgtgtggaacccgtgtctgtaacgtttcctggtaactgagaatcccacacactgactagaaagaactaaggtctgcatgagtgttgggattaaagatgtgtacatgcctggacctaagcttttctttccctgaaacttggctctataccacactggccttgaactcagacttcagtctgactctgtcccctgggattaaaggcatgtctacattccagccagatcacatagacctagaagtctttttatgtgtgatctcttaccagagcagtcatgttctgaattaaacttaaaatttctctacagtggctcatgcctctaatcccttcacttgggagactgaaacaggaggattgctgagatggaggcttgcaaggcttccattgtgagtggctacacagttagaacccatcttaaaacacatgtgagtgaaataatgtgcttttctcatcacgccataatcaggcctggccctgtgtcagtctgcaagacgagtagggtggtcacggatgacttttttcttacttgtttgtggccagaggactttgcttttgtaggctccaccagtctgagcccggtgtgctttttagtgctttgagttcctaggttgcctatttgagggataagacgacaagttgatagggtctggtggaaataccaccaaattcttagatttattatcagctttagaggtttgaccatagccattgtctacattcttatctcctctaggacttaaaaacaagaagaaaaattcccatgtaataatactgaagagttcttaagtgttttgttttttttaaaacatgagctcggactggtgagatggctcagtgggtaagagcacccaactgttcttctgaaggtctgaagttcaaatcccagcaaccacatggtggctcacaaccatccataatgaaatctgactccctcttctggagtgtctgaagatagctacagtgtacttatatataataaaaataaataaatcttttaaaaaaaaaacatgagctcttgatgtcagaaaaaaaaaccctgatttttttaaaaataaaagagtacattgaaaatcttattggagtatgaatttgtgttctaaaatatttttttcctgatatctttcagctaattaagaaaacttgaggtgggcactggggactcacacactcctttaatgcttgggaggcagaaacagatctctgtgagttcaaggtcagcttaggctacagagtaaaaccctgtctgaaaccaaaccaaaaaaggggtgccgggggcgggggcgggggcgggggcgggatttataaacattggcttaaacctgacttattgaatggaaagaaatcagttaactgctaggatcgggctttactagatagactaactctcttgtaatggaatttcagatttttcctgtctttttctatcctttctctctctctatatatatatatgccttttgtgtatcaactagtaaatgctatttttccttttcagctgctactaattagcattgtgatccagttccaaactttataaaattaagtcttctatattcagacttacctttgtttctactcattaaaaataattttgagcaaatgttcagatagaaaaataatttttaattctcaactgtttagcttccatagagactgcacttccagctcttattgtacccatcttggagccttgtggtaattcggagtgcctacacatttttgtagatttgcattctggaatgttccaattgatgctttatggacttggtaagttactaaatgtcgtcactcaagtaagtgtgtgtgtgtgtgtgtgtgtgtgtgtgtgtgtgtgttgcctgtgtatatgcatgtacaccacatgagtgtttagtgcccctaactctatgaggtcagaagaggatatcagatctcctggaattgaaattacagatggctgtgaattaccatgtcagtcctgggaatcgaacctggattctctgcaatagcaacatgtgcccttaactcctaggccatctctctggcccaaggaaaattttgtaagaaagcaaattgaaacttaactactataatgtgtaggaaggggtggtgtgtgcagcgtgaaagtaagtatgaaaggaataatgaactgtttgacatctcttccttggaatttttttgagtcctatctgaaatttttttgtatcagaagataatttttttttttttaaatatttatttatttattttatctaagtacactgtagctgtcctcagacactccagaagagggagtcagatctcgttatggatggttgtgagccaccatgtggttgctgggatttgaactcctgaccttcggaagagcagtcgggtgcttttacccactgagccatctcaccagcccgataatttttttattatgtaaaaataacagtgatgactgcttttagattatctgctcaggagttcagtttttattttatcactaataaattgacatataaatgactagtaggaattgctagtatcctttgtgactagagaaaatatttgtgacagtatatctacataatgacctggaatatgtatctatataatgacttagaatatggagccctagaggaattgaaagtttgctttctagtcaagtgtatggagtgaactacattcctagcccttatttcaaggtcagcctagtctacagaggacatccaaggctacacagagaaaccttgtctcaaatttttttttttttttttttttttttggtttctaacttgttcttttattgtgtgggtattctcaaatgatatatatttactaggaacaaaagtgttttcgatgactgctcaaacaatagtcctaactatggtgtatatactctatttagtcagttaatattaaacaaaagaaattgattaaaataagggatttttgattctattatgtagctataaaggtgagttaaattttattattatttatttaaaattgtttttgaaacaggcatgtagctttgggtggcctggaacttgctatgtaacccaggcaggccttgaattcaaagagacatccctacttatgcattctgagctgggattaaaggcatatacctaccacacgtggctaaaaaggtagaattttgaaacatattggcagctcatggaaaataggactttgaatcacatatttattataggtaaatgacatacatatgacagtggtttgttttttaacttgctccccccctccatttaacatggaaacatcacttatttgttgctcaagtatacgacatagttttacgtaacagcagacaatcccaaggaaacactgaaattacctcatctggttaatactaacatttccccttatcatctgctctctagggtagccatatcttcataggcttcagaaaactttcctttctccatctcttccctcatataccagtttgacaagggcaaatttggcacacatcaggtcagacatggtccaagtaagcccaggccttagcagtgaccggtatttgtcagtttacccatagctcaccgcatattggctaggcccacaagctaccttagtaggatgctattaagtatgctaatcttgaagctagtgaataaccaagccaaactggatagtacagttagctttgaggcagcaatgacaacactgacatttttgggaaccatgtcactgtggtatgacaagaattaagctgtgtatttatcatgccttggctgaccatattgttggctggattagcaagatgatggttgtttagggacaggaaaatcaatatggcatggggcaccatgaaatggctcataaggaaggcagtcatttgagtcagaggtggccagtaagcataactaaggttagttaatatatcaatcattcaatagaaaggatttgtgatggatatattgaggtcctgatttttcatcatgaaggcacagagtgtaaccagttggtatgggcagtaactggagagctaggtagagtcctctagcttagacttcttgctgtgatcaacccgggcattccatcaaggcagtgacagacacagtcagccagttccaccatcaaagctactgaaaatcctgaagtcctatttagttaacatattggggacaaattccttgctgttgatgagctgccagggggtaagagccaatattaggtggcaacacaaagttcataaggaagcctaggttattcaaacacaactttgggttcatgtctgccactccccatcctcctatcatgtacccactgaaaacggattaccatagtgatcctatctctcgtacttgaccatctattaaataccatattttattagtagaacaggcaattgcaattaatttggaaactagcctagccagtgtggatggatttgcacgcatatgtgcacacatgtttaacatacatgacgtttagatttctattccacaaggcaggagagaagtggcctactaggaacctccactgagatgctaccaaagtctgagggagtagaatggaagggcagctggctctgaggggttcagtatattgcacaacacccccagctgggggcagccctcaccagccagtgctgctccacccccatatgcctgtataccttttgtttttcaaaaccctttctttagctattttctcaatcattcatagtatacactcagataagcacataaaaatgaaaagggatggacagtaggtttttgtgcatagaagtcaagatgctataagaacatacagtagaaatgtattttgtcaccgttgtaggggctgcagaataagctaatgtcagtggagttgatttcagtgcgggcttcacttctgactcctaggcttttctgaccatgtccttacaaggggttgcacacattcctgtagggcagtgcttctcaacctccttaatgctgtgtctctttaatgcatttccacatgttgtggtgtccccactttaaaattattttcattgctacttcattttttaaaaaatattttatgaatgtgagtgcactgtagctatcttcagacacacccgaagagggtgtcagatcccattacggatggttgtgagccaccattgtggttgctgggaactgaactcagggcttctggaagagcagtcagtgcttttaaccactgagccatctctctggcccttattgctacttcataactgtaattttgttactgtgagaacttaatgtagatatgtgacatgtaggatatctgatatgcgatccctgtgaaggggtcattcaacccccaaagggattgccacccacaggttgagaaccactgctatggaggtgctcctctcttcgagaccccttctgcacttagctacctcaaaagtctgcctttgaactgcatcgcagtggagataaggactttaatatataagttttgggaggcagggactgcaatggcttccttttttttttttaagatattgatctagttagttgaaatcatttcgtgccttccttttttttttctacttaactaattattttctactgccattaaaattttggactggcgtttattagtaagccagtcatttttggacaatgacttgtttggacaatgtttatgcttgagatcatttgtatactgttcaaagcaacattttaataggcagtgatttttttttttagttaagattctaagtctagtaattttctgaattttaagttgaaaatggtatttaattcttataatacaggcaaagaagtatttctgcacgtgttccttgttcttgttagtgaaatgtgaaggaggaaaagcaagttgctgacagctcctggtggattgattttattctctcacatacaacatggtttaaagttgggttgcatagatgaaggttttgcttgtgtttaaacagtggtgaatgaattctttattctgtagacccagccactctggaggacatggaaaaatctttgaatgatgacatgaagcggatcatcccttggattcagcaacttaagtaagctcaagactcaaaagggaaacctatcctgacaatatttcttttcttctccataattagtcttaatcagtcactgcccttaaagtttgtgacatgaaacctgagcacctttggtaccttgaactctaaattgccttggaatgtgtccagccaggatggctgtcttcatctcagattcccctctagatacaatgttggtctgaagggcatgacactacattttcattggtcatattttctccagagcaagtacttctcacaaattcgtagtgaatttttatactgtgttctctaatagaatccaatttgtttttgttcagaagcagttactgtccgaactgttgttcccttttctctaacattgtcatttagtttgtatcaaaactaccttgttaacagaaccagagacagttatctgggctttcctttccatttgggctccactgaggtagcattatggcaactttaccaagctattcttacttacttctgtttctgagacagggtcccatacagctgaagcttacattactatgtagctgagacaagttttgaactcctgatcctccttcctctatctctcatgtcctggcattatggacacgtgccaccacgcccaactcaatctttgaaatatttcataagattattaacttgtactaagttgaccacatttgacagctgttccaacgatctagttgtacagcattgtttttagtccctcttctgttgcctatgtacagttaatcatcgttgctagccctgggtaatcacaaatctagttctctaaatttggtggcttggtttttcactttttatataaacagaagcacgagctgtgtgatctgacgtgcttcttccacttgtattttcaagggttatgttgtagcatctatcaatattttgtccttatgctttaatgctgaatggacagaccatgtgttctttattttataataaatgggtttacagtaagtggagttttagcacttcttcttggctgttgtgtgaacttccattttcattttctgtggctaaaacttagcagtggaattgttgagatagagagtaaaaattatgttagacttttgatatatattcttaaacttctttttaaagtagccatgccactttgccattcaatcagcatatgagggtttctgttttggcacagatactcgctattgtctttggtaggaggaggtatctcatggcagtcttagaatattttgcctctaatggctaacgatattgagcatctggtttatgggatatttttgtactatggaacaaaaacagattctatttaaagaaatgctgggcatggtggcacatgtctctaatcccagtacttggcagaggtagaaagattactgagttcagcctgctctccgtggtaacttttaggttagccagaggtatatagttggggtcctaatccccaaaataccaagccaaactaaacaaaaaccccaaatgagtcacatataacataaaccccagcttctttactatttgagtcatagacataatgttacatgtactccgataaagaaaatcagacaagcctaccctaggaaagtaattaccgaagctgcacaattttcagtgtttataggaagttagtgtaaagctcacctagaaatttatttccagaatcaaaacaaaaagtgaaggatgaaataacatgctggacatgtgttctagcctcttgtcctagctctcaagtggttgagataggggattgcgaatgggctacattgtaagactttgtcccagggacagaaagaaaggagaaaaagaaatagtattcccacatatactttaaaagactaccctatatattatttattttgtttggtttttcaggacagggtttctctgattaaccctgcctgtctttttgtagacttggctggccgtcgaactcacagatctgctgggctaaaggtgtgtgccatcacacttggcaatatttaggatttttaatgtaacagtgagccatattttgtcttgtacactatgtaggtagtctgaggtaattaaggaggctgtgtatgttaatgtttatcttgttttttttaataacattagtagacataatagtctcaaaaagatattttgattggaatgaattcattttcaactcttgccacaaacgaagcaaaggatacatttttaacgttcatctttatagtttttcaaattgattctttaacgttatgattagatggttgtgacagctgtttcctcacagagatcccactgcctctgcctcctgagtgctgggattaaaggcgcctgccactacaccccccctgaatcactttggttttcatgattaaacaaaaaaaatttctaggaatagggagggagggagggagggagggagggagggagagagagacagacagagagagagagagagagagagagagagagagatacagatctatgagtttgaggtaacctgatctacatagtgagttgcaggcccaacaggctacatggtcagagtatgtctcaaaaaaaaacaaaaaaaaaaaaacccagaggtccccacttcctatttcacactgggggagctgtccaactgcttttaagatgtactatattctgacacagtttcattgcacatgcctagcatactatttgtaccacatgtagtttttgcaaactgacctataccctattggataaatggagcaagcatgctctcaatagttgggccactttgtcactatattgctatggaagtgcttgtaccttagctcattgtgcatcagtgagtctgagccagtgcttagctcttttttcacatagatccttatattttatcctagccacaaggatgatcatacataaacccgggaggagtactatagcaaactcatcaaagtaaaatcccaggtctgacctcaatgggaggagggaaagggtagttaatgccagacgctttacacatactttttatagaaagtggtgctgacatcttaagtgaggaaagagaaataaagtgtttttttttaaaagattaataataaaattaataaataaatctttaaaaaaaagaaaaaagatttatttacttattatatgtaagtacactgtagctgtcctcagatactccagaagagggcgtcagatttccttatggatggttgtgagccaccatgtggttgcttggatttgaactggggaccttccgaagagcagtctgcgcttttaaccactgagccatctcgccagcctgaaataaagtgttttatgcttgcttgtttagttgtatgaatactttcgattattttttttatttttgagtttatactataggtccctccaaaatatgtatatacattcatattcctaaatagagccagttgttccacatatgtatgttttcagtgctgactgttgggcactgaacagttggtgtgcttttcccactttatagtttttggtttggttgttttgtttttagtttttctctgtgtggtcaatgttgtcctggaacttactctgtagactaggctgacttcaaactcacagggatccctctgcctctgcctctgcctcctgactgctgggattaaaggcacctgccactacccccctgaatcactttaggtttcttatttaaagctgttgagtttagtttgatctgtctttaagcatcaggaatcttccattccctatgctaaactaagctactaccttagtcttaaagttcatttttcctcacaaataagctagttgccaaatacaaaactggagcaatgactcagtgatttggttgtatgtcagcgtttctccggctgtcctggaatttactatgtataccaggctggtctcgaactcacagagatctgcttgcctctgcctcccaagtttaggaattaaaggcgtgagccactactgtctggctttttcagttattcgttagtgttctgtaatttatttgtatatcagtggcatatagttaaccagaaaagttacgactttatcatgtggattatcttttaaattaaggttttggctgggacaacagcgttgcaaacaatctataaaacatctgcctacaataaccactgaaacgttgcagcttgccaactattcaacacatcccattggaagcctttctaagaataagctgtttattaaacttactcgccttccacagtactacattgtaagtatgccaagcatgatggatcaaattcagtaattttggatgtatgcagaaagctttcttgtctagtttcccatgcaaacgaattttccttggtgtctgactttcatatagggatttcaacccaggggtacgattaaaggaagaaaagtcaaataagctgctgaggagtataaggtagccttcacctctcaccctagtgcctctgccgcagtgaggcctcgcttgttgaggaggctttgtttacattagacaaggaaggcttaggttctaattggaatgaagtgtctctttggttagatacaaaaaataatgtagagtgaaactaactataactattaagaagatttggagatatttggtatcaagacaaacttgctttgttttagttgaactagaatttggggaaatataggctgactaaagtagattcattttctcctttattgaaggtgtattctattttgtggatggcattcttttagtgtacaatgagattttttttcttttcatatttccattcttcctaggtttttcagatatttgacttttcacatgtttatttttcattttggtttttgtttgttttgtttttgagatctttgaattggttagaattatttttaagaatttactataaatatattttcacatttaaagtagtttctctggacagtaaatattttcgacaaaaatctatggtgcttgaatgttttaattcaagatttctggttgaaaggaataggaatgaatttttaagattttccgatgtaccttttaatcatactatcttaaagtgataccaggtaccagctgatctatttagttaataggttagtaagtcttatcgctgatatggattttatcaaaattcataaaacctgaatcagccagtgaacatatttagaactttgtgctcagtcataccaaaaataaaattgaagtaggtgcatactgtttaagtttctggttttatttggtgtcaatgaatagcttttagtgtcagtgtcctggtaataaaacaaaaattcattccactgtaagtcattctccttcccttagatttgtctctatattcataagcagaaaagtaactataaccatagtcattaagaataggataggagctgtgaggtggtgccatatgcctttaatcccagcacatgtggcacagaggcagtgtctctgggatatctgaggtcaaggccaaactcgtctacatagcaaatttcaggatagccagggctatactgacaaattctgtctagaaaaaaaaaaagacagaaaggaaaggatactatataattgattacctcagaatttattttctgtgttgtaattagatactgtgaaaatctgtgcttttcagtctcttgacatttcttttttgggcggtgctggagattgacttcatgctagaacacatgctgggcaagcaatttgccattgagctcttcttttttatgttttaagacaatgtttcattaacttgctgagttcgctttgaacagagctctgtagcaaggcgggccttgaactcatatatgtgttttagtgttgattgtttctttggtggatgtttgtgcaccatgtgtgtatagacagaagagaagatctaacccctgagactggagttatatatgcttgtgagctgccatgtgagcgcagtgaatttagcccagatcatctggaagagcaatcagtgctcttaacctctgagtcctttctccatccccagaccttaaacttgtaatgttcttgccttatcatctgcaatacctgcgattagaggcctgatccaccaggcctacaacaaactttttatttttgtacagtatacattttggtgactgaatactattgtaacctctatctgagtaatgatacagatttatcatgccactacgtgtcctcatgctctggcttttagctagatgtttacatttgtaaaatgtgttaactgtgacagaatacacaaatagacaaggtgtggcccctcaatggcactctcagcaggcacttacagtgcttgctcactcatgttgtgcccacagaaaccccagtttctagttcataagtcagggttcagctggatgtgttggcaacaggggtttttattcccagtctgtggaaggtagaggcaggaggaatcggctcacagtctgcttgggctacttgaaaatctgtctcagaaacaaaaatgagaatgcatttccccttgtttcccaatgagaggtgggtcaggcctctaatcccacttgtttttaccttggctacaataattgaggttttagggtatattcacaggtaagggaggtaaaaggcaatttaaaattaaagggcaataaaagattaaaatagataactttatagaagacctggtatattatataaatttcaaggataaccaatgacaatactttatctcatttcttgtgtttactgtctacaaactgcacttgatgtaagatggacaatgtacaatggttcttattctactgggtctcacctctttctgatttgtgtcattttaggttgtggaaatgcttgaggttcctaataagcctacgcagctatcatataactattactttatgtcggtgagtactgcagatcgtgaggacagccctgtcatggcactgctgctgcagcaattcaaggacaacatccaggacctgatgtcctatacaaagactgggaaacagaccagaactggtaccaagcacaaggtatgctcacataggagttagcagacaatgtttgtgcaacccccttcccattttatttatttatttatttatttaaatttatactattttggttttttgagacagggtttctccatttagctccacctatcctggagaactggctctgtagaccaggctgatactaagctcatagatcctcctgcctctgtctctcaagtgctgggtttataggagtatattaactgtgcctggtttcattatttttaagtgggaaagagttagatatagtttttaaggtacacagcagcaatgaagcagctatgcacattttctgtaaaaggtgtcttcctctttggagagtaggggttggtgatagaagtggaccccagggctttgtgcactgcaggcaagcactctccactggtccttggcagcccttgtttgtttcttttgcagacagatgcagagcttttcatgttccgtttctttgtagccctggctagcctcaaccatagcattcttctgtgttttgcttcctgagcaagaatttgaccaaaggcttttgtttgaattaagaacaatatatcattaaccacaaaggaacttgctaaacacaaactacttgctacttagttacttgtgcctgtgttatgagttgtttaatttgttactaccctgtgttgaaaggtcacatttgtttgggttagccccaagctttgttgtagtgcttccattaccttagtgaatcacaagcacacgtaattttttttcacacattttttaaaaattattttctagttgtctgatgacccatgtccgatagactccaagaaagccaaacgatcaggagaaatgtgtgccttcaataaagttctagctcactttgttgctatgtgtgacaccaacatgccatttgttggtcttcgattggaggtaagttgggaattttcatatgttaactcaaattgcatggcaccagcaggagtagtatctggcccacacaagactattctttttttctcccattccactatctcatagtcttctccttagattaatgggaattaaattgttcccagttaaagaaggtggacaacattgtttaggtcttatcagagatggctgcttaataaagcatggcattttgagttggtgaagtaatgtttgagcactacttacactggcatcctttctgagaagtaaatcagaaaaatattaaactaaatgttactttgatgttgtggaagaacatcagatgcagaattcatgtctttcaagagtatggcgttgtgccgggtggtggtggcgcacgcctttaatcccagcacttgggaggcagaagcaggcggatttctgagttcgaggccagcctggtctacaaagtgagttccaggacagccagagctacagagaaaccctgtctcgaaaacaaacaacagaatatggcgttgtagggttggagagatggctccctactagagcattggttgttctttcagagaacccaggttcagcacccacatgacagttcaacactgttgtaactcagctccaggggatctgacctcctcatatagacatgcatgcagacaaaataacaatgcatataaaataagtcattaaaaagattgtgttgttatatctaccatgatctctaaaatatgaatgtaaagtgaaataacaactggttttttggattttgctttttgaaaaaggggcttatgtagcctagctggccttgaatttgctatgtagctaaggataaacttaaattccttttgtttttgtttctcctttcctatcctaagattacaagtcatatgccatcatgcttgctgaaaccttcaacttttccttattattttttaaaagatttatatgagtacactgtagctgtcttcatacacaccaggagagggcatcagatcccattacagatggttgtgagccaccatgtggttgctgggatttgaactcaggacctctggaatctggaagagtagtcagtgctcttaactgctgagccatttctccggccccatttttcttcattattattagtactttttaagtgtattggtgttttgccttacatgtatttctgtgtgagggggcctgatccgcattgtttctctcttggatgttatttcaattacttatagaagtccctgagttactgtttgggtgatgggaagagtaggcacatgattttggggcatgcaatgcattcctgtctacctccctgtgcgttggggaaaatggaaagacacgtatggtttttgtaggtgcacatggttcttatactctactcagatgtttttgtctttctcctctgtgatccatacatgctatacacacacggatcttcatacaatactttcttgaattcattcaagctcttaaaaacttaactacaatctcctctttaaattgatggataatattaaaataccagctcattttcttcttataataatgaattctgagctgtgaataactacatgtaatcttactggcagtgtttttctctttattgattgcaagttgcaagtcattttttgagctgttctagactttagttccttttgagtgtaaacttgtattgtctatttggtcatcagctagctttctaaactttcttcttctgactctcaaagtcaggctagataaatatttaaataatttgtgggacagggtatgtaagaatccagtcatagaagccatgtcattgtttactgagggcaaggctttctttcctccatcagaggaccttctggcctgccttcctaagatggactctgccagatgagtttcagcctgtccctacttttgcctgacttcagtttcattttgacgaaacagtagaatcacaaatataatcagttctcgtttttagttccttcatttgaaaccacttgaactgattctggagtacttacagcttgtagcaaaaaatgggagcatactgtgaattttgaagatttccgtattgcggatattctctttgaagcgaaacgccgaagcacctgtgacttgtacttgctttactctagtttccaagggcatctgagaacaggaagactgctcatgctgatacactgtcactttgacaaagattgcccttagaaaagatgggatcaagatagataacaggcagagaaaagctgatttcttttgtgaatttagcagtttaatacccctgtgctttttctcttttcagttgtctaacctcgagataccacatcagggagtgcaagtggaaggtgatggcttcaaccatgcaattcgcttattaaagtaagcttgtgttctgtgtctaacttggcgctacttgttgcagtcacagtggagaacagtttctctcctatggaacagcgtaaagcagtgctcacagtctgtgtatgtcgtagatttttgtgtagaattacggaggtccaggggaggttcttttttgttcatttggtggcaatccagcaccatctggcattttagggcatcatttgttaaccagataatctagtcagtgtaaatgtttcaggtttgatttttgtaaagccctccaggatgccttgggtttgcatagcagggaaatataggctacttcaaagtcaaggtgggaattcccaggaaagtgccagttgtatatgcagactgaaagagtgatgagaattagccagacgaaagggagatggggttagagtagaggtcctaaccagaagaggtaactgctaatatgaagggttggaggtaagaaaatgctcagcatgatggatctgaatgttgagcaacagataaaggcaggtgatagagatgagcacaaaggtgtaagcaggaatgcctagagcccgtagagtcttttttttttttttttgtcattaagcaatgtagaccttatcctactggtactaggaaaccatctgaagctggacactctattctagcacattcctcacaatatcttcacaattattcaagaggctgatgacagaggatttagaccagttttaacattacagtgaagtgcccattttaagacacaaaaacaaccccaaaaagaagccaatatgattttaagtacaaactgacatcattagaaaagtttttctggaaattgaaccttatggcaatatgcagaataaaggagagtgagattgaagtagcaacaccagttgaagtggttcatggtaaaattgccgttagtttggactagggtatgttcctgtaaggacttaggagatgaaccagtcaagggttggtgattagatagatttcagaggtacaggggacggaggcagcaaggactcattaattttgtcctaggcaaaagatgggtgatggtttgaagtagaggacaccacagtgtgaaaggacttttctaagtttgaggggcctacagatccattgagcatacacaaatgttctcaagctcacggtaacgtttggacaggtgacaatgtcaccatcccagtggtagtaagtgagctgacatagcaaattagatgaataggaatgtgcaaacaaatgaagttgggtgctgggcctggtggtacacatctataactccagcacttaggattcggatgcaggaggatggccatgaatttgctttcagtctgagttagatagtgagatcacgtcttaacctcccaacccacacacatacaagagacgggaaatcaagctggtcataaggtttagttttaaatggacagaagaaaaaagaaccaaatgatgctggaaagtacaggtagtgggtggaaagctgaacatgagaaatatgagataaggatatgtcctaatgaactttagtagcacattaaaaattaagaacacttggaaagggggagctgttactctaattcacttggtagaatatcttcttgatatacatgaggccatgtatcaagcttcagcagctcataaaccaggtttgtcgcatgcctataatctcagtactcagaaggtggatggagaatggaggagcaattcaaggtttgaattgctttgcataaaatagattacaaaatcaacaagttccatttgactaccacagataaggagatgataataacatctgtgttttattcgttttagttttcacaatcttttgaagcatcttgtcaacatttttcagagagctttcacatttgtctctgatggaaccagggcttgagacatgtcagatgagctgcattccagtaccctttctacttgaactcaagcaaactctgaagtgtccttcctaggaaagatgcattcttctttcctctccctctccctctccctctccctctccctctccctctccctctccctctccctctccctctccctctccctctccctctcctcattaggtattttcctcatttacatttccaatgctatccaaaaagtcagcatttttgttttcttttttaacttcatttcataaaatttaagggaggtctttaattctccctttcccctctatatttacaatgtaaagggaaaaattcaaaagttgatagatttaaagacagttttccagtggctgttgttatcatgctagggtatttaaagggaagaatgataaatgaggatctttatgattgtttttttttcattaaaaccttatactgattattataaatataatcttttactaactgttctaacacatttgattttgagaaactcttctttcaagcatgaattaattttcaaaaagaatgagtcaaccttttcaagctcttaagtttgggcacatttttgctttttgctgaaaatatgctctgttcttattccagcttttttaactctttgaaaacctgaaataaaagtatcagttctatcacagtaactttcttcatctgctctgcttcactgacctgttaccttttgctgaatttaaagacccttgttccttcagatgagatacagaacacgtgctaagaatgtatgctcatgttgcttaggttttgagccttgggtaaacttcaattttcacccgaactcacactgtctcaggcgtgaatcattgtttttcatacccccatgtgtttcgttgcttcttatagccaaggcctggcagataggcacaactcactctttctttcttcctttcttccttcctttctttctttctttctttctttctttctttctttctttctttctttggcaagtcttgggacttgagttcctactgcatgtgcatgtatgacctttagaaaaacctttccccttttgttttctgtcatacttgaatcctgactttactcttagctccctgagtaacctttccgcttgttactctataatatatactttttgatgtttgtttgctcagacatacatgttaccctagagaagttttgtctaatttctcaggttattcaatgctagagaaacatcacgaaggagtagctatttaaattaaacttttaaaagatttttgggaagttttcaaataaggttaaccctctttattcatgaaatagtgtcctcagttcttattcttttttgtattaagatattttttgtatatggttatttcatctgtatgaatatctgtgcaccatgtgagcgtgcatgcactaaaaatgacaaggatgcactttgacagatctactgtagttgaggtcttaaatgaaatggagtcttagacttcccttagttctcactttggaaatgtgtaggttctgtgctttcattttctctccagatggatgtgatgtaaacctaaggtgaacagaatatgtgtctccacttatactccagactcaaggtgaaatgtccgtctaaattagctgctttagagctccccaagaatgcctgttgtgaggactaagggtgggcaagttgaagatcatttatccaatattggtgtggttctttgaaaatggttagcccatagagagtagcagtgttggggtcccttctaattaagatgtagaactctcagctcttccagtgccatgcctgtctggatgctgccatgctttctgccatgatggtaatggactggacctcagaatcagtccagccccaattattaaatgttgtcctttataagagttgccttggtcatggtgtctcttcccagcagtggaacactgacaaagagtcatgtcagttaacttttaaagttgaatggattaagtggaagtcagcttttagagttttctttaaacatcaagctctagttccattactttatgccaggtaaacactatataactaatgtttcaaaataattaaaaaaggggtatgaagcagttacattcaattaattttttggagagtccatagaaaactgattactacagatacagattgagctagctataacacggtacactcaatttcagtctcaatttggactgtgtgttcattatcagtattaatgccaaaacagatcacaatttgttaaaagaatcatattgttgtccgtcttcactggtgtttatgtccatttgtctctgtatgtttgtgtgtctgtctgtgtgtatgtttgcgggtatattaaattctaaatatacatctacatgcaaggaaaggtttttttttctaggaggaatttacaggaagtagtttgggctatgccagatgacacaaatctctccacaacaaggtgcttgtctctcttaatccctagggtccccatcatggaaggagagaactgacttgtgcaagttgtcctctgacacatataccatggcatatgtatgctttgacttacagaataaatacatttttaaaaagaaactattttaaagtgtctaattttatgatagtaatctgttctcacagcagtcccagttattggtttaaaccaattaccacttttctgatttggcaccaacattatccctccattgtaagcagtcgggcatgagaaaccagtggtagggttaactattttcaggtttaaatactacatgttgaaataccccatccaatatgattgtctggctctgactgacagattatatttggctttcatgtggcttctaaacaatccctgacttttgacatggataaagagaggccactgtggaacagagtatttgcccatctaccaaagctgcgagtgaaagacaaatctagaaaatatttccaaactttgtcatcttattatgtttttggactttgatcataaaagccacacatatcttggtcatttgcctatttcacaagttcctttcaatattgccatacattctgagaactttgcccattttttctttgtgacagtgttttatgtagcatatcctagtcttgaacaaagtagcaaggcgattttctagtctcttggtccctagtgtaggacttgaattgcttttctactgctggccttataagcacgatatcaagctcaacttttataatgcattttggatggaactatttcttttcaatgtattttccctaccactattctacatcagcaggatctatgtgaatcagagttgctcaggctgggtttgaatttgagatcactttgccttcatcttaagtagctgagatcacatacacacttgggccaccatacaagaggagtcatgttctcttgtctacaacagtgcctatcaatagctagatatcttgtacatttttatttttttccaccaaattctagagtttcataagatgtggagttggccctatatatctctacagatgctagaaagataatgcataataaatattatgttgttataaattattttgttataaacttgtgacctttttacaaaccctgtactaggtagtgcttcaacatttaccatctttctgctatgtggcccatacatttttcttggtattgaagcagttttttcatgacagtgtttattactggttttatttttttactggttcctggaggcttcattcctcctacctggcctgtgaccttctggttcctccctactttctcacctgccctcctcacttgaggttgcctatctctgttcctgccctcagctaactaccagtaggaggtcaaggagcctggtgcctggcccaagcccttccattcctgccagtccacttttgaagctgccccagaggccccagtgggtacctgaacagtgttgctcaagctctgcctctggaagccagcaaagatgcccaccaggagccacatgcttacgtctgctgtgtactctttggctcatggcacctgccagccccatgggccttacccctgccctcttctttctgatatttttctttttggctaactttatctggtgatgttttggttcctgccaataatttcaaaactcaattggattaggcatgaagattgctgcaaattctaggcccgcctggactaaaaataaaccaacaaagcaaaaatctgcatgttgaagagaaaatgtgtttaaagcttcaatggagaacattgtgatgcaacattttaatgcaatatatttcacttttgctctatccatatatttaattttttgccacatgcaaaaaataaaaaaaaaaataatgtctcttactgtttttcagttccaggtcagcggttttcaacatggaggtggggtggttttaccctttaaggaacatgaagggcaatgtctaaatatacttttatcattacctaagcaatcagggtccgaagtgctattggcatctagtagattgaggccatggaggcccatcacagctccccacaataaagacttgtccagtcaaaatagcaatattgcccagaccgaggagtccattctgggtattctgaataagaaaattgaaacaagtttctgtatttccagatattgccttgataggaataattataaaatctaagatccaatctgtgagttgagagatactatataattaatgtagcagctgttatttcatctactactgaaataccagctaaaatatattgttcataacattgtatggtatggtaaatagtctctaaagctgtagaaggaaaatagaaacactgtctttgggtttgggggttggggggttaaaatgagagtcctaatataggttgatgtcatctgatgtgggctaaatattaccaattgctgggaactgttgcattgtagaagggatctagaagccatgttggacctaaagctctgttgtcatgtcataccctgtgtgtcatttttactttgtgctttgtctttgtgcataacatacatctcatgtgtcatctttcatcacaggattcctccctgtaaaggaataagtgaggaaacacagaaggctctggaccgctctcttcttgattgcactttccgattacaaggtagaaataaccgcacttgggtggctgaattagtgtttgcaaattgtccgcttaatggcacttccaccagggagcaaggtaagatctttcacactgtgtttttgcttatgtccatatttttaaaagtattggttactattagttttttcctttgaatcctttaggaccatcccgacatgtttacctgacgtatgaaaatttgttgtctgaacctgttggtggcagaaaagtagttgaaatgtttcttaatgactggagtagcattgcccgtttatacgagtgtgtgttggaatttgcacgttctctaccaggtacatgtaatagtcttccttttaaatgaaaatacctccttcatgtaacagaaaaagtaaaacctgtacagtgttttaaaaaaatacagccaaaagtatctaaggaaaattgtcttctttaccgcagtgtatagtctctctttctccggcggaaaaactgttaaatttcttttatttctagaaatttgggcacatagacagacttgtgagtaatatacttttgtgttataatatagtcctcatctactgtgagcatgcaagctaataaacattgtgctgtgtcagcatgataccactctaagaggacctgagagaatggagccaataaatgaggcagactttataaataataaataataaatagccaattttattcagagcatcatattatgtataccacaagggttagatagtatcatataagtaaagtatacaattacaatggaagtcacatgtggcaaaacatgttttccacagaggcacagaaacaacaatagttggaacgaataatctgaagtcaactcagatgggcacaaaagcacattccaagaatgatgctgtttttgaagacactgaggtcataacactcagaattctcatacggctccattctttgattgtgtcccaacactagcacatttaattgcacagctacttaggaaatagctatcccctattttacagatgacaaaaacatttcacagagacttaaaaacttcactttgtgtaagagcttttcttggcatgaactgagagcagagaaggccaggacagagaaagtgccttgctgtattagccactgtgctagaccttttccatggctcaccttctctgtgctggctttacatgcttttgattctgccactgccttggcaaacaatcaaacgggcatggtgatgtgggcctgcaatcatgacacttggtagggaaaagcagcaagatcgaggcgtatatccatcacccttagtacacagagactctgagggacaatgtggggttcaaggagaccgtatcacaaccaaactaggcatatgatttgccaaaatgctctacttttcatacctgcttcttaaacatgtccgtgtccgatcaatatgcattttgtttgtttctgcttagaaatacctgctcatctgaatattttctcagaagttcgtgtttataattatcgaaagcttatcttatgttatggaaccaccaaaggaagctcagtaagtatatgaattaaaacatggttgttctgtggcctggagaaataaatggcttagtgcttatgtgcactgtcagtatttcagaaaacctggattcagttcccagccagcccccatatagcagctcacagcagtttgtgttccaagatctgactccctcatccatgcaggcaaaatatcaatgcacatgaaataaaataaaaataaatattgaaaaatggaggttcctttcttatttatcttttaaaaattaagaacttaaatgatagttgccagacactgcagcttggaaaagaaacaaaggaaagaaaactgccttaaataaaggctcgaggaacatcaattttaaatgctctgctgaaataaaagtgtgatatatgcttaattctttaaaactgaaaaataaattatagtgtctttagagcatatgatcttgattttaaaacaagcactcttgacattttttccttcacagacttcaattgggattcatgtttaactttatatgaatggctttgagaaatacagtttgtctttggtttgagttatacgaaaatattcagtctttattcgtatcttaatcctaagtatattccctgtaatctatacttcttttccttaaaaatgagttgggaactaaagagaggactcagtgattgagaggctgtactggtctcatagaggatccagcaaccatctgtaactccagtcccagggtttctcggacaccagccatggacatggtacacatagagacttgtacaacacttgtattcgtttctctctagacacttctataactagtaatgtctgaaattattagtaattgaatgaacatgtgtttgaggattttccctttttattataacagtgcttgctaccttagttgatggcattgagaatatgactctgcattgaaataaatctttaaatctcaagagttgcattttctatttaaaagatttatatttctagtttatataataaaagggagatgatatgtatgctcataggctctgttgatctatataaatatcatatttggagattgggagcaaatcttagcacattactcatttttacaagaagccctcctttgatgcttgctgacttatctttatcatggtttgcacctggaatctgttactttgcagtttgtttcacatgtgctctctttgctctagattagtattcagtggaactccattcatcagaaatttcacattgcgttgggaacagttggcccaaactcaggttgcagtaactgtcacaataccattctccatcaacttcaagaaatgttcaacaaaacaccaaatgtggttcagttattacaggtaattaagttctctgtcttaagatgtactagtagtatgctatgcaaaacacctaaaattatctgcatttctcttttaatgacgaagatggatgtttttgtcttacatggtttaaactctgcctggagaacttaattaaaatgatctagtgcacttcaaaagaaacttttctagaatgtcccagaatgttcatttgtgacaatgagacagaaaattgtaagttttctgcagttacatgacaactgggtgatatctctgtttcttccaggttttgtttgatactcaggcaccattaaatgctatcaacaaactccctactgttccaatgttgggcttgacccagagaactaacaccgcctaccagtgtttctccattttaccacaatcatccacccacatcagactggccttcaggaacatgtactgcattgacatatactgccgtagtcgaggcgtcgtggcaatacgggacggtgcctatagtctttttgataacagcaagttagttgaaggcttctatcctgcaccaggattaaaggtacacacttcctcgttagggaataatagaataaatatattctcgaaaaccattcctttgagggagaaatgtcccattcgaatttagtaagcaatacagttgctatatcttctctgcaacctcattttggaggagctagggtttgcagtaagttctgtgtctttgtacatgaaatgttgggaagccccttgtttcctcattctctggttaataagtttgggaatatgaaagagcataatatttgcttattgggactttaaaggaagactttattgcttgagatcctcatgaaagatgtttggagagtcaaatagttctaaaggctgcttctgaaaacttgctcccttaccctactcctggtgtgttcctgctcctcagagaaaactgttgtcacttgtcagcacttgtcaggtagctgctactctttgtgtttatatagctgtatctctgagtaccaaggtacgctgtcacttgttgagtaattctcaccctcaaaagggagtgcttacaactttgaaaacttggtttcacttactctttcttccttcaggctgctcctagtatataagtaaatacattggcctttctcctggttttacaataaggttatgtagcaattgtgatttcgtaggggtttgtttgtttgtttgtctgtttgtttagtattcttgttgttctgaagatacttgtccttttgggcctccacatggaactgcactcatgcaaaaatgtgttctcacaggtctacatgcaaacaaacaaaaaaccctagtcaaaactcggttgggattagtgtggctcctgggaacacatgagagcaggagcttgaggtgtgttgctctgttgtgctcacagtcaggaagcagagcaggttgcttcctcctttatttagttcagtctcccaggctccgtaaaatctgttactcacattcaggatgtgtgatcttaattctctggaaccaccctcagaagcccattcagaagtttgtcttctgtgtgactctacattcctcatgctaacagtcaggttaaccattacacatcccatttctttctcttacattgctgatttttgtagtatgcctgctatagtagctgcctggaagaaggtacataggagattggttgaagtccatggaggttattggagaccttgtatgtttgacagtgtttttagtttaccttcatttaactgagagtgcctaggtatagaattctagactacgatcattttttgtagaatgtttgaagctctgctgctttgttttctacattggattgtgactggcctgaaccaagtgcctgtaagccttaataatctccttgggaggttgttttgtcttttttcctcacagtactaggtttcaaatgtaccttgatactccttacatcagtgctggggttcaagcaccttatcccctgagccatctgcccagcccagaagcatgttctcatatggatagatcactttctcttccctttcatctttcaatcttaactccatttcttttgtagaactttgatctctttcatgttggtgcctttcttcgattattaagtaattctttactctctgctcttatttataggtaaggtttggagactctggtgttcatcccaggacaatctgcatggccatactgccaaaatcagtagctttaggtctcttgttgggccactgcgaatttgtagaaatgttgtatatctgtttccccatttgcaaaaggtcaaaggagaggatgaaaaaagtcttaccagctttaaatatatggcctttaatacccattttaagggtggtaacctttttctggattgctgctggatccagtcttcctgcccacacagagctgctcctttagaagctggtgatgcgtagagctctgggagagtagtggtgaattttttattctttgtatagtttttgttttgtttaatatggatggatgtttggtgttaaagagaagttatttaatcccatcttggggtttctacccatctttgaccatttagttccaggataaaagagacacacaacctttttgtttaaaataagccttaaacagtataagagttggacagatacctacctgctgtgctattagaatctactttgctattgataaccccaaattattatttactacttactgtatttcatttgggctgcttttatctctaattgacagccctcagatccatgtttttatagttcacctaactcatggtgacttctccttcctcctcctgcaccctttccttttcctatgatcccaagcccgtgaaatgtaaaccgtaactatgtcttttctgcccagcaattggctgttggcatctttatttaccaatcagaaataacttggaggacagggccacttgagtccacatgcacactccaggtcttgggagcccacacttagcattatagtaaacagcaagaccaaacctcaacaattctcctttttagttcaatattaggctcattttctctcagatatagattggatacaattatatagcaattaggaaaattactaggtatgatacacatttataataggtattttatcatctatcctaacttaatgagtttgcagttctgtacctcagtcatctttgattttaacttgtattaccatctgaaaccaatcgtttacacctagaacatcttaaatcctaaccaattctgagactggaactatctagttttcagccccatcagaggtttaagaaggaataaatatttgaatattcaggaacacagcttccaaaatttaaacaattgacagctgacaatttggacagtctctaacatttcttataacattggagcatctttctgcagccttctggcccagaacaactgactgaagagaagtatgaaggacttatgaaggactagctttagcttaccttgtcttggcagagcttagtagttgactatcccgcgtctgtttatctttttttggatagcattctgtctgcagatgaagtcagggcatttcttgcctagtggctagctcgccacaaatgaagcaacttcacatggaggtaatgatgcttaacattttctttgaagtggaatggggtatgctgtcaggaacagacacatgttttgtagtcaaatatcttttaataataaaataaccttgaatgtcatactctgtggttctctgatgcctttgaagaccatctacctatatacagcataactaaattgttaaacattattttttatctatttactatttgagtgaccttgagaacattttattgtaattatctaaattagactttaataaagtttgactatctgactatttatttgtattacttaatttttctaaacagtttataataggagctattaaaaggactgagtctaagccttgtattcttaaatgagttgcacatgcacaatgcctatctaagaggaacaatagtaattttaaattctgtgtctataaaatattctgtatcagtgtaacaaattataacttcaattttgcatcaaaatataaagatctctaccattgttagattatggctataaaattcttttatttagccgggcgaggtggcgcatgcctttaatcccagcacttgggaggcagaggcaggcgcatttctgagttcgaggccagcctggtctacagagtgagttccaggacagccaaggctacacagagaaaccctgtcttgaaaaaaccaaaaaccaaaataacttttatttaagagtaaatttaataattcatccttatttgtctaatttcttatgatatttctatatctatttcttttcaaccccttccctttacctgagaaagaaagggtagagaagaaggaaagatagaaatccctcagtgtaagccccctattttatttcttctgtttccgagaccataattatgtgtaaattatcccttaaagtgacagtatatttataattcataaaaaacaaagccatctactccaacttaagggactgggacaacagtattctaattattttctgctgaattgggttgaagaatttctaacctacaaggaaactgaaaaaattgttaagtcaaaataacgctagttagcatttgttgtccagtcttcctgtgttgagaacgtgcagggcttaactgaagtcctgtctggaacagtctgaaagactggatgaaccaaggtcattgggattaagcagtcttttctgaagctgttctagatgcaagtctctggaaacagcattagttgaagtaggattaggcagggagctgaaacaacagataatctcagcacccctgaggttcaatgttgtcagagatgtactcttgttatttcattctttaatatatgaaccttataaccaatattttgttctataaagatatttgtatggaatgtgcacggttcacagatcgtttaaggattaatttttactccttgttaagttagtttgatcagtaaccaattataataagtcctcattcatgtcatgaaagaatggcatgatgaattttgaggattctgtagccaacaagatttacaagctatgtatatctgaagttctggctacagacatttttatgtctcagccagtttcagggctgttcccatgtagaggggatcaacaaatcatgttacctgtcctgtttggtttacttgatttttttttcccctcctgtctgcaactaaactcatcaaatcttatcctattactaaggaaggtgtcctattaacagagatagagcctctctctcaaaatagcaacccaaagtcatcaaaatatagagtaattcaattagcagacttaacaatttggtctacatatatgtctgtgtaccatttatgtgtctgcatcctgggaactagagtcatagatgtttgtgagctgtcatgttggtgcttggaaatgaacttgtgtccctcaggaagagcacccaaacctcttaactgccaaggtaactggccctgctactctcaaagtgtcttgagaatctggatggaagtacctttgcttcttggctttcctggtggcttccttaggatatgagtgttctaattgggtagttcagccatctgctttagcagcttctaggagcttccagcaacttccatggtacatcgctgtttttttttttcttcttctctaatttaaaagactatgttcttttaataatcctctaatgattttgatgaaataatgacatgcctatttgaagatgggaaagcggtattaagtggagaatcagactgcaaaggtgactcgatggataagagcacttgctatgaaggaaagaaaatctgaggtcaaattccttgcacccatatataaactaacaagccaagcatggctgtgtgtgactatgccttcattgttgaatgaagacaggtggtttattgcaatttactggccagcaagcttaagtggagagcttcaagttctttcagacacgccccccccccaaaaaaaaaagaaggaggaggaggagaatacaagacccagtcacgcagtcagtcctctactgacctgtatctgcacatagaatccttgcacatcctgagagagccatacacagaaagacatcgcttgagacataaactctagtagtcttgcttacgtttttgataacataccttatttgaaaaggctttctcactccagatggttcaggattaaaatgaagcagtctaaaacaccaaaagttagctttgtgtgtacaagcgtgtgggtgggtggtgatggggtacatgtttgtattgtaggaatgaatccctgtgtgtgtgtgtgtgtgtgtgtgtgtgtgtgtgtgcatgcgtgcgtgcgcgcacacgcgcgcacatgcgcaagtctaagccagacgttgatatcagttattttcattctttagtttactttttgagatgaggtcgtttactgatcttggagttcacagatttacaagagtagttaaccagcatacaccccttctctctgcccctccccagtgctgggattacatctgtgcagtgccacagctagctttttaacagaaatcctcttcttgtgtagaaacactttaccagctgaaccatcttctttgtgtagcgctctctcttttttttttttttaaataaggtcttgttttttttggtccaggctaggctctaatccaacagttctcttattcctgcctcctacatgccgtggttattggcatgtgtcaccatgctaaggtaatgcacttaattcctattcatctttttaaatcatattttctagattaaagtgtgagaccttgtgcctgtcattgtggccatatgcctataattgtagcacatcaaggtagatatctgtagtcaatgccagtctggtcttaatatatagtgagtcacaggtcagccacgattacatagtgaaatcctccctcaatatccccctagccccccccaaaaaagaacaaaggaaaaagaagccctttgctaatgagaaattttatgctgatgctcatgtatatatggcctgcatttctgggtgagagaatgccacgtgcttagagctctcagggtatttagtttactggactctttttactgtttacaggttacctcaatttgctctcttgctccagaactcaaatatctcattagactgtctgcatagcatggttgtgttacaatattctcaatgatcatacatattttacttaggttgtaagatgtctcagcaggtaaaggcatttgtcatcatgcctgacaacccaagtcttggccacagaacccacttgatggaataagagaattgattcctgcaagatgttttttagcctccccagatacgccattgaagatgcatacacatgcacacacacaagtacacacatacctaaacaaatggttacatggggaaaaaatattttgctgaagtaattaaattttgtgtttatacctgtagactttcctgaacatgtttgttgatagcaatcaagatgctcggagaagatctgtaaatgaggatgataaccctccttctcctataggaggtgacatgatggactctttaatatcacagctccagccacctcagcaacaggtaaatgtctgcctgcaagtctactgtcccatctgtggaacagcttctataggtgtcagcatttctttgttaaaagatagaatgtctttggaagacctaagaagcccaggaaacccctattaaaaaattgtaacagagacaacaaggagacctccattggtaggaaatgagcacttgaggtcaaggctttttctattactactcatttctaattgggaaaaaaaagtctcttgctggatgctgggcaaccttttgtgcagcagcctcactgtgtctttgaaaggcagctgttacacatttgctgttgttcattaaggtctctgccaagccagccagttctaatttcaagggttcttctatccacagcttcaccaagtcatgcgatcacagctccaaagctttgagcactcttgctgactccttcccttgcctagttgaacagcccgcaagccagcctcaatttgttctcactttgtctctcttgaaatagaaagtagtcactcattgatcttggactcctaaaccagtgccttatgattcactagcatggaaaagactctgtgtgtcagggtacaaagaaccttttggctggagcctttagcagttgattttagttgtatgtgaatgcacaacctgttgccaaggttctgaggcgcatccttcagaggcaattttctgaagtaactcaccgctcctccttcgtaatcttttgtgaaatagcacagtccttgggcttcctcgcttctggcctggctacttatgcttagtaagtccaatatgctggtgcttgtgtctttcatcgagtactagactcttaacagcaggagtttgtatattacacctggcaggtatttagcttttttccttccctgtatttggttttcttgctgacataaaaatacagggcagcccagtaagacccaatatgaatacctctgtacccagagtggggctgtgacagatgttgacttagatgagaagattgtagaccatcacaatggaggaggaccttgcccagcaatgccagaggagtgctgttgctgctgctgctgttcttcctcctctccctcctcctcctcctcctcctcctcttcttcttctctgctattatttattttgcgggttttctttttgttttgtttttttttacattgtaaatctctccttgaattgatgttgggaaagagtaagtcacatattctaggaaagcagtgattgagatgggctagatagtagccacagcaagtgtcatactgacaattaatagagaatctgttattcccctctccctaaataaatcatccattggctgctttccaagaattttataggtcacagaaaaatcacactgtagcttattaaacattctggttttgctaagagttctatgtaccaataactttaatacttgatatgagatttccacctgggagaatagttagaggctaaaggattagaggtgggtagattaaggaaaatttagcatggtctagtgatgttaggaagattcatcactgttacaactcctagattctttgtttctgttttgtttttcttgtttctttatttttaaatcaaatgtctgacagtgtcactcagaatacttggggggtaaaaaaacaacaacaggaaaaaaaattaccaccaccaataaaaattgtgttttgagacagtatcactattagtcttggctgttccgggaactccctctgtaggccagactggcctcaatctcacagagatcagcctgcctctgtcttccaaagtctgcattaaaggcatgtgccatctcatctgcttaatgtttttaaacatttatcaaatggtacatttaagaagtgttgaaggcgcatgcacagagtcagaaaatgaagcaacatgaagcttttaagtaattacaatactgttctatattttgctatatgtgattaatacctcaactttaaaaaaacagacttggaaggtaaatgtaaaatatgcttgcacacatgtgtgggtgactgtatcactggaaaatggatcaggaggaagtgtgctaccatggaagctatatctccagctacatttaccactttttatttgctgcaaatggaggcagcaattaaaggaatgggtattgaaagattcaccctgattttacagatgttaacatcaaggatagaaataaaactggcaggaaaatgggggacggggggacagaattggtgatgttgaagcaggtaagaaatgaggggcttgctggttttcaaacagttgcaagccttccttcttccagacttcctagtttgcatggtcgacgtgtatttagaatagatctgtatctaaatggtttcctatatgccaaccagtggagcagcaaagccttatgttggtctaatgaggaaaaactacacatatattctctgtggttgaccagcatgccaacattaactttgcttttctttttttcccaccagccatttccaaagcagccagggacatcaggcgcttaccctcttacttcaccccctacatcctatcacagcacagttaatcagtccccctctatgatgcacacacagtctccaggtaagatacgagttattctctgttcttgtctacctcaagaggaagcattgcttaggtgacctcaggtgtcacacaggtttttacctgctctctgtctcattatttgcctacattcattggagcagtgctgaaaaacccacatttgcagtactttaggagcattttgtaagatttgttttaagtgcctagagccagacttgtggcaccatttccaagattgctagtaatctgatggtctgcattagaggttgacagtcataggccttaagtaaacaaacaaatgaaacaaagccatgtcaacttatgtggtattcatgtctgctctttttcactctttttttatatatattttgaggctgggtctgatattacccaggctggccttaaactcactatgtagttagactgtctggagatcattgatccttctctgctttctcctccctagtattggggttaggagtacaccaccatgcctgactgctttgtgatggatggccttctacccctgctccatatgtgaacctttgggagatgtggcagtgatttgttctccagctccctggagtcgggcacatcatatcttatttgtcctgaccaaatggctttgttgggcagttctgtgcactgtaaagtgtgggtggcatgtgaaaattttacttttgactgaatagttctatgaaatctcttgagcctgaagttcagcaggaaactaggtcctagcccctggctcccatttgccatctaagaaatgataggcatcagatttcttaaggaaaataccctcttaccttgcagtttccattctcaaattaataggataaaaaatttaaattgttatattacaaaagaagtattaggtaaaatataagaagttaaataattttgccaggcctggtgatggaaatctataatctcagttattttggaggctaggggaacaggatcaaaagcttaagaacaaaaaaagaaaaaaaagggggggggtgaggagggaaaaaaaagtttaagaccacaaaatctgaaaaaaatacagaaaagtctgggccatagttcagtggttgagtgcttgcttagcatacatacatgaggcccagtgttcaattcttagtagtacaagaagaaaaaagcctttggtttaatgcatggatcaaatagtgaatgtcttcatcgttagaggatgctctgcgtattagcttgatatgtgtgtgtgtctgtgtgtgtgtctgcatttgtgatactaaggatggaacccaaagtctcacatatgctaaacaaatgttttactagtgacatctccaaacccgaagagttttcccattgtaaagtagaattggtattatatgttttttcttttttctttatatattaatttcctaaaatcccttaatacagatatgtgtgtattcgtgtacatacatataacaaatgtacacgtacccacagatcttgctaatctgagacacttgtttaacccactcattccatttgtaaatgagaatagcataaaacactggctattccagctgccacctttcaacccgtctcatcatggcagcctcttcctcttttgtatgcctctctcacagccactcagattgctaaagggatttgttgattttcaagtcggatcctgggggaagaatgccacatccttgtttttagaaaagtctttaaatgtcctactttttggaggctctatgtgtgtgcatggttctgccctagagatgcttctttgcctgcctccttcaccttgactcggctcaagatgagacttaaaggatgccttggagaaggccaaatgcaaggacacagactaggtgggtgggtattccaggcacacccccacaccatgtgtgtggaacctgtggtcccagagtacactgtcttgaatgaccagaatatggatatgtgagactcttcaagaatttggtctttactggatcagccatccatatttggactttattagggtaacaaaggggtattattattattattattattattattattattactataccagagaggagctggtttttagtactacagaggtctttaaattctttggttacaaaagcctagagatttttcaagtctaagtgtgctgtagacatttggctctatggaggcctgcagcttatcagagagtgaagaagggtatatagagtcattccagactctaattgccacccaccatgtgggacaaactatctgtccttagagttgcctctaagtccacatgtggtctggaactcacctttaaactctgtcatctcctctcaggccacccttcttcactcttcttggaccataggttgaagatttggaagttatcatccccaggatcattaaaggctgagtgggtgggagagcttagtccctatgaataccagaggtgaaagtcacagctggagaggatataggctctatcagatagatacccagaaccccaggggtatgtctctaggaaaagcagagactagtgtttaggaggaaggggaaaatgcattttaagtaattataatagtagacagacatgcttgctatgactatgccaagcccaattctaagcactttactcatttaatcctcacagcaaacttatggcataggtcccattattattcccattttatggagaaaaaccgaggcatggagaagttaagtcacatgtcagatcatacagctaaataggtaaatataacacatgtcaatttggttgacatatttattgagaacacgatattgcttaagtattttagaacataaatatgaaattatcctatactacagtaaagagtttgaaacctgctaatattgaatgataataaagcaagtattaatatgttgagtttattcttaagttctccctttgaagtcctttaaagttaaaatccctcccatggctttaagtgccatctttaagtgcctgtctcccagcttctgtatgtattttagatctcactttggaactccagcctttgattttctaattatctattcagtacttctacctaatatctagtggcttgccaaaactcaccagggctgaaactaaattcctagtttcccagtcctgtgtcctgatccttgtatggacaacacactcagaaagaggcagccccttctttcatattccttggcatattctgctcatatcagagatacacagaatatgtttgcttatatgcccatattgagttatttaccaaatactattgaccatgtcctgtttttaaactcaaattgaagccttttgcagtaccccaaccagtcttcagtcaccctagcagctcataccagccactagagtgatcctttctagacagaagtttggtaatggctttcattccagactctaattgccacccaccatgtgggacaaactatctgtccttagagttgcctctaagtccacatgtggtctggaactcacctttaaactctgtcatctcctctcaggccacccttcttcactcttttccagcactctggcccccttcctgtcacacaaactatccgttctttgagacctttggattggctcatttgtctgcctggattatctttctccctgtgctgtgtcctgcatatttcttcctgtctggtttacacatcaatttagagtctttagctctgccaccacaaggaattcttttcctttgcactggtcttcccctagcacttgtcattaccttctaggttaatcgtgctcattttagtagattacatgctccaggagggcagaaattgtcttatgttaactatgtcctttgtgcctagaacagtgcctggcaagaagctggtaatctcacctatttgtagacaaagtatgtaactaaaaagtgcagtggttatatttctttgcagttagtgagtataagagttacaatgtggatccatggatttgaactttcttgtaatagagaggtctttccagttttccttcctgctatttatgggacttattctgtctctttagtctctagggagtttttttgttttgttttgttttttgttttttgttttgttttgttttgttttgttttacttgtgctccttggacaggacatactatgtgtcctgtgagatcatctgtaattattttcctttattaggaaatctgcatgctgccagctcccccagtggggctttgagagccccatcaccagcgtcatttgttccaactcctcccccatcctcgcatggaatctcaataggaccaggggccagttttgctagtccacatggtgagtccatacatggaaatcgctatagcatttagagcgtgatggaaaagtaatttttgttaaataaaattccttattgaaaactggtaatttattgaggagtagcaaaaatacgacttgagcaaaaagacattttttcatagtttactcacacagaggcactgactggttggtctgtggctgtcttcccctgcttgtcctttttgtcacctgctgcttgcttgctggccatcccgtacctctgtgattgctttctagttattggcctgtctccctcagatacctcccctaacctaggtgggtaccttcccagatgagtggattctcagtgggatcaaataaacattagaaggaggtagacagtgaattgtccccctgtgattgttgtcagtttgttttttgagatcttgctatatagcccaggctggcctccaagttgcaacagttctccaccccaagtgctgagattagaagcagcatacaggacacccgacttaaatgttttctttcatgtcaccagacagccaccttacctcttttctcaaagtcatttgtcttactggtttctgatatattctttattcttatattgctaatttttggtgtatgtgtgtgagtgttttgtcatgtatgtatgtgaatcatgtacattcctagtgtccctgcctagaggtcagaagagggcatcagaacccctggaattggaattacaagtggttgtgagccaccctgtgggtgttggaaagcaaaccctggtaaatcctaatcactgagccatttctctctccctccccgggtttatagtcttacagatctgttttacacacacacacacacacactacctcctccccaccttacatggcagcatattacataacctgttcacttaaacatcgtaaacattgtgccacattagaacataaagaacttcttcagcctctcagctgtgttcagctatgaccttacttcttattaatactattgtttttgaacatttgtcagtgaatattcattatcatactacagagctttataacatcccgtgtctgggtataccataacttaagtatagttctattttgaatgtttacgtattttcacaattgaaaatgctgccataggtatccatatgatctccttacataagttccgaaaaatgtcattgaagtcattcgacaacattgggcatatttcttacctgaagggctggaccaatttcttgtagcagctggggagaatgcctgttgtcctcccacatagccaacatgggatagtaggattttctaaaagtaactgggccacttttctaggtgaaaaaatttggcattttaatattagatatgtgtttcttgattattagtgaaatttcacttactgaattcacacttttttgaatgcccatttgtcttcagtgtctcttttaataagtcaagaccatttattcactaaaacaatcagtatactttctcagtgtttcatttgaggacaaagggatataaacaatatatcaaagatagttttgtggtgaaatttaaaatgtcaaattgttaaggaagccactgctttcaaaacttgattctcagttatatttcttattcagtgtagccgtcactgaataaagaaaatgtatagtttccttcccttgtccttctctgagaagaatggaaacataatttttcagagctggtcttcctttcagcaaagcttgatgttttcattaaatgtatggggccttctctggaggaaaattcatcccttcttagtctcctcacttcctaactctgcaacccactttgaaagtacagaaagcctagcagggcgtggtggtgcacacctttaattccagtactgtggaagcagaggcagatggatttctatgagttcaaggccagtctggtctacatagtaagttctagggcagccaaggtgatgcaaaaagaccctgtgtcaaaaagcaaccgaaaagaaagtaccaaaaacgctacaaaaatagagacttaggtgtaatgtgaaacagaacaacgaaaatgactcattctttaaggcgctggctgttttcacatactttagggacattaaaatatgtgttttgagaattatgttttattacacctttttttttcaggaacccttgaccctagttctccatatactatggtgtcaccaagtggacgagcaggaaactggcctgggtcacctcaagtgtccggaccctcaccagcaacccgtttgcctggaatgtcaccagctaacccatctctgcattctcctgttccagatgtttctcattctcctcgagctggcacaagtgagtgttgtcagcactgtttttccaaagcaaacgccaatgtctgactccgccttcacatttcaaagtcacagtgtatttctctaaggagaatttccaaaccttaaccttttttcctttacaaatcagtctgcgatattaattagcaatgtcatgaaaaatgtattaagaaaccaagtctctgcacctctgtcaatgtctgctaacttatgtcttcaatattgaaccataaaagataccttaagttaaccaccaaaggcatagaagttaatataaggccataatactgatgaaagactggacagttgattgtaaataggattttctagactcggtaggtggaaagaattatttttctttgaaggaaataactttttatcatggtaattttgaaggatgattcctatgacatgttcatgggggaatgtggcttttacaaatcttgtattggttataattgttcatatcttcttttctgtgttgacttcattattcccatggtattggccttttaaactatgtgcctctgagtctttgaatttataaatttgttatcttaataaatattgtaaaaatgtaaaaaaaaaaaagattttaaaagtgtatgcattccataactttcagtgcttaaagcaacaaatgctatgttagctcacaatgtttgctctgataactctcctgagctagttgacttgtccatagcctcagctggcatggattctcttgtttacccagtggatagagcacatgacagaggacatgggagtcttgtaagtattccagcatcccttgcaaaagcaggtcacaggaccaagcagagtttaggttgagaagcagaacccagttccttgaaggagtccctacaggatcatattgaacctgaatacaatcagaagattcactgtagctgattctgctatctgagaactgacatatgatccttcataacaaggactagttacaagagttacaattacctggcaactgtctgatgaaggcaaagcaggcagcaatggcatggtgtgtatgcattcataattgaagttacctgttttccttcccaaaaggttcccagacaatgccaaccaacatgcctccacctcgaaaactacctcagcgctcctgggcagcatctatacccaccattctcactcatagtgccttgaacatcttactgctaccatctccaacgccaggccttgtgcctggcctggcaggtagttacctttgttccccacttgagagattccttggatctgtcatcatgagacgacaccttcaaagaatcatccaacaggaaacggtacgagtattacgcaagtttctaagtggtcggtcattgtcaagggcagaagacaatctttgggagggttaccttcttaaccatcctggtagaattgggcttcaagcctttacctagcattaaagatgcgccccacttaatctaatcagatcttagattagagggttgtacagtttactgttctgtgattttagataatgtggtttaccagggccgaggaacagatgatcacactaaacagattcagtgcacataggtctgacggcgcacatacaaatgactgtttgctctctgatgtgcttttgtagatagactgactttgaagtcgagtcctcatcaaaatcaaagtgttgatcataggcattagggcttttttaaaactgatgagtaattacatttgtttaaaatcttgcagacataggcatctagccaaccttacggtgataacattctttatttatatttaccattattaccagtagatacatgtgttaatgaagtagccaaagtgtttgtttgtaataaatactatatacacttgcctcaaagtcatttcataatctttatagtcagatatatttaaaagaatgtaaaaagtattttaatttggattgtgtaaaatagtgggtttcatttgatttttttttgattttgatttttttctttaatgttaattgttaattaataattcattaataattaataaattaagctggttactaagtttttattaatgtgtatgggtggttttgccttcctgtttgtgtaccacatgcatgcagtgtacaggaaggccaaaagaggccatcaaaccttcctggaactggaattacaggcgtgagtcctagggtgctgggaatcaaacctgttcctctggaagagcagctcctactttaatgtttttctttttctttcctttaaaaaaaaagatattatttgccttatgtatgagtacactgtagctgtcttcagactcaccagaagaggcatcaaatcccattacagatggttgtgagctaccatgtgggtgctgggatttgaactcaggacctttggatctctccagccccaatgtttttcatatgtgaacatacttatgcatactctcccccattgccctctcttttcactgtacccctgttcaatattaacatatgttaattaaattgccattcagcttagagaggatgagagctgtggtgcagcctcagttctgctattcgtggtccctgtagcattgggctttgtgactctcgtcagaattactggatcaacatgttttctattgagacgattctgtcagctaagtttgtgtctttccctgttgatttgctgcatccttgttttacagttgcagctgatcaattccaatgaacctggtgtaatcatgttcaagacagatgccctgaaatgcagagtagcccttagtcccaaaaccaaccagacccttcagctaaaagtgacacctgaaaatgcaggacaatggaaacccgatgagcttcaagttttggagaaattcttcgaaacaagagtatgtgtttcctaatatatgcttgactttagtcagtgaatccatgaagtcgaagtagaatgaagagtaaggtgatttctttgcccctaccccctgtaggttgcaggaccgccatttaaagccaacacacttatagccttcaccaagctgttgggagcgccgacacacatcctccgggactgtgtgcatataatgaagttggagttggtgagttgctgagaaacacaaacttttctaattgggtctattggaagagactgtagaacagtacttatggtctagctcactcactttgcgtatcattccatttctcctaaaattcatttcctttaagataataaattttatctatttaataataattactatttagtactaaaatattaatagggacttactatcctggctatcctcaaatttatgtgcttgcctctagcctctaagtggggagttaaaggcttcaattcaagaagtatattctgtcgggtgtggtgggacacgcctttaatcccagcactctggaggcagaggcaggcttagtggttaagagtactgactattcttctgaaggtcatgagttcaaatcccagcaacacatggtgactcacaatcatccataatgagatctgaccccttcttctggggtgtctgaagacagctacagtgtacttagatataataagttaaaaaaaaaagatataacccctctccagccattctcagcaagcagagttcccagaagctaacttcttgcagagatggtttgatgaaaagagcaaagatctctcttgtatttgtatctatttccattatgaaacactttacatgtatttctttcccctgaatatctgtgaagcctcagtgttgagtcacacagagcaggtgccagaagggcagcagtcatcgttagcgctctgggtatctgttcctgcttttgtttgagccttttcagggtcgctgctgggcttctacagcttggttttcatttgtatttgggtttctatagccaggaaaagaaatggctactagcagaatgatttaaaacaatagcagttaattcagtcttaattctagagagaagtcctaaatcaaggtatctttgaggacttgctctctaaaggctccacaggaggatatgtgtcttgtctctcacttggtaattcagcttttgcttctataccaattactctgacttatgcatccccatgtatgagggctctacctgataatctcttcctaacttgcttatatctgcaaagacctcattttcaagtgagatcatactgaactggttggtcctgagaataaggacttcttatcttgttctggcacacaattcaacccataacaaccccccagtatttgctagtgttcatgagagagaccatttctagaatgtcctgcttaatctcttgccagaaatccactgagtaaatcttggagatcttgccacattttagagcataaaatgtttcccattttcaacaaaacgaatgttcttttaagtcagtgaagtaacatggctaaatagccactcctccctaaccttcattcctaccctagactcaaacccagaacctcacgtgctctgtcattgagctacatccccagccccacagtcttctacatttaagtattacaaaaggacacaacaaagaacttctaaaaaagaggttttgctttgtctgtagtgtcattttttaggacaaattggtgaacgaaaggatatgtagatgtcattaggcaaattattctctctgttgaggttaccccagtttatgttcccacaagcacccccaggtcagttatcagttagttttcccccctcattttataccattgttttagctattataaacctttgctataaataggtattttaaacctttggtaaatttagctagttctttttattgttatttactttttcttgttttttcaaaatgacttatttttctgtaacggttacctgcatgtatgtctgtgcccacatctgtgcctggtacactaggaggccagaaagcgctgtcagattcccttggagtggtgttagagatgattgtgagccagagcctgagcctttgaatcactcagtcatcttccagcactttttttttatttcgtgtgtgtgtgtctgtctgtctgtctgtctgtacctcagtttatgcaactgagagcagtgctcatggcagccaaagagatcattgaatcctctggggctggttgtgagtcttgacatgggttctgggaaataaacacaagtcctctgcaagagcaacaagctcccttaacctctcagccatctcggcatcccaagatggatgttcattttactttgcatgtctatatatgtgcattctgtgtatgctatatgcacatgagtgctggcataggccaaaagagaaggcatcggattcctttcagctggagttaaagttggttgtgagctaccctatatagatgttagcaatcaaacttgggtgctctggaagagcagtatgcatttttaacctgctgagttatctctccagccctatgttttaggtgtttcttaaaactatatagtttgagcctttatgatagatggtgtttatttgattaacctaatacccccctcctccttgttgccattttaatatcaggtttaaggaagcaaggatttttttttcttgtttttctttctttttggttttgtttagattttcatctgataggatataacagacattataagtcagaaagatttctttgagattttgaaggagtaaatatgtatctataaaagcacctgtgattttctcttccaaacgatcaccatggcttcagtcgtttatttagggaagcagttagaaaccaaaatgaacgtcagtcagcaagaactttaagtgacatgagttgatccttatttgtagaagggagcagcatatgtcagagtgccactgcatgttcgtgagcgagattagagcctcactcaaaatggggcactggctgggatgcagggaggaagcagtgaagtcccgagtgttgatggctttatgaaaacaatggggcaagagttggtgtcagagacactgcagccactggccttgggcggaataaaggagaacatagcgcccaaatttaccccagagcttttagttagttgtttcatggattttttttaagtaaaagtgcatgctgtctggatcaataaatgtaaggtgaagttctaactcttcagactccatagcagatgtaatttttaaatgttaagaggtttttgtcattatttttcccctttaaaacagttcccagatcaagcaacgcagctgaaatggaacgttcagttttgcctcaccatccctcccagcgcaccaccaattgcaccgcctgggacaccagctgtggtcctgaaatccaaaatgctattttttgtaagtatcacctgacatcgtctgtgcgtgtagagtttctgaggaaaaagccacatgagcattgtagaacatcttttgagtgagctcttccctgttagctatatgtctagggttttccactgttagactgtggggttcttagctcccttagtaacaacagagatttattcaaggttgtaattgggagacaattataacactcgggtgggtctcacttttttcctcatatttaattttcctgtacttgctgtatcttattctgaaagtaaatgatagtacctctcacaaatcgagacaaatatttgattttctgtttttattctctttatctacagcttcaactaactcagaaaacatcagtccctccccaagaacctgttagtataatagttccaattatttatgatatggcttcaggtaccactcagcaggcagacattcccagacagcagaactcttctgttgctgcgccaatgatggtcagcaacattctgaagaggtttgcagagatgaaccctccacgacaaggtacatgagcagtagatggtattttgttgcatatatgttataacacttccttttagagagacctccctcccgttccctctcttctccctccttccctactctgcatcccaatcctagcactagtactctgttgccatggccctcttagttagtgtctgcctgtcgctttctttctttctcactggttcttcagttttgtccatttctctgctgcctggacttttttgttagcaaatgactattgggactgagccagttgccaatgccagaagcttgtatttatagcacacattgccacaaagccctaggttaggatgatagacttttccggggctgtgaatccctgccttgccatcagtacctgccgctctgtacatcacaaagttggaatgcatgttggtttctcatactccatggttcgatcatgaatagaatactattatcaaaagttgtgtatcttctaaatgttttgtgaagaataaaagctgatacaaatggcatcgctgctttttgggcttcttatgtaagtgtcaggcgggtgcaagtgagcctttaccctgaacgcacagtgaagctctgagactggacatttcccaggaaaccagagtgtttcttgacagataaatgaggtcccttcgacaatggagtagcccacacttaactcctggcaatgccaaatttgggggtctaaatcatgaagctcagcaaagagaactttgcttcagttttgctcatttctaatatttatgaatgtacgctcatgcctgatgctaaggaagtcctctttatagccttagaatagcttgcaaacagaattaggagaaatgaggacaaagctgttctctgaaacattttaaagtatcagtgtcaaaagttttaggaatcctgaggggaaaaggaagtttttaaaagctatctgttcccccattccatacctaggtaagggcttgcctcagtttctaaggaatccactgggcagtagagaacagtgtgcttcgtttgttagaatacttctgacaactttctgctttcattctttaacctttctcttcagctgagaataggccctcaggaatcaaaatttaaagccatcacaattctcaagttagcagtctagtagaactcggatggtaaacataattccttcatatggataacttttaagtatgtcctatccactgggattgaaaaattaaaagggaaatgatttgatcttactgtgatctagcaaattttctacctatcagtgtaaagtgtcaaagtgtgtatgcatgtccctgtatgcacaggcatgcatgcacacacatgcgcttgcacatgtacatgcacacatacgcaccgcagtttgttaagaattggtaaggtattatgggggtgctttctttttttcttttgttccttctttggttggacaaacctttggatttcctttgtccttttgtctgtaccctcattttccagtgcttggagcaaagactggcagtgacttgcacaggaacacagtgtcctaccctttgacaggccataattcctatgagggcttccgttcaccccctatcagccataagtagtgtcaaagcctgttctaacaggaaggatctagtttggcgtgaggatgaggagtatgagttgtacctccacaatcgagtttttacatccttgccatgagatatgtcagcttccttgcccttctcccacagtgcaaacattttgagggaaaatgctagcttggttcagtggtgttacacctgtaatctctgcccctggaggctgaggcaggagagttttgagttctaaaccagtttggcttacatagaccattcgttgtcttataacaactacaatgaaaagaaaaggggaaaaatacctaagcttaataaaccttttctcctttgaaaacagaaacaaaacctcctttatttttgtatttaattgacttcagtcttaatgtgtaaatttagaagtcaaatatttccatgaagccaacaatctctatgagctgtcatagactttcattgtgcagtataacttcactagccaaatttaaaatttaacctaactacaatataaaatgaaaatgttgaatttcttagccaaagtagtgctgtgtagagcatggacatttcttttgctgcagaacattgtattggtcagcagtattactataacttagtggaagtagccttatctggcctttcatgcagagttagctggaaggacatcacggatgtcataactaatgcactgatatacattagaactatcgttagatcaagaatgcattaagtattctagagtcagactgttcaagtcttatccaatgtggcactgcttccgtgcactgaaagcatctctttctctctgtttaaacttgacatgtgctcccagtttcttcctgagacaaaaacaatgcccaacccaaatataatgttacaccacaccagttcctactgcctaaaatctgaatagtttaaaatacttaacgtctttgatttcaaattcgtgactgattttaaccatcccttccctcactggtgtgttaacgtctctcctccactgcgaatagctaatgaccatttttctctgttgcagg

SEQ ID NO: 667 - DNA, 84462 bp, mus musculus; identical to SEQ ID NO: 666

SEQ ID NO: 668 - DNA, 7974 bp, mus musculus
gtggccagtagtttgcggcatcgggaggaggagcagcaacagcagcagtagcggcagcggctggctgagaggggagacgggcgagcgggtgcagacggcagcaccagctaccgctcaccatgcccggcttgcccagagggcactggcattcacttccctagcccctcgcgggctgcggcgcagtgtcctccctggctttccagctgagccgattcatctgagacccgaacctctcgccccaaacccattccttcctgctctccccctctctctcatactccacattcgcacttcccatccacacattcactcttcctctctttcgaacatccacgaacagacctcccctgcgcgcgagcgccggggagggaggaagccctaagcagggctgatagcgcttctcctggaggatgggatccagaagctcccgcaagtaaactttggagccgacagaagccctcgaccctggcagctgcccaggcggaccccaacaacatgcggctgaactaaggagggctttctttggcggcggcggcggcggcggcggcggcagcggcagcggcggcagcggcggcggcagcggcggctgctgcggtccttgaagctacaccccagcccaaacccaggaaggcaaagaagccccgggtacccgcgactgcagccccgcctcttctggccggtactgtagtagcttcctttcttcaccttcccattccccgtgtcccctcccccttccccggggcaattggaaagagcaggactttgattttcttggacaaattgccatcttcccgtttttagaaacttaaggcggaggcctgggctgcgttggcaactttgatttccgagatataaacgcccgcagacccgcaactgctctgtgggaggaaccctgcgcccacctcggatcctgggcagacgcaccccccaccccacgccctcggacaccaacctcagcgcccgggagagtgctctcgcatctctcccctcccccttcctctgcccgccccgggacagccctccagctctgccaaatccctgggagcccacggatcttgccaggaactcagacttctgcctgcgatcccccctttccctctaacaggccttgaagaggccagagggccccccccccccggatcccggagggtgcgtaccaggcgggagctccctccgcagtgagctgggcgcgctggggggaggtccttgcgcatgccaggtgcacagactgcgcgctcgcctgccccagtgccggtgcgctgcggcgggtccggcagtgcctgagaggctgcgcccccacagccttccacgtccgcgccccgagtccactaccgactctgctgcttgtggccctctggggcgtgcgagcgccgctcgaaccgcagccctgcgctgctgcggccagtcccgcctggctaactttgaaaggggaaaactgagtagccgggctggagggagggggctcggggctgcgcggcgctccctgggcaccccggagcccccggccccccagacagtctctgctgagaccactgcaatctcagcattggagcctgcgcgggttcctcccgcgcgcctccgggccgccctgggcgggactcctcccgcggcctccggggccacggggcgcgcgcaacaggcggcccgagccggcgggaagctggagcgccggcggcgtcggtctcggaggggtgtggagaggcgaggcaaggcagagccccgcgcagccatggagtctctcctgctgccggtgctattgctgctggctgtactgtggacgcaggcggctgccctgattaaccttaaatactcggtcgaagaggagcagcgcgccgggacggtgatcgctaacgtggccaaggacgcgcgggaggccggcttcgcgctggacccccgacaggcttctgctttccgcgtggtgtccaactcggctccgcacctggtggacatcaaccccagctcgggcctcttggtcaccaagcagaagattgaccgagacctgctgtgccgccagagccccaagtgtatcatctcgctcgaggtcatgtccagctcaatggagatctgtgtgattaaggtggagatcaaagacctgaacgacaatgctcccagttttccggccgcacagatagagctggagatctctgaggcagccagccccggcacccgcatcccactggacagtgcatatgacccggactccggcagctttggtgtgcagacctacgagctcacgcccaacgagctgtttggcctggaaataaagacgcggggtgacggttcgcgctttgctgaactggtggtggagaagagcctggaccgtgagacacagtcacattacagctttcgcattacggctctcgacggaggcgacccaccacacatgggcacagttggcctcagcatcaaggtgaccgattcgaatgacaacaacccagtgtttggcgagtccacctactcagtgagcgtgcctgaaaattcacctcccaatacacccgtcatccgcctcaatgccagcgatccagatgagggcaccaatggccaagtggtctattccttctatggttatgtcaatgaccgtacgcgtgaactcttccaaattgacccacacagcggcctggtcaccgtcaccggtgcgctagactatgaagagggccatgtgtacgaactggatgtgcaagccaaagacctggggcccaactctatccctgcacactgcaaagtcacagtcagcgtacttgatactaatgacaacccgccaattatcaacctcctgtcggtcaatagcgagcttgtggaggtgagcgagagcgcccccccgggctatgtgattgccctggttcgggtgtctgatcgcgactccgggctcaatggacgtgtgcagtgccgcttgctgggcaatgtcccctttcgactgcaggagtatgagagcttctccactattcttgtggatgggaggctggaccgagagcagcatgaccagtacaatctcactattcaggctcgagacagcggtgtgcctatgctgcagagtgccaagtcgttcactgtgcgtatcacagatgagaatgacaaccacccacacttctccaagccttactaccaagtcattgtacaggagaacaacactcctggtgcctatctgctctcagtgtctgcccgcgaccctgacatgggtcttaatggcagtgtctcctatcaaattgtgccatcacaggtgcgagacatgccagtcttcacctatgtctcaatcaatcccaactctggtgacatctatgcgctccgttcctttaaccatgagcagaccaaggcgtttgaattcaaggtcctggccaaggatggcggcttgccctccctgcaaagcaatgccactgtgagggtcattatcctcgacgtcaatgacaatacaccggtcatcactgccccacctctgatcaatggcactgctgaggtctacattcctcgaaactctggcataggctatttggtgactgtagttaaggcagacgattatgatgagggcgaaaatggccgagtcacctatgacatgacagaaggtgaccgaggtttcttcgaaatagaccaggtcaatggagaagtcagaaccactcgtacctttaatgagaactccaagccttcctatgagcttatagtggtggcccatgaccatggcaagacatctctctctgcttctgcccttgtcctaatatacctgtccccagctcttgatgcccaagagtcaatgggctctgtgaacttatccctgattttcattattgctctgggctccattgcgggcattctctttgtcactatgatcttcgtggcaatcaaatgcaagcgtgacaacaaagagatccggacctacaattgcaggtagagccaagttttctttcttttcttctgtgttttgagtgagtaagatatgtgtatttgtgtcggtcggtctaaaaaccccagtgcttttgtttcctatttaaatgcatgcagcatacccacaatgcttctttgtggagggtgagaagtttgtgacagtccaagttgatcaattcttttgatctgacaatttgctggaagacaatcatttactgtttgaatggattttgtcacataatgatgatgagcagaaaagcaattatcatttaaaattttcacagctgtctccaatgaagttaaggtagaaaaaaatgagggggaaggagggagaatcaaggagtgagagaggagggagggagggagggagaggaaggagagctcaagagagacggattttcctatttgtagcaaaagttctatggggtcatggttgggagggcttgctttcctggaacccagtgttttgcagaggagagctgaaaggggatggtgtactggcagctgtcttgtcctgctgtagggttatagttcacagagagagagctctgagagtttatgataagaaacggagaggaggaagagagagagagagagagagagagagagagagagagagagagagagagagagagagagagagagagagagagagagaaagagccctgtgcaggggaagcaggtcattagtggttttgagtgtattcttggcttgttttgtatctagtccccagacatatggctatacaaagtaaaattctattaggcatctgtatgttttcaaatatcggcttggttggtgtgtgaagaccaaacatcccaatgagaaacaagactttgcatccagatgtttcagtaaaaatagcaatcttctggagttggctatgctttcctttaatgtggaactgtgctgtggcattaagatctggtccctaccagtggatgtcactatgggctattgtgttacagtttctctgaagtgtgtgtaggatgtgcgtgggggtggggaaacaagaggagaggaaaaagaagtagaaacttgaatagcatgtaatgtagcatttttaaagtcttgattaacacattagaggttcttgctgaagacttccttgcgatttgattgaagaaataagtctaagaatttctagaatcctatttaggataatgcacatattttttttccagcagtgtctcatcgaaacagttgaaaaaagttatttttatttatttttttactttgctgaaaatgaatgatgctgctatttccagccaaggtgtgtgtgtgcttgtgtgtactttcaacacacctacacatactgtatctcgtaccatctgtgcttgcatgttaatcagtcaaaatatgttcctgtaggtccgatttgtatctgacaccatctgaaatacacacgtctgtgaatcagagctccctgaatatgtaacagccatgcaattattgtttcccttttactattctctgcattacacaagttagtagacaaatgctaaccacacatgaatatcaatcaggtgccataaaagagcagctgcaatgcctcataaatgctttaatcctgttactactgaaatggccatgacttttctttccttcagtaccaagtcacttcagatgggagaaatggaaattaatattgctcttacctttgaaacctgtgacagccactggcgatttttataggagaaaaatgcaggctcaataaaatttttatttatatggagataatgacagaggggactctttttaagccattttctcagcataaagtaaatgcataagacccttaccatgatgaaaaagaaatcagcttgaagtagagatattgaaggctttgccacttcttggtgatatatgactagaagtaagaactctttctgagagcttgccaaggagatcattaaacaaggaagaacatttgaattgagaaaaaaagtgcaaatctcagtgctctccaacttcacccaaatgtgtattttataaagcactcttccttgtgatggcttgcgattagtgaagtacagtttaattaaataattggtcaataccgaatgggccatgcattgaatgcctctgctgaataattggatggggcattgccaaacttacccatcatgggtaaacaaaatgactagaacttcccattgattcagtaaacagattagaaaagaaatgtaatcctagtcctgaagtttggggaattttatctgtcccttggcctctgtatcaccaatttgccatcatttcaaggcagactggacagagagtaaaagggtgaggtaaagtgattgcttatgtctaggtagatcctggggacagagcaataatttgccttggtagatatgggtaggtaggcaaactccccatctgctcagccttcttagaatcacaaagttcaggagaagcctatgcgtctatgtgattaggcagggttttctagttctgaaatgcattcatttatgagacttgtgagttgatctgcaattgctgcttgtattgggctcctctttttgtattctgacaattagctttgtcaagtgagagaatacagacacattctttcacttgtaaagtccaacctgtattctttattatccttattgttttgctgattattactcagagattgaattctcagacaataagctgaaatcattatgtgcaaagtaatacatgacattgaaaatctgactaccttttaacgtatttcttttgacaagtctcttaatgcttggtgtctttggtgcacgttcctgggtctgtgtcagtgttaattaaattgagctttttatgttccagttgcagcacagctgcttgtaggtacacctgaatggagaaggatgctgaatgcactaacctttaaattcctttgcagtaattgtttaaccatcacttgtctcctcggctgttttataaaaggacaaaacagcaagtgtctgcattgcatctcggtttctcccaatagtgaggagcaagacaaaaaggcagaggagaaagtgagcctaaggggaaagaggtaaaaaggcattttcccctcattcaaatgggtttggctatcagatttctctaggagaggagggggaagggtggaaagtagaagggagctgggctagggcagggaggagggtgtgggtgagcagagttaggtgctcttagaggacagggtgtgaacctctactctagtctaaaagtgatcagtttaatgacagaggaagctgattcatggtatttgccacattgcaaattcctggaggcattggcaagggtttttcttaatcccctccatctccttttctgttaaattggcacttactttgtaccttacccagtactccctttaggttccagggcagcatcagatttgagcattttcatgctctcccccataggctcaactttccccaccctcacccctgcttactggccactcataaggaaaaatttcaaattgaaatatgaaattttctttgggaagggttggtgggaggcgggaggttagtatgtttaatatgcaaacttcatggccctcagcttgttttcgcatgcaaaaggcacagggagaaacacgatgatgtaatgcgccagaataaggagctggagcagagatggggtgcaaccctctggggtacttaatgtttattcgtcagtacatggtctgggaaggtgttatctattcgtgctgccttttctgtcacatagaatcgctgagtactcctatgggcatcaaaagaaatcaagtaagaagaaaaaaattagtaagaatgacatccgccttgtacctcgggacgtggaggagacagacaagatgaatgttgtcagttgctcctcccttacttcgtccctcaactatttcgactaccaccagcagacactgcccctgggctgtcgtcgctctgagagcactttcctgaatgtggagaaccagaatacccgtaacaccactgccagccacatctaccatcactccttcaacagccagggcccacagcagccagacctgatcatcaatggtgtgcccctgcctgaggtgagtgcagctaagtggttcggtgggggtcttcccagatcttctagagctgcttactatc

SEQ ID NO: 669 - DNA, 7974 bp, mus musculus; identical to SEQ ID NO: 668

SEQ ID NO: 670 - DNA, 45428 bp, mus musculus
gggaaagttgcagctttttccgcctcctgggagggttgagtagggccggccgcctgggttgctggtctaagtctttttggagctagagacccttccaaccattcggcacccggacctttggtcacctagtagcacctgttgcaggtgacaggtaggtggcagctagtatctgagcgcaccctcaccctctctctgtctgggacttcttggactcccccagccccgtgtctcacccccacttcgggggcgtgtgtcctgttgtaccttgtgtgaggtccctgtcctccctccccagctgccacgcgggcccttctgctgtgtccgcgtctagggaccgcacccccacgcggtgcctcccgtctgctccaggcggtccctccctgccacttatccttctctcgggctgcttctgcccagttcccttgaacggagtttgtgggagctacctctccacaggtatccttggctctgcgcgccccaactccctccccctccgtcccctccagtagccttggcccctctagagagctggcccctggcgcaggcttgaacaggcttctagtggaactgtgtcctcggacttggaggctagtcacctttttggtgacctcgctggacttgactgtccagctccttctatggcccctcgctgtttctgaactccaggcttctgttttcctagcttcaccttgtctcttcaccacaggtacagacttcaggcaagttgactcttgagttctacctcagtgggttggttccccttgggcatggagctggagccccagctgtgtaggttagagctcaactcctttatcatgcccccttcaaacaggctggggggttgctcctggcagaaggacaccagtgctcctccagcctggagaggatgatgagcactgagaggacactgaaggagatggatgggctttaggagaagttgatggtaaaagaatttggtttaaaattctgatagcttgaaaagtgatgtgtttgctttaaccaactctttctccctcccccgaccccaatatgctacagtttcaggaccagaggatctagcattctagtatataaatggcttctagaaggactgaccctaagccctgtatatctgtgggagaaattaatctcctatatcccttgacttccctacctcactttccctttctgcttttgttactttgagacagggtctcactgtagctcaggatggtagacaaggctggcctcacactggctggcaatcctcctgcctctacctcccaaagtgctgctgttataggtccgcaacatcacatctgttctctgctgttttttttttttttaaacctggttactcttctgctctttcttagctgcactcttcataaatatgttgacattaaggagttaatgaactaaggtgcaaatttgccatgaagaactaaaaacaataattagctcagagagctctggcaatttttttcttggtgtgtgtgtgcgtgctggaaatcctagtagaaaaagcccccacaaaactggtttgtgaatctccctttgggtagcagatggtcgtgatttcaaaggctacaccctaggtcagagtggtgaacttgaacttggaggctggttctgggattattagtctgtgagtatatgaagcattctggttggtgttctctgagcactttcccttcaaggttggaactattaaagtgatggcataatgaacgaatgaagtcaggtggcgacgtgattagttctcatcctatctcagataagcctcacactaattctatgcaattggtgatacagttacagccatgatacaacacagaggaggctgaaaggttaagtgtgatgctctaaattacactctgacaacgggacaagcttgtatggagctaacttctggtccatggttccatcttagatgcactgtggggaagttgaattaccacattcatgtcttaactgagttaacttcaaacatgagaccagttgcatgttgctgttgttaagtacataccctggatgactgaaacctctgaggctctcagctctgttgtcattgtcttgaagttaggagaacaaattcctgggttttagaggtgtgttcctgaattctctggatgggcacctgatttaacttcttcctttccagatggccagaggggaaacaatggcgtagcagctgacaggtttttgacagaaatatgtgtatgtgacaaagccacaccaggcagacagagtgatagcacaccctttttatttgtagcttcagcagagatactcaggagagtatatcttcctcaagcccacctctggaactttgtttaaactactggttgtcccccccccccccccccggccaacttggtactcatatccccaacctcttgtcattaactcttattcatctctcaagatttctcctaacatcattgcctttgaggcaagctcactgaatgcatacttccttctcccaaggagaatgactacttatattgtcttgaaggactttatttagacttcaataaaggcctgaataccattctgtttttccatctggaaggttgtaatctctgtaaaggaagtaactggatcttgaagcacaaagatttgtgctaggggttggggatgcactgatggtaagattggaataagaaacaatcttgagctatttgtaacacagaatagggacaagcattgtgcctctgtttcaaggccgtcacttgaccaacccactgaaaattgcaaccatgtccctaaccattcattttctttaaaaaaaaaagtttacttaattttatgtgcattgatgttttgcctgcatgtatgtctgaatgagagtgttgaatcccatgggacagacagttgtgagctgtcatgtaagtactgggaattgaacctgatcctctggaagagcagccagtgctctgaatggctgagccatctctccagccccttaaacactctttccacctctttcctacatttgttttgcttattcattgtttcgcttctaccccataacacaaatggatatgaattgctgtcttttgtattcactgatggtcaaaggaaccagagttctgagcacatcataggcgtcagactgatgctggtgagtgaatgaatgaatggagtttgcccctagcccagtactcatacagttttccttctgttgaggtttttttgtttggctgtttgttattgttgttgttgttgttttgctttgagactctatttctgataacaactttgacctaattataaatatttcctctctgtttaatttctaagttgttggagataagagtcccagaatgtatcctaggctagcctagacttcactgtgtatcctgtctggcttcatactcatggctattttactgcctcagttttctgagtgccaggattgaagatgtgaaccagtatgcttgaccagaaccttcactttatgtttaagtacaaatcgtgtgggtggaggaagaaagaaaccttttcctttggttcatcttcttaacagtggcagcactgggaagggaggtgcgaattatcagcggtcccgaggacattcaggcatttgtcaaggtcagtgagagaaggcgactgtgcaacagggaaaagccccaacaaataaaagatgccacgaattaggtttttattctcatcacccttaatcttatatgtgaggtggttactaggttatgggctgtatggagaaggtccaactgagtacttttacaacaattgcctagctgtagactagttttgtagtctagcagcagctgtgtagcaaaatcaaagtgctagtttgtttaaatgcagtttgaaatatccagacagaaaaaaagtccagaatctatttgataacagcagacttagaaggacctatgccctgtaaaaaacagtaactatatacttctcaacatttattgtctgttaacttctttgaaatgtgagtttgcataaataaactgctcaggcactttaaatctcttcttcccaaacactgagcattggactgtcttaggactcagcctacagacttttctctacccaaaacctgctcagaagttctctttaagtaccattgctgtgacatctagacggccaccattcatgtttctgttctgggcctttcttctgtgctgaagcctcaggttcttagtggcctatttgatatttctacctggcatctgatagatgcctcaagggtaacatggccaagtatggattattgattgccctaatacctaatccttccctttgccttcccatgactaagaaaagggcaccattatacagttagttagttgaaccaagaatattgggttacccaggatttctgtcatcttaggccaccacataacagtgtttgaactcttgttgatctcactttcaaactgtatggtgaactcttccatgtgtctccattttctctgcctgctacctacctttgtcccagccaccatgaaggttcactgaacattcttgaacaatggtaaaatatatacaactatttctatggagcagctctgtattggtgtgtgggatgggtaaaccatgtcaggaagcttgaggggtagagagggttgagaccccagaaactcacacctgagatggtaggcaccccctgctccctgacagatacctggacaatttgtaggcacatccctgctccctgctagattcctggcctggaacatgtgccacatgggtgtgggatgtatatgtgtgtacacacatgtgcttgtagtcatgtagacggagcagggctttaggtgtttggctctatcactgttgccttattcccttgaaacagaatctctcactgaatctggagcacaccctatgcttgcagccagtgagccccagcaatctctctataacaggctttttacaagggttctggagatcgaactcaggtcatcgttagaagtcttacccattgaatcatcttcctagtgctgggaaaaatcattgtagtaagtgaccttctgagtgagggggtattgatcaatggatacatagtttcccctcaactggggagataatgcattctgatgataacgcatcatatattcttacattgttaaaagaataaactgaacctttctataatataaacatatatcaaaattgattctctcctataaatacacacaattattatcaatgaaagataaacacacatacatacatatattaaaaattgagtaggcaagacccaattagcatctcagagaatttacatatttactatcaagagcatcttttgcttatgcccttattaagggtgaatgatcttttaaaaacatctttcttttttcctatggtggagatcaaacccatcatctcatgcatagtaggcaagtaacctaccagtcagttacacccccctgtttgggacaatgtggtatttacattgaagaagcttggctataatgggaaggagacaaggctcaggggagatcagggtactaattttgtgttactttaaatacaggattgagagaaagctatttatgaggcaaccacatagaatcagatgataaagggtccctgaggaagctgggggctagtgattgaacagaatgaatgtggagaataatactatacttagagaaaggcaactagctctttggttgagacaacagagaaagggcaaaactagtgatgctccgaaggacagagctgtggagggctggtcttctgagggtggtcctcttgacaagagtggtgaagggctcaagtggcatttgagaaagatgaaaagaagggtgctccatcaagatacatgtttcacagcctcatatttactgcaaatgtatccatcttttgttaattttatctccataaagctgcaaaaaataaaatgggtctcaactattgtgctttgtttctccctcaagtcacagaggctggtttccattctttccggcctcactcaccagccaagatcttgaggcactatgaacaatgtagtttgagagatttgtccaaatggctgggacagaaattaacaaggtcagagattagatggtgccagcaagtgaggagttgaattgacagatcactcaatttcatggccatgactatttaaaactacctggaattcaaggtattttgaagatatggaaatctcctgtggtatctgcactatttcatgtttgtaggtttttcagtttaggtcctaggagtgccttagtgtctgtgccttcaaattattgccagtgatataccagaaagcatggttatatctgctgagggcccactatgtgttggctatgaggtcctgaaatgtgctaggcacctgcatcgggtctggccatccaaacatttgacatgtattggagacagacaccactctctttttcgggggagcacttcagcagggaaggcacgtgttaaacatggattaaacaatggatcagaaaatttgttgctactgggaaaagttctataaagttcaacttttgaaaaatcagttattctaacagatttttttttctttccagtttacattcatcaagaaagtatgagaatcccttttatagttctcttttagaaagctgagcactggggctggagagatggcccaatagttagaagagcttgctgctctttgagaagtcctgatgctggttaccagcacccagcacctgcttcagggacaggacccatgtggcaaatacccacaaacattcataaataaaaatcaatctttttttttgcaaaaaaaaagcactgctgaaaatctccttttaaggggagcagctacttctcaaatcaaggggaaatgagctgatagctgtttttccctaggaaaaaataatctctgaagttgtgattattgcgtttagcaaatgatacatttctttttctcttaaaactagagaaagcaagaaaaagtaaaaattttgtttggtctaaatgtataagtatcatgtagctccttcattttgtttctgacttgtattaaaggtataaatatgatctgcatcttttggttatacaatattggcttacaagacatttggtatgattaaaaaggtgtaacatttgtaacagaaagttaccttaaaagtggtaactcagggttggagatatttaaaataacaacatgtggcatgatacagcccaggaaatcagtcctgtatacttctaaattgggataatattttaagtaattcttatcgtagaaactagacttattagggataagatttaaaacaatgtctcccttttaaaaaaatcaatcttaaaaagatcaacaacgtctgtctgtaagaattgacacccaaatatttaaaaaaattatttccaatatgggtggaccatcttcttttagatttctcttgaccatttgattttcctcccttaagacttatctgattgtattctcttgtctattgagtatttttctctcttctatgatgccactaaccactcgcttttcttttcttctcaagatttggagagtccaccccatcttttctctgtatttataattatttctttctatttcctttcaacctcttccttatatagcttggtgtgctcagagatatgaagatatttttattacttcacccagtaagagttaaaatataattttattgcctctgcttatcttaattcccagagggaaatttttttgtttgtctttttttccagacattgtttgtatgcctatataagatattccaatctattcattcatccttcccatctctctatattgagaaatacaaatgggaggggatctagaactaggtggaggttcaccatgagcaggcatagatgagcttaactatagctttggcatcagtaactgatctgatggcatgtatatttctctatgataagaggtaagaccagcctcttggacaggagttaaagtagacagggtttggattgaatattagagtcactcgagcaataggtattgtggagaacaggaaggctagtccgacccagagaagcatatttgtggtgcccagcagtgttgaggtgagcttggtgatgaagaatttgtgtgggtaataatctaccaggcccatcttcttctttcactgtatcccaggagctctcaggaaggcataaaagacacatgagctcagatgggttttaaaaaaggagatatttgtaatgaaattaggagttaatgaggacactgacaagagtgtatttgaaataatagaatccaaactgtctaggaaaggaagtaaagacagaaaggggctgaccagatgaaagagggtttgtagaagactgttaagtgaggtcttggagtaggaatgacttgggagagatcactgagtgaaaaagttggaaggatggactgttaaattcggagaggagtattgaatcaatgatgaaaaaggtggagaagttctgcagaataaactcttgggtgtggttgaatgataagtggtatttttgatgccagctaattcactctacaaatattgattgagtgtatttgttggccaagcagcactctagacactgaaggtacagagatgaacaaaattaagctccatttcctttcccctccaataatatatttcgttcatacagtttacaatcctgtagtgtacacacacacacaatttttacatttgtaaaataagaggatagtttgctgagcaaatttctctctgtgtaattttatttagaatactaataattacaatactaacagcaaatacttatatgtgtggcaaagaaagtccgcctaggtattttgactgctttcctttttaaaattctacttatttcattatgagaatttgtatctttttctcctgagaacttgtaaaggtactttcatgtaccttgtcagttctgaaaatatagaaatgtacaaacctactttgaatctttcagtgtttgtagcttcttaatttttgtttttgaactgttagaacagtgcttctgcagtacaccagatgttggtaatgcatgtactaatcttgtgctagggatttgaagtaatgtgtcaagtaattatggttaaacagtttaggaggcaaggaacacttgcagtcagttcgtatattacattttatttcgtagcttgtaatttctcttaccttttgtgtaaacattcgcacatatttattagcattttacttgaatgaaatttacactttaaaatggtctgccacatatgcagctcagttaaagttcaaatgcaggttatttggttgtgcttaaggtttctatggccatagctagatcacagcatccctaaaattaaaaagaagccaaatgcatgaaattgcagctaggtgtgaacatgggctggattagtcatgagccgtcatgacttctcatttaagaggatggtgtgggtgctttgtaggtgacgtggcctgagagaaacagatgccatttggagtttagtttagaaatcactaccatctgtgaccctggcaaaagaacagggtcttccctgtggggtttctgctttatcaaagcttatagaacagggtatgataattgagttacaaggtgataagctttattgaaaaattacagccttatcacacttaaaaatgattataagtgaataagattttataatatttctttatttggggagagtaggtttaggggtgggtcagatggatcaaaccaaaatcagggctttgtgaatgctagtcaatgctgtcccactgaaactggctcttgaatatttgccaccctctttatatagaccaggctgacttttaaaatcacagtcctattgccttagcctcctgtttgctgggattccgggtatgcaccactatgctgggtggttttgattttgaagactcttaggctctttagtatacaaacattaaagttcttaaggtcttcgatgtagaaggtagtgaactgtttggtcttttaccatcaactgtatagggccttatggagttgcctggcttacacgagaggacggttttctagtgcagattttgaaagttagagatttaagtaggattgtcttaatagctatttctcctgttgccaaatgggacatttggacccatgatctcatttttgaccaacaatctcatttttatggtagttaatacttctgtgagccatctgtatgaagacctgcctctaggatttgtggtgggtttaagttttgaggagtaggtttttatgactatgaaatcatgaaaagaaagccacattgtgcacacgcttttgcatgctgctctgtaagggcaatgtgtagagtttcagatctagcttccccttaggacttcctgtagagatgtatagagtatatgaagtggaaatttcctcaaatcatgcaggatcggtatttgacgattttgaaatgtaactatgtagatagcatgtggtgaaagctgtccccacacatgattttaagagctaagtgaggacattccatcttggttcctttggctcccttcggtgtgctcccactgtccattagaagaaatgccctagatagggagagtggctctttccccgtctgcagatgagaggtctcggcagactgagggcctctcaaacttccatccattactacataatgactttaaatacctccctcaagttcctaggcataaaatgtccccttttccaaatgtcaccatgcagaacactatttctagaatgtaaagagatcgtacaatcaaatggctaagaccttggactctggaaccagactacctagtcagaaaattagactgtctcttccaggggtgtgtaaccttgggcaagttatttgctcagtctgtgtctcactttcctcctttgtaaaatgtacacaatattttagtacctgcctcatggcgtgattctaagggctaaatgactccaggtgtagaaaagtgcctgatacatacataatccatgctatagaagtgttagctgctctcaccttccacacagtcctcatcctagttggtgtatatcttaaaaggagctaaaactgcagagcgctgcagcacatacaaacccctttcatagaacccacttagagaaaaaaaaaactattcgagactgtaaagcttcaggtagaactgtgagctagctgcaaatttcttgctatcaaggaaagaagagaaaaccaccttgctgctctaaaactgttgatggcaggctcagagaggtcaaagcctggggcatgtgtgacaggaggctgtgctctgcagatgacccagccaggggccgccagactgcaggtgaatccaggtacttgaccgtgaagcctcacttgctctttgatgtaagagccttggctttgaatctttttctttctccccattcctgttttcctttcttccccccttctctttttgatcctactttaaaaatgtatgatatttttccatgttttatgtatctttataagtcactttaaatcctgtctggaacagtgtataaataattatctttaaaagcgatcatatctaattactaacatttgcttaatatttatgcttaccagtctacatccatgcagagaggtacgggcaagtttccatctgggcaagaatactgattagatttctcaaatttcatagaaagatgtcaaaacagccatatgctcatatatttttccaaagcatatggttaataataattaaaactaagcagctaacaatattgggtttttattcgaggccagacactatgctatgccttttactcacaatgcctatttgactccccagaacccctggcagttcttgttattgcctttctttctagtgggaaaactgagacttagcgagctcaaataacttttgcaaacttcatagaaataaaatgccgtgaacgggcagcctggcttcagctccagttcttttaagttctcttcttatgctatatcgtccttagttaggaatctagtgcatcagaactccatgtcctcataacggaagctctttctgtgttatacaacatttgcagactttacctctgtgttacctttgcgatttttctcctttccctctctactacttctgtgctctgacctcgtttcttgtcatttttctcccagcatttatgtcacacacgcacacacacacacacacacacacactccaaacagtggtctgcacaactgtgtgagtgctctaaagtgtccttgccttacctgaaacacttcagtgtgccctgtgtcaaaagctgactagctaagcatctgtgcataatgtgccaagctcccagagacctcctgagcctttatcaccctccctttatgctttgtcagtcattatcaccacagtgcttgctatagcatgttgctttatgcccccatgctttttcctcttgatggaaaacccttgttctactggtaaaccagctgctacccattaaacttacattcagttcatgtgttcctgctgacaattctctttttggtctcctttccacccagatgggttaaatgctccaacttggtattcttatgctatcctatgcgtgtgtgtgtgtgtgtgtgtgtgcatgtgtgtgtgcgtgcgtgtgtgcacacatacacatgatcaatttttacattttagagactgtatttaattttaaaattgttgagaattttatatgtgtatagaatgtgttgtgatgatatttacctcattacttctgttgtcgctctcaccctcctgctaacccctcctctttccacactagtttccctctttttctattattcttacttttctgtgcatatctgataacagtacctgcagctgctgtgtgtgaacgatggcaatgattatatcctatccagaaggtacttttttaaaaaaagatttatttatttatttatttttatgagtattctgtagctgtcttcagacacacagaagagctcatcagatcccattacagatggttgtgagccaccatgtgattgctgggaattgaactcagaaactctggaagagtagtcagtgctcttaacctggtcaacaattcacgggaagctatcctgcatttggtcttaggatttcatttaagaatacatggattctaagaatagcattatgtacctctgatgcatatctttctttgtgtaatttttaaatgattatccaagagtctgcttcttgggttgtgtgctttttgtggtcatgtgctgtgctttattcctttattcttagttagcttgcatagtacttagaacatagttggtccacctagtcagtgaccattttgtacacagtgcagaattcagagccctaagcctgggaagaaaccatacaaatattcagaggtaactactaggacagtagaaggtggtctcatgggaaaacctgtggggctagataaatttatacttacaagtccagaaggaaaaaaagggggcaaatattcctagacattaattgtgatagtgtttttggttaatctccttcagatattgtcattgccctagtgacagttaatttggtgcaatgaatgcaccaaaaagaacttttaaactttggagacaccaacactaacagctttgctatttgaatctatgctaaatttcagtagtctagactagatagttgagatatatttatttccatgattatgtttattaaacacttcaccctaaagtggagaggaacagttgatacaacgaccaatacagcattccaatgtggacattgtgttgtatctagtgccttggtgtataacagaatccagatgggatttctggaatcactgactccctagaagatagcttgcttgtttcaccctatatattgttgttgatgatgatgatgtttgtttgattggggtatgtgctcatgagtgtgggtgattggtgatgccaaaggcattagatatcctggagctgggattccactcagttgtgatctactgacatgagtggtggaaagtaaaatccagtcctctgtaagaacaggagcctctcgttaacaatcaagccgtccttcaagttcctcacctgtttttgagtaatattacttgtgatgtatatgtttaaatagattgtatttttttctttttaatattttagagatgtgttctgcttttgtttacatttgtttataataattaatgtgcttttatcataatctctgtgtatcagtgtgcaatgtacttctgtcccttaaactctaccttttattattatttctggttttaagtgacttgacaatggtctactttccttatatattatgaccataactttccttatatgttattcttaaggttcagtgtacttcttgtatctgtgatctcatagtacttttcaaatttagtttattagtcttctgaaaacattttagtgttccaaatttcattgattactctagaattatactagacgacttagagttgttgggcaacccattaaatttctttcatagtttttcttgctgtgcatcattttgtagattgtgtcttcattgctaattgtcttttaactacaatgtctaatctgttgttaatgccgtgttctgtatgtttgatctccatcactatagttttatataaaagacttcagtcttttatttttacagcttccaaatccctacttaacttttcaaacacatggaaagtagccatagtaactatttttagtggccttgttaaatccaatattggaatttgtggaacatttttaattatcttgttccatattataagcagaattgtcctgatttttggcactagaaatgatgcattttacctgattaattgtatatttttgtatcataaacattcttgagctctgctttgggattcacttaagcaatttggaagcacttaagttacctgaaagtagacggctcctttcaagttttttctggttagatttggtaggaaggataagaacaactaataacgtaggcctaattgtttctcactactaaaatatacgacagtacgtttagccagtggtctatgaatcatgaggttttctagtctggctgtgaaaagaggcactccttctggttttatttgaatgctaggcatagtgctattgaatcctttcaggtaggtctttccctagtctggagtaatttcatcacagggacgacttgcactggacagtcctttgctaaatacttgagagaggatatcagttggtgcttgaggggttctccttttgctgttctagcacattctctgtctcgagagctccagtcccctaaggtttgctaagattctcagccttctcactctgggaggcttagctggctttccctggtttcctcctctatacttggcttgaaaatgctcaaggcgatgagttctaaaaatgagaaatctcaccctgcttatccccatccatagagattgtagccttgcactgcctcgtttacagtgtcttgaacaccatgttttcatggattttgccaatgtattgtatgagtagatctacattctctactacttcatcttgaacatcagtaggtgtgatgtttggcacatctcagcgattatgaccaagctcagtttcagttgtcatcctccaaacatgtaggcagcatgacattacttgtttgacataactaaatcaacccctaaataactatatttaaatgcattcagaatctggtgtctggtattgtaaatctcacataacaaatgagtgtctatgtatactatacaaatattggcttaacaagaattcgtttaattcagaccttcatggataaactaacatcctttgaacaaatctagttccctatgcttagtaagatattaatttttaccaaaattgttcattatcctttggtgggaaatgacagttaatccattagagatgacatattaaaaccatcatatgattagcatttgtaagtctagaaaaaatatttactatcacttcaaccttttatcccttgagcatgagtcaggacttcagaaaaccttctgtcagtgtaatttcttatttaaaaacttctaaaagaagtgcatgctgtctggctagagtttaactaatgataaactcagattcttcaaaagaaaatgaacattttgccaagatgtagtagaatctgaaaggatgaattctcatgtataaagcgatgacctatgggctggggttgctcagtggtacacagtagttacctgtgagtgaggctgtgcacagcatctctgtcttcacataacttggagcattttgtgtgtttaaaactcatttgccatttacaaaataagttcagttacagatgtataaattaattttacaaataaagaaggccttgatgaggggtaccaacttacccagagtcacacagtgaatggtaaagttgagattcatattcagtctggctccaaagcccttgtgtttaatcctagtatccatactttatcagaaaaacaactgttttttcctctttcaactccattaccactactcagtttttgtggatctaaacctaaacacataaataccaatatctctcagtgataacgctcactaatcattcattaaagtcaaactgtatatcagggattggtctaaatttctgggtgtctatatccaacaatttctcctaaggaggtcctatctggcagacatttcgagtttgaacacaaatattatcatcttcacattaataagtagccttcacgtttgagagacagagcaggtattcatgtattcaacaaatataacacagagccaaatctgtaatatactcttcctactataagaactgttttttttttttaaattcacatcacttttcattattagaacaccatttagtagcgatttttaatctgtatgctattaaggagatgcatctatctgaatgactttctagggtagttccgaaggtcatatagctgatatatagagtcagagttcgcatccaactctgtctacatcactatttccattattttgtggtttcttttttatttaaaaattttttctttaaaatttaagatactttaaggtagctcctccatatgagggtttgtatctagtctcaaactgatatctctgggaggcctgctcttttctgaagggaaatggagaagtagtagatctagaggagaggggaggtgggggaggggaactcggaggagaggtgagaggggaaactgtggttggtctgtaatatatgagagaagaattaacaacaacaacaacaaagagatagcttcttccttctcttcttaaaacctagttttgttggagttagcattaattctcctacattattatttcttaatctataggatcagggtatagattctaaatatgcccactaaatcaaaattattgttcaacttgcctatatactttttactttttctgctagaactattattgattgggacatatgtcaactttctgtcctgatggcgccatttacagttcccttgctttgctattcacttggaatattatcctcatctttagcaataaatgcatgcaattccttactaaaaaagttgccttttctagacgactgttctgggtctaggccctaccaaaatgttattatcaatgaaaactgacactatgtgactacatagaacaaacgagctcaagttttgacaagtgatcttagcagtgacttggcccttttgacatttacgtctggatgggagtgaaggagtatagtaagtccttttagactttgatgtctccattaggaagttctcctatccataacttgagagtatatgagtggccataaatttttagaaaacgttgtctttctgtgtttatgcctctattgtttttctttattctgtttttcaaaatatgatgttatcatttgccctaaactgttattgcttaatgcattgcataggaaagcattacttttcattccatatagtcccttttgaatccctagggaatattttatctcgtaatatgcaaacagccatggtggcagaggtgaagcaaaaggcaggtttatttgctaagatattaaagacatggttaatctattatgaggtcttctttgacctatgagttaattagaagtgtctggcaaattttcagacagtattgagattagaattaacctttaaaattaacttcttatttaatgtccttgaactcaaatacaatttttaatttgttaaaacttaggccttttaatttattgagacttttctagtacatgattagttcttgtgtgtgtgtgtgtgtaatattccaagtgtgcttaagaagaatactttcagctcaatatatagtttttatatgccatttaaatcaagtttcttttcatgctcaacttgtttatacatttactaattaatttggttttaattttttgagacaggctgtcatgtaaactaggttgaccttaaaccttctgtggagcaaagaaagccctgaattgtgatcttcctgtgtgtgcctccagagtgctcggggcggggtttacaggtgtgagccagctgttaactttgctgttaagctgctggcatcgaacccagggcttcagactccaacccatctttcccttcattctcctttatcaacaaatgcactcatagggttagagagatgatgctgaataagaatgcctattactctcccagagttatgttctcctagttatgttctcggcacccatgggattggcttacaactgcccagaactccagctctgtgagatctggtgccctcttttggtatcataccccttgtatctgcatgcacgtgatatatacacacacacacacagacactttaaaacaacactcatttaaataaggcagaaatccatatcctctgtgaaaatcctcacatgtaaatagcattctcttttttttttgtctctttctctcctccctcccctgtctatgtatgacagaattagatacttctgtaagtttccatagatctaatttaaaatttcttgatagcacttgcacaaagtactgtgttcatgtgtaagtttctggaactcagcgactgtggtttattcatctcggtgtccccagtgctttcacagagtggtgctcaacaaatgctaatttaatgggagaagctgttctcaagtgcagaggtagtgcctgttatttgggaggtagcgggggtggtagaatcttttgaagcattattaggaagatgactaaattccaggaacacatgaacaagtcagggatggagaattcagcttaaactggcagcccccttaaatctagagaccacctacctgactatctgagttaatagaattgagagttgagaacacttacaataataaaagttggatgatgatgagggcggccttcttggagggagagtttgacttagctgccttataatccttcctgactaagatgcttattctgaatgacccagccactttccagagtcatgagtaattttttgaaaaaataaaaatcattctaggccaggggttcaaatgtgaaagtagaaataatgaatcgcaaactttttttttttctactttgtctctttagctttaactcaagaagaaggtagcctgggggggggaaatgttctagggctgggcagtgactctgcagttaataatcttcatgacattaactgcttttttattttagacacatctggtcactcttcttgcccaggttgctttgaaggaagaggaggagcctaaagccaccatgtcggagatactagacctctcttttctgtccgagatggaaagggatttgatcctcggtgttctgcagagagatgaagaactcagaaaagcagatgagaaaaggattcggtaaggggcccagaaatactaagcccttgcaggctttcaaccaaggagactcaagcttttcagttgtttcttcattcattgtcggcatcgagtaaatgatttaaagctgcgtaggactgctgggctctgcatttgttgcttgtacagaacacagtggtcttactggcatcctctccacttctgtacatcctgaacccacttgtgcttctctttcctgtcttggcaggcgactgaagaatgagctcctggagatcaaaagaaaaggggccaaaaggggcagccaacactatagtgatcgaacctgtgccaggtgccaggagggcctgggccgcttaattcccaaaagcagcacttgtgtgggctgcaatcatttagtgtgccgagaatgccgagttctggaaagcaatggctcttggaggtgcaaggtgtgctcgaaggagatgtgagtatcacttcgtggcagcataaagagggggacatatgtcgggctgccctgagactttctctcatcaattttgttagttgagtgacaagagtcattgtttctacaggtcttacttaaggtttctattgctgtgacaaaataccatgaccaaaaagcaaatttgggagaaaaggagtttatttggcttacacttccaggttgctgttcattattgaaggaagttggggcaggaactctccaacagggcgagaacctggaggcaggtgctgaagcagaggccatgcaggggcgctgataactggcttgctttccatggcttgctcagcctgctttcctgtagaagccaggaaggatcacctgcccagggataacactatccacaatagcctgggtcctccctcagtgagcactaattgagaaaatgccttacagctggatctcatggaggcatttcctcaactgaggctcctttctctgcgataactccagcttgtgtcaagttcacatacaaaaccagccagtccaacacatctgacattttcttttattttttccccccagagagctgaagaaagcaactggagattggttttatgaccagaaagtaaatcgctttgattaccgaacaggcagcgagataatcaggatgtccctgcgccagaagcctgcaggtattgttcagggctagaggctgtttgaaggacctggccttgaagatagaaggcttgtgtggaatccagctgtattctggctagtggtgccttaactccaggtgctcagccagtctgtgtgaatagaagaggctgtatctagcctatctgcaagcgtgtgttttggggaagctggtttgaaagttgtttccttcccttatctcattattacatcctgccatgcttttgttttgaagtgaataaaagagagacagcggggcagtccctccttcagcagacacagatgggtgatatctggccaggaagaaggatcattcaagaacaacaacagagggaacaaaggtgagagccaaggaattagtattatttagttcttctattactactacttcgttttctaaagtaataggtattattagagggaagttggaaaatgcagataaaatcgaaggaggaggaggaggaggaagaggagggaaaagaatcaatcctgattccactagccccaggcaaatattaacatttaggcaaatttattttgttcttaggctacactcccctgtgaaaaagaaatctattatttctttacaagggtttatttactttaaaagttagtgtctgttggcaggtgtgtatacttgtgggtagttggctgcagaggtcagaagggtgttagatcccctggagttggactcataggcagttgtgaaccccatgacatgggtgctgggagccgaacttgagtccctctgccagagcaacacacatcattaactgatcccccagtctcatgttagctttcttccacacttccctaatcttttcttttattctcgttgttcattactaaaatttatttaacttttcaggctttgtgatattttctttctgttatgcaatcataaatcaacagactttaaaaaccggtttagttttagtttcgcatttatgcatactgtttgcttacacttaggcctggaaccgtgacttctctactcctgaattctttactttggctttatttcttggttgtctagattttgtcatcggggagtgctgtcaagaagggtttgtgatgtttattgcattctttcatgttcagaatacctgccaacgaccttggcagttgcatattacagacttgagtcatgttttctttctctcagactattgtagatgttgttccattgtcttctgccattgaatctaactatgaaaaagaccaggttgacatttttacccttgtaggtaactttttgtgtgtatatacacacatgcacacaagaatataaatcaacaaagattactctgtccttttttttgacatatgatatactcttcatgatccttttctttatagttagaatttttctggaccacctcttgaacatttttcctgttttgttaatttagggccccaccttgggaatattggattccacgatcctctatttctataatgttttcaaaagtgtatgatgtaaaagcaaaagagaaatatccaagcacttaaccatagagactccagtgtcttcgttcccttcatgctatttgggtttgcaccattcctttcctttctctctgtcttttctgttccttcctttccatttgctgactttaatggtttgaggaaattatcttgtttagatttggtttttcttcaattgtttttatcattttgttgttttatcatcttgtatttgagctcatgcactttagaaagtctacattatgcttgtgcaagcagaataaatatatattatgcaaactaagatggctgtgacattgttatgggatgcaaatttgtgggcccaccaccattcaaccattcatatatatatatgtataaatatatatatatgtatatatatatatgtatatgtatagtgtatgtgtgtgtgtgtgtgtatccatcctctttgagtaactaccacatagctgggtttttaaaattagttttattttttaaaaaagatgcaaaattttattttggaactaaggaccacacccagagcctgtgctgctagtcaagtgctgtaccactaagctaaattttcaacccaagatttaaaaaattttaactgattctttaaaaattgtgttatacttatgggatagcatgtagtatttcaataaatatgtgcaataaattaatgtaatgcttaaatcaaggtgagcagagctacttttcatatcacctcttacggtgaaaactttcaaaactgtttattttttaaaagacatagtacacgttatcttgtgtagtcctataaatgcagagttgcatactaaaacttcttacagtgatataactataacttagtaccctcccattctcccttgtttggacaagcactgttttgctcatatatgcatgggtgttttgcctgcttttatgtctgtgtagcacatttggactttgtgcctacagaggccagaagaggatactgggatcgcctggggttggagttacagatgactgtgagctaccatgtgggtgttgggaattgagccaggaccctcatgaagtgtaggtggtgttcttaatcactaagccatttctctggcccctgttggacttatttctctgtaaccctagaaaagaggtagaaggtgggttgtagtctcaatgtttgtctcctgaatttttataatcctttgttttatattttttgtgtccgtatggtgtgcacgtgcacatgtttatgtgcatacatgcgtgcatgtttgtgcgtgcatgcatgagcacatgaggaaggcagagaaaatcgtcaggtgtctggccctaaatatcctccaccttcttcccttggaatagggagggtcttccactgagcctggagactaggctggaggtcatgtctcagtggtgcacttcctctgcttccacataaagacctgggttcaggcacgtgatgatacctggattctagggatttaaacgtgctttcccctgcctgcaaagcagccattcttatttactgatccatctcttcagcatattctcagcttccaaaccctttgttttcttaacttctttttttttaactttgtcttatgggcatatactttaccccattcatttgttgttggtgaattttaggcatatgtattgtgaagactttttctttaattttacctcagccaaagagaaaagtttttattacatcttttattgatcataagaaaatgagtatagagctggtggcacatggctgaatttgaaggtattttcgaggctgcagtaggaagggcacagcttgagggcactttgggctatctagtaaaagcaaagattacaaagaagtctacaagaacatggaggttaaatcctctaataattttctttgtccgatcgctgttaatagtcattgataattttggcatgtgaattaccaagatctctacacacacccatgtgagttaaacacctgaattttaattgtttttaatagattatattagggacatgttaagtttaaaaataaataagaactttcaaaacagtagtgcaaacaatcccatagaaaaggagaaaaagatctgaagggatatttcactaatgaaaatatgcaaatgtcaaataacaaagttcaacactatcaataactagaacacaaataaaataacaatgagatgctccatgtccactagaatggctatcattttcaaaagatcggttataccatgtgctggatacagaacaactggcattcctattcatttctgtggataaatgtaccatgctcagctgctctttttgttttttaaaagttcactgtacatttactatgtgattcagatgtttcaaagatctgtaacaagagaattcaaggcatatgtccatcagaaacttgtatatatatcacagaactaattaaaattagtttgcacttataaaaccccagaaaaccaaaattatagtaaatgtagtcactataaatatgtagtctataaaaacataagatggcatactaatagtagtgatataaatttgacgtgctccatgatacttccttgtttgtcttttctttctctctctctcttttgtctgtctgtctgtcttttgatctttctgtctttctttcttgcagactttatcttgtgtagataatcataggtgcagtgagtttctgggtggtgagttttctgactgtactgtacccatgtcatggcctcaacactgcctttagcttttccattcttttcacccttctgtgatgttccctgggccttggcaggggatgggaggacagttgatctcggtgttctatttagggctaagcactcaacaggcaattattttcaggactctgataggttctatctctctgtaataactgctgaccattgcagagagaaacgtattttgccaaagttcaggcaacatcaatttataaatgtaaagtataaatacttagaaagcaatttgacaacatgtcatttaccaaaacaacagtagtaagcttttctctagggcactggtcctcaaccttcccagagttaatacagttcctcatgtggtgctgattccccacaaccatacaattatttatgttgctacttcataactgtaattttgctatgttaggaattgggatgtaaatatctgatattcaggatggtcttagatgatgcctgtgaaagggcccacaggttgagaaccactgattttggtttataataccagaccttagtcttttttgtgaaataactggttatcctcataaacgttatgctactcctgcaccagtgggtgcatcttgcctagcaggtcagtatcgtagcatgtaggattggcttcagcaataccactggtttttgttttgttttccctcatagtaacctacggagctccttctagtactatgaaagcttataggcaaaaatgaagtagttgtatggccttgtcctagattctagtttattggtctacaaatttgtttttgtgatagcactatgtgtttttatcactgtggcattgtagtttaacttgaaatttggtatggtaatgcctccagaaatattctttttcctcatgttggactcctggggtctcttgtgcttttgtgtgcgttttaagatttttttccttctatttctatgaagaatgtcactggaaatttgatagggattacttgaatctgtaaattgcttttaggaaaatagccattataacaatgttgattgttttttccaattcataaacctgggcggtcttcccatgttctagcagctccctcagtttcttcagtgtgctaaggtttttagtgtagaagactttcacgtccttgcttaggtttatcccagggtacctttaggctattatgaaactgtttttgttttcagcttgtatgaaattgatatatagaaagtctggtgacttttgtgcattaattttatatcttgccattctgctgattatgcttaaaagatttctggtggtgtctttacgatctgttatgtatacaccagcttcattcatgatagttaaaacctggaaacaattgaagtgcccaccaacaggtgaatggataaactggtttgtttatgccacaggatactgatttcttaaggaacaatctattgataacatagtattatgaatgtatctcaaaatacgtatgttgagtgaaaagcactaaacaagaaagtactcatgttctgaatgaggaagtgcaaacctctagtcccagcagtttggagatgcagagttagagacagaggccagaggcagaaggcagagtcaggtggatctctgtgagtttaaggctgccattgtctacatagcaagttcctggccagctagaactaaataatgagaccgtgtttaaaaaaataaaataaaataaaaaccctcaacaaatcaaacaacaaaacagaacaaaacaagtaagagtacctggtctaggagtctatatgattctggtatacaaatttccagaaaatacaaactaattttcagtggccaaactagatggacatttgcctgggaccaggagctagaagggaaagaagggattgccaacaggcatgaagacacttcaggagagtgattaatgtgttccctaactaaactgtagcagtagcctttgaagtgcctatctattgccagaaatcattagcgtgcgtaattaagcacgtacagcttgtttgtaccaattagttaaaaccagcagaaaactgcaacacagacgcttttccaacgccagagcacttgattgggttttatgtttgtgtgctgctcgactgtatatatggactgtgattttatcagatagccttgggtgcatgagtcatctgttctaggtgatgagcccccccccccgccccctattcctttgtagttaaggttaaaaatggcttttatttgctgaacttgattaacgcatctgacatcactggtcagaatgtaatttctgaaatctactgcttctggctgtctgcgacctcttgtctcattggattgagaagcctcatatttgttataaacatgaaaactgattgagtgcgcataagtgatttttacatagaaattatggagcctcagagataatttaatgaacccttttatttttatagaaaagaaagcaggataaatcatttacctgagatcacacagataaagaccaggactcctatctctcagtttatttttactgcacagatgtcaaataattgcttttttgccttacggttgtttacatcagctcaggatcagaacgtattcatctttaggggaaaaaaaaaaagaaatacaagcaccaaacactccatggactattgttgaacaatgtctctagaggaatgattctgtttgaaattctttttctctttgcattgaaggggacaaaaggatgattttaaagtaaagaaaaccaagcaagcgccttgctgtgtcttgtaagacaaagctggtacatttgtcaaaaatgacctctgtcccaccgcctgcagacgctaaagtttcaactcagctacttctgtttgtttgcacagccctatctcaaacatcacctgacaagctggaaagtttattctctactggctgagacacagagacattagagatttggttacttgttcatttgttaaatatatgtggaagcttactatgtgacagatactcttttgtgcgctgggatactattatggatacagaagggtcccttgtttgtagattgtagatttggggctaggaagcacataaagcaaatcaaaagcaaataatcaaataaatagtctgccagatgttggagagtgtgatggagacaatgacctggaatgaacagatatggagtgtgtgtgtgtgtgtgtgtgtgtgtgtgtgctctgttttccttagatagttaaggcagatctgaattgtaaggtgacatttgaaaaaactgcagaggcaaacattgagagtatttggaggggaggagcattgtagacagaaatctcagcaggtataaagaactcaaagagtctgacacaagtgtagtctggagttgagttggggatgcttgtgcaaggaaataagcacagaaatggatgggaggccagttgcataagactttgttgacctctctagactctaaattatattgaaagagagggaaagatgtcaaaaccaatcttatgattattgtctcttttttgttgttgttgtttaaaaaccgaggtaaaattcacatagcattaaaccattttgtaattttgtaaagttcagtgtaacaagtgttcacacttttaggatgtaacacaaccatcacaattactgattgtcagagtattcctatcagccccaaaagaaaccacgtccatgaattagccactgctatttctttcaggctggaatctccattctgcctttctggatttgcataccctgcatttgccatttgaattgagtcatacccaccatggacatttagattggtttctttcagttagcataaagtttacagtattcatccatgttgctgtagacattagagctttggtgctcatttgtggatgaacaatagagctttgtattgctatacagtattttggctctcccgttctctgtagatgagcaattggattctttctaccttttgggttataagaataatgctacgagaggctcagttgttaaaagcatgtatccctcttgcagaggacatggatttgcttcccagcacccacatggtgatttataacaatcagtaactccacttccagtggctcctgtgccctcttaccaacccccatgggtaccaggcattcacatgccacacaggcaaaacattaatatgcattagataaataaatgaacaaaatgctttaaaaatcggggttttagggtaggaggttactgccaggcatggtgttgcagacctgtaatcctagcattccagagtaagtttgaggctagcctggtctatatgaaaagaagtaaaggcttgggacatttagaaagtaggagatcgtagtgttctgggatgtagggtgcagccctaggtatgattcccactgttgtaaaatcaaatcacatttatgttttaaaaaaatatcgctcgggttactactgcgagtcagttggagagatatctatccagagtcaggagagttcccctcttgtaaaacagtggatcttggtttttattctagtgtgctgtttgaagtgccaaagaccagaagtggaaagagtgcactggaggctgagagcgagagtctggatagctacactgctgactcagacagcacctccaggtggagtttccctgtttggtcatccgtccattctgagctctcattttgttctctagcatcaggatgcacgtttcttctgccttcctgctttctgtccttgggctgttggatggatctttcttctaacctcaccagaagtctctctttagtacctctgttgcttggctctgagcactgcttcctggagtgagctaactccccctggatgctgcactctggaggattctgcttctgtctcttgggagaggatgtgtgcgcgtttgtgcgtgcgtgcagagttgtttgcccgatcttctgcactgccttggatggatgtgaaatgggccttctcagttttgttgctatagtgatggcaatgccttgccttccttgttagtgctttggggcctggctagaagaggaaggggaagcacggtttggttctaacttctgatacttctaggagagattctctggataaatctggactcttcccagaatggaagaagatgtccgctcccaaatctcaagttgaaaaggtaaactgcaggctgttggttttacttctcctccctccctccctccctccctccctccctccttctatccatcctcttcttccctccttcccttccctctccctctaccctgtcttcatatctcaagtcaggaattcaactaaaattttaccccggcttcatttggaaacatttcacaggtcttggctgaaatgtgcgaacatgagttttatattaatctctcctttaactttgtcatagttggattaaaatctgacccataagctgttcctttggtctacctgctagtcttccccaccacccccatgtccttgaacttattcccttctaggaaattccaccagggaaccaaaatgcagtctgtggtgatgagggtgacatggtattcaagaagaacaccaaaaaagtcctgaggccttcaggtagcatctctgtcactgcaatctgcggcttgtgttctaagtgctttggctgggctcctggtatggagtacagcagtttccttttgacttaaagttttggtctttcatgcagaatacactaagtctgtgatagaccttcgcccagaagatgtggcccaagaaagtggcatcttgggagacagaagcaaatctgtaccaggcctcagtgtggatatggtgaggactcttacatttcacttcagtaccatattaaaattttaaactttagaattggctttagtactcaattctctcatcctaattgtttaattctttggaaatgtgaaatgacttttaatttccccaatttccgaagtataccagcaccttcatttgcttaaagtattgtctttggtgtggcttaccattatcaccttgttggatatatggttggccacgcaaacaaatacttattttaactaaaatataaagagaggagtagtgagatgactgatggggcagcagcacttgctgcaacagcctgacaacctcagcttgacccctgaagtccacagtaagatggaaggtgagaaccgacttcctaaggatgtctttggctctccacatgcatgccgttgcacaagcatggttgaatacagacatgatgatgatgatgatagaatatacaaacagcaacaataattttagtaaaaatttatacaaagagatggctatgctggggtattcaaatgggagagttatagaactcccatgaaaatactaaatacttgttttcttttgagacatgaagatatatttttaaagggaatacacacacacacacacacacacacacacacacacacacacaaacatgaaagctcagaagttttgcagccaattttggtcctcactgaaggaaagaccttgattctttttgaaccttgcttttattaactctcaagtttacattgtcccaggaagaagaggaggaggaggaagaggacattgaccacctggtgaagttgcaccgccagaaactggccagaggcagcatgcagagtggctcctccatggtctgttctatgtgtttgtgcttttagacacactggggcaccaggaagggaagaagagccatctgtcattagagcaaactgggaaaatgcccttagtcactcttgctagggcaggagcatgcatttgtttcttactattgtcactgtagagcttaggtgcttagtgtggcttctaggtgactgccagaacctctgatctggagagtctccaagaggtagccaagactctggccattctttcctcccagctttgggaaaagcagctggaactcctctcaggagaaccaggctgtgaagtaaacaagaccatacttctagacttcttaagccactccctactcttacactaaaggcaagaagatggcgtgagaaggacctttgccagcttgacatcgaggttgttgattgggattgaaggcaaaacagcctcatggacattagctaagcaggcctatatctatcataagtacaaagattgctcttttgggtgaacagagttcacaaggagactaattagatttttacacttacactggaagaaactgtagacctcaacctcatatttttcactgctactgttatatttgcatcggtggctctccagctactctcagttctggcccagtctctttcctctgtagatactgctcaatagatggtaaataagtaaggccccattttaaaccagcgaccagcatcttctagccagtgttgcaacatacataacacacagcacagatgggcttagctgtaccttacctccctactccttgtcatcattctaaagatggggacattgaccaatagattgtgtaaaatgaggtggcaagagacatcaagagtctgtgtgagccaggaggtgaactcaagcaattgtggatgtgttactttcgctgacttaccctctgggtaaagggctattggcagtcctggctccatgcaggcctttttgagacatttggcttcatcacaagggaagatgggagcagttggggattgtagtatgttttttttccctgagccatttgtaattgctttcccctcagagtacccttggcagcattatgagtatctatagcgaagctggtgattttgggaacatctctgtgacgggcaagattgccttttcactgaagtttgagcagaaaacacagactttggtcatccatgtcaaggagtgccaccagctggcctatgctgatgaagccaagaagcgttctaacccgtgagtgcttcggggacttgactcatactctgacaggagaggcagacctcagaatctattgggttactcttgaccaaaaattatcacttctttggtgacagaatagtaagatgtcatttaataaagggcttaggacttggaaaaagcaaaaatgatttttttgacctagtatttcatcatgtgccaagcaggaaactaaagatgggactcgagaaaggcaagcaaataatttagtgttgctcttggtttctagatatgtgaagacttatcttctgcctgacaagtcccgccaaggaaaaagaaaaaccagcatcaagcgggacaccatcaatccactatatgatgagacctttcgggtatacatttgaacctagaggggagaaggttttgtttttgttttgggtctttgtggtatagctttgcctctacagcatagctggaagatcattcctgtgcctgaggaatcactgtgagattcctatcctcacctcttcatatcctcacctcttgggggaagagaacagaggtgaattcccaggacccacgtgatggctcacagctgtctgtaactccagtgtcatcgatccaatgtcatattctggccttggtggacatctacatacatgtgttgcacataaacatacgcaggcacgcattcacataaaatagaagaaaagttatctgagatccagcgaggtgccccacacggtagaaagtgataactgactcctgtaagctttctctaacccccacactcatgccatgacatactcgtgtccacacatacatacatgacattcatgcactcacatgaatactaacacaaataagcaaaatgtcataaaaaaaaagttaaaagcagtgtgacataaagagtctccttggcaattgtttgtggatattctcaggtcctttcagccaagcaaggaaaacttaatattctctggcttcctatggacagtgttagggctaggaaaagaagagcagttgaagctttgagtagagcaattcaaagtgctttggaactaaaaccatttgacacactgaactagagaccaagggggacaggttgtttaggttttggaagaattcattgttgaggaatcactcctaactggccaccctgggatgtttctctcccctcatagtacgagatttcggaatctcttctggctcagaggactttgcagttttccgtttggcatcatggtcgttttggcagaaacactttccttggagaggcggaggtccacatggactcttggaagctggataagaagctggatcactgcctccctttacatggaaaggtagtctgctttaaaggtcgttcacagcttgcttcccaggtgaattgtctgtagtggcctctgctggtctgtgttggaaggagctttgcatggagctgtctgtagaactctactgcaccctgctgacctttctaagtttagcaggagcaatttcttctgtgtaaatcaggcaaagcggaacactaaagctcacatcactatccagagcctgcatgtattcagacatcctgacttgcacttcctctcaaatataaccttgcatatcctaatctgcacccccccttctgtgacaaacttcctgctttagaagtgaaaggcacaacagttgatgggtttgcaatggctgccctcttggttctgtatgcaggccagggaagccggactttagagatagcatctcagatggcagtgtaataaggtggcaccatagtgatgggtaaactcagtacagctcatgactagagtcctgcttctgtgacttactagtcacctagtgaatttacctacttctgggagcctcagttttgtcttcaacaaaatgatatagcagtgctggtgtgggactcaatgcagggtatgctttagtgtgtagcacacaatggccagttcatagcatattgccattctgattaagatgaaacagtgacatctgaacactttaggcagcaacctcttgtttatcaccatgaatccaatacaaacccctttaaaagttgtaataccattttgaatgtttcaaacaattcacagcacacagacctttgcaaagatggtctagaaactcagaacaggagctgcctcttggaactggaagagagatatacttcattatttatttatttatttatttatttttacactctagattttatttccccacctcgtccaccgtccaactgttccacatcccacacctcttccccacatcactgtctccacgaggatgtctccatccccacctcccaccccatttgacctctccactccctggggcctccagtctcttgagggttagatgcatcatctctgaatgaacacagacccggcagttctctgctgtatgtgtgttgagggcttcatatcagctggtgtatgctgcctggttggtggtccagtgttttagggatcttgggggtccagagagatatacttttatcttttcatcttattattgtcttttagttttctttgttttaaactttcaaacttttgccctgttaaaactattaagtacaaaaagatctatatatacatggttccaaattaaaacaataaaaattatgtaaaaagaaagtcagtttcattacttagatatagctactcttagcaaatatttaagcatcgctctagaatttttgtattagatattaatctaccacctacctatcatctatacatacacatacatagtgcattatttttgactaaagtgaattgaatacgccttgttcacatgtatagatacatacattatatatgtatatataaacaatttattacaggcatcactctatgccatttcttaccaattaatctcattttacttgctatataatattctcttacattttttatattataaatttatttacctgatccctactagtggctacttcagttgttatatttggaaactgctgtcatatatctttccctctgtgttcagtattggtgatccaatccagggcttcatatatgctaaacaagtgctatcctgctgagccataccctgcctcctatcttggcttcctttggggaaagtaattgtcagagaaagccttcgtggcaaaagagttgagtcacaggagagtatatctagaaaacttcagtgacattacatttctctactttaaagagccatagaaacaggaaagcaattgctatcaaagtaaaacatgctataagagtcctagaatttctgaacaatttggcatgaaaatcattctccctgtagcttggagtttatataattgtagtgaaaatgtcacctgaaagcaccatgaattgccaccaaaacatgtctttcattaaaatggaggtgcttgctctttggaaatatttttttttttggcagaatgaaaatgtgccacagaaagaagtccatcatactgaactctgaatttcaagagttcactaaaataaacagtctaggaattaacaaattgtgtagcttatgaaataaaatactgtcttatcttcctctttaaaatttttaataacttgaagttttccccttatatcttatatttaaaactttatcaaataatttaatatgtaaacttaatatgtaagtatatttcccagacttaaggttttttaaaactaaatttttaattaaaaatttaaaaatcatacatttcttcttaacttaaaataatctacagctagtgtttctgggattttttttgataccctaccccccaacagtccacgtgttaccattttcttttctcttgctgacaatccttccccacagactaaacttgtatattctggatatgcagtatgtctattgaaatatagattatacctaccagtattagcatgctcattggtgaggacgtagcttagctcagcctcaagaaatgtgagggcgcctctaatttgtgcaggggaaaactggagcataaggaaaatgacagccagtgagctaacagagggaagcagtcccctcctagagctacctgttctatgtcctggacatatgtcctatgttctttcactgttacatccattcagtcaacataggggtacccatgtaaagttggtaccacactgagtgttggcctttctgggatggacagaagtaagcttgtctcctgtcctttggggcacacagattctaatgatagagggttgttggctaaaaacttgtttaagacaggctgatataatgtagaggtagagtatatgcttagcaggtctgaggccctgggcttgatacctggcactgaagcaaagaagcaaactgtcaaatattaaaatctgtgtagcagacttttacctttccctaaaacctgtacaagctccctctcgtttttaaagtactttttacttttaagaagcagatgtggctctttttcacaaggaggccactattgatgatgatataaagtagcaaaaagtctctttgcttttcccagtatgttctcctagtgttagattcttctgtcagaaagtataaattcagtatgattgtatttttaagatataaatgaaagcatagatgtagatttattttactcaacaggtgtaaggtagagttttatgggtatataactaactatgtgttccattcaaccgagatttgaaataaaaacacttcaaggagcaattgacacaggctggaatcatctgggttcaattttaactagctggattgtaaggggaaggccatgtataagctatgactgaggaggggaaggccaaatggtttcttttctgcagtgactttctttgctttgcacttcagctagcagagatagcccgtgttccttctgataacctcatgccacatgtcacatgaaggcattaaagtcactcttaacctggcctgtgttcactgacacttcgatgactttcacttcttggcttgtactaacaatgctggtagcaagattcctaatcaaatatcattgattccgtggtgagtttgtgtggccatcttgttggcatacctttggggacatttggagtctggtaatcatatcctcagaggacacagtagtgcactccggttcttctgaatctcctcctgaagagactgccaaagaaaactgtagctgctgtggcatttcgccataaaagatggaccgtcttgtgccatgaacctgttcttggggtaattgtatctatttattttcttcctttatttttgtaatagggcctggctatgtatttgaggctggcctctaactcatggtcctttttcttcagtcttcccagtgctgggattgcagcgatggaccaccatagccacctatggggacaacgttagaatcctcagggggaggtcctagtgcttcctgggagccctgatttcacttgttgggtttccctatgtttcagatcagtactgagtcctcgcctggtttgccagcacacaaaggcgagttggtggtttcattgaaatacatcccagcctccaaactccctgttggaggtgaccggaaaaagagtgagttttctttgggggccctggattgagctcttaggcttctacacagggtctatgagagattggtgctggcactgttggctagggaagaaggggatgtttcctggatcttctaggttagagtgtcttcctaaggaggcctttccgtctctcagctggaaggaagtgccatggtgctggcattcctttgagacgatttctaggctgttaatgtgatttggtcttgttccatctgtgtcaagctcctaagaaggcagaagagaacaggagctttgtggctgagaaggatacctggaaggagtagtgaggcatgaggagtaggaagggcaaggctgagtcactccacgtagccagcatggtgctagtaactgttgatatgtagagaagagaaacgaaggacaacttttacagaatgggtatcatgtgcccaggccacccacctacgagggtgatggagagagctttgctgaggaaggaatattgaaactgggccttgccaggcacaaaatgagggaaggtgaaagggaggaacagtgtttgggagaagggacagtgcgagcaccggttcttaaagagattggtagttggccaaggtggtgcatgcctggaatcccagtacttgggctgaggcaggaggattcctatgatttttcatgctggataggttatgtactgggttacaggtcagacttggctatagagtgagacccccatctcaaaaaaaaattgactagctaaaacaaaaaggaaaatgaaacaattatttaaaatgtaggtggagaatgcagctcagttcttagagtacttgcatagtggccataaaggtctctgttgtatgcaaagggcacttcagaaactggcacttgggtggtggagctatgaagatcaggaggtgaaggggatcatagctacatagagaatttgaggctaacctgggttacatgagaccttgcttttctttttaaaaaaggctcaatctataggcctggtaaatgtggggttgtgggtcagtgatcaggaatatgttaccagttatagtggagctggagttatgatgtgagtgtgtatgtatatgagtaaagctgggattggagatgagtctggagccaaataaaaaagaaaagggcctttaatgaagagcttaacttgatctgctggcaatgggaagcccaaattagtgtgtgtgtcacatatatatcatatatcatatacatacatacatacatacatacacacatataatatatattcaggaaagtacactgtagggttgaggaatcagtaggctcaaggactgtgtgcagaatgactagataagaagcgaagacagaacttttgggaacagcaacatttaaaaaggatgaagagatggagaacgttaaagagggggagggtcatcaggacacagaaaggccaggagaaaatttgaagaagacgtgagcaggagctgtcagcactctccaaacactctaagcagtcaggccagatgaggtctgagaagatgcagctacaattaggttggaaggcactaatggaatgtgatttcacaagaaactaggctcggtggatgaggcagagaagcagaggtgatgagctcggtcagttctttgccagtgtaattagtgatcatgaaaggaaagaaaggtacagagaacagctttgaaagatcagattgaaggaagggaagttttgtttgaaatggattttttaaaaaaagaaaaaaaaaacagatcagtaagtgttcagactgagggcaaaggatcagttggggaaaagcatattcacaatggtaggtgagagtggaggtggaaattgatggtgttctggtgagtcctgggcagtaaggggtgaggtgaaaaactcagcagaagatttcctgcctgctttaattgcttagcaaatgacaggcaactgcttctttttggttcagatgactcatgtatagcatagctcagaggaggactatttggagaataaatgcctaaggtagtggttggttcatagcaagcttttaatgaacatttattgctattggtattactagttgagttcctactgcttatcctgggcaccgagctaggaacaaaagatgcaggcataattcagttaaggagtttgcaggatcccaaaagcaaggagagaacgtagtatatagttaaagttcaggatacagctggtggcatgggggttcacttgcaatggccgacatcccttacaggtaaaggtggggaagggggagaactccaggtgtggatcaaagaagccaagaacctgacggctgccaaatcaggagggacttcagacagctttgtcaaggggtgagtccctgggccagcatcaaactaagcagttataagacaagcaaattcatggggaacccagtttaatttttctctgtagatcctgccctcctcccaccaccttcagcagcttggtttctgaaattaggtaatggcaaggtctccaccactacctttgcactgctctgagatcagtttggcctcaacttgtgctccctttcacaggggagggtgatagacaatttggctctgactttctcatactagtcctctgccataggcctaggatgaaaatccatgtcccataactgtctagattcagggtgcaaggctatgtgctccataatttttattatggactataagcttcctctacattagagatcatttcctgacttcagctccctaagaagtcatgtttaactaaacatacatatgagtaatggcttcatttatctcgtgagagaaaagtggaaccgcatacttaaactgagccttggtggagtataggccacagcatgactaatgtcttcattattctctttaggttaaaggaagtagatgatctagtggaagtagtgggaagcctgccccagcagattcaaaggagggttgtgtgtacttggacctgggtgctggcttaccatcctgggctaggcttgtgctaggggtaaggtgaccgtattgccagtttgagtaggtgttcatgactccccgccctctgccagatacctccttcccatgaggaacaaggccagtaagcgtaaaactcctgtgatgaagaagactctgagtccccactacaaccatacatttgtctacaatggtgtgaggctggaagatctacaacacatgtgcctggaactgactgtatgggaccgggagcccctggccagcaatgacttcctgggaggggtcagactgggtgttggcactggtgagactctcctccatccaatcatcaattgtcttaaggcttcttgtctctcttgctcctcacagctctcagccacagctatgtacaaagaacttttctgacagtaatttccttcctttatgtaaccatccaacaagtacttattgagcacctgctacgtgctaggcctaagggaaggtagacctcatacagtgttctatgtatagaaaggtgaccctgaaggccaggaacttcatcctcctcctataaagaatgccgaaaactaccataacatctgacttgtgatttctattttctatcttattataatgagaagggtccttgccagcaaattcttgctctcctaggattttagattacctcccacttctccatggtttttcttctataatttctatctgttctgtatgaccagtttcatttgatttgactactgaaggggaaggctctggtgacaccagtcttcctgttcatttcttcctttgttttgagatggagtctcattagcccagattagcctgggactcctgatcctcttacttctacctcccaaatgctcagatctggacaagagccaatgtgctcaggcctaatttgattaaataaagagcacattttccactgaccacatgtccccctcactctaaaaacaatgacctcgatttcctggcatttctttctgttcttggtgttatggtgtctactactcttaagagtgattgctcatgcaaagtgaggttattatctcactggaattcccaagcactacgcaatagagcagcctgcttcctttatcctgaaatacctgccactgtttgctttctttgactccctttgactccattctatatcacttaacaacttccttcatgggttcttcattttgtactcaaactttaaatgatggtgctctctggcttggtcttggatgctccttttctctctctctctctctttagtcttgttcaagcccatccaatcttttgacatcgtgtcatcatgacattttcaaatatagtgttcatactcaagaactgtgcaattgagttatcaataatcaccaaaaagttaaaaaaagtcattgctttaattagttatgattttgtgctggactatattcatagttatccttagctccatgaagttctggttggagttgtttgttggattctttttttatatatgtcataaatatgtaagacttatttattacttttttattttttcttggatattttctttatttacatttcaaatgtctactcaattcttaccttgaatattatttgtatatgaataccttacaaagcatctacaatatttttacacgtgtaagcaacttcatgtctgtcccctgtttaaaactcttcagtgtctttcttccacatttagaaattcttaccaagtccacagaccacatataatcttgactcttccttttttatctgttctgtatcatttccctgtattattgtgttacaaccaccaaagcttctactctgttctccaaatataccaaatcacttcctactttgggtttttataatgatcatgttttctattctcatgtaagctgcctagggcagaggcattctttgtgtgctcatcaaagtatctccaaacaggcatccagtagcaatcaggaaatttccactgaatgaatgaattattgtacaataggagtaggaacacataatgctaacggtaggcctagaatttacagctatagaaaaagtatttagaggctgtacatgctcattatctaaatacttggcaggcagaggcagggagattgccacaacttcaaggccagccaagatttctgtgtgaaatcctgtctcagtaataacaaaaaggaggaggtgttcaatttttttaaaaggttaagtcaaggacccatgtatagactagtacttcagttactaaccagtccactgccgccttacaatatatgcaataaactgtatttttgaaaatcaagtcaagttaccaatgacagataggtagcagttttggtatggggtcccagacaccagagctctgaaaaggtcactaagcaacaagcctctattgacattatgtcatttcaagtcccatttcatcaacctgcactctccccattgtttccgaagcacatgtatttatagactcagcttgccagcttgctgtccccaatgtcttttctgtgttggattttttgccttataaccaatcctccctgattggctcagtggtgggactctgttcagtctcctctggtgttttccctcagggatcagtaatggcgaagtggtggactggatggattcgactggtgaagaagtaagcttgtggcagaagatgcgacagtacccagggtcttgggcagaaggaactctgcagctccgttcttcaatggtcaagcagaagctgggtgtatgagttcctatcctcatctgcaggtgcagccctggtcagtccaagtcaaaagaaagcaaagcaaccacaagaaaagatttctaatttaatgtgtgtgtgtgtgcatgtgtgtgtgtatgtgtgtgtgtgtaaacatgtatttctacagatcttattttgctagcaagtgtggcacaggcttgctccttcttttaaagcagcccaagaataagggccctttcaaatggtttttatttatatataatctagtatagtttttgagtacatagttggctttttctgtggtttaattaagtttaaaaaccatattacaacaactctctactttctatcttgctatctttgctcacactttcgctggaagtgtggctgcttttggcacgagttctagttcatgggtctaagtgtgcctgatcaaaggccagagctcttggaagcaaggtttggttgttcaagatattattagactatgggagaagggtgaacgagcagtccttcctctctaatttgtattttatctcatcatctaccttgatacccttctagaacttgccttttaacttttcccgttttaagcagtttccaccttgcttgagtatagtgtttttctttgaaatgcaatgaaaaattccccagctccttctgaggcctttggggagtccttataatggagtcactgtagaaaaatcactttaattagataatggccttttcactgagacattaacatgtcccatgagacctactagctgatcccacaaggtccaagtgactctgaatgaagtttttcaaagcctgtgctgagttctctgttttaaactgttacagcacttgttggacagagatatccttatctccctcatggaagatgaggcatgttcactctcatgtattatcgctttctctaagtttgtgtctgggtgtgctgctacatagaacatagtctgtatacctctgtttcatctgcaagggccaaagaccgtctaaaatgacaccgtgctcccccaggttgggtactagtaccatgccatgaaaatgtggatggaattccccagccattctaacttttcacccaatatactttcagttcctgtctttggttgtttcctaaacttgacctgggtgtaacatgggagtagtgtgtgttgagacttaaaagaggttctagtgggctttcatttcctgctactcattcttccgaactgaacttttcattcataagcagtctgtctatagaaaggtgtatgtggaaggtgtctggagcagagaagaaatgcctgtcagtgacatccagctgcaagttgacattcctgtaaggtcactggattgcaggcagctaaagtgattaagattatgggtgtaaactgcatagaatgtttttcaaagattcccttcaatatggattgatcctgtaatggaaacatacctgagagcccaggctcagacttgttctttgatattctactttaatatgcatgtgtgtttcaataaagctttctcacccgagtgtttacatttga

SEQ ID NO: 671 - DNA, 45428 bp, mus musculus; identical to SEQ ID NO: 670

SEQ ID NO: 672 - DNA, 329681 bp, mus musculus
tagtccgcgccaggcgggtgctcgggctcgggagcctggcggctgctgaggctgaggggaggagctgaaggcagcggtcgcggctcccgcccgcactgaacgctcatcccgcgaagccccctcccacactcgggagggcggcggcggcgggaggaggaggagaaggaggagggagcgtctctgccgccgcctcctggtccccagcgcggatcagccgccaccacctcccttcgcgacgatcctccctccatggtgctgccgcggccccccctgtagcccgagctgccccgcgccgcgccggagccggtctcgggcagagggagcggtcgcggcctcgcggcccgcgcgggctgacgagcggagagtgcggcgcttcgcggtccccgagggtccgcacgccccggcagcgcggtcgccagccaccgcgcgaggagcagcgggcgggcgggcggcgccgggcccgggccgccctcgctcccacgccccggccccgccgcccgcgccggggcggcagccggcagaggaaaggcgctgcagtctccgggcctcacggccccagtcgagcttcctcagcaccgagggcttgcgggtcctgagtggaggacacgagcccggagccgggcactgagctcttgggcgcccccaacccagttttcagaaccctccacgctgcggccgctgtccccttcggaccatggccgacgacgacgtgctgttcgaggatgtgtacgagctatgcgaggtgatcggcaagtgagtctccacgcgagggagcgggagtgtggaaaaatgcttttcagcgatgcccggggcctcccgcacccgttccgggcctgccccctgccctctctccctcccctctgcctccctcgttctcttcaccctggagaatttttagacgtgtacctgggtttcctgccaggaatgggtctgggggcttcttagtaatgcgtggaggccaccgagccccggtcggccaccccataaggcgtggggcgggctccctgcattttatctgacggttacacagggacgtggcaggaccgattttgtagttgcttcctgggaacagttggggtttttgttacctttcctgtaccatagacctttcacgaaaagagcagcctgcatttcatgagcttgtgtggagagagcgagagagcgcgtccggggtttttaattgtggggtgtgtgtctattgtgccaggatattagacagatgcctttgtgttcaccccatgcccggatttaagagggtcattgaagacggatgcgtccagtttcagcaaattcttcacctgccatagacaaacatagaaagagttgggggcacccaaatttttaatgcctcgttatgcaatgactgtacaatcagtgctcgaggctcccttccactgttgttgggatggtggttagcgtggtagagccgtctgctttgagtcaccgggctggtctagaatatagaactgacagtccaaatgctcatcctttcatctgtgttgtataattacactagggaaaagcagggaatcagattaatcacagtcctgattgagaattaaatctgcagttcctcatctaattgtccagtcctgaaatctgttttgaattgtttccttttcattcttgtcaaacagtattccaagtgcacaatcctgctaatttgcttgtgagggaaatgctggcaatctgaagttgatttcctagttcagcgtgtattctctggctttggaagttgagatcagatttaagagcgatttttgcttatttaatagggctcgttagatggctagtattagaatattttacttcgttttggaagcggtgctttattgtctattttaaggtccgcagttgggaaatgaaaccaagacagcatttggctctagctcttttaagttgtctgcactatactcagtttcaattttttgagtacgggtaactgattttttttcctccatgttgagatattacaatacggctcacatggtgaaattgtgggtagagcttgctacactcttttcttagacccaaatgctccttgccccattgttcagtgaccagcctatctgttaagaggaggatgtccaaatgtgtctggtacagtctttgtggatgtgctcagagcagcgctgttcaaaagctatttaatgagagccacgtgtaatttgtcattttctagtaggcactttagaaagatttcaaacaaaaaggtgcaattttcgtaaaatatttatgtaatacattatatataattagtgatttcagcatgaaaaaattttgccatactgtatatcttttcctactaaaccattgaaatgcaatgtatattttacactaacagaacatctcaattttgacgctaagctaattttttaccagaagtatttgatctgtatttaggtttcataaaatttgcatgtgcaaaaaaaaaaatagattcacatattcaagttgttccaaacgtacataaaagttttccactaactgaatttactatttctaaattttaatcaagtaagcagaatgcaaaatgcctcagttcaattagtcatatttcaagtgcttaatatccacagcctactgccacaattttagagagaaaaaaattcaaaaatctccttcatttcttcattgttgtgaggacacaaaaaagagaaattcgatgtttctcaaaaaccacacaaatggctatgagagtgagggatacttgttgtatcttagttgtagctgttgtgagcctgaagttgataattagaaaatgtgggattaagctgcttgcagatattgtggtgatggaaatagctatcattgaatcaattttggtgattggttctgatttcttcaggtctgaaaggatgacagtgtagatttcaaacgtggtcagcttcatgttagtagtctgtgttgtgctgacttaaaattgagaaaatattttcagaagacacccctagtagaattaagtttatccattctgttctgcagctgcagaaggaggaagagcaagcgaattttgatatgccacctagtcagtggctgcctgcattactgtgaactgtgaaatttcattcctatcctacacaatctgacttggttggtgtcgtctataaaatgccattccttgaaataatgaatccaagatagactcagtcttaaagactgtaatgatggtgcgcctcaccccatgcaaaggttgaagatttctccgggaaatcgtgtcagtatatattgatcctgaaattgaaattcgcttgaggttttttattttagagaccttgacagcatacacttaaacttagaatttgttcaattataagcttaaacagaaaggccttgcaaatcatcgttcatccggaaaaaaatcttttttgatgatttctagccagactccatggaattttgattttcttttgtatcagattggtatcacaaattgtgtttacaccacaatatcttaagagttttaaattttcactaaggctctttaaaataaatttcagttttttaaggcatattggccacccacccacccactcatgcttctgcctattcacctacctacttgctccttttctatgagactctacttcttcagactctacttggtggtgtaaggaaatttcaatttgagtgagggtgggagagagggaggctctcaggaatgcagccctggctggcatggagcttgttatgtagatctggctgctcttgaactcagagatctgcctgtctctgcttttgaaatgctgggattaaaggtgtatgctgtcatgcctggtttaaatttccaatgtaatctaaaccccctttggtgtctttttcttggttaagaacagaacttgaggtaaggagatttggagagagattgctctttgcaatacattttctttgtagctgttgcaaactttactcttattaaatctgtcttcgaaagaatcaggtatcttaattataaagatcaggaaggtgctatttcttttcaaaaaaagtaaggtgacaccctctgggttttctttctgaaagttgcagaaactcttaaatgatttttgtttccataacattttcatatggcatctttcaagttactgaagcaaatacaattatagtcacaaacttccttttttctctttgtttttgagacagttttactatatgatttgtagatcaggctgtcctccactcatagctatacacctgcctctgcttctgcctcctacatgctgagattcattgtatagcaccaccacacccatctagtccccaaactttttaccttaacaaatgtagcaattgctggaaagaaaaggtattatgcaatacaagttaataactaattttgtcataatcacttactgttccttctgcagatttatagttttgtaggtaaatgtaaaattagtaatggtatatgaaataagttttaaaacagttcatttaagttaaaacataaaacccaccatctttctggtgtaagcagtatattttgaagaggatcatacaatgtactatttttatgtatgtaggatgaatattggccctgggttttagagtgttcagtaacctggaacttctgactctctttttctactagaacatagattggaatgatgaagcaatgactcatggacgacatgcaagtttgccaggcatactatatttgcttataccctgagaacacataacatatttaacatatttacagttacttatttatggtctcgctacctagctaataggtagcttcttgaaggcaggaaaatgtgtaacaaacatattttttcattgctaaacacactacctgccttgtaatagtcattcattagctgtgggataaattgagaagttttaataaaatctcattaaaaggcaaaaagtgtatttatcaactttggagtaattattgtccccaaatgctgaattagttgaaagtggtgctgctttccctggctacatattagaactgtcaggggaactttttaaaaaggtctgtgccaagaccctgttacagaacagtgtaaggcagaatcctgagacatgacacaggtaattggtaaaactaaacgaatcatgtatgaagagtcagttttaaaagctagtttctgggactagcttttcagaggattaaatattttccaaagtagaataaatatgttttgtagtgcacttaaactatcagaccaaaacatggatttttatcttctatgcatttatgtctctgaccctgttgtgtaagaatttagcttcagcctgtgtttggctttggtttcctgggccttttatggtttgcattgatttgtgacactcatctaatgctaacatggtgattgtctcatgtttgcagcaacacagaacaaggattgcttcaataactgttgatgatagctttctactacaatgccttaatttaataagaaattcattagtttagtatggattgtttgcacacacactttattaaaagagaatggttaagttacttatgtactttaagttctgtaattgtaactacaatgatgcaatttgccagagaattgagttaaaaccagtcttatgtaaacactggattaataatatataaaatacataattaagcatagaaaaaaattagcttttctgatttgcgctaattactctggctttcccatgtattgattatatcagtgacttggagttctggtaacccaggggaagcattacatgaatcagaagaattgtcctgaaaacttaaatagacactgtacataaaatagtttttaatattaagcttaggaagtggtggggagtgttctggctaagatcacatgggattctatctgcttttaaaggctgttccttttggccacagtttactggtgtttcaggttatgggaaaaaataccatattggatttctttaaaataaggctaattttcatctttaaaatctattattgtaaaagatgattactttccagttacacttctcacctctttggtggactgtactattccttcttaaattacttctttttttctcttgctttatgactttggttctcaacctgtgggttgggacctctttgggatcaaatgaccctttaacaggggtcacatatcagatacactatatatcagatatttacgttatgactcataagggtatcaaacttaacagttatgaagtagcaatggaaataattatggttggaggtcaccatttcatgaggcactactgcattgaagggtcgcagcattaggaaggttgagaaccattggtctaagatgaagtattagcatttgtaatcaaactaattgataaatctatatattctttagcagtggaaataaggactcttgaccatatgtccacagtataattggttttgaaacgttctctatcccttttactcctcaagtgtttgctccccagactaagtattctaagtttctgagtcagaagtagtgaggtttgcatagaggcgtttgttggaggctagggtggatgatttcttatgccctgtgctacatagtgaattgcatttgactttgaaaaccacgtcctaaactgcagcttccgaatctgtctcagctgccagcactgttcactaaagtagtgaaaaaatgctactgttgtacagttgccactgtagagaaagtacctgtcaccagctgccaggttgatgggatgttctgcttttccaatatggagcttatattttacttgccatttataatacagatttctttttcctgtatttgtgttttatagattttgagtactggcttttaagtaaaatagtttgcttttccaaaataatgccatttccattcactagcttgtatttggccatgaagtagatggaagccttttgttgagtgacaaagaaaagattaagtacaatgtttctcctttttatctttttaagttcctagtatttatcacactaatattgtttccttaaattattccattatagagatgttcattctttctggtgtcaaggattctttgtccttggatggtgttagtatgctcctctcctttcctttctcatcctctctctcatcttaaacagcttttctttatggttcctgcctctgctcctgctggctttcctcctccctggcttccctcaatgacagactagtaccgggtcatgtaaaccaaataaacactttcctcctccaagttggttttggtcagtgttttattgcagcaaactaggacatcactgaaccatagatagattttactgcttattaaatgaagaatggtttattctgttccagaggtctctacccttgctatggtgtgcagatagctattatatcactgctagttcatgcatccaattttgtgctttaaggaaacacattttcagcctttctgcttatcttttttttccactgaatatcggattgctttgctttgtggtttgtaaggcatcccctgaagatctgatctggtaacctttgggtacatttttatctatatagaaggaatgatacctgcttcacacgctatttgcatagattagtgatttaaagtgaaggttaagtgttttttacttgtagaatgtctctgccatactcaaatttcttttgacagttttgtatgtaagtttcaacaattttatatgtgatctttctcagtgttaaatacatgctctgttacataaataatatgttgaaatgaatatgtaggtaaagtatcatttattcattcatgtatttgtagctgtgaagtcatgggcaaattagttaacatctctgatcattagttcctttacctgtaaaatgaagatgatagtatagttttcttttgaggtggattgtgaagattaaataatacaatctatggaaatgtttgcagtttttattttagttgcatcatcatcatcatccagcaaacacttgaattctccagcctcaaggagctctgtaaataagagacagatgattacatctagaccatagcacactaattgttgaatcctgataagtcagtaaggcaagagtcacagctaacttgtccatgctgcttgctgtctgggcataggtttaaagccagcataaagaaagtcgtcagtagttgttgaatgaatatattaagtgagaaacccagagacaatgtgactacctagcaggaaaataaatttgaggaaatctttgtagcggacacaaaacttgaaagggttgttagtccttgggtaatatttaaaattttaggcttgttttttcattcctaaaaataagtagagaaattcagataaaggaactctaataactcttaggaatatataaatatattcaagagcacctagtgtcttttagcaaaaaaaaaaaaaaaaaaaaaaaaaaagttatatgctacgaaagatattctttgtgttcctaatttatttgtaagcctgtctcgggttgtagtattacagtgtggtgaaaagctccaaaatttttgttaaaagagttttatatcatacctttgcatttggacattgggtagaattaattgctcataatgtgagattttatgatgaagaaaaggaaactctagggctggtgagatggctcagagggtaatggtacttgccagcaagcctgactacttgagtttgattcctgctgggactcacaatggtgaaaggagagaaccaattcctgcatgttgttctgtggtgtgtgtacatatgtatatatacatataatacaaattgtgctaatttgtttaaaagaaaaggaagatcctggaatatgtatttaagaaataactatatacacgctttgttaaatttatactgtagtagtttcccaaattttattatgacagcagtttccatatcttaaccaaggacaaatgagtagtgtgtgaaacattgggcactgactctaaagtacctaaatgcacactctgtaagtatgatcaccctgactctctctcctccaaccccatttctccatgacttcctggctggcctgttcccttctttctctctcctctctctttctgtcccatttctttcccagactcccttctcacccccccccccttctcatgccccaaaataaacttcattttataccctcccccacaaggaaaggatcatcctgatgggagagggtggtctacttagacacttgtatggaaataggttggcttcagaagatagtaaaaggtgtcttttcctataatccttggacagtgttatttatattgcatcatttaggttagcagtttcactgactccacctgtctcccttaaactattagtttaaaaggagaactgtctgaatttatttgtatatgaataatttcccatcttctatttaggcttaatattattatcttaattaggcctcagtcaagcagtataatgtaatattgaatttgagattatcaggtttcaggtttcttttttctaaagagattttttttaaacatttatttattaattatatgtatgcacactgtagctgtcttcagacaccccagaagagggcatcagatctcattacagatggttgtgagccaccatgtggttgctgggatttgaactcatgaccttcagaagagcagtcagcgctcttaaccactagccatctctccagccccaggtttttttggagacatgatctcaactgtgtagatcaaactggcttcacagatatccacatgcctctgcttcttgattgttgggttaaaggcatgggcaaccatgcccacctagatactatcttttaaaaaagtctatggagcagggtcctctgcaggaatagcatgtgcccttggccactgagctgtcactgtagcatgattatcttttgaataaatgtcttcttttaaagtacgtatttataaagtaattagatgcttgtaaaacaggaagctcttttcactgagaccattcttaattatatttcacatgaatttgacaaattattactagactatttggataacagatcaaattgagaatataattatctcatagtataatcaacatattttaagacatgctaatatgtggggggaaaacctattactagccatacctgttgtaacctatgctatttttttctttaaaaagatttcttctaatggatatatctacatcttgcatctgaggctcaaggaacatagaagaagaaggggtgaaaagattttaagagccagggagtttgttgattgtaagagccaaagatgagtgaggttgtgtctcgtagtaacatcaggagctacactcataaagccttaccagtatgactggccaaacatgagctgaacaacgatgacatcagtgagcatgccaaactggatggagagaagcccatgaggcttcaaccccacacagagaactaaaagcagctgaggaaagctgggagtgggagaggtggccttccccaggggaaagcacacaagtgcttgttcagtgctgtttaagtcagtcctgaaaacatgcatacaggttgtattatatttatatctacctgcatacaataacaattagtgaaaaaagaggccatgaatttgaaggagcgtcaggagggcttgtaaggagggtttggagggcaggaagggaaaggagaaatgtaattataatctgaaatttttttaaaaggtttttcttatggctattaatgtaatctatgtaaacgtctgttcacatgaacatgctttgtttatcatatttgcagagagagcctggaaatctgaagaggaagcattcagagcttgctgctatacctcttagattcccaatgttaatgtttcgcctgggcctgagtcttcccattagactgctggatcatacttcatagtctatgacttacttgtcctaaaggtccagtgggctttaaattgatatctggagcttcaggcttcttggttagatttaccttggtggcttcagtattaggcttacaaatatgaatatggacttgatggccttattagcacatttcctcttatttccagatcctttcttagacatagaagcagagagagctgtaagttggattttaaaaaaaaaaaagcaatttaggaattggtagtctaggcatgatggctctttgctgcaattccagcaattgggaggcaaagacaggaagcttactgtaaactcaaggctaaaataaaagaccaagacaaatattccaaagaaactttatttttaaaaatggttgtttgtttagcctggcattcacaatgtagagcaggcaggcctcatacagagattcacctcccttagctttctgagtgctgggattaaacacatacgctaccatgcctcttagaaaagtattaagtacattttcacatgacaccagtatttggattatttttctctatttcttcatctcataaaagaatggatagctgaagtgatggcttagacattaagagaacttgctgatcttacagaggacccaagttctgttgacagcacccatgttgggcatcttacaactgcctgtaattccagttccaggggatccagtgctcataaaataaaaatcaaaaccaaacattttaaaaagagatagtaatgattggcactgctgaactttctttgatttgggaaggatttattttttctagaaaatgtgtgtgtgtgagcgagatgtatgtgtgacatatgtggaggtcagaggacaacttgtatgagttggttctttccttccaccatgttgttcttagggatccaacccaagttgtaaggcttgtgcagtgattgcctttatacacagcttgctgggctctacctttgtccttaaactgatttcatgttgtctttatgagccttacataatatgctttgtctcttaagtatgatttagaacatattatgtcgaaatgttgattatacaaaggtaaagtgtgtttactgatggagcaataataaattcacactgaaatcaaagcaaagacacaatagaaattaacgttttttttttctttaaattgtaaattttcgattgaacctttaaatttggaacttcaagtgagaaacatttgtatctaaccagatatgaagttagactcttcaacaaatggttagcctggaaggaagaatttaggtattctcaaagtgtagaaccttttggttagcagctgctcccaggaatgtggtagaaatgcagatctcaggcctcaccttgaccttccagatcagaagctagggggatagagtcccattattgccacgttaacaagatctccaagagaattctgatacatatcacatttttttttataactatccacttagaactctagatcagtaaatgatggcttgtagactaaaatggttcactccctctttcttatgtatggctgctttgtatgctataagcagagttggatagttcttcaggactactgtccgcagagccttgattatttgttatttggccctgttaacaaagagctcattgacccctgtttgaaataaagttttaatattgtttccttgcccaaaattctaaagagtgagtagttaaaatcattagataaatattcacatcttcctttacacatgaccctcatatttctacaaacccattccactttctaatatcaacttattaactcaatgactagacttttaaataaaaataaaatactatgttgccctttcttttctctgcttggtgatagtaccaagcttgataatagtgctatgaccatttctcactgattccatgtggtgtgctttggtatttctatattctagtgtaatctaacttaatcatacattgtaatcttcatttctcgatattcctcctgccttttttatttcctcaagacaaatcccactttgtgactgttttgtttaggaatccatgagctaattgctgtgcctgaagtacctttgtcctgcagtgctgtagttgcttgcactttaccagagtgattgacacacagataacaaatatcttgggtactcttcaatcatttcctaggagagttattgttagcatttacacatccaaccaagaatggtgattcatgtctatagttggggtgcaattctgaactgatttttcctttgtccttgctctcaattgttaagatcattggtggtcagcatcacataaaatatagggagtgattttactactgttcttattgatggactgggatacttctgtttccccatatcactgaaggaaagccagtgggttttcttttgaaagaaaggccatgctatagtctcctgctctaatagcaaaagcagaaaaggtggttttgttgcagatgtgattccatgcttgtatttcttttccttctatgaccgttttaagtaagaaaagaggacttggctaagtgttactgagctgtcttacttgtgagtttgtttggttcatgatttatctcagacaaggaacatagttaatgaattcagactggacatgactgaattagctctttcattatttttagggtttccccatcaacttaattcataccttttgccctacttactcatcccggtggtgagatagaaagaggagacacatacaaaggcaaacacacagaatctggtcatttaggtctattgcccaaggcagcctgtcagataatttgagatttactgttttctgcaaaatagtgttggaggtgaagtatttttttaaaattaaattatggctatgactaaaacatgaactctttaaaagaaggcagtgttattttcccagctattacaatagccacccacagaaatcatctgagccacctcatcctttctgttttatctacctgaaacaggccgggtgggtgatgctaaaagtttggtaaatcacactacactttaactaagaggaatgctctgctggtttatgctgtggtgttctctctggtgcaggggcatctgagacagtcctacacattcagaggtaagtaagcttcagtaattatctttacttccttggcagccacttatgtttgtgaggtgagcattcctttcagagaagcaactgctagataaattctgctgaatgtggcttttgaaccattttcaaggctatgatgttcacattcaaaatgtcttagtaagctgggcatggtggcgcacgcctttaatcccagcacttgggaggcagaggcaggcggatttctgagttcgaggccagcctggtctacagagtgagttccaggacagccagggatacacagagaaaccctgtctcgaaaagaaaaaaaaacaaaaacaaaaacaaaaaaacaaaatgtcttagtaagtaagagagggtgatttaagagtgtctgtggtgcattatcagctaaggctcattaggaaatagactttggacgcaaatctccaggtaacaagtcttatgttcttattgtactaatactttcctactttgaaaccactgaaatctccccatgcctctttgaaactaatttgtaaacagaattgtattgtagatattgaatatagtggtataatcctatctagtactaattactaagtagtttccctagtttctgagaactttcaaagtgtcaggcttcataccacagtttttccagagtttgcattgttttcccttctctccttgctattgttacactcagactgcctagtgcagtggttctcaatcttcctaatacagtgacccttttctacagttcctcatgctgcggtaacccccaaccataacgttattttcattgctacctcatagctgtaattttgttaccattatcgatcatgatgtaggtatcagtgttttctgatggtaacccctgtgaaagggttttttcaacccccaaagggttcaaaacccacaggacaatgaacactgatttagtataacccatgtggctagactcgctttcagtcaactagctagcccaacctgaccttgagtaaaggtaggtaatacagtagctacaaggatgcagctgtttcaggttagtaattattaaatataattcattaaacagaactttctctggagagaatttctaaatcaccagtagactgatgaaaaagtgtacgacactgaatcattgaaaaatgcaaataggaaaccatagtgataagcatgttacacttaggacagctagaattaaaaagatagatggctgctttgcgcaggtggctctggttaaactaagtggatcataaaaccgaaagtcatgaatctgggaaaagggctgggaggaaggaagagcagtgcacatgaatgggaggaagagagaagagactgggaagagaaagtaactagaatgctttatacacatacatgaaattgtctacgaccaagcgtaattaatttgcaaaaggctgatagcaagattataaatggtgagaatataaaatggtacagccactatgcaaaatatgctgtcagttcttcaaaaagttagttttgtgggacccagcaattcctttactaggtatatagccaagagaactgaaaacttgtatttacacaaaactcatgtataaaatactcatatgtacattattcataatggaaaagatgcagaaacaactccactgtacattggtagacaaacagttaagaaaatttagtaattgcacagtgaatttttatttggccataaaaggagtgaagtatttatacagctttcaacatggattcctctaaaacttattctaagtgaaagaaaccaggcatataaataccacatgatgtataattgtgtttatatacatttccagaagaaatacatattttgatagaaaaactaaatttgtggttactaggagttgtggggaaaagacaggatatagagtgactgtaagagatcatggggtttcttctttggtctccagaatagtgcttgctcatcaatgcacaattttgaatatactgaagcccaccaaattgtatatttagaagagtaaattttattgtttgtggatatctcaataaaaatgttattttttaaaattttagcttttaagtcacaccagcaacatttcatatgctcaatagctatgtattgttagtggctacatgttggtggcacagatttggaacgtttttgccatcatccacaattttgttgaatagcacttatctagaggatttgagactcataatttgggacaaaaaaggaaggaaggaagggagggagggagggaggagagagagagagagggagagagagagagagagagagagagagagaggtacaagcctaaaaaccaaaaagagtctagaagtgatttagagaaacgttgatttatgatactttagtgctatctgactgtttcattaagagacaccaccagcctatttttcaaatcattctcaaatgagtgtggtaagtggttatgtcttgtatgtcttatttgtgttagcaattttaagacaatttaaatcatagccagtatcttttccaagcatggtgttctaaaactacaaatcaacaagaataactggaaaattcacaaatatgtgcaaattacgtgacacgttccttaacaactgataggtcatagaaggaactgaaagagaaaatattttacatctaattagagacaaatggaaataaaatatactaaaacttgagaattaaggcaaaaccctattctatgaatgaagtttatggtgctcaacaccaaccttagaggctggggaatgactcaagctggaaagttgcttgccaggcaagtgtgaggaccacaattcagatcccagaattcaagtcaaaaatccaaatgttgatggcacattctcataatccctgcactggggaggtagagtcagacagatccttggaactcactgcctacactctagccaaataggtaagttccaggtaaagtgagagactgtctcaaaaggtaagttgaagataactgaagaagatatctgatgttcacctctggcctacacatgtacacacatgtcaagaaaaagcaaagattacaaataaatatttaacttcgcacctgaagtagggaaaaaaaaaaacacccacaaacaaacctaggctccaaagcaaagtgaaagaataaataagcaaaaattagtgaaatagaagattaaaaaaaaaaaaaaaaccaagaactaacaaaactaagttaattctttttgaagatgaaatctacaaactttcagccagattaagaaaagtaagtaaatgaaaggattttttttcttttttacaacaagtaatagagaaataggattataagagactgctttgagcaattacatggtagcaaattgaatcacctgaagaaatggatacattcttagaaaaatattcctttctaagattagatcataaagaaatagaaaatctgaacagaccaataatggagaaggaaattagtaatcaaaaacctttccaccaagcaaagcaaggagtcaaggttgctggcttcattaataaattctcctgaatattacagaagagttaatgtcagtcctttgcaaactcttaaaaatttgaagaggaggaattatttcaaactgactttatgaggtaagtattactctaatgtcaaagcagactacgagaaaaagagaaaagtacacaccaatatccatgatggaggtaatttgcaaattcttcaaccaaatgtaagcaatccaaatttaataacatagtcaaaagggcgtgcatcctttcctcaacctcaaacgaatgagtgacagaaaaactggctttcttagattgcagtctgctattgtagaagttatgatggatcatagacacaccaaggaggcaaaagatgaactttttaaaaggcaaaacaaggaaagttacatatgttattttgtaagaattatccttggttacaggctcagtaaaggatggcatgtgtggtccaaagttgaacaataatggctgggtagacatccttgtagaagtatttctttgtacaaggttgcaatttttggcaatgtttgtgataacttgtatcacgtatgcatgaggaagattttcatgagaacccctttcttcctggtttcctgattattacactttgtcctaaatggcttcattttggtttttacaactttcacacttgttacaaaaatgctctgcctaaagggactcttgagaaagctggttatcatatagaatgacatggacaaatgaacacacctctttgatttctagtttttttccccccagtgggaaaatggagaggttgacgtcactgataatttttaagtactcttgaactctaaaattagtgattctgtaactgattatttcattttacctttgatactaatcaaactttttatttcatttacttactattaaattttaggtagcatggatgggagggaaagaagtatcataccatcatgattaaataaaatttatctgtagggtgcaaagatgtttcattatatgctattagttaatgtaaaaatattagtagaataaactctgaaatccatgtggttatctcactagaagaaaaaagataaaacggaaaaaatccaataaaatttaaattccttttacgataaaaaaaaaaagaactaggaaagaatgtacatgagcacactgaatgcaatgtgtaaccaccccacagctaatatactgaatctagaaattttgaaagcttttcctttaatttataaacaggttatgcatacccaatcaccaattctttttcatatattactgggagatcaagttggagcagttaataaataaaaggcatccaaatcacaaagaaaataataaaaagttcatatatatatatgtccttaacagactactgaagaggaggaaaaggagacttcataaatttaaattttttctataagttttctttctgttctttagatagaatgccttcatatttgcttatttttcttcttgtcagtttaattttatgttgaattcttctaatgaaaatttcattttgattattaataattctttaaagaaactaagacaaattaaaaacatttcttgcattgatgtaggtttttgatgatacccttggttttagcttctttgctatacttcctagaacaaactctcataaatctataaatttcctcctgcatgcacatgtttacatgaacacacaaacacacacgcaaatgtaagaaaataaataaaaagaggactgagtcctacagttgtcctcgcacctctgcatacctgctgtggcatattcatgtgtgtctgtatgcacacgtgataaaactacaatacaactaaagcatacaactaaacccaacagttgggtctcttcagagccaattttggttggctactatttcccttcagcaatttttttctcaatgagttaatattttcaataatatgttataacagttcttgttatgagtctccaaaggtggttgttttcatctggctcagtgatttgcatggactagttatgaagttatgcttcctctctggtagcatggaactgtttggctttcttttagtcaggatctctggtgcctgggctatctttattatgtaactgatactgacctcaaattcaaagtagcactcctgcctcaacctcctgaattatagggattgcaaggattgttcatcctgccagcatgaacattttgtttcattttcttcaatttattaaagtctgttttcctagggttttccatttggtcagcataatttaatgggtaatcaacgattggccagtttaccacaagcattttgagccagtgagccttacatcttttgttagggagaatttgtatgtggagtggagcagacatttgaagtttaggtaatttataagtctttttaggacctgaagagatggatcatgagttaagagcttatactgctcttgcaggagacctgaattgagttctcagcatctgtgtctggtagtggtaactcacaactacctgaaactccagttccagagtatccaaagcctattttggactctttaggtgcctttactgatatgcacataaactcacatatgcgtgacttaaaaaagtaatatgtaaacatctgccttgatttgtaaaccaaaggaacctagtggaatacccagagacaaacccgtacagcactgcacaccagttattttttttttttacaaagtgtcaataacatgaattgagaaaagacttcatatttattgtataggtgctggcagaaaagggtacctagataatttctctcaccttgcataaaaaaaaaatctcaaactcgatcagagatgataatttaaaacaggaaacactggaactgctaaagaaaaacaaaggatataggtacaggcaacagatttctatctataaccccaataacacaagaaacaagtccaagaattagcacatagaattacatgagaattaagaagctgtgaagcaaaagaaactaagatcatctttaaccatcagagaaatacaaagaaaaactactttcagatttcaccccaccctattgagaatggcaatcatcaagaaaataaatgacaagtacaggttcggatataggaaaggggaacccttgtattctgtgggaagtataggctaatgcactactatacaaattggataacctggctgtaccactcctggaaatctacccccaaaatgctacatcctactatagagatgcttgcatatccatgtttatcactgtttcttttacaataaatagcaaggagattaaatcagcctgaatatccatcaacagaagatgaaattgtgtttctgtgtgtgtgtgtgtgtgtgtgtgtgtgtgtgcacatgcacataatggagttttattccactgtaaagaaaaatatatttaggattttgcaagaaagtgggtggaactggaaaatactaagtgaggtaattgaggctcagaaagacaaatatgcacgctctttcccacatgcagattctagccccaaactggaaagtatgcttatccaagtgtgagggggaatgcgcaaaggccaggaaactagaaacgggcacataagactgcaaaaaagaacctcgagcaatgaccagtaggggccacaattaaatatggaagggaggaataatggggggaagtatgatgaggaaggcagactgatgagggatggtgggggagagtcagccaagtgaaacgtttatgaaaacctattattttgtcgactagttaaaataagaaaaaattacacacacacgcacacaacctgcctgactttcactttgagtttgtacagagcctcaccaccagctgcagttctaggtaactgggagcctccccagtccctctcaggaatgcacatagctctgtacataatgcacagtctttctgaacctccaaaatacattaaagttttaagtcctctttgtgtcatttcaaagttctcctatttatatgcttgcctattgtcttatttgcctcaaagaaatgttgtgagtttaagtagctgtgggttttgattgtgcactgatgattgctattcttttcaccggtgctccaagaatggggttcataaatcgggtcaactccctgcaatgacagtttccacaaagctaggagaccacagaatcctggtaaaggatgggaaccgctccatgtcaagtgccacagaccttctggtattacccatcatctgtaggcagaagcctcattctgccgttttatgccttacctcataggtttacactgtgtctgtaatttgttagcttttcatttagtataagtatttcctcctgtccttgataattcattatactttctgatgactgtgtcatcttatcatttatttgaaagccttataatttacttggtgattcccctattattgtactttagataattacttatataatttgactgacttccccaataggcgccaagctcaggaaggcctgaaactgttttgtttactttgttctacttcaccctcagtgtctaacatagtaatttttgtttcctcactttaaaaaatgttacagttagtactttcaaaaaatatgtcttgctggcaaggttttatccagatgtgtgtgtgtgtgtgtgtgtgtattttaaccaagaatgaagttccagaaatataacagcttagtcaaatgattattattggcttctgtgttagaggacaacttggtagatttgattttctcctttcaccttcacatggattctgggaattgaactcagattgtcaggcttgcagagcaaatgccctggttttgttcttgttgtttgttttcagttttgtcttttttaaagtcatatttgattggtatatatgtatgtatgtgtgtgtgtgtgtgtgtgtgtgtgtgtgtatacatatatatatgcaacctataattaagaatgccagaaatacatagagttagcataaatagaaacacatgtgtgaacagacataaatgacattttaatttgtgtggctcttgagcatgttcattttccaggagccaatcagcattgagcagtcagcatgctgtgggcaatcattaaatttcatactgtgaaatttgttagtggaggttggttaaacatatctcttccctagttataacctatcatctttttctttatttctttggttgttttgctgcttcctgagcattatgccatcttcttttgttttgatatcctattgttgttggttaatctgaaatttatttaggttttgagtgggtagtaaagataaagatcatgcctggtaaaatagcttttttttcccaccctcaaatgatgtggcaggatccctgacccccatagtaagtgctttcttcaaagagactgatcaaaggggtaaaatgtaggatcatatggaaaagatggatagactgttgctggccattccaggtagcctgtgccagcagtggagatggaactgaatcctgtaaatgcattggtctcttgatacacatattggtcagctgatattgcagcgggggccatcaccattaatttagttgttaggtgtcctcctttgtatggagtccagttgagggtgttgtaccattccttgatctggtgtgtttgatgagttctgggacctgatttgtggactcttccacaaatagacatttgaagggataactggtatctcatttagataatagtagataaagtagtttcctaagcagtttaataagcatcgttatagtatagttcattaagactataacaaccaggaagtaactaaagaatatctataaaactgtacaatttgaaatcacactttgctctctgttttgtgagtttctgctggaaaattcatcttttaaatatgatatttttatacaagccttcctccgaagtaaacagatatctcttggtgcaactactttttccagggtcatagcattaggtcagctagtggaaacattgtctatgtgctgttcaaggctatgagtgacttcttagtagtatgtggaaaacaatattaaggaacacctatggggtaaaagttcttagtagaaaatgtgattacatgatagtgtttatgctagtcctagccttttcagtactttacctttaaatgttttatgtgttatgtgttatgttttatcttcaaaataatgtttggtattgatagattctgtttagttgccctactatttattgatactatacaaaactttagagtgatccaccagctttgagttgaagtacacagataacaaccaacagaaagattggtttctactgcagaatttcagcctcttaaattagttttcttcccttcctctggaaagcaccaatctcaaggcctatatttctccttttccaggtttaagtcattggaggttcttgctagaaagcacagacaaagcacatggagccagtgcccccaagtttttcagaccatctggaactacctgtggctgcttcacagtctaaaacttcagatggtgttatgatctgttggcagatggctacattgggatccttgtgtcagggttttcatttatctttccttttattctaaaatagaaggaaaaatgaaatggaagaaggatacattgaaagttgtgatattttctgtgaactgagaaatgaaacgtctcagaatatgtagatagatgatagatagcgttcctgctttggattgactagttttgtgttgtttttgtttggttgatttttgttctttcagattcacatttctttacctggaattagctaagaacaattggcatttataagagttgatggtataatagatctgattctctgtctctttctttctgcctctctctggctgtctccccctcccctgcctctctctctctttggtggcctggaacttgttatgtagatcaggttagcttcatacagatatccacctgcctctgtctgcatcatgctggaaaaggtatgaactatcatatctagccttcatagataggattttattgctggtgccttcagcaatacggcttaaaataattagaaaggtgtcactactttatgtttcaggaagagtgttgcaaagcttttaattcagtatttgttgacccaaagtgtctgacacattaaaataaagtcttgggatctaatgaaaagagaaaaataaccctaaatacacactgtgttgcttgctgcctcatttaattgaattcaaggtgatttctcaacttaatatattaagttttaatgcttcgctatatgtgtagggcatatctggctggctatgtaagtacatttatcttaaaatatctcaatatagttaggcttatttacataggtgtctgatagaatgttagctatattaaatatttagttgtttggcaagcaatttgacttttgtgcatatttatgtgcatattcatacataaacacactgacagagacagacagacagacacacacccctaaccagaagccagaggagtaacatgagaatatgtttcagatatatctgtaatgaagaatttgcttctggtttttgtgtaatattgcatttttaccttttgctacatgttttaatttttggtcattttcctgagaagttgttacttccactttcaacgtcttaaaaaaataaattttacagaggaatatgaaatgtatttaaagcttttggtttttttccttgtattactctctaagtcagcccagatggtggccattatggatagtaatagcaaggaagaaagctgttaataccacagtgtctagcatatgtctcccttttatgagtttgtgaactagtgtcaaaggtgtgctacaacatgtattttatgcagactagcttttagaacgttcctaaagccttccatctacatcaaccaatcagaatagattagacaatagttatctcttgtgcttttatccatggcaggtaactgcattttttttgaaggaagctttgatcttctcatctagccaggttttcacttgaaatttcctaactatgttgtgtggtcttaactgttacttttcaaaagctaaggtcttagggctgtagatgtagttcagtggtagatagcttgcttagcatatacagggccctgggtttgaccccaagcacagccagaaagcctctaaaacaaatactaaggtcctctagcatttgatagcatttagagcccacatacagtagagtgggcaattgtgttttttgcatatatgccttttttttctgtagttgggatttctgttctttttatatattcagtgtggaaggtattccgaaagtgatctaaagcaaccttggccttaaagatgtaacttgttctacaatgctatactttcttttacagtcttttaaaggttgtatttctagactttttaagtgtttccctgtgtgttgacaaggacattgaccttagctttgaaaatattaatgggggcagggttgtgactaaatggtaagagcacttgtttggtgtacacagcatgggaggaaaaggtaatagacatgagagggaaatgtgtaacagcacctgcgttaaagacatggacagtgagatctgaatgaaatacattttaatattactgaaatttcagttatatttttatcttggattgcttcactcttcttgagatcagagggagctatgattcgtactattatcataaaaacagatgattatatttagtcagcagtcaactgtgttggttctgtctggctaaaccaaaagcagtagagacaactagactttgatccttttatgccctctctatcctaggtcattatttctttgctgtaaaatcagaataatgaacttggtacattgctacatgggacagtatagctatgttcttcaaatggacttgagacctaaaaaaggtggtgttgagtgtatccaaaagggtagcaaattattatattaggtatgaataaattataaactatagatttaattaataatttacgcattcatagtatattaggattcagggtttttaaaaaaatgcacattattgtgtgtggatgccagtgtatgtgtgtgtgtgtgtgtgtgtgtgtgtgtgtgtgtgtgtgtgtatgtgtgtgtgtatgaagctcagaggaaagcttttaggactctatcttctactttcatgtggtttatgggggttgaattcatgtcatgcctgactggcaagcagtctacctatttagagctccttttaaaaatactcatttcgtacatgttctttatgtcagctgtataagtcagctttcctaatattcttatctctggggaatgaacaagtgattttttttttcaaaatgtgattgatccgaagttgaagagttagatgatttaattagatcagaattatttaatatggacagcttaacatatttttctgcattctaaggtctagaatttgtttttgaatccctgagatctagagttgagaagaaactgaagttcatccaagcaggttttaaagcactgagttagaagtcaacagtaatcgtagagtttgagacccttgagggtctcaactggcatattctgtttattggcagagaatctcttggtcaattagctatgcttgaagtggacatatgttaacatgagaatgataaatatctagtgatctgactaaatccattatgactttttaaaagtacctgatagagccttttttttttttacagattctgttttgctgggcatattaggaaaaagtatgaacaatatcatagtaagttacaggattttctatatatcaggagttaaactttcctgtctggtacagaaaatctgaataacagcctaagtaaatttgtgtccattttcccccacaaaataacagttccaaagtatattccatggctgacatgttacatctaagatactattagggacacggctccttctagccttcctttcaactctccttattatatacttaaggtcacagaatagtcttcaagtctctattcatcatgtttgtggtggaagcaagttgaaaggacagtacaagatggttcctgccagctgagtgagccatcttgaataagtttttccataaaacaaaagaaacacaatttccttttatctcactgactggatgatatcatgaaactatctcatttactaaaaagttgggaaatgtattttactggagtacattagaaactaacaccattgggcttctgatagtatgaaatagggggagaatatatattgaatagatgaataataatctttgctacagaataactctctggctatctaatccttatactttctgtacagaaaactgcccaccctttctgtgatgaaaaaaaatctctgcattgttgtctttaattcctcagtgtctttatgatgtacagccttctccattaggacaaggtaaagaatttgaggaagcaaagatacattttggctcagattcagaggtcttggtgcataattcttgtcttcattgcttctagttctgtgatggtgggagctttgtcagaggtgactgttttcgtagaactacaggaagctgggacagagcaggatcaaatacaacctccaaggaccagctggcagtggcctacttcctctaattacattctgccttccaaagtttccagaaccactcttatgtaacactaccagttagggaccaagtcttttatggggagactttatactcgaatcaaaccataataggtagaaaaagaataggttaactagtaaaactttctgccctgaaaagaagaaatataagttatcattcctatcggtcaaggaaagtggactccttaccctggcttcttggatgatctatgtcagcagaacctattcctgggtagctgctctctacggtgtgactttctttgccaggaaagtaaatttgtaaggaggagtttcagaggcctgtgttctgtcagaaatttctatggaatccactgttactgattgggaagcctaagcaaaaggcaggcaattagggtaggtataattactgaaatggatagcagagtcagccaagcaaatagactgatctgtggtgccaaaaggtgttttctttacccaccaagaaacccagggctgtactttagaaactctaaatcacccttcctcgctcgtttaccccatcgagtgctagaagttaaccatactttcctgggggctttgtagcttctcaaccaataccctgttgctggccatttaggaccataaattattttacaattccaataggtatttttggtttgctacaggacaattttggagtcttcatgattatatttaccacaaaagatgtataggagtttatttacctttcttatattagtatgctgcatgggagagaacccatatctttctaaagaaaaagccttaaggggctagagatgtagctcacttgataggatgcttgcttaacatgaatgaagtcatgtgttccatccctaactataaaactgggtatggtgacacatttctgtaatcctagcacttggaaatggaaggaagaagatcagaatttcatgtcatcctttgtgacatggagagttcattctccaccttattattttgagtcaagttttcttactgaacctggagttaggctggcagcaagcaaagccccagaaattctcctgtctccacccaccacagcattgagatttcaggagtgtggccactcccagctttttacatgggtgcttgaaagtcaaacttgattctttgtgcttgtgcagcaagcatgtttacccactgagccaccagtttttaagactagttttcctttaagtctttcatttgcctcaatctaggggataataggcagtttaatatatatttacttagactcaaaaactgaaagaaattagaactagggaaaatgatttttccaaggacaacgtttagagaggacatggaaataatatgagagggaaactatatagacacaattgctaagaagggaattaattgtatcttgggtattccgagcttctgggctaatatccacttatcagtgagtgcataccatgtgtgttcttttgtgattgggttacctcactcaggatgatatcctccagatccatccatttgcctaagaattttatgaattcattgtttttaatagctgagtaatactccattgtgtaaatgtaccacattttctgtatccattcctctgttgaggggcatctgggttctttccagcttctggcaattataagtaaggctgctatgaacatagtggagcatgtgtccttcttaccggttgggacatcttctggatatatgcccaggagaggtattgcgggatcctccagtcgaactatgtccgattttctgatttccagatgtccagatgatttctgatgtccaaactgatttccagagtggttgtaccagcttgcaatcccaccagcaatggaggagtgtattcattgtgtgtggggggagataaatgatcaataaaaaatgggcaaagtagtctttctgtgatcctattgagaccaaatgataccatgctatttaaactaggtgatatacttcacccagactattcactcctgtttacagtgaagggaaccatggaaaaagtaaacccattgctagtagtttctgtttacaaatattagagccaggattagttactttccttttgctgtaacaaagtaaccacaaaaaaagcttaagcaagggaaggtttattaaagaattatttaactttatgtatatcattgttttgcttgtatgtatgtatgtacatcatgtgcatccatggtgcatccatggtgcccacaaaaggtcagaagagggtatggactcctctgtaactgaagttaacagatccaccagttaacagaaccatcatatgggtagggtactgagaattgaacctgggacctctgcaagggtaacgggtgttcataactgctgagctctctctccagccccagtaaaggtgtattttggctcccagtttcagagacatttcagtctagcagatctccttttgcggcagtggaaggacatggcaggtttttttttttttttctcatcatagccaaccaggaaatgcagcccactaactggaaccagggatgtaaccttgaaagcctgcctttaataaccttccttcagacagactttacttcctaaggagatccataacccaagagagcagcactattttatgggtaaaaatataaatccttaggaagccattagactaaaatagtgccacaaactggggactaagcatttagaacatgagctagtgaaggaaactttagattaaaaatacaacaggagctattgtataatcacttctttcttgaaatgaaaagtaaattcttttgctttcagtagtagttatcttgcatattcttttaaaatatttctgtttattctttgacaattgcatacatgtatacagtgtatcttgattatacctacccctctaggttccccatcctacttcctctgaacccctctcaacacatgccccctctcacttttgtgtgcattttgtgtgtgtgtgtgtgtgtgtaactcatccagtttatttaatactgcctgaatgtgtgtaggtatggagccatcccccagaaagagcatgaacaacatagtagcagctatatacttctagcaaaaattgactgcctctttcctaactaccatcaattgtcaatagcttgtcagctactgataatgtcttgtaagtcactcctttatctgtgtgggaatgctgatgctttgcatgtcttgagtgggtaactatagctgctgtgaatttttgagaacaacatccatgttatacacagaagacagcatttcacacagacagcatttcacattctagctctttttttctgctccctctaatgatgttgtctgagccttggattagaaggttattgatacagatatcccattgatatagatgcccattaccttgcatgtttttaagtttacctttataaaaatatgtttgatcaatttcattaagacgtagacattttaaacactcctttttgtagcatgctggactaagaagtaatcttgaaggacaagttctaatggagaactttcatgctatttaacttgaaaggttttagttttataaatttactttgctagttttcctgaactagatcccccaaattggtatataaagactgagtagcatgcggcctttactagaatctcattttcttttctttttcttttttaagagttgctatttttccacaatttatttatttatttattcactttacatcccaatattaccccttcctccccacacttccccctccccttctcctctgggaatggggaatcccccctgggtattaccccaccctgtcacatcaaattactgcaagactaggtacatcctctcccgttgaggacaggcatggtggtccagttaggggaatgggatccacaggtaggcaacaggttcagagacaaccctgctccagttgttgggggatctgcatggagaccaaacagtgcatctgctacatattgtgagagttattgtgtggattatgtccagtccatgcttgctctttggttgatggtttagtctcttgagagcctccaagtgtccaggttagttgattctgtggtcttcctgtagggtccctattctctttgggtacctcaatccttccctgattcttccgcaagactccctaagctccatctaatgtttggctgtggatttccacatcaatttccattggctgctggatggagcctctcagaggacagttatgctaggctcttgccatacatgtcctttagggaggacatgcaacctttacttgaatatcagtttctttaaaaaaaatctcaaatacttttacatcttttaagacattaaggaaagaatcatcattcttgtgtaccagttatcaggtatttttaaaaatattttaataacatgtattatacaaaataatgaatttcacttttatatgcagaatgtatttagatcatccacaataatgtatttagatcttacacacacatacacacaaattactctctcttgtccctttcctattccctctgattctcttctttgctaccttaatgactttcttggtgatccattaagcttcattagagttgattacaagaatatgggagtatgggtaagtctgttttcaggaccatgtgtaccttttgagcagcgattcctctgaagaaaagtgtctttctctctcccctgtcaaccattagcttgcctcagtctcagagaggaatttggagccctgtgaatccatacctcctcagcaacaggttattgataggctcagtcttgtacagaaaccacagctgatgtgtgttaaggagtataacagccattgtatgcctagaagttggtgttccatactagcactccactcttgcctctcctccagctcttgcattctttcttccccttctgtggtgtctctgggcctagtagggatcccatgcgtagctgagcattcaccaggcacctcgtctcagcactttgaacagttacaactctctgcaggtaacactgacctctgcagaaagaagcgtctcagccgaagcagtgcttagttattttattagatagcagggcttaatactggtaaataaataggagctgttttattgaggatttcttaaatactaggcatagcaggaaatagtttacattctttaatcctcaaaacaattcccaaaggtagaaaatattatcctgtgttagttttctggcataataatgtatacttgagataatcaacttgtaatgagaagcgatgtatttgcctcatggatttttgagcatgatcaattgtacctattgtgttgctctgtaacaaggcaacacatcatgacaggagttcatagtggagggcaacttcttacctcatgactgggtgactaatgagagaaagatgtttggagccctactctacctttcaggggtacatctgcaatgatctcaagattgcccattatgccccagtatttaaaagttacacaacctcccaaaatgcagtgctaaggaacacaatctaactcaggaatctgtctctctactctgcaattattcccatgtatgtgtggaagccagaggtcgacactattcgtcttcctcaatcactctccactggattttttgagacacagtctttcactaaacctagagcacactcatttagctagactagttgtctaacagacctcccagatctttcctgttgctgccttcccagcactaggtttgcaggcacatgccacctgttttgtgtttgtttgtttttatttttttatgtggctggttgggcatctaaacaaagatcctcatacttgcttgacaagtgctttaccaactgagccatttctccagcacaggatttaatatctgaaacatttcctttctttatagagatttgtaaactgaggctcaaagagctgtaagcaataaagctgggagtctaagttaatttgattctaaagtctgtactctctaaaattatgcatggcccctgccatttgggaattcattttaacagggggaagtaaatagaaaaagtaaatgttcttagttttgacatagttgctatgtgccttgcagtgtctaaaaattatatgcaaaagatctttggaatgcttagtgaattaaaatggaatatcaactccacatggcatagagcttttgggaagtattaattcaacaaaatttattgagcagttatgttctgggttcttttggccttgaggatataacactgactaatacaagagattctgtttctgtcatagaaattgcaattcagagagagaaacagatgttaaataatcccataaacagttgtttaaaagtcattgatgttgaatactatgaaggaatggcacataggttctatgagagtaattgaaaaggaaattaagcctattccagaaatgagaaataatggaatagtctgttttctgagaagagatctctcaatttccacaacctaatattttatgactcttgattcattattatttctgcaagtatgctacagacttgtactttgtgtcacttgggaagaatgaatttaacttggtttgaagctaatcttaggaagatgattgtgagtggtatagctagatgcggtgcaggtctagattgtattgagagatgagtcaggaaaggtaggcagaagagaaaaatatttatgtgatcaaatctggttttctattaaccttcttcccatcacttcagtgaatccaagaaatatgaaattttatttttccctctttctaattgcattttaaaaataaactatgtcaatattgactaaagtagtttggataatgagatgtcttacagttctaaaaatatctgtaatgcagtaataatgattggaatcacattcccaaagtgtaatggtttgaatgacaatgtctcccataggctcagatatttgaacacttgctctccagttggtggagctgtttgggagaggtttaggacgtggagcctatctggagggatatgtcactgggagccaccgtctctgcttcatgagtggtttaagatgtaagctctcagcttcctcctccttccatcatgcctgactgttgccatgcttgtctgacatggtgaattcttatccttctcaaaccataagagaaggtaaactgttttcttccgcatgttgctttggtcatgttgtcacagcagcaaaaagtaactaatacaaaagtagtaaaatgctggaagggcttatagctaagctgagggcttaggttttataagaagatacagttaactttccatgactgagtcccacatttgtagattcaactaaccacagattaaaaataacaaatctctactaacattgtgcgtgtttttctgtatattgtaacctagtatgaaaactacttaatagtatttgcattatatttgcataattgagaatctaaagaatgtaggtggatctgtcttagttgtatgtaaaaatatcccatatcctatttaatatagggagttagagtaggaaccattatccacagatgctgtactattcatcatttatataaggtcaagttgtcctgaaaagaaaggtggtggttttgtttatttacccccaccccacacttctctcccttccccctccctctcttgcttcatcccctttgttattcctggggcaggagggtggctatgtgtgtgagcacctgtgtgagtgccccccatctgtctgtgtaatgatagggatgggacccagactcttaacccatgctgaacaagagttctaccactgagctacaaactcagtcccaaagaataaacattgttttatttatttatttatttatttagtgctggggattgaacctcagttcttatgtgtaccaagccaagtgctatcccactgacttttatccataacccctggagagaaattggaattatatattacatatttcattttatgtatatttgtgtgtttatcacatacatgaaggccaaaagatctctagaactgaagttttacaggtgattgcaaggtgtgtgagatgggttatgggaactgaacctggatccttttcaaaagtagctcgtgtttttaaccactgggctatctgatctagtccctgaagagaaagtttttaaccttggtgctccaagtattttctgttgatgaggcaacacgaattttgttaatgatcctagagggaagtaagagctcaagtaagagaaaatggacagtaggagcagcacagggagtgtgctacagagcaccaagaactgcctaggactccatgctctgcatcggagctgggcactgccagtgtttggcactgactactgagcattctggaatatgaatcaggatttcacttttcaaagctcactcctaagactgaaccatgatgtaaagtacagcaaaaaaatcaaaagtatatacagctagtaaggttttatgaactagaatcctagtaaagaaattagaacattaccaaaagccctgtctcatattacttttggttatgtcattttattagaaaatggaggaaataatctttttcactttttaggagtaccaagaaacagcacaaagtgtaagaaaaaaaccagcccccctaatatcataaaggcataggtcagttttccaagaagagcatatttgcagcattacgaataaaccaattaaatttgaagtaattatggaaatatcttggagaattgccaagcaaagggtgaaatagttgtcagtctaaaaccaattattcaagagtcagcaagatggttctgtgggtagacatttgcagttaggccccaggaccacctgagtgatccttccacacagtggaaggagagagctgactcctagtgtctccttgagttcatctgcttgctggtttactatctcctctgtcagactttgggactctccctgcatcatctctcttttatcttactattttctcttttatcttactattttcctgccagggtcctacctcctatgtcctgcctcagctcattggccatcagcttttttattgacaggtgatgtttataagagatttttttttttaacagtaaacccctcctcactgggaaaattactttccatactgcagcagactgttttctggcaacaaaagcttattactgaaattaaatctcttcactaaaaagtacttatatgaaatgttttgatccaatattacatttttagtacatttttagtttatttattgtgtatgtgtattcatatgtatgtaggtgtgcataagctacagcacacacatgtagatcagagaacaacgtcaggagtcagttctcttcttctaccatgtaggtcctggggatggaactctggtcatcaggcttggcaaacaatgattttgcccactgagccccagaaattaccttttggacacaagtttattgaatgcagtatattgcgcgcgtgtgtgtttgtgtgtgtatttgtatagtaatagatatatatttcttcataaaagtgtaatggtgtacctattcatgctgagctttttataagtttagtcataaatgtacccttttgtacaaaataaatcaagtgtgtttattagatgatgaaaaaaaaaacaatgaagatgtggggaacactattcctgccatctcgtacagaactgataaaagtttggaaacatttataatttataacttacatcccatagtttactaatttttctgatataactagagggaacatttcaagttacatgggatatataattatattttatatcaaatttccaaaatttagtgcttgtagaagttaactaaatgctgttctatttagcatagactcagctatccctgttgccttcagattagcaggaaacctacataccaaatcttcataatctcttcaacaaaaagatttctccctaaatcggaggggagaatgtcagttttaaaaattacttgttttttggattaggagtagcatgtattttgtctgtctttaatttgttaaaatctcatcctttaaaaaaaattgagtccatgtaataaagacattcaacatcagaatgtgttttgctttttatagtaaatggtcaaagaaaaataatttatcagaaatgagacttttactttggagggtctttatgttgtaatacattttttcttcattaaaaatcagttatgtagttagttgatatcagttcttttactaacactgtatttgatctgttctgagtttttaatgagagagaaataaaaatgtttaaaatatgagtaactattttaaaagacaataaatatgcacaatttcaataaaatgaaatttaaaaccagtaaatgtagtagaattctcaggattcttcctattccactttacaatggagaataatattggtaaatgttcttggagttgccaaggttttgttaaaaattacattttaaaggacaacttaaaaatataaaagtgagccgggcgtggtggcacaggcctttaatcccagcactgggaaggcagaggcaggaggatttttgagttcgaggacagcctggtctacaaagtgaattccaggacagtcagggctacacagagaaaccctgtcttgaaagaatatatatatcaatttttttttacttatcaatcataagtaaaggcacttatggccaaagcccattgatctctaggacctacacagtgaatggagagaactgactcccacaggttgtcctttgacctctacatacgtgcaatgatgtatacacacatacatgtgcacacacatacatacaaataagtgaaataatttttaattacatgaaaagtcaaacttgaattttgttgtttatttatcaatatgacaaccagagcgccagtcatcctgcatttttatattcatgttgctagggtgcaaatagtggcctttatattttgttggttatcagcagctctctaattgaacttaagaactgctcaacaggagggaattcatgctggccaactacatatggctagtgaggtcatggacttcagaggagactctactttcctaaaccagtataattcccagctacattttaaatacttatccttatatccacagataaacacagctctcactttcatcaaagaagcttctttttgtagcagatggagactattacaaaaaacccacaactgataaaaatacaggaaacaactgaccatggggtacccaatccccagttgatagatctaatacaacctttaccctaaggttcagggaatatcacataagtgggtatagaaagagtttaagaggcagaggaccaggatgtctgctgtgagatagtcaactacacttaagaaatcttaactatgtggttgcctaaacaaggccttcgtgatagcaacaccagttggtatacaatgtgaataggggaaatctcataaggccccatccctagattaaaagctatagacaattaatggctgctaagagaaggagaacagtcttctggaatgaattccctgattggttatctgacaccaagtgcatatgaacaacactaaatggatttagcaagaagtgtgtatttgtgtgtgtgcaaaacagtaattaaagaagagatcatggatttgaggagtagagaaacatgggagaagagaggtgtggaaatgatggaaatatatttgtgtgttaaattttcaaaaaaaaaattatagagctagggaaatggctcaacaattacagcatttgccattgcaagcattaaggcccgagtttagatccccagaacccatgcaaatgccaggtgggttgggtggctcacctgtagtttctgctttggatggtggagcaagctggttagcgagactagtaatattggagagctccggccttattaagagaccctgtctcagtgagtaggtggaagagcaattgagaatgattcctgagacatacctcagactttcacaggtatacacttgctcagacacttgcacatatgcaaacgtgcatacacacacttaacacagaccagacactgtcaagtttaaaagaaagcagaaaaaaaaaaataacatttacaggttaaataagaatccaaatagagattgaaacgatttccactttaatcaaataaaattgttgtgatttctggaagtgatcctaaaataatactcattaagtgttcctatgacatatttatagggaccatgagtactaggttttcactctttttctaaagccctggtgtatcagataaatcttgcactcttgagccagtgtggacatttagaaggaaaagaaatagagtggtatgatgtcaatgaaaactgttaatactctgtctctgttcttagtgccttgtgggagctagtgatcatctcttgcattttgtagccatagagtcattgacaaatcaaagggtttggccaaatgatgccttggattcatctccacacatgactttattttattctagatatatctctagtaaaactttgttgccagatgcagctcttgaccttagatatctcagacctcagaaacatgatcaaatgaatctgttataaattacccagtttgtggtaattttatggtagcacaaaatggaataagacattgtagttaatcagataaatcagatactcatgccgatcaatcacttaattctcagaataattctgaattaattatacttagtagtagtttctttagccctgttttacagatgagcaaactgaggtacagggaagttaaataacttggcaatagctctccaatatttttaactaattcaatcaaatttcaaattttaaaattctaagtgtactgtcaaaaactttcttaattactatgctattcctgcttcatacctatattggacttgcactaaaattacataatctttatctcttttattagaagtaaaaactactctgttacaaatatcagagaattccagccactagagtatatccctagcagtggcctgcagtgctatctccatgttcaacagcaaccagcacatcagaaagccaatattataaccttttaaaggaagcattattatgccttcatgattaccatgcttcatttaaaatacattcttgtttcccttgtagtcatatctaccaactttcttccattgtcatactgttaacacagtgccttctaatatcttgttaactttagagtcagagagcttaatcaattacatatgttggtaccagggatgagggtcagatgtccctccagcagtgcttctaatgattagaaaagtagcatagctgttctatccaagctgttctgtatgacgatttagaggtggaaaaaggccaaaaggctttacaagtacaataaagaagctaagtcccagaaccttcagctaagaagaccacaatgtctagtttggtggtaaagaagactcagaaactttaagacttcaaaagttattagtatgtacttttcaaatattcattgtcttggatcagttccactccaatcaaagatacaaacacagactttcactctttagaaagcacattattgagactattctcttgcaaagtaatgactttttggttcagggcaggactctctcccaagattttagataaagccataaagagcgatttgctctaacggctttagcatcatatgctgtgttgatagtttatttaatttttaaagcattaaacattcaaatcaagtactaatccaaattagtaagcatctgttactatccatgcttgtctctgttctgtggagaactatcatggcaaggcaaggaggaaggagctgcgacctagatagaccttgccaatactgctgaccacaatcatattttctctttatcatgaaacattttattatgacaattaatgttgcagctgagtggtctccttaaaatgactaatttttatgaatagtatattacctgtatatgagatttctactataatttgatttgcttacctatacctagtctcgagattcattttatttgtataataaatgaaagcagcagatgtatagcactttggcttatttgtaatacagatcagataagtgtttgtgggaaacgagaggcataaaacaagctttaaaaaatgcagtctgttatatggaagttacaaactacagtttcattaaggatagtaactctgaatttgtgcactgtgaggaacaagaatttttataagtgaaatagtaatggcttttttgatgtgttccctggaaagaatggtgagtcataatttttcaattgattaaactctaattcagtgtttctagtactttttactaataatattacaaccaaaataaaataagtgcgcagtagaactcatttcttctgttgtggctctctaaaagaggtctgagcaaaccctaattgtcctcatcctgcagtgaattgtacaacagatgcagttttaaagttttggttcttggcgtgaatttttcaccttttattccagtattagccttttgtttgaagcacctaatgttaagtggcatcagtgtgtatttctaaaagacataattagagtctctcttttttactcctaaaggaaaaaagcaaggtcagcattgactttttgcagctccttctccgggtgttctttgaatgcaactgggcttggttaggtcaaagtcaacagtatttgtttctttttctttttggctgaaatttaatattaataatataattaaatattttggattaaaaagcccttgtgagaacatctttcaggtagtactcaagtgattccttccatattcttgatagttgtagtgctgataaacaaaaaacacttttctgtaagcttttcatttaatttatatttaaccatgaagaaggtgcttataatgtggacaccaaaagaaatagggagcaaatgcatggtctcagttgatgtattagaaatcttttgatggctttctatcattacttatgtcaaaacacctgagatcattaacttctaaagggaccagtttcatttggctcagtttcagtttgtgattaggcagatctgtcactttcagcctctggtgactagtagtggcaggaaacatgccacaaagcaaacctcttactttgtggtcagaattcacaagagaactaggaagatgccaatcgaatccattcaggtgcctaaagaaagagtccctgtcccttaggcctcacctccgaaagattccaccacctttcaattatgctattctggggaccaagcttccaacacctggacttctaggggataggaatttaaatcatgaaacatcttctagaggagtaattttacattagttttgcaaggtgattttaactatcaaaaccaagataggtaaaaacagccacagccaggagaaacctaaggagatacgatggcatgtggtataccttggtgtagatgagatactgatacagaaaaaaaaaggatatttaagtaaaaattaaggaaatcgaactaaataatagacatgatttagtacccatttatccctgtaggttcatttattgtaacagatgtgccattttaacttcatcaaggaacgaagtacatgctatgttgaaacctgtacgttgttttatgtatggctttcatcctcctgaaaacctaaaattatttgaaaaaaaaaaaaagacatgatatgattggatgtgccttgagatctgcacttcagcgatcctgcattatgcttgatcaagcataattcaaacatgattccatattttaaagaaaactgacaatccgagttcacttgtagcagagctgaagaagtggtgaagataatcgtatctcatcgtctgaaacttcaatccaaatgtattctaaaagtgaaagcaacactgtttggggtataggcaacctatttctgtaaagtacctgatagtaaacagtttattctttgcagtccatatggtttttcattgacaaccactcaactgctattgaagcaaaaaagcacacataatacataaggcaatgaatgttgctgaatttaaaaagtcatatttattgaaacaggtgagtctggttttcacctgcatcttgtagcttgctgactctggagctaaaagctcatactgctccgtaggtaacatattaactcctttaagaattcataaaggagtacagtcagaacaagttagaatagtattgctttgcttcagttggcagggcgtatagaaatggcagcggtggagagatgaatgtacatggtttatttgcacataagctcatttgccatacttgtgagggactatcttgattaggttaattgaggcgggaaaccccatcctgaaagaagagccttttgccttgtggataagactgatcagctgcctcaaccccctaggtttgcctggaggctggcctccaggatgattccagaccctgtcaaattgacaacactaaccatcacagcatttagggtcaaagcctgggccctaaatgccctcacaatctaggctgagcactcaccatttataagccagtttaaaagacaagtagcagcaaagcaaagaaaggattagtgtgagtacattgggaaaggaacaagtagaggccaagtacccaccctccccagtctctagtgtcttgacatgaagattaggcttaagtaaagaacaagaggtagacatacagttctggtcatgatgtgggagtgacccatcattggcatacatagcattgcctaggcttctggctactagctggcctgcatttgtcagtattatgtaatatctctttctggaagcatcatcccctctccagatggaatccagaccccagtgtttttttctgtaacataaaatcctgaggtaattttaattccttgaaatccattgtctcaatagttgatagtcaaagaggaagagtgtttccctttagggcagtgcttctcaactttcctaatgctgtgatccacaactcagagttgtttttgttgctatttcattaactataattttcctactgttatgagtcataatgtaaatatctgtgttttccagtgctattagatgacatcacccctgtgaagggtctttccacccccaaagggatctcaactcacaggttgaggactgttgctttagagtattttctctcttgctgggatagttctattcttactgctccttgcactattagaaactatacccttctctccaatgccacccctccccccaacaaaagagactgaagagttttagggaaagtaggctattcagtacgtgtctcatatgacttggtggtacttctgatatgatgacagggagatcttttttctctggatgtagtgtgaccatcttaacagcataaaacattgtgtaggaatttctttaaaacacctggataaattactttatttttcctgtttattggattttaagttttagttatttgggagaaatcgcccagcatatggtttaagaagtaaaatcttgctagtgtatgcaatggtgtcatcgtttggatgctgattatggggtggatccctggatatggcagtctctagatggtccatcctttcgtctcagctccaaactttgtctctgtaactccttccatgggtattttgttcccaattctaagaagggacaaagtgaccacacttcggtcttcctttttcttgagttccatgtgttttgcaacttgtatcttgggtattctaagtttctgggctaatatccacttatcagtgagtacataccatgtgggttacctcacacaggatgataccctccaggtccatccatttgcctaggaatttcataaattcattctttttaatagctaagtactatgtatcagaagatggcctagtcggccatcagttgggaagagaggccccttggtcttggaaactttatatgcctcagtacaggggaatgccagggccaagaagtgggaatgggtgggtaggggagtgagggagagggtatgggggacttttgggatagcatttgaaatgtaaatgaagaaaatacccaattaaaaaaaaagaagtaaaatcatagctgggtgtggtggtgcatgcctttaatcccagcacttgggaggctgaggcaggcggatttctgagtttgaggccagcctggtctacaaagtgagttccaggacagccagggctacacagagaaaccctgtctcgaaaaaacccaccccccaaaaaaaaaaaccgaaaaaaaaaacccaaccaccctcccaaaaaaaaccaaaaaaaaaaaaaaaggtaaaatcataaacatttccaactagacaaaggtaatgagacaggaaaacacagtattgcccagagattaagaacacctaagattttatgaacattaggacagtaaaatcaaagagaaccattagaaaccaaagcaaggaagaatggctagcaatgagggatggtgtgtagctgttgaaaatggctcagtgttggctttccaatccagtctgaaaactctgtgtgtatgtgtgtgtgtatccaagttttattttatgcctcaataggaaagttggcccaggctatctatttaactattattgaaaagaaagcactccctggttatttcttggttcttactcttagtgaaataacaccttgtagtatgagagataacatattttaggggagaggtagttaagaggtacttacaagattacccctagctgtcctatcttgtgtgtatgtgctaggtatgcctgctatcttctgtgttccttgtgactttccgaagtatcttccatctctgtttcacagttcaaataagctcgttcctaagatattaaataactactcatatcatcgtaattaataataatgacacccaggacccaactcctgttcttctaaactcgtagctacttactttataatggacttgattcaaagaagaaaaagttgaagtctgtcaagaatggcttttttaaagaagacattttttttttctaattaaaaattattttgaactggagtgcttggactcctaggtttcttcggcatgacaaaaggaagctgtaaattcattgtgaatgttaatgcttggctagtataaatgaatttgtttctttcgttcaatggtcagtcaatgagagtacctaaaaaccctcacatgttgaggttatggagatggctcagtgagtaagagagctttctatataagtatgaagacctgagttcataatccccagtaccaacataagaagcctagagtggctgtgctctttcaggtagagttggaagaacagttgggacatgctggttgctactgccagtctagtcaaaatggtgagttctaggttcagtgagagaccctgcctctggcatataaggtagaaagttggacatttagcatcctcctctagcttctacaactgtacacctatatgtcactcccaaaagaaaccttgcatttaaaacatgctccttttgatgattacttaatttattttgtgtctatactagatagctttaatgcattatcctatattttttcctactagttggctcaagggttaagacatgacaattgcttatgtgttcattttaaatgaactgatgagtgaagtggttatggctaaactgttcctctttttcttttttctgtctgttccatggctatctatcagttcaaacttatgcttagcattaatttggaaccataacctttttaaaaagtcattgtctgcctgtacaaaaggagttatatggataattagttttttctacttagtatttcttctgttaaaactattagaagcacatatataatagtataaactgaattatttttagtgaactattgaaacatgcaacaaattactgtcattcctttttataaaattttaggatggaaaactttctgagctttcaaagagctacaaggttctattttgggaaacatctcaactttacaaggcctgttttcagtcattagaataaggaagtatttaagtacaagctgcccctggtgaccttcctcaaatgagacttcttctctttataaagtttccacaacttcccaaagtatcagtagcagctgaggaacaaatgttcaaaacatgaaccaacagggaccgttttagacctaagccacagcatctcccttataaatacagccaactggcctagaaatggggtcatgtaaaagcagtaagtgctttctggatattagaataaaaaaaaacggagagagcagttaggaacattagaatttaaataaaaataacaagcactaattagctcactagattttttaaaaaccttccacttgctcctagactgagcatcagaaaatctatgacacatgtcatcagtaaacatagaaaacaaaaatcccttaagcccactttccctgacaagaagaccaggaaataggaatcccaacaggtcttacacatctctgctgctccacactggacccccccgccatgtgggcaatattatctacccactggaacggaaatatccagcccctctaagcccttataccacaattggactctagcaggtagtctgacctgacagccactacaatacctggtcatttcttcctctcaatacctggtcatttcttcctctgtgccacaattctggttggtccctgtagtctgaaatgacagcagcaaaacaaaggttatacctacttcttacttctaccaacaaaggataggctgtgtaggttgcaatcatttgttttccttcccttcaccccatatcttaaggagaccaagacccaatagcttgtgagctctttccctcagaactgcccagagataattagcacatggtcctgggaaacaacttttgtccctacaggtgatatctcaatagaggttgaattggagcctgtcttagtttctttttttgttgctttgacaaaatgtgctcacccaagtagcttaagggagaaaggatttattctgacctatagtttaatagttatcatggtgaggaaattcagggtgacagaaacttaaaggagctgctcacatcacatctagtcaggaagcagaaagtgctgaaagctgtctctccacctgtgtagtccaggatttgagctagggaacaacagtgtcattcacagagggtgggtcttccaacctgaattaaatcaatcaaggtacttttcataaacatgtccagagtcccatcttccaggtgattttagattctgtgaagttgacaatgaatactagccatcgcagagcccttgaagaataggccagagtagccttgtgagtgttgagaaaattacacagccattggaaacaaggcctaaaaaagcagtccatagtttatgtactaaacctaaataaggtgactacctgctaagataaaaggtcctatagtccctagtccctaaataatatgcatactatcctggatacacaagtgccaggtaaaacaacttaaatgagaatagccatccaattgactccaaggctgaaatgaagcagatactagaatgaactgatgaagaaaatttttgttggtgtcctaaagttgctccaacaatcagctgaatgaaaaggtttgcaaagtgcagtaggagcactaactaattaattacagttagaatgtcaaagaaactggtcaagaatggcaccagaacttcttgctaagctattaggagttctcttcaactgtaaaagggaaaggggaaaagagaacactcaggagttcacttgctcttgctttgagggatatggttggctgttcttgtcttgttctccacgctgttttgtaccttacttgttactaggaagtcatgtaaacgatgagagcttgttctgctctttagacggcttgcacaggagctttactaacgagggtacactattgccactcagggacgttggtttcttacctaacttaagtttttttctaaatgttttgatattttactatcttgcttaaacaattatatccactgtactcttattttcagatttctttccccaaagcaattattttccagatcatctactttacttctttagacctagaaactgattactacaattataattcaaaacctattttctgctgccctgcacccgagctgggtaattgagtgtaaatggttatttcctttgcatgctttgttgttgtgttaagtgttttttggttaaaagaccagaggttgcctgctgaatatgcgtatattaacaattgtaaaagaaagtaaattactttggggagtattaatgaatagacatttaaattacatagctaaatcttttgaatccattattaagcaaacaattggattaacacccccaaagttatttaatcaacagtttataagccatatttgaatatttgttacagaaaatgatatttgaatggccattaaaacattacaacataataatgcatgttgttattctaaatattaagattcaagttatctctctatatatgtgactttgacaaagaacaaatttaatccttaaaagaaagatccatatcattgtagtatcagtttttttccagagaacaccaatgagtagtaatttttacatgcgtggcagggattgataggctcagcaaggtaggggtgcttattcccaaccacaagaccggatcactaataagtcacaggatagaaggtgggtaggtcttcatgtgatagtccacaatctgacttgacttagaagatttcattctttaaaaaactctgtatgataccaattcagaaaacctcaatttagagtgttagctaattatgtttttttgttttaatattaatattactaccttaagcagctaaaatgaaaagtaggtaagtagatattactggcctcaagatttcttttactaacttaatttaaactagatacattaattttatataatttacgactaggtttaactagggatctttaaaacatgattctgaaaagaaagagatttataatactccacagaggtatattgaaaagcagactgttagctgtagcttctgagcctgagtagtaatcccacctcattcttaggtacagttgtgataatggcttccaaaaatactattgtatgacgatatgccatcttgaatacaatctgttagtgaattgcaacaaaaacacattactttgaagctgtgatttacaatgcaatttcacactctcggacttcaataattattagtttcagtttataagaattggattatgtacagaaaatttgacaattgtgataatgctagcactaattataggtaattttgttgaacactagtagaaaattaattaaaaagagaaaaagtaatcccagcactcgggaggcagaggcagaggcagaggcagaggcagaggcagaggcagaggcagaggcagaggcagaggcagaggcagaggcagaggcagaggcagaggcagaggcagaggcaggaggatttctgagttcgaggccagcctggtgtgcagagtgagttccaggacagccagggctacacagagaaactctgtctcgaaaaaataataataataaaataatttatacaatatattctgatcatatttcctctctatccccaactccttctaggaacccccacttcccctcacacacatataaccctccaaacaagcaacaagacaagatatgccaacacatgtacacacacacatatatacacacacaggcacgcacgcacaaactatggaatttgtattgtgtcagccaactactcatgggtgtgggacctgctctgcaatttggttgatagatccaatgtcactccattggagaaaactgattttccctttgccagtggatatcaattataaatagtttctttgttaggggtggtagcccaagtccacattcccttcacagtgctgggacccaatctggcttgcagctgtataggtcctgtgtgtgttggcacaatcttcgtgagttcatatgtgcatcagtcttgctgtggctgagattgtttcctttgagacatccatcacctctggctcttacagtctttctgccttcacttccacatagatgcctgagcgttgaggggagaattttgataaagacatcctatttagaactgagtgctgcaaagtttctcagtctatgtatattctctagttgttcatctcttaattcccatctactgcagatagaagcttctgtgatgcagttgagtgatgcactgatctatgggtatagcaatatatcattaggagtcattttattgctacgttccagaacgtacgttagcagaattgtattaggctttcacctaagtccatagcctatctagtatcaggttcttagcaataagggtctcatcttatggagtgggctttaaactcaaccaaaatgtagttgtctagtcccataacatttgtcctactattgcactagtatattttgtaaacccatcactgttgcaggtaacagggtttatagttggctgattgcctttctcctccagtagtacacagagtacttccctcaccatgaaaactattcgtgctgctgcttcttgtatggtaccagcacaactttcctcatgtatttgatgacatacgtaagtgttgtcttctgcagtagggccttatcattaggttgtaccaaacaaccaattgcctggcaatagcttgtgatgtttgggagtgttccatggtacccctttactcagtagctcaacaagatataacctttttctgataatggagttttcacttactggtataagatatctagttggggcattctctcccctattatttagattactttcagatatgtaatattttagaattctacagtaataagtttccatatggtttttcaaaagatcttttacattggttaactttttcttttttcttattagatatcttgtagtctttcaataatggtgctttttcttctccttcgctctccccaccttcctctccaccttcccttttatctgcccaatcatcagctctcctttattttacaaattaaggtgggaagcaggtttacaggaaatcacctgagtgacccccccccaaccactcacaggagaacagaattaatatcaaatataattagccccaaggctatccacaacagacgccagacaattattttttaaaagccttttttgttgttgtttttgtttcctacaatttctgggtttttttcatagttattttcagtgcttctcttgtttggtctgtttgctctagattacactttctgttagcactggccactgttttagactctccttcagaagtcttgggagccatggctctctggccatgattagaaatcaagcattgttcttacttggaggcagtattacctcccaacttctaggatatttggaaacacttggagatatttttgattatcaaagcctggggcgggggggggcactgctacaagtcttcagtgagaacagttcatattgctttcctatacaagaaaaaaaaatcagttcaaaatggcaatagtgctaacttgagaaaccccacagcagaagacttaaaagcttcctgggaaaccaaaagtctctctggaaggggatttaattaattcagggcatcttaacctttctccaatcatgacccttttcacctgagaaacttatacaacttcaggtaaaataagcatacaaatgaaacattttctttacaattcataaagatttttatttaaaaacaattagtttgtacatatatatgtatgtatgtatatagttttatttaccatttgttaaggaggaaaacaaatttgcatactaatcaagaggattgcttatttttacatgaattaaatcttggttgaatgtttgataccaaagagcatagagcatattaaatatttttcagacttgattgatactaattttgcaattgtcaatgctgagaacattgttttacataaatacacaatagaaaaatgttagaaatgtgtttaggatcattttagaaatttttagaaattctgtcctgataccaatccaaaatgcatttaatgattttttttcaatcaaactcaaatcagaaacttaacaccaattttaaaagtcaatcactctaacccaatgcactaaaaaggtgtatgctaatttactatatgctcaggagtcatagtaggaaaatattaaaagtctgattttcataatcaaaacattgttttcataagagcagaaaactttctatgtacactaaatacactgtggttcataacatattagtctcaaatgtgagttaaggtggtctaggaaggagtcatccgtgttgagtggcatgtgcagtgcaaagtgggcatactgctgtgtatttaaagtcaaagctctgacacagtgccagtgagtgctgccataaatttgattttggattgttgttgttgattgttgttgggcatgagaaaccttggcattttgtgtgtgtgtgtgtgtgtgtgtgtatgtgacacatttagatttgtggatccatggggttacatcccatgttgtaagaagctgatatatagttgaatgatgtggggtaacctcattttatcttggaaaaggactgagactgtcaataacacacacacacacacacacacacacacacacaaaacaacctcatgctcctttgctttctatccctttctcaatgaccttctctggtcttgataatgtattgctgtctctaaagtatgaatccttgttaggatgagaaaggagcagttacccatggtataagatagagacataactgcttctttaaaatctttcttcttgattctatgccccagtacaggggaatgccagggccaggaagtgggagtgggtgggttggggagcagggcagggggagggtataggggactttcgggatagcatttcagatgtaaatgaagaaaatatttaattaaaacttttcttcttctagttccagattcatgagattgttctgtaacataaatgggtttggttttaaataatcttccttgctttctcctgcatcagttaacattattgtgtctgtgtacactctttatccctcaaatttgattatttcatctctcttgttctcccagttatttctttaagctccttttaatagatttgggaaataagttaggtgcactatgctcaatttatcttggttttctggaaaccaggcataatttatagcatagtttcatgtaattatagtctttttaaaaaatatatttagctcttatatgggaattatctattacctacatttaacttttcctataaagggaaagtaaaggagagtattctgtgtctgcatagggcagctatggtctttctagaattctagaagatattctaacaatacagattttttgttatttctttatctgtctttggtattagagtagtactggcttcataaaaagaatttgtaaacattgctttcatttccattctatggaataatcttcatagtatcaagtgttagttcttttaagatgtattagaattctgcagtgaatctatctgcctctgagatgtttttagttgggcagcttttttttttttttttttttactgtttcagtcttgttgctggagatgtatacatacatatatgtttaaatttttatttcatcttggttgcattttagtgggtcatatacactggaaaattcatctatttcttctagcgtttcaaagttaagggaatataggtttataaggtatgtcttcatgatttttctggacttcattggtatctgttacaacatcttacttctgatatctaattttatcgatgtaggtcttctcctctttatcttttggttaaattggcaaagaattttccagtcttgcttatcagagaaacaactctttgtttaattgattctttgtattatatttgtttctagttcattaatttctgctctgatcctagtttttttgtgtgtgacaaggtctcactgtgtaaacttgactggcctagaacttcctgtatataacaggctggcctcatactcacagaaatctgcttgcctcctctcttctatgattctaggagtgtgctcccaagccctcattctctccctgtctagtgttttcaagtttggtttgttcttgactttccaagactttaggtgcaccattcagttatttatttgagatttttcagatggcagcaaacttgtgtgactaagcaaaatttccactagcaggtatgggatacctccacagaagtttatcagcgaagccccagatgtcccccccaaaacaggttctgcagtacttttagttattcatcactagatgatatgacccttttgcagaagatgccctagttataagatagagagaaagtaagctgaaactgagctggaatcttcttctctgctggctactctcatagtactagaatgtgctactctacatgctgctggaagagaaaatgtattattggccttacccatctgtgtaccctaaaaaacaggaaaaaaaaaactatcctgaaaagatgtgtctacctatgcaatagtggcataattgtgagaacagctgccatctgataagatttgaggcttgttcccaagagtgaaactcatagctagtaagcccacttaacagtctatgcctagggaagttgtaggtccaactggagtaactagatttatacatcatcaaactgccttctaaatacgtatatttatacccattgacataggttgttctcagtcataatgagagaagcctttctttgcaataatcagcaatgaatacaaagactagatagactcgtagcaccctaagattctaagaatgggtgatggttgaaggctcagtcctaaacagacatttatattcctccctttaagctcagagaacactgggagaggcatttaggaagtatgcaaaagccagaagataaggagaaagcctgtggatgccatttcctgaactcaatagaaccatcacagtcatgaactcagcaagtgcacttaccctcagtggtccacatacaagacaggtcatgttaaaagggaaggggctcgtacaacttcctattgcactgttggctattgatggtttttgggaacaggggaataattattatatacactgccaagcccaccagagcctgacagatagctgcaaacccacagtcatttatacagccctggttcacacagtaggtcacaaagaaaaacaaatagacacatatgagaaagaattctaggaaagaggaggggtgtgtgtgtctgcgtgcctgtgtgtgggtctgtgtgtgtgtgtgtgtaggagtagtagtgagatgagagagttgaaactgagagtggttagtgtgcattatgcatttatattaagttgtcaaatagtaaagttaactaaaaattttaaaagtcatagaataaataaataaataaataaattctttttcatccggcaatatttaatcaaatctcaaatatcaccagttgttactctattttggtcaataccctagtagagaaagataatgtatcattttcttccacatcaatagtcaagagttggctatatggtacattaaataaattttaggtaaaaacttccaagaatcaagaaggggttgacaagcaaaacagaaatctgttcttcctgacttttatttcccctaaactatcagctaaatataagtaatgactataatatggttctatgttaatgctgcttattacttttcattttcataaaagaccaacccaaattcttttagtagtatctgctgagttttaagttgtgaatgaaatcataagcaacctcagactgttttgatgtctttaaggttattacatgggtctcagctcaccttcgttagcttcctgcttgttagtaaggaaaagcctttactctgctttacttaggacttgtgttcaggtcttgaagaattcataaatacattccttttaaaattctattaaataagcttaataaaccagtggatttaatttttattcatatttttaaaaatattttgagactatagttacattatttctgccttccctttattcccaccaagttctctcatgcactgctcctctctctttgggatttgtgtccttttctttttaattgttggtattttgtatgtatgtgtgtgtgcctatccttaaaaggtggttcattgtctcattgctttttctctcctttctccaaagctatcttaatttaattctcatacaatggtagcaggagaagcttatgctttcttctttgcctatatttaagcaattgcctggattggccacaaacaaccctacagacagaactcagaaattttacaaaatgatgcagtgagttgaatgatactacacaatatatatatagagagaacatgtggtcaaaacctgattatgttaaatgtttcctgaaattgtatgctattgtcagacgaaataatcacaagtaagactaggttaaaagtggaagcatttgtaagagtcctgcctcacttctttgtgttgtcattgaggaagatctagtggttttcagtgactgtggaaaaggttttctttctgtagatttgtgatctgaacgttaacattatcaacactttcctttccaggctcgctttgctctttgtgaaaagatttgaagctaggtggaattgatgtttgtgaagatggcattcaattgatcacggatccataattaagtataggttagattaaatttatttgctagtcccttaactgaaaaaaggaaaaacagtattacaaatcaaaggaatactcaaacacacacacacacacacacacacacacacacacacacgagtgccctctaaaagccagtgagagcgtcctttgtgtattcttccaccagtcgggattggaaaaaaatgtatacatgcacatatgctcctatatttaatgggtgaatcatagttgaagtgctagtttcacacaacaaatctgtccttgggtatcttaaattcttgagttctgatatttatttgatgactgctcaggatccaagtattgacattttatttccctctgcatatccaattgtgcaacatgtattgagtcactgatgaagattgcagggaggcgtaggtaagcaagtcactagaccagtacaatgacttttactgataaggcagttcattatttatggcagtttaaaatagttctgatttgaaattttagaatgatgaaggatttctgtaatttttttttttttttagtcagactagagaggttcctggacaccaaatcatgcagggatttttccttgagaactccctgcctaagactgtaatccagattttgttgaggattatcttttccttattttatgtagtattgcttatatgttttgtattttggttcttgattaggggtgtgtgtgtgtgtgtgtaaaactttttctctgggattttaagtgagaccatataagattttaattttttcaataatttttattagatattttctttatttacattccaaatgatatcctctttcctgatttcccctccaaaaaccccctctcctctaccctctccccgtgctcctcaacccacccactcccattcctggccctggcattcccctatactgagacatagaaccttcacaggaccaagggcctctcatcctattgatgaccgactaggccatcctctgctacatatgcagctagagccattagtcccaccatgtgttttctttgattggtggtttagcccaaggagctctggggatactggttagttcatattgttcctcctatggggctgcaaccccttcagctccttgggtcctttctctagctccttcattgggaaccctgtgctcagtcaaatagttggctgtgagcatccacttctgtacttgtcaggcactggtagagcctctcaggaaaacagctatatcaggctcctgtcagcaagcttttgttggcatctgcaatagtgtctgggtttggtaattgtatatgggatgaatccccaagtggggcagtcgctggatggcctttccttcagtgtctgcttcaaactttgtttctgtaactcctcccatgggtattttgttcccccttctaagaaggattgaagtatccatactttggtcttccttcttcttgagtttcatgtgttttgcgaattgtatgttgggtattccgagcttctgggctaatatccacttatcagtgagtgcgtatcatgtgtgttcttttgtgattgggttacttcactatgtacaagatatcctccagtacaagaatgaatgagaaaccttttttcagtagttactacaaaacatttggagcttaaagttaagagtttatgatgtgccaagaagtgatggagataaactcagtaggatatggaaataaagattaggtttgtggcaaagtaagagggagatgttgatttaacttttggcttcaaaaagagtatgtcttatacgtttgcagcagcagttgatgaaaaaaggggccatgaatttgaaggaaatcagggaagagttcatggaaaagttcggagggaggaaagggaagggagagttgttgcaattaaaatacaatatcatattaaacaaaaagtgtgtctgtatacaaccacttctacaaacttcccattgtatcagatgttggtaattatttgcaattactacatttgttttttgtcctgactataaggatagtatttagaattttatatatataccatatataagaatttttatatattttatatatatatgaaaacctatttatttggcctccatttttggtataacaatatcttaaactgatgaattacctttgaattagacaatagtactcaaaattgcattgcttaaattttattgtgaagctctctatagtttgtagtgaataaagaaacacagtaagatgttgatcaaaaagaggaaattaatgtcagtgaattaaaattgacttttttgttttttaggggtcccttcagtgttgtacggcgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaacccatttatcaacctaacctcatctgggggtggggaagcaggggatatgatatagtggggaagtgggtggagacagtgtgaactccagttgaaatagttgctcagaaatctaaaagatagcatttgaaatatggaatcattaagtcatatgggatctttatgagcttatgctttttttttttttttactagaaagagagtgaaatagggacatactttttaaggtataatttgagtcctgttctgtgaggtgtaggaagggaaggaaaggaaataactataagaatgttaattgaagatttagaagcagccaaggtcctttaagtataatttttggcctttgggattactatctcctataactagatgattgatattttgattcacatttggctaatcacatactgtatttgtaaaagttgaaaggtcagtagtattagaatttgtgggacttagatttttttaaaatatatatatgtgtatatatataaatatatatatatatatatatatatataaatatatatatatacacacacacacatttgagttacttattatttttaaattttaccatgattcacattaaagtaacaaaactgattattatattgactctcctaattatcctatttactagctttagactttcgccacctagtaaaagatgtattcttccttagtattttgtttttgaatcttaaaggctgtgcaattgaagaaaatacaaagtgaagtaccctatttgtgttttacccaattatctagttttgcaaagtagaatctcacacagtgtgagctccaatctattcctatagatttttattcaggacaattatttctaaacacgttgtgactctttaaattattattatcaatataatgtttatagaagattgttaaaaattattgctaagaggctgaagacatggctcagtgattaagagccctagctgctctcccgaaggacttgggtttgattctaccaccacaaaaaaggactcaaaaaccatctctatcccaggcccaggggatcgcttgccctcttctggcccccatcagcaccagcccatgcccttggtatacagacatgtaggcaggcaaaacccccatacaaatacaatgaaaataaatacatcttttaacaaacatttttaagttacttctaagaaaacctcccttgctgatttgtttttagtgctttaatctttactggatgcctacaaggggccttctcagtcaaagtgtatgcatgcatttagattaaataaacgtgaccacagtactgagggaaaaatcttgtagtaaaatttaggtgtttcatagttcatgatttcattgtcagaactggacattaactgcttttaaatatacattattttatatgcttagcaaaatggaaaatttgccatttgatgggccttacagttatttttcctttgaactgttttgtttggatgtattgttggctttgtagtgctggggatcaaacccaggtcctcaggcaaactaagcaaatactgtttttcttaacttttaaatacttttaaagttctctatgcctcagtagtctataagggcactgaggaaactttgtgcaaacctgattattaaacaagtagatgttttgctaaatgctgaaaaaaagttctgatattgtttataaacagatctaatttgttgattggtacagatctaatttaaaattacaaatgttaaatcaattatccaattatctatattaaattagaataatggaattgaaatatcttacataatattgcaaataactaaaataaatacttataggttatttcttagccccaaattactaatatcaaagttttgatttgtcctatcattatacctaattttctgtctttccagatatgtttctaaatttccaaagatatttttaaaggaaacaactactttttcatttgtctatagtaaattattgttagatttctttagttagatctctggaactagagacttagaatgtgaggaggaatctcttttactacttacgtaaagaaggttatggtgatttacacattcagtcccagaatttaggaggcaggcgcagagataggtggatctctgtgagttcaaggtcatcctgctatacataaaaagttaaaggctagcctgtatatattgagactgtctcaaaacaaacaagcaaacaacaataaaacaaaacaaaacaaaacagaacccatttcgccagagggttaaactccaaaccatttttttttgtcattctaataatttttttattctttaatctttttttacagtccagactttatccccctcccagtccatcctccaactgttccacatcccacacctcttccccccatcccctgtctccaggaggaggtccccactccccacccccaccctaccagacttccccactccctggggtcccaagtctctgcaggattaagtgcattttctctaactgtatctagaccccacagtcctctgctgtatatgcgttgtggtcatcataccagctactgtgtgctgcctggttggtagctcagtgtctgagagatctcaggggtccgagttagttgagactgcttgttttcttatagggtcagcctcctcctcagcttcttccagctttcctctaattcaaccacaggggtccccgacttcagtccaatggttgggtgtaagtatctgcctctgtctcagtcagctgcttgttgggcctctcagagggcagccatgctagactcctgtctataagcatatcatagcatcagtaatagtgtcaggccttgaaccctcaccttgagatggatcccaatttgggcaggtcactggacctcctttccttcagtctcttctccatttttgtccctgcagttctttttttttttaattgggtatttatttcatttacatttccaatgctatcccaaaagtcccccacacgctcccccacccacccactcccacttcttggccctgtcgttcccctgtactgaggcatataaagtttgcatgactaataggcctctctttccactgatggccgactaggccattttctgattcctatgcagctagaaacatgagctccaggggggttctggttagttcatattgttgttccacctatagggttgcagatccctttagctccttgggtactttctctagctcctccattgggagccctgtgactcatccaatagctgaccgtgagcatccacttctgtgtttgctaggccccggcatagtctcacaagagacagctacatctgggtcctttcgataaaatcttgctggtgtatgcagtggtgtcagcgtttggaagctgattatgggagggatccctggatatggcagtctctagatggtccatccttttgtcacagctccaaactttgtctctgtaactccttccatgggtgttttgttcccaattctaagaaggggcaaagtgtccacactttggtcttcgttcttcttgagtttcatgcgtttagtaaattgtatcttatatcttgggtatcctaagtttctgcccctttagacctttctgcccaacttcttttcatctcttttctagttactacgggcaaaaaccgtctgattccgtcagctcttctattccatttataaattgttggggtccaaaaataacccgttttaaggcaaagcatgcaaaacatactgtatcaagaagaaacaaattttgaaggggaatatagcatagtaaagaagagtccataagttcaagtaagattatctagaaatatcttttaattctagctatttaagacaactttttttcttattttttgttaattcctttttcttcaaattttttattagatattttcttcatttacatttcaaatgctatcctgaaagttccctataccctcccccctccctgctcccctacacacacactcccctggtgttcccctgtactggggcatataaagtttacaataccacggggcctctcttcccaatgattaagcaacaaatcatttaaaatccatcctgtgccttattctttgcttactcatatcttttctccccttggcttatagtttctttgacccttatcattgcccattttttcctgttaccatatctgtttcaaaatatattatgggctagatgtaatcatttattttcaaaatatattttaagctagatatggttgagcaggactgtaatctaaagattatgtggaggccagaagatcagaagttgcaggtcatcatggactccatagttcaagcccatgaattcaaagccaatctgtgctacatgaaaccctgcctcaagaaagaaaataataaccaatatgaatgcatgtgtctaatgaggatcactgtggagcctaccatacatcacttatttagataggtcattgtttataatatgattttattagaaacatctgtagtaaattctgtataagtaacatacaaatttaattttgaaataaaatgtttattaattgaaaatttctatattagtcaataaattttaagtttatattgccttagggaagcttccacatgataatttatttttctttattttttgctgctaatattctaatttttgttcagtagggtttttcaagttgcacaaaatccaatagtcccttgaaaataaatatattttgtcatgtgttcatttttcattgtttttacaagattctgaaacagacatatcactcctaagtattttataatttcttcctctatatgtatatagaagtaaaattgcttatgagtatgagataagtgaaaagtttctactaaatgaaagctaaatgattttatattaaaatatttctgatatggggccagtgaaataggtcaacaggtaaagcacttgtcatcaaacaggacagtgttagtttgatcccaggaatcaacaaggtaggacttacttgactcctggaagtcatgttctgagctgcatatacacacaaactcacagaatcagtaagtaaatgtaataaaacattttaaggttttattatttatatgtgtatgcttgtgtgaatatatgtgtgcgtttctgtagaaaccagaagaaggtatcaaatcctctgagtctggagttacacaagactgttagccacctgatacagttgctaggaaccaaacttgggtcctgtgaaagagcaggaagtatatttaactgtgagtcatttctcccgcctctcattagaaggtattttcatacacatatatagaaacaaagacatacaggtacatcccattagtgaaattcttagattcttatctttgaacgtttttttctgaaaaaaataaatttttactgtttttattattactaattaattattttttagtttataccccaaatgttgacctctcctagcccctccctgtctcctctgagaaggtgcccccccccccagcattcccagtttctgaggcatcaagtctctacaggattaggcacatcctctcccactgagaccatacaaggcaaccctctgttacatatgtgccgagaggcctcagaccagcctatatatacagcatatgtgctggggtccacagtccagcccatgctgtacactctttggttggtggcttaatctttaggagctcccaggggtccaggttagttggtactgttggtcttcctatggggttgccattcccttcagttccttctgtccttcccctaactgttccataggggtccctgacttcaacccaatagtttcaacccaatagttgggtgtaagtatctgcatctgtctcagtcagctgctggtagagcctctcagaggacagccatgctagactactgtctgcaagcacaacatggcatcagtaatagtgtcagggagtgctgcttgcccatggatggatcccaagttggggaacaaaataatcatgggagacagagggagggaagcacctgggtgaaagaggggaaggggaggggaaaaggggttcagtgtcaggtatagggagagacaggagagaagcccagaggacccagagaatgaatggaaatatgcagctacctggggtggtgggaggaacctctagaaaatcccagagatctaggatgggagaagctcccaggacttaatgcgggtgaccttagccaaaatgcccaatggtggagatatgaaacatgcaaaccacctccagtagttagacaggaccccagtggagggatggagacaccaacctaccttgaaaaatattgactcaagattgttcctgtccaaaagaaatacagggataaaaatggagcagtcactgaatgaatgaatggccaaccagtgactggcccaacttgggatccatctttggatttttaattaatacactttttgtcttttattctgctgtgccactaataaggttttatttttaaaatatgaaaatgtattcaagcaaacaaagaaattaaaagatagtaagatagatagaattagaaactgaatatccagagttccaagttacttttaattttacttacttattttggtgctagggtttgaacccaaagccttgattttgctacgtctacaatctaccagtgaactctactcccagtccataaccacagtttgaataaagattgtatagtgaaagatctcttttattggttattttatttatttacatttcatatgttatcccccttctcaatttcccctccacaagctcccatccccttctccctccccctacttctatgagggtgctcccccacctgcccacccacccacccacttctgtctcagcaacctagtgttctcctatcctgggtcagcaagcctccacaggaccaaggggctcccttcccagtgctgctggataaggcaattctctgctacatatccagctggagtcatgggttccccctgtgtactctttggttggtggttttgtccctgggagctttgagggttctggttggttgatattgttgttcttcctataaggttgcaaaccccttcagctccttacagtccttgccctaacttccccattggggtccccacacttagtccaatgtttggttgtgtgtatccgcatctgtattggtcaggctctggcagagcctctcgggagacagctatacctggctcctgtcagcaagcacttcttggcatcagcaatagtgtctgggtttggtatcagtagatgggatggctccctaggtggggcagtctctggatagccggcttttccttcagtttctactccattctttgtccctgtatttccttttgacaggaggaattctggattaatatttttgaggtgggtgggtggccccacccttcaactggggaccgtgtctatcctctggatatagtctctacaggttctatctccctaaattcctccagttggatcctgggaaccccctgggtctctggcatgtgggactttctagtggctacccccagttccccctctcccactgctacacacctactttcaaattcctgaccctctgtatttcaacccccttctcctcccatatctgacctggttcttccccttcccctcctctccttttgtgtaggtatttcctacaagttcaaacattccctcctagaggaaagacagaggtttataggatcagtgaaactcgcaaggcacaggaagttataagattctcttcccaaggttctataggaagccagcaatttctggggagagaagactggtaaactgcttccagagtccctaagtaaaaccttaatgtactaggagtgttgagaggagagggaaaagaaagagaaagaatgtgtgaaggaatgcttaaggaactgatggcacagaattctcgtaagttctacatagataaaccaaaaggatatatcataattaagctgtcaaaaattgacaaggaaagtaaactccagaagaaagcaagaaggaatgaattcatcatagagaagggatctgcattagctaccagcagatttttcatcagaaatcatgatactagtggcaatggaataggatccaacatgctgaaagaaaatattatcaagaatcctttatacagaaaaagcatacttcaaaaaatgaagtataaattattttcagataaacaaaacaaatctggctgcctggttattgggactaataaacttgctctacaagaaattctcaaggtagatttttacagtctgaacaggaagtatttgttaatattttgaagccatatagaaataaaaaaatactcttaacatcacatataaaaatgtgacagccagtatagacatactttttgcaacatggtctcaatatgtaacattgatatgttgatctgaaactgattaggcagaccaggctgatcttgaattcagaggtctgcctgcctctgcctccccagtcagattaaaggcttgtgctactactacccctggctataaatacatttttattacacctgtgtttctcttaactgacttaaaaaataactgcataaagtagcattataaaactatgttaatgagaccattatgtaagagtgtcaccccaaattaaccaataaaagtacttaatagctatagtagacatagacaatatggcaagatgatataaatggtgtagtagatactatctatacaatgtcaaagaagtaactggtagaggaatataggcacatagcaaagtttctaatataaataatatcttattggtaataccattaaacataaatgaattaaaactaattataaggcagagagaggcacaatgactaaaaacatgccctattatatattatctacagtaggaacattttatttttattatattggtttttttttgtgtgtaggtatgtgtgcatatatgtgcatgtacatactccacaatatgtatttggtgatcagagggtaactgtctttctatctatcataatgaaacttagttcagcattctgggcagctagcacctctacctgttgagccattgttctagtcagagtcacattttagactcaaaaggcatttaagttgaagtggtaggaaaagatgtatcttttcaaactgtaaccaaaagaaatctaaaatacctgtacaaaaaacccccagaaatttgtatttcagtgatacttttctatttcagagctgaggagacagctcagcctgtggacttcagttccatccttagaacccatgttaaaatgtcaggcatgatggcttctgcttgtaatttctgcaccaggtacagggtgtaaaagaaacataataatttgatctttaatgtagaaaatcattatataaattgaaatgtgtatatatagacttaataagagttacatacaggaaacttgaaacttacgacagtttttttaatctaaataaatggggagcctttctcatatttgtgattcggaagatagtactgtgaaggttatttcctcgcaagttaatctgtagattcattgcattccaaattgtgatcccaaccaactactttttggatattgacaaagtgattctaaagttctataaaaaggcaaactatccagaatacctaccatcttattacagaaaagcaaagttgcaagactactactcaacaccagtacttacttaagaggtgcagggcatattgattgttttgtttgggacactacaatgttagggtaaaaaaaatcatgaaatatgatcagtgtgattttaaaggaataatagcattgggctcgttgtggagtatcttcttcgtggcacacatctattttccattttgttggcgacaagaattttcatataatgataaaattgagtaattatacatataatgccttagtacatggaaacctgtgaaaccaaacggatatctattgtttgtagcagtgttagtttcctgcatttgatattgtactgtggttgtgtaagatgttgccaagggaagaaaggactaggttaatgatatacaaagaccctttgtattatttttgcacatttctgttaatgtataattactctagaataaaagatgttctttaaaagttgttttgtggtttctacaatcttctacaaagtaataattatgcttcaaatattcaggagtatgaaaaagcacaattttaactaacggttttggtttctaatcgctcaaattggtatgttcaggcaaatcgtgattgatgtaactgagagcatcatcaaacagttacttgctttccctaggaaacatgaatatttaataatcctcatttacataatgaatttgcattcattttgtaggataattactggtctagctaattaatctatatcctctcctgtgtgcagaaagcatgtgaaaatattttatttgctgtgatattttcttagtgttattccttttctgctgtggcatgtgtggcatataacagtgaatttcaagacattaagggttatactttaattttgtcatgtgcagtttctgaacactttcatcatgaattttgaagtcctggtcacagatttaatgactcaaattgtaatttgtgaattcagcatttgaaatgaaaacacccattctttcagatgttactgaattatcttgtatgtgcctcatcctgtgcatgtgagacaaatagattttattgtggagctatgacataatcacttttagcattggtattattaaacatgaatagaatcatgaaataattaaatgtagccaatattttgaatcactttatttttttgatattagttttatggagaaaacaagggatttttgtattatgaaatatttgagcaaagctagttggagaccagcttccagccagttgtataattttccacagaatgtctatttttaccatttctgaccgtatttcccatttaattattgcattgggtcactggctagtatattctaaaagaggattttcgtgttagatttttttctatactgttgaagcataaaaaacttcgatgatagaagtactattttttagcaaattacattaatggtacatcattggctatttttcttgagatgcagagagagaggaggggagcagtcagtttatctgtctgtctgtctgcctgcctgcctgccttcctgtctctttgccttccttacctgtctgtctatattgaactctgttgagaaaaaaaagtcagcttttaaacaaatgtatccattttaaaaatatttgtggtagtctagattacctgttcgtagaagtatatatgggcgtttgttcacaaaaatgactcagactcactaggtaataattctagatgtgaacatttaatatgttgactatattcctggtgccattattataaatgtctcttaatctagatttctcatctcacatattagatgtgttgatgaagaggctgtcgtgttttataataatgctctcaaagctccgtggtttatatattcaatttaatcttaatatcatcttaatgtcatattcaagaactataacagtatgacacactgtaaaatgagaacctctgctcaatatttattctgaaataatatagtattttaaggttatctcacccctaccacatgcggattttttaaaaagttccctattccactttctttatacaaataactatctattcttacaaatctttatttcattgttatttactttatgtgatttagagaatttctctggaaactataaagatagacagtgatagatattttagtaggttgatggatgcataaaccctgctagatggagataggaaaaaaatctataaaatgagtatgagaatttgattgtaatatttaagtctgaagcaactgagaggtagttcttttattttgagttggtgttgttaatggctgaatacgcatttgaaataagctaagaaatcatattttgttattaaggttgttatccttcagtagttcacattatgtagttcaatgtatattcaaaaaagcaaatgctaacttaggaacgaaaacatctatttaaaaggagtattacacaaaaagagaaaggagctattgaaatgtattatggatgagaatttttcttagtcccacccagaatcttattgtggtctactgaaatatgtacagaaatcttccagatgtcaaacaaagggagtagaatttgttttagcagataaatctgtgttcatggaaggtttatatacttctcaaatatcagccagaacagcatttttcttacatgggaggagtaaacaaagctagaaagaccttggagagagagaagggggcttaaccaaattttgttcttgttcatttattcatttttaactggtatattgttcttattgattatgtagttgggctaatcagttataaggcaaggaatggtaactcagagtgtctgagtttggccttatcatagataagtaaaggagctcatgaatcttatgtaagtcataaaggaaaggttttgtttttgttgttagaagctgttttttaaaacataaaagttggtaaatttattaacattttatatttttccacaatcaaggtgtttaaataaaatttaacaaatgttcaattgtaaagactttgaaaggttattaatattcactgcatcatttttatattcctaatttatacaagaatatattattagtcctgattttctttggcaaagaaaaattgtcagcaattttttatgtatacagttcaacctcattattcatgggctctagatcagtaggttcatccaaatacagattggaaatattttgcaaaagaaaaagttatcgtactaaataagtacaaactcttacctaataatgaattgggattggaaagtattgactaccctttaacattaccccattctcagtaatgtgaagaacatacaaagaaacataagcaatctgtcctattgtaatttgcaacattttagagatagtgtagaagttgtaaattttaagtggtaatagtattacttgcatctgtatttgtcaggctctggcagagcctctcaggagacagctataacaggctcctgtcagcatgctctttttggcatccacaatagtgcctggttttggtagctatagatgggatggatccccaggtgggacagactctggacggcctttccttaagtctctgctctgaactttgtcacctgctcgaacacatttcctcctgtgagtattttgttccctcttctatgaagcactgaagtatccacactttggtcttccttcttcttgaccttcatatggtctgtgaattgtatcttggttattctgaacttttgggctaatatccacttatcggtgagtacataccatgtgtgttcctttatgactgggttatcccactcaggatgatattttcaagttccatccatttgcctaagaatttcatgaatttattgtttttaatagctgagtagtagtactccactgtgtaaatgtaccacattttctgtatccattcctctattgagagacatcttggttgtttcaagctcctggctattagaagtaaggctgctatgaacatagtgtagcatgtgtccttattacaagttggaacatcttctgtgtatatgcccaggagaggtgttgctggatcttccagtagtactatgtccagttttctgagaaaccaccaaattgatttccagagtggttgtaccagcttgcgatcccaccagcaatggaggagtgttcctctttctccatatacttgccagcatctgctgtcacctgagttttttattttagccattctgactggtgtgaggtggaatctcagggttgttttgatttgcatttccctgatgactaaggatgtagaacatttctttagatgctttttggccatttgctattcctcggtagagaattcttcgtttagctgttccccattttttaatagatttatttggttctctggagtctaacttcctgagttctttgtatatattggatattaactctctattggatgtaagattggtaaatatcttttccccaatctgttggttgccttttgtcctattgacagtgtgctttgccttatggaagctttgcaattttatgaagtcccatttgtaaattcttgatctgagagcataagccattggtgttctgttcaggaaaatttcccctgtgcccaagtgttcaagactcttaccctctttttcttctattagtttcagtgtatctggttttatgtggaggtccttgatccacttggacttgagctttgtacaaggagataagaatggatcaatgtgcattcttctatgtgctgacctccagttgaaccagcaccatttgttgaaaatgctgtcttctttccactgggtggttttagtgaaaattaagtgaccataggtgtgtaggtttatttctgggtcttcatttttattccattgatctacctgcctgtcactgtaccaataccatgcagttttttatcatgattgttctgttgtacagtttgaggtcagggatggtgatttccccagaagttcttttattattgagaagagtattcgctgtcctaggttttttgttattccaaatgaatttgcaaattgttctttctaactttatgaagaattgagttggaattttgatgggaattgcattgaacctgtagattgctttttggcaagatggccatttttactatattaatcctgccaatccatgagcatgggagatctttccatcttctgaggtctccttcaatttctttcttcagggaattgaagttcttgttgtacagatctttcacttgtttggttagagccacatcaagatattttgcattgtttgtgactattgtgaatggtgtcatttccttaatttctttctcagcccatttatatagggaggctactgatttgtttgagttaatttaatatccagccactttgctgaagttgtttattaggtctaggagttctctggtggaatttttggggtgacttaaataaactatcatatcatctgcaaatattattttgacttcttcctttccaatgtgtatccctttgacctccttttgttgtctaattcctcgagctagaacttcgagtactatattgtatagatagggggagagtaggcagccttgtctagtctctgagtttagtgagattgcttcaagtttctctcgatttagtttgatgttgcctacttgtcttagtcagggtttctattcctgtacaaacatcatgaccaagaaacaagttggggaggaaagggtttattcagcttacacttccatactgctgttcatcaccaagaaagtcaggactggaactcaagcaggtcaggaagcaggagctgatgcagaggccatggagggatgttctttactggcttgcttgctctggcttgctcagcctgctctcttatagaacccaagactaccagcccagagatggcaccacccacaaggggcctttcccccttgatcactaattgagaaaatgccttacagctggatctcatggaggcatttcctcaactgaagctcctttctctgtgctgactccagctgtgtcaagttgacacacaactagccagtacactactgtgtattgcttttactatgtttaggtatgggtcttgaattcctgatctttccaagacttttatgatgaatgggtgttggattttgccaaatgctttttcagcatctaatgagatgatcatagagttttttttccttttgagtttgtttacatagtggattatgtcgatggattttggtatattgaaccatccctgcatccctgggatgaagcctacttgatcatgatggatgatcgttttcatgtgtccttggattcagtttgtgagaattttattgagtatttttgcatctgatattcataagggaaattggttcaaagttctctctctctctttctttctttctcttttttcttttttaactgtgatttgatttattatgtcaaaatagctcctggaacaaatatggttatttcgataattggtttcatattgatttctctttatttttttcctcatttattttctttcatttcaccactcttttgtttttttattagatattttcttcatttacttttcaaatgctatccccttttctagtttcctctctgaaagtcccctataccaccaccaccacccccccgccctgctccctaacccacccactcgctcttcctggccctggcattcccctgtattggggcatataatcttagcaagaccagggcctctctgcccatgggtggccaactatcctctgctacatatgcagctagagacacaagctcttggagggggggggtactggttagttcatattgttgttccacctatagggttgcagacccctttagctccttgggtactttctctagctccttcattgggggcccaaagttctctttctttgttgggtctttgtgtggtttaggtatcagagtaattgtggcttcatagaacgaattgggtagattcttctgtttctattttgtggaatggtttgtggagtattggtactaggtcttcattgaaggtgtgatctgatagaactctgcactaaacttatctggtcctgggctttttttggatgggagacttttaacaactgcttctatttctttgggtgttataggactgttctgattcaactttggtatttgtaatctgtttagaaaattgtccatttcatccagttttttcatttttgttgagtataggcttttttagtaggatctgataattttttaaaatttcctctgtttctgttatgtctcccttttcatttctgattttgataatttggatactgtctctgccctctggttagtctggctaagggtttaatctagttgattttctcaaagaaccagctcctagttttgtagattctttgtatagttctttttgtttctacttggttgatttcaatactgagcttgattatttccttctgcctactcttcttgggactatttgcttccttttgttctagagctttcaggtgtattgtagtgtgtgatctttccagttcctttttggaggtactgagagctatgagttttcctcttagcactgctttcattgtgtcccataagtttgggtatgttgtggcttcattttcattccattctaaaaagtctttgatttctttttttatttctgccttgaccaagttatcattgaatagggcattgttcagtgtccatgtgtatgtgggctttcttttgtttttgttgttattgaagaccagctttagtctatgattttctgataggatgcatggaattatttcagtctttttgtatctgttgaggcctattttgtaaacaattatatggtcaatttaggagaagatagcatgaggtgctgagaagaaggcatattctttcattttaggatgaaatgttctatagatagctgttaaatctatttggtccataacttctgttagtttcactgcatctctgtttagtttctgtttcaatgatctgtccattgttgagagtgggtattgaagtcttccactattgtgtgaggttcaatgtatgctttgagctttagtaaagtttcttttatgaatgtaggtgctcttcatttgaacatagatgttcacaattgagagttcctctaggtagatttttcctttgatgagtatgaagtttccttccttatcttttttgataacttttggttgaaagtcgattttattcgatattagaatgactagtccagcttgtttcttgggacaatttgcttggaaaattgttttttagccctttattctgaggcagtgtctgtctttgacactgaggtgtctttcctatatgcagcaaaatgctgggtcctgttaataaatctaatttttaaaatggggcaaaggccagatacatgataaaggttcttgcatgataacttgagtttagtattctgagcatacatggtggtggaggagaatggactcctgccagttgtcatccgacttccacaatgaactgtgccacatacacactcacacacttatatacaagcatgtgttggcattcctgtatgtacatacacaaaatgaaaaaaaagtactgttatttaaatagacaaatgaagggctggggacataggttgttagtgatagagtacttatgaacaaggtccagggtcttatccataactccatggtgaaaaataaactatatcttcttgggataatggtgcatacctttaatcccaggattccggaccctgagagaagaagattgcagcatctgaatcaacctgaagtatataatgagttcaagacaaaacaaaagataatcagtgggtataaatagatacttattgaaagaagaaataaaataacccacatatacttggaaaaatgctcaatttctatagttacacaggaaatgttattaataattacagttaagggctagagagatagatggcttagttgttataagcattggatgttcttccagagacctggcttcaaattctgatacccacatggcaactcatagctgtctgtaactccaagatctggcaccttcacacagacatacacgcaagcagtacagcaatgtacataaaataaaaacaactgaaaaaattacaatgagttacctatcatcttaccccagtggaaatggctattaaaaatactgtcatgtatatatgtgtgtgtgtgtgtattatgtatattatatatatatatatatatatatatatatatatatatatatatacacgtgtgtgtaaattaataaaattatagagcagtatggagcatcctccaaaaatagacctatgatataatccagttttcctacttctgggtatatgtccaaaagaaatgaagtcagcatgcaagcatgcaagtatgcaaacaagatatctgtatgccaatgttcatagttatactatctacagtggctgatagaaccagcctaggtacacacagacaggttgattgattaagaaaatacattatatgtgtacagtatattgtttagttatatagaagaatcagatcctgttatttgtagcaaacttgttggaatcgaaggatattttgtttaatgaaatatgtcagctagagaaagtcaaatattgtatgtcctttcttgtatgtcctttctttaaaaacaaaaatgtcaagctaaaaacataatagtattagtggagttagggaaggataagctacaggtttggggtagttagaagcagggagagaagaggctaaatttgattagtttttggtattaacatgtattataataccacactcagcctcaatgataagaacttaatgtatgttaatcaattataaaatactaaaaatatcttattcatatgtaatttacatatcataaaattctttgcctgtatattttcagtggttttcactgccacaactcttatatgtagaacattcttatcaaccctgaaagaaatttttagctttctgaagacctatgatccttgacccacaaacctgtgaccaacctatcatctttgattctaatttgtctctatggatttacacattttgaacattaatggagtcatacaataggagacccttaaaactgttttctttcacttaaaatgtttcaaaaatgcatctatacatggtatctctggtcagtttttaaaataaattattttatgtatttacatatcagtcatttccccctctcttggtccctctcccgtagttcctcctcccattcctcctcccccttgcctctgagagggtgctcctacctcctccagacctccccctttcctcaggcctcaagtctctcaaagattaagtgtatcttctcccactgaggccagaccaggcagacctctgcttatatttgtgccaggggtcttggaccagttcatgtatgctcctggttgatggctcagtgtctgggagctccctgagggctgagttagttgagactgctggtcttcctatgaggtcactctccccttcagcttcttctatacttcctctattcaacaataggggttccttgacaacagtccaatggttggatgtaagttcctgcttctgtctcagtcagctgctggtagggactcttggaggacagccatgctgggctcctgtctgtaagtacatcatagcatctgtaatagtgtcaggccttggatctccccacccccaacccacacgcacaccatgagatggatcccaagttgggtcactggacctcctttccttcagtttcttctccatttttgtccctgcagttttttatagacaggaacaattctgggtcagaaatattgactgtgggttagtaacctagtcccaccatttgaggccttgtctatttcctggatgtagactttggctattatatagatatattatattgtatactaatatatggatgtatatccattcactaactgaggattggtattggaccaccttattagctgccatatgtaatgctgctgttaatattagctagcaatcagtctccattcatgttttttgtactttatacattcatctattcagcaatgtttctttgtaactctcaaactaatacttgtggcatttttgtggtcacccacagacctacaaagcagtgaaaatttgaattgcttaacacttgggttcctagttaaggttaaacagtgtagctcttctcttattttagctctcattctgtaaatgagtgctctttttaaggtctatttaattccacacttcacttttttgtgctttttgctattgatttagctgcttcaaagtagccaccaagtgtactgccaaagtgttgcctagcattccttcaatgtaagaatgctattacaaatgctttacaacggaagtgctcaatttggatatgaatcacagagctcttggcagtgagttcagttaacaaattaatatatgttaacaaatgtatctttacacaaacatatagaggatatatactgatcagttgaccagaaatacatgaccagaaatgtacaggaacctgatgctctatttcttctgtagagcaatggttcagtgtttatcccatgtatgagctaactagaaaataataactatgaaaaattagttgcatattatttttcatagatacatatgtttgagttttcttgagtgtatgtttaagagtaccattgcagagtgggcatatagcttagttgttttgcctagtgtctgtgaggctgtaggttccattcccagtagagacaaaatagaaaaaaaaacggggggggggcagcattgttaggctataacatagcatcttgtctttgtgagcaaggtttctcaccctttatacatataaagatgagaatacaattcaaatttgagttgaacatcgttatattcagccaggcatgagaaaatggcttcattgttgggcaggtattagaattgccctggcttagacacccatagcacataagaatcattatcttttatatgtcaatatgcatagctttcaggatcctctaaagagatatctctaatttaaaggaacatttacagttttcctaatgtggactccatactttgttcattgtatcagatttttatcacctgcctcagttctattttgtccaattcccttgtggtcaatttatgacattgcatctagagtgcttaagtcttatgtaggaagatgttaagcctagaaatgagttaagacagtgtttttaagttgacaaatttacatgaactcaacccttctagtagcatgaaaattgagtatgtaattgaaatattttaatgacaagtataaaaacgagcagtgtctataaagagaataatttgtgcttctgttgtagtaaagattgtatctggacccaagtgaataagcacattttaatgacacatgcccacttcagactgttctcccctactttatatcacagtgttgagataatcttggctttacataccccatacttcaaaaccatctagaatactgcccagcacaaaatagacacttgctgaatatttcataatgtattgaggattccagggatactacagcaaagcaatggtgtgggattttgactggttggtgaaggttgttacacctgtaaaagttcacatggttttattacatttttatggccaatattccaaagttgaactataaaaacaaacaattctaatgttatttatccctcttaacctgaccaactctctgggttatctagactactttcttatgcaagcttattctgcagctgtatatgaggttatataatcagttatggcagtagttggtgacttttctcatactataagaagtcaagtctagttatcttcaaagtaaaccttgcaaaggtcccaaacgcagatcaggaatgggcaaaatcttgaaaaatatttcaggattcaaaaagaaagtcactccatggccagtaaatgatacatagctcagtcatcagagaaatccagattaaaccacaaactgatagcactgtgttactaacagtgacaataacaattctacgtgtcactggagatgtaaaactaccaagagctcttttagtacaagaataaatttgtaaactggaaatctctaccaaagcatgcatacctaatatccttatgagtagcattttcattccttaggtgtacactaaatagaaataatttaacatgtatgcaccaaaaaataaaaatgtgcaagtgtggttttaatagaattctttatgatagtctaaattagaaacatcccaagttccaaaaagaacacagaaaattatagtgtccttatatagtgaaatagtaaaaagaaaatagatgtatatttgttacatacaaaatatagatgactctcacagcatagtacgtaaaagaaaccaggcatatgggctggggagatggctcagcagaaaaaagagccaagctgcacaagcctgatgacctgagctcaatcgcctgaacccatataagaaagcaaatgtagcactctttttttttggtattttcctcgtttacattttcaatgctaccccaaaagtcccccatacccaccccccaattctctacccacccactccccctttttggccttggggttcccctgtactggggcatataaagattgcaagtccaatgggcctctctttgcagtgatggccgactagggtaatcccagtgctcctactgtatgtaggacaggaggctgaggcagaacacttgcctggaagctcacataccagctggctcagggtattcagcccagcagcagaaacaggagagatcctgcatcaataagctggaaggcaagaaacagttcctccaagttctcctccaactctcacatgtgtgcaagttgatactagtaatggctcaggtgtgtacacacatgcctcaacactcgcacataatacacatacaataaagcactattctctatctggccacatttatttaaaatacaaaagtactgtgagtaatgttatgtttgaactcaaactgagaggagatactggctggtagtagacagcagggctactaaggtactggttgtacacttttttgtttttttattagagagttcactgaccattcagcaggccgcactcttgtaagttatttacagtgaaggggtgagcacagttccaagggcaagagactggaacagttttaatatgttattttgtccattgatgtggtaaagatggactctttagatatttacattttaaataaagaaattttatttgttcttaaaaggctttcttctagttttgtgcttattagataaccattctgagggatactagtaatggctcaggtgtgtacagataggtacacagcatagagaaatgtgtgataatccagatagaagattgtcatctcagtagtaaatataaagaaaaaattactcaggacactaggaaatctgatttgttatcttcattggatacttagaaaatgatgacaagtcacttgatttaattattataaaaatttttatctaaaatgataacatagtatcatttctgaaatgtttagaaaataattttcctagtctatttaaactggccttgtattttctgtgctattagcctttatcttgacttgcttaaatttattccccaacaatgtgtggtaaattgtttctgttccatgttatacttcagaaatgactgccagcatatttaacattactatttgagaaatgattgccaaattactcattattgaatataaagctagtaagcagtgttggcttttgaagaagctctgccagtttgtctctatagtaatgtgttcatatttttaacactttggatatgtaaataaaggtgttacaaagtatctgcaatcttcaccataattgtctgcttactcaatcctggtgtttaagctttagaaactgtttattgtttctaaaaatagttttaaagatttcatccatgagtacttgtgtttacatcatttctaccctaccttctccacctccaaccccgatgtcttcccacttctttttaagttcatgaccttcgtgtgtgggacatacacatacatgagagagagagagagagagagagagagagagagagagagagagagagagagagagacctgcacagtccatttcattttaatgtgatcatcttgcccactgattcactgatatttgaaaattcttttcttattcatggagattaagtaaatgacatttctgtcctgttgagttcttattaaattcaaggaaaagtttaaggttgttaagttctaaggggattatagctaaaaggctttagttttccttcttggtccaggaaaaacctgagaagagctgaagtcagacattccaaatttgtctgtacagcatgacctcagcttttatgaggatgatgatactgtcttcacagagctggcactaagattaagaataaacccaagccaatgcttggcacaaatgagacatttccaacaggagtctgtctgaaaaaaagagcccaaagagcatccggtggttttggaagcaggaagctttctattgggtccactttctccttacatagaccatggtggagaacctggaaggttgaacttggtgccttcagcatcctgctctgggacacactgagaaggaagatccctcctccgaggatcagagtactcagagtactacatccacatagcgctgtctcaatcttcagaacctttatggttttccttttatcttattgagttggggatggtggggctagaggcagacatgctttccctaaggacccattcaatggatccttaaatgagcctcctatgccctcaatatgtgtttccaagtagggtgaggggcacctaggttgatgggaaatgaaaataatcattacaagaacttagcaggatttctgataatcattcaagttataatcatttaacaaattaatatgtatgcacacatgattaaagtattgatggcagaaaaaaagaataaggatgtttgaagttcttcatcttactgcatatcatatagtatagataatgtataatttcctgccctttgtttcaactgtgtatcatcaattaattttggagttaccttaatcttagcaacatcaatctcatctctataatttctgtttgcttattttaagtactgttttctttcttcccaagtaaacaatgagtttttatgaacaatgagaagataaaaaaattgttctaatactgttaacaaaatgtctaaaaatattttaaataaaaaaattcaaagatgctcatggatattaatgtttccttccaaatgctctgtcagcagaaccggtaataacattaattttctgttttccaagtgtgacatattaaagacagctgacttaggagaaggggcttgaatccactacaagtatatgagtacttgtgactcttcccacatttatagttgaattctaatccccaaggattaggaggtgggcctccacaaataggattagtgttctttttaaggaggctccaaactcagtgtcttcacttgtcaaatgaagatgatacaagaatgtggttatgcagaataactgggatgtaacatatatttatataaggtaatgacattaataagaagacaaactacacactaaataccaagctctttgctaagagaatgctttatcgttatctccttagttctcccagcaactgggcttcttgtgtccagttgacaaagaggaaagtggagctttcaaatggaaataacttacctagctataagtccagaatgggaacacagtttaatgtgagatgccactcaaaaactcgctagtcttaattaaatcatcatgctatagaatacaaaattaggatatagatggcaaaaataaaaaacaaatattcaaataattataatatgtaattttctgtaaggcaatacaaatttaaaatttattgaatcatctaatgtttttcaattacataaaatcggtacttatgagcatgagatgagtaaaagatttctaccaaatgaaaactaagtgggtttatattaaaatatttctgacatggggccagtgagatagctccacaggtaaaggcacttgtcaccaagcataatgattaaaataataataattaccgttatttaataacattagtactattatttagaaaaatgatataatctattttaatgtaaagacatattttgagtgaaaatgcaactattagacaatccatacacataaatgtgacatttcaaaactaaaagtccaagtggtgtggtaaataataagaaaaatgatccacaagcagtttcttttccagtcttcatttgtctaaaaagtcggaaatttttggtattgaagaaaatatacagatcccatctttgcatgggaaagataaaaatctctggctgtctttatcctgccataccaagtacatctaaaaaaatttttatatatattattatgtgcattggtgttttgttttgttttgcctttgtgaatgtgtgtgagggtgtcagatcctctgaaactgtagctatatatagttgtgagctgccatttgggtactgggaattgaacctaggtcctccggtagagccgctagtgctcttaactgctgagccatctctccagcccataccaaatacatttttaaactcaagactgttagtttaatgtttgagtgaggtcttggttcttactccatcccaaagcagtaagtagcagatgttctcaattgaagaagataaatatgacaacagtgaagaatttgtctccgaatcagagactaaaataaggatatattgtgctctgcaattagacactaaaatccagtctagcactgttcattaaaatggaatttttaatagttttgtaatcaaaagataatttattttaggcagattgttttcatatgccttttagcatggtttttaagaatattataaggaaacagatgatgattgccttttgaactgtaaaacacttctcagttttggtaaatggtttaggttcaccaaaaaacctgtaaggacacatcttcagtggtagactagcattgaagacaacatgacattcttctgtaagaaactagttagatctgagtacaaagctagtttggtgtgatcaaaatagacacaatagatttcaacatacatctgttatatgttagatcacaacatacatctgctgtatgtggttagctgagaaaaatcaggaaagaaagtgtacttgcagttgttgctttcataatatatttttaaatgtttgatcttgaaacaaggaaaaattctaaggccattctctttctgtttgtaaccactttaatatctatagtttcaggaattcaaagaatttgctgaatactttttatcattttaattagttacccccaaggtgcatagtcccttctagagatagaggctaaacagcaagtatttgaacaggcaaagtttaatattatgaattattgccctctgtagtatgggctagtaagaattctagaactctgacaaataaatataggacttgcaagcataaggactagccactattctcagggctgaagtggaagcctcaggcagacgtttggccaatctcccagtaccactgaaattcaagccttgttggagacagcatgtggtagctaactggaccacaggtttgctgagatatcctgctggtagaaaacaatgggaatctgccttccagagtttaacagccaccatccttagggattaggtcacctctgaatgtgcagaaaacggactaaagatgtgcctgaggaagctggtcgcagacagagtactctactggctgtactctgctgcaaagccacctcaagagggttctcagaagttgcttatggacaggtgccacatgctgagcactgaaaataaattatacacataggggatccttaagagaaaagcactggaaccagagagcaaaatgcctctgctttagtgttcctccaatgccctctgttggcaaaccttaatgttgggtcagctgtaaaagcattgagttcagcttcagtagtgcagagcagtaaataacctgcagaagtgcagagcctggattcatgagtagtgtaggggcaggaagcttttctggatatagtggtggttttgttgtattgtgtttttttgatacaaaatctcattctgaagctcaggttggccttaaactcacttccaccttgccctccagagtgtgggggttacaggtatatgcaaccatgcttagctgaatatagtgagggtttttattattagcttctaagatagcatacaaattactgggtttcattatgatgctttcttgtataatttgttattcactccctctttgctgccctaccctatccccttgcctccctctcgatagtctcctctcccaggagacttttcttcttaacatttggtcccattaccttacttttttctggttttgcctccccccttaagattttttcccctgtgagccctttctagtttcatgacctgcacccacacagatgggatagcttaatgccatattgtatcttagctaccccatctgtaatacttggcagtgttttcattttattttgctttcttttccttatttcccttaaatgattaataactaaatagcatagcatatccacattagaattgttagtattgatgattatcaatctgggaaaattcagtttttgaagtaaaattttaccaaaaacattatgcatataaataaaataaacccatgatttgattcagaatattgtgttagtccatattgtgcatttagacttgttatagtagggtttcataaatattgcctagagagtttctgtaaaataatataaatgaccaggtgagtttggatgaaaattctattggcctatatattaaagtaaaagccataatttctttctgaaaaaaaaaaaggactttaaagaagagtatgaagaattaggtatgatccaatggattcctttaatagtgtgtcacataaatgccaaccaacatattgcagagtagtaaactaataatgtgtcctggagagcagtttattctttctgtaataacaggaggcttattcctttgctgtctttctccattccctcttatcaacacctaagttggaacgttaagtttacccattgctggaccattgcagaactctttctataggctgttctccagtcacaacccacctctaatttttttctaccaattacctacaattttttctttcttaattactactttcttcatttccccaagtcttcagaacatgtcattaatagtggatttctctgtattactctattgctttgagattgaattaaaacactgatattaaattatctgatgtttgcatttccaggacattcatgttttatgtcatttccccacaggaatgctttgctagattgacttaatagatctttatttttttcttcttatgttagataaattcaacctaccataaaggaagccataaggcagcaaaggtagattcatctagaatcaaaattttacacaattattgttacagtgtgtgaagggtaagtgatgttcactaacccctaaaagatgttcatatccaaatcctacaattcaagattatgccatattaccttatatggcaaaatgaagttgtaaatgtggttaaagatcttgagatgggagattatcctggattatttgtgtgggctcaaactaatgacaatggtttgataaaaaggcaggttgagtaagatttaacttacaggagaagatagtgtgacaaattagagattgggatgctccagctggtatctcaagaatgttggcagcctgtacaagtctaaagagacaagaaacaagattctctcctccttagaccctcccaaggaaccaaccttgccaacaccttgatcttagtttactaggactcattggagatgcttacctctaaaactattacataattatgttatgttgtttaaagccatagagtttgaagtgacttactgccaatgcaacaggaaactattgcattttaataggcacttgctcaactgtagcatagaagggaaagtgagaacttctcttaaaagagtcagtgaattaataaatggacttgttgggggtaggtcactgaaggtgggagaaaggatgtatagaggtgcagagtggtgaattagttgacttagtgtgcaagtagttggtgctattggagagatggtagctagcttatgaatgctgtgtctgtgatgctaagaagtttgagtttattttttatcactgaggaaacattggtagacttaaagcagggaagtcgcacaattgggtctatatttaagaccaattagacagtgttacaaagagagttatttaaagagagagccagcaagcaaggaaggtgcagtggccctcatgagaaataggagactttggatggaggaaaggagttgcacacgacgtctcaagcagtgcgatgtggtacctttcaagagacaatcctgagaaatgctcatttgtttgcttcataggattagttgcatagtgataacatctttttacagtacacatgatcaaaggatgagctgggaaaaataaatgagttttgttaaacattttactcctggtgaacttctaaaataaaaatgtgtttattttgatctaaaagttaggaccaagttctgcgcaaaagatgaaataaagaaacaatggagtggggataccagggtcctgaggaaaacctccatttataaagggcggagcagagacagacttacccaaagacacttggagagttatcttctgagaatgccgtcattaatgctgagagagaaaaatcatttctctgctgtcagaaatggcttagagaccagttgatagaataactgtgatgtcagtggactttggcagtgtggaaatcagtgggaacctcagcaagatcatgttcagtcctggggtaaagctagcatattgcggtagtctgaggaaggaatacgcagacaggaaatgaatacagtgtcgcgtccgctctcgaccagcaagaacgacacgaccaccagtccttctaacagaagtttattcagcaaacttcagtcttcgtctctctctcttcatctttttcctcatctctcccgaacccgggcctctcactcttatatactctcagtccccatccactcacagcaggccacgtcacctcaccaggcacgcagcttcagccaatcagggcggcagggacgtgtctccaccaaatatggacttgtttaaaccgccagcatcatggtgcaccttgtgcagctctcatgatggtcaatggtcgtggcttattttcaggtgtatgaggaagtcaggtgcaagtcataagacttagctgcagtccctggcaccttcttgggactgctgccacacccgctcctcacaatacaggatactttttttttggttttgtttttgttttttggatttttcgagacagggtttctctgtgtatccctggctgtcctggaactcacgctgtagaccaggttggcctcaaactcagaaatccccttgcctctgcctcccaagtgctgggattaaaggcatgtgccaccatgcccagtcaggatactttttgagagaaaaaaaaattgctctggaaatattccagagattttctagagtgggaagacaagagacatgtgtaacaagagtgttccatcctggcttaagatatgggtagcaatgccatatgacatcctataacagaatatgggggctgtaaaaatttggcaacaggaaacagtttctgaacatgcaataaacaaaacttgattcaaaagcaagtgcatgctgaatttgaaattcctagcagcatgcacctgtgttacatcatgtggcgtcactgctgccttgcttctgagcccacagtgcacgcacactttccacctcatattctgtcacatgatctaacaccaacaaacactgccagaaacacctgagctctcattcctgactattgtatgctacagcctagtgttttgttgtacacaaaaagggtttggcttttatagaaatagaataatggtttaattattttaaaaaggccatattaccctaccattgttccttagcatataaatatcaaatatcattaaattgtgtttatatgtttgactcttttttttacattattgtttgagtttctgactttggttttattttctagaaatcattaaatgaatttggatttcaattagaacagaatttccagcaatttctgaaatagtcctacatatacttctgccattttgtagtacatatttatgcaaagaggcattctctgcatcgacaattataaagtcaaaatattgattaactctgaaaagcaaagattctctatgtcctgcagtatcaaatatccagccagaatttaattctttgcaaataaacaagcacatctctctcattaccatgcaaatttgctttaatctttaatcaatagtaaaattatatgagtgcagaagagttattttatagcttctttatgatttgtttatcagtaaatacttgatttttatatacctctacacccaagtttgaatacaaatttcctgggcaaaaggggattgcaaatagaaaatatttagaagctcgatctaagaagaggaacagtgtgtgggggaggggtagagattaaggccgggtgtggttcagcatcagtactgcttggaggtggaagctactaggaaagagtaagaaagcatgactggtgggagtgggttttgatagcaaacagggggtgtcccttgacatatatcagaagctgtcctggttagctttaactgttaattggacacagcctagcacagtggctctcaaccttcctaatgcagaaactttaacacagttccttatgttctggtaccctagccataaaattattttgttgctactttaacactgtaaattttctacttttatgaatcataatgtacatgtctgatatgtaggatatctgatatgtgaaccctgtgcctaaaggagtcacaactcacatttcactctgacttagagtaacctgagaaggacatttcagtttagagattgcacgatcagattgttccatcagcatgtctttggagtattatctggatttctagttgatgtaaagggccccacccatcagtgagcagtgctgtttccttagtaggtagtccttggctgtataagaaagctagctaagtatccacctgaacaagccagcaagcagcctttcctccattcaagtttctgctgagttcctgccctcacttcccatcaatagtggagtgtaaccagtaaactgaaataaaccctttcctcctccagttggtattggtcatcttgtatatcacagtaacaaaaagaaagtagaacagaagctgaaggaggaggacccacagtgatgttgttggtaaagtgggaagcatggtggtgataggagagataggaacggtcttaacaacacttaggaaaatgcaatggaggtaagaggggagattgctaggcctcctcaaggggacagttaatacagacttcttgtcctttggtcattaagaaaccatcagatggtttcccatagtggttgtactgttttactttactaccaatgataataccaataacatgtgagaattacagctactctatatcactgccagggcttgagattgtctttttttttttcttcaatcttagccattctagtggtgtgtcatggaagtccatgtggctttttaatttgtatttacctgatgactacatatgtttctgcttaaggactattgtgttctgttgttgtagtactagtaatagtagtgcacactacagtactactagtgtgtgtgtaaaggggggagttatatctccattgtattaagttacagtaacatattctccatacttacttgttgtttgtcaggtatacatattacaacttttgtctcacaccttgtgacattcaatcttatatatttctaatttgggaaaaattcaatttgatttttttcttttatggttctgtatcttaaaaaacattactaccatcaggtttatataaattttttattgtattttctactgtaattctagttttaaccattactctagattctgaaatcctttgatagtttcttttttcagtgtgagattagagttgaggttcatgaatagctacttactctggtggtgtttattgtaaaagttacctttgtctatcacagcattttggcacttttatcaaaactaatatgttgttctctttctatactttctcttctgtcctatcctaatgccaggcctatgcagtctgggttactctataactaacacttaagttgcactaacttacattctattattacttccaaacattcttggtctattctaagttctttacatttttgtaaaaagtttctgagataatgtcatttgttttgttttgtttttgaagcatgaggttttgattcagatttattttaaatctgcaaacaaatttgggaagaatggtgtactggctagttttgtgtcaacttgacacagctgcagttatcacagagaaaggagcttcagttgaggaaatgcctccatgagatacaactgtaaggcattttctcaattagtgatcaagggggaaaggccccttgtgggtggtgccatctctgggctggtagtcttgggttctataagagagcaggctgagcaagccagagcaagcaagccagtaaggaacatccatccctccatggcctctgcatcagctcctgcttcctgacctgcttgagttccagtcctgacttccttggtgatgaacagcagtatggaagtgtaagctgaataaaccctttcctccccaacttgcttcttggtcatgatgtttgtgcaggaatagaaaccctgactaagacaaatgagataaattaaagttactgttaaggcctccaatacatgagcattttttatttatgtaggccaactttgtgtgagtaaatattttgaagagtagagagcacatgcatatttgatttaatttatttttaggactttctgtgatttctccagtttagacatatttttgtctttctaaagtaaattttcttgcatttcacttttacccatatctttccaacatttgttggttttcattattgtttccttaatgacagccattttgtctggaatgagaagtaatctcagtgtagcttttacattttcccaattactaaagatgctgaaatcattttcatttatttgttggctacttgtgtttcttccttaaaaatattttttgttgttgttgttcagttattgatacatttgtttgttattttgatgtttaattttttgagttcatttatattctggatactaattccttgttaaataaacagctggcaatagctgcctctaattctgtaaattgtctttttactcttttgattgtatacattcatgcaattccatttctcagttcttcctattatttgatgaaccaccagagatctatttggaaagtcattggctatgcctgaatcattttatctcaaagtgttaataattctcttcttagttatagttctagctttttgcttttatttctttgtaatgttttaaggaaaatgtattatttcataactaaatagatatgatatactaaaaattatttttatttttgagattaatataattacatctttctccttcccctttcctcccctgaatgcacatatatatatatgtctttgagttctttccaatgcatagccctttaaaactaattggtgttacatgcatttgtgtgtgttcctaaatatagcctgcttactctatacaaagttacttgtatgtatgttttcagggctgattatttggtgttggctgatgaattgctgtgctcctctctaatgaagagtagttctccctgtcttactcagggtttctattcctgcacaaacatcatgaccaagaagcagttggggaggaaagggtttattcggcttacactaacatgctgctgttcatcaccaaggaagtcaggactggaactcaagcaggtcaagaagcaggagctgatgcagaggccatggagggatggatgttccttactggcttgcttgctctggcttgctcagcctgctctcttatagaacccaagactaccagcccagagatggtctcacacacaaggggcctttcccccttgatcactaattgagaaaatgccttacagttgtatctcatggaggcatttcctcaactgaagctcctttttctgtcataacttcagctgtgtcaagttgacacaaaactagctggtacaattgaacccttgtcaacttgacacacaagtgcatcactagtaagcctcaacccttagttcttattcatccccaagatcttaaataactttaaaagtcccacagtctttacatattaaaagttcagtcctttaaaaatatccaatatcttttaaaatcaaaagtctttttacaattaaaagtctcttaactgtgggatccactaaaatattttcttccttcaagagggaaaatatcagggcacagtcacaatcaaaagcaataattaaactccaactgtccaatgtatgggatccaaatcatgatcttctgggctcctccaagggcttgggtcacttctccagccatgccctttgtagcacacatcttgtcttctaggctccagctgcctgtactccactgctgctgctgttcttggtggtcatctcatggtactggcatctccaaaacaatgcatgaccccttcagtcctgggccatcaacttcaactgaggctgcaccttcaccaatggccttccatggcctctcacagtgccaagcctcagctgctctgcgtgaccccttcatgccttcaaaaccagtaccacctgggtgactcttacacattaccaagtcctactgcatcacaaggtacaaccttggctatctctggcacacagcctctgtgctctcagaaaacacttcccagaagatgtcaccttgatgatgctggtctcttcttaataaccgctaatttcttagctccagctaaccaccatcaatagtcccaggaatgcaaagtttttgctttagtatcttgttaatcacagctgattcttcagccccagctaaccagaactacagaatcttcacaatccaaaatagtaatggccctgaaaagagtctttaattttccctctgaaattttacaagccaggcctccatcttctgcactgttctcaacattatcttccaagctcctatacaacatctcacagagctctgaacaccgaatgaaacttctggcccaaagttccaaagtccttccacagtcctccccaaaacatggtcaagttgtaacaggaataccccattcctggtaccaatgtgtcttagtcagggtttctattcctgctcgaacatcatgaccaagaaacaagttggggaggaaagggtttattcggcttacacttccatactgctgttcatcaccaaggaagtcaggactggaactcaagcaggtcaggaagcaggagctgatgcagaggccatggaggggtggatgttccttactggcttgcttgctctggcttgctctggcttgctcagcctgctctcttattacccaagattaccagcccagagattgtcccacacacaaggggcctttcccccttgatcactaattgagaaaatgccttaaagttgggtctcatggaggcatttcctcaactgaagctcctttctctgtgataatgccagcctgtgtcaagttgacacaaaactagccagtacactcccactcccagcacttcttacttgcctgtagttttttgtgcatagggttgagtgacgccttgtgctctttcccccatctactttggcatgtctatcggtgtcatccttgttcaactcatatttagtcatccatgtcagtgaggctttatgggtatagcttctgatgttactagaagatacaacctcacagcaagcatcttgttcctatgtctcttacaatctgtgtctcttccgccatgctccctaagccttaggtgcaggaacattgtgtagctgtacccttaactctgcattttaattgactgtggttttctacaatggtctctgttacaaaaagaagtttccttggtgagggagtgtacttatttgtgggcataaggacaaatatttagagtgtagtagggattgtgctggtttagtaaagtagtaagcataggttctcctctaagagtcttgattttactagctctgggtagttggctaggtttccatttcctcctatgatttctcttttgttgaatggccttaagttcaattagaaagctgttgcttattgtcaagctatgtgggccactatggaaccattaggtctattgtgccatgctgatcactgttgtggtttatcctagactagtttcaaatttggtgtcttagagtaagagactcctttattttattcttttttttttttttttatgtttttgagacaggttctaactgtataagtctggctgacctggaactcattttgcagaccaaactagcctgaacttgcaaggatccacctgcttctcccttctaagtactaggattaaaggcatatgccactctgcctacccttacattaagatctttgatctattttgagttgattttagattgaacaagttttagattccgttttctagtgtgaatatactgttttctcaacatgacttgttaaagaatcttttcctccaaaatatagttttgctacctttgccaaaaatcagagctgaaacttcttgggcttgcttcctgattttttactctattctattggtgtacatgtcgtgcacgtgcgtgcgtgtgtgtgtgtgtgtgtgtgtgtgtgtgtgtgtgtgtgtgtgtgtttgtgtgattttaatattgccatactggtggtgggttgtttttttttttttttgcctgtttctgagaaaggttgtttaagatactgtaatacctccagcattgctccttttgcttaatactgctttggttatttagggtttttatgtttccacataattttttgggacaggttctctctgtgtatccctggctgtcctggtactccctgagtagaccaggctggcctcagactcacagagattatactgtgccttcccccctagtgctgagattaaagacgttaccaccacacctggcatccatgtggatttgaagatgccagttttactttttagtctctgtatgccttttatgaggatttcattgaatattggcagtattaatccagtccataaatatatcttcgatttcttcggtgttttggagtttttattgtagatttttaaatacctttggttaaaataataaataggcagttttaaagctattgtggtgtttccctgagttctttttcagaacaacatctcttattgttgtatagagaagctactgacttttgtatcttgctactttttaaaaattcttcttcgcatatcctgactgcagtttcccctctctctatccctcctattcccttccccagctcccttccccctgatccaccatttcttcatttcctttcagaaaagaacagacctccaagggatatcaactgaacatggcatataaagttacaataaggctaggcatatacccgcatatcaatcaagactagatggggcaaccaagtaggaaaagggtcccaagagcaggcaaaagatttagagacaccctccagttccactgttaggtgtcccattagattactaagcaatacagcaacaatgttagaggacctagctcagacctatacaaggtccatgattgccatttcagtctctttgagccccctatggaaccctgcttagttgattctgtgggccctgttctcttggtatcctcaacccctctagctcctgcagtctttcctctcccttttctacagggttctcctggttccacctagtgtttgactgtgggtctctgcatctgctcccatcagtagctggatggtgcccctctatgacaaatgagttaggcaccaatctattggtatagcagaatatcattaggaatcatttcattgtttttttttttttttttggagtgtgtttagctctatctatcctgggtctctggactgtccagcctctggtttctggaaaccaaggcagtgctatttgtgtgttccctcttttggtgtgggcttcaacttggaccagtccttgcttggccactctcttaaattctgcctcaccattgccccagcatgtctggtaggacaggtcaaaggttttgtggctaggttaatggtccagttccactgttgggtggctagcctggttatagaagatggatggtttgggcttatctttcattactagggtcattctcagagattccagggagtttccactgcagtaagtttctcatctcacccaaatgccccccaattcctcttttctctcccagtactctctccatccctcccacccctaaccctggctcctaaacccttctgtttccaaccccaacccctccccccagcctacattcaaattcttttcaattttcccttcccagagagaaccatttattgtcatccttctcaacccctttgagctctccttattccttagcctctctgagtttgtggattattctttacttaccagctaatgtctgcttataagtactagggtactatgtttgtctttctgtgtcttgattacctcactcaggataatgactttttttctactttcattcatttgcctgcaaatttcatgctgtcgttttagcataaatatatcaacaattcctgtattcttcagttgagggacatctaggttgtttccagtttctggctactatgaaaaaagctgctatgaatatagttgaataagtgtccttgtggtaggatggcaaattctccaggagtggtatagctggatcttcaggtagatatttcccattttctgagcaatagctgtactgatttccagagtggttgtacatgttttcactcttaccagcaatgaaggagtgttccccttgctccacatcctagccaccatgagctattacttgttttgttgatcttagccattctcacaaacgcaagatggaatctcaaagtagttttgatttgcatttccctgttggctaaggatgttgaacatttctttaagtatttctcagccatttcagtttcattctcctcaaaagaactctgtttagatctgaattgattattttaaattggattatttggtttgtcgatatctagtttcttgagttctttatatattttatatatcagccctctctcagatgtggggtttatgaagatcttttcccaatctgtagactgttgttttgtcctaatgactctcctttgctttagaaaagtttttcagtttcatgagctctcctttattaattgttgatcttagtggctgagctattggtgtactgttcagtgagttgtctcctgtgccaatgcattcaagactactccccactttctcttctttatatatatattttattaggtattttcctcttttacatttgcaatgctatcccataagtcccccatatcctccccccaaatcccctacccacccactccccctttttggccctggcgttcccctgtactgaggcatataacgtttgcctgaccaatgggcctctctttccactgatggccgactaggccatcttctgatacatatgcagctagagataagagctccggggtactggttagttcataatgttgttgcacctacagggttgcagatctctttagctctttggatactttctctagctcctccattgggggccctgtgatccatccaatagctgactgtgaggatccacttatgtgtttgctaggcccggcatagtctcacaagagacagctatatctgggtcctttcagcaaaatcttgctagtgtatgcaatggtgtcagcgtttggaagctgattatgggatggatccccggatatggcaatctctagatggtccatcctttcatcacagctccaaactttgtctctgtaactccttccatgggtgttttgttcccaattctaagaaggggcaaagtgtccacactttggtcttcgttcttcttgaggttcatgcgtttagcaaattgtctcttatatctcgggtatactaagtttctgggctaatatccacttatcagtgagtacatatcatttgagttcttttgtgattgtgttacctcactcaggatgatgccctccaggtccaaccatttggctaggaatttcataaattcattccttttaatagctgagtagtactccattgtgtaaatgtaccacattttttgcatccattcctctgttgaggggcatctgggttctttccagcttctggctattataaataaggctgctatgaacatagtggagcatgtgtccttcttaccggttggaccatcttctggatatatgcccagaagaggtattccgggatcctccggtagtactatgtccatttttctgaggaaccatcagactgatttccagagttctcttctatcagattcagtgtgtctggttttatggtgagaagcttaacagtcttctagtgtagttttttgagtcttctcaatatagggttttattatctgcaaacagggataattttacttcttttgttgtttatatctttttatatcagtctcttgccttattgctttcactaagatttcagaaattattttgaataagaatggtaatatggaacatcttttcttttgttaattttagaggaaatggttttagttttctcataaattttatttttaatattaatagatgattgcattttgatgattgttggaattatttatattgtttcaaatctttcacatcatttgtaaactttagttattacatttgattctattattattttttaatcctagtgtccagtttttgtattagaatatatgcatgccattgatttttgatattttagttttgttgtctcctgcagacttgctaagttcagtctttgtggcgttttatgatagattatctctgaatttcgccatggaagactgattatgtgttaactatgtcatctcaaatatacatcttttctactctgtggggtgtttatttctgtactacactagctaaaactttactcccatattacaagactagtcttgagatcaaatgtctcatcctcatcttagaaagcatttggtctcttaccagtatatataatatcaactgcatggggtttttgtgaatggcctttgtcagatcaaataaacttctttctattcctactttgcacaagattttgttttgttttaaagaatggatgttttattttgtcaatttctctttctacattaattaaaatgattatgtattttacttttaagtttattgacagtcacctgtttttatttctgtaatgataaaccactgctgaaaaattcagatagctctatagttttcttgtaatgtctctagctggctttgataacaaggttatgctgatttatataacaaattaagatgcattcatatttttttattttgaaaataggtttgtataaagttgacatatttgatagaattagttaatgatgccatgtgagtctagaattttcattgaggggtggtttaattttaaaaaaataaaagtgcttctgaagtatttttattactccagaactaaaatagcttttcttctttgcacctgttttagtccccgtatttaatgtgaatcgtcttttgcattaagtgaggtttctctgtcatatttggttatagctccaagtgtcaccctgctctcttcacttagcttttggagatttgagctgtgtgtacccagattcctaggaaggtgaggagccactgtgttgtttgacgttctttcctgtgccttctctttcttctagtgctgtgcccagactatctcctctcccccattctcctcagaagtaatctgccttctcagcccagaaacactcttctgctctgcgttatctcctctcctgattaggaaactgggcatcacttccagaattagctcagtatctgaaaatatttgtttcatacatttttttccagttttctagctcaatgggaaaagaaagttcttttccaattaaactttcattctttagaaaaagtcctcatcatgacttttaatgtgcttttaatgtgatttcaataaatcttagttctaatgactttcagaaagggagatagtgttatcaaattctgacaaatataatcaaccttatcttatttccattgatgctgtggttggaaaattatcactacacttccaatgtggttaaaaatagaattttgttagagtgaagagggataaatatgatgttacagtaaagagagttaataatacaaaaaaaattaacacatagcatttacttagcattttagttgtgtgaagtgctttgctaaaaggtagctccttttcctcattactagtctgttatatagtctctatattatgacagttttgcaaggggaagaactgaaacttggcagaggttaagtggcttgttcagactgagaaaaccatcaagtaagtgtcctagattctaactaagtattgacaaagttcaagtcaacattgtcaatctccaaggtccccttcataatcaccatgctgacttttaagtgggcaggcagctctggcagctaagggatccccttcagaacttgaagtgtgggatccactgctttgggtggagtcagggcagcagttccaggtttcctacggaagtctttctttgggtgccttttcagtgctttttctgctttatgagagaaagtcagcaagcttttaagcacaacttacacagagattctgatgccgtcttttcttttctctatgtgtgattggaaatctaagtggacctagtgggagaccttaaaattggctttcatttttattctgtgttaagacattttttggtaatgatgaagtggcatggaagcagagagtactgaaaacatggttactgtgttcatagtttcaaagtatctagtaattttgttaagtctgaaattatatcaaagtaaaaggtgttttagatacaatgtttacttaaacattgtatctatcttcatggtttagccactgactggctgtattattaacttggttcactctaattttattcctggctctttattcctgtaccttctatttaatgtttttaaattagagaaaacagttagatggttctgaaagtaaactaactgtgaaataaggtacattcacataaatatgttttctattcttgtttccttcacatttaatcatttccaatagtgtttattctaaatctttaagattatataaaagttatggttcataattacagcataattgcagtattataagtattgtattgtaaacatacacaaacacattcctctttcttgattgagaagtgtcatgtttcatacagcactttgcatctttcgttttgaagaaaaatagatattctatgattcatttcctagcaggatatgtaggtcctccttattctatttgtagctctggattgccattcttcaaaatcttatttggtgaacatgtactgtctgctatgtgcccatctattggatagattctatcagatgtagtgtatggccttgtatgataaatacatatatcttatctgcattcaagttatggagtttcaaaaatttttaatacattgctttctccaatatacagtagctgattcatcagtatttatttttattagcctcctccttccttaaaacttagaacagcttatgtcatttttgtttctgttgtacataatattgttcagatattatttgtaaacctactaatgagtatatcgcaatgtttaaaatatttagatagctggttgtaaaatgtaagcaaatagtatgataacaaagaccagtaaattggcctgacaaacaaactacctgtcatgcgagactaagtacttaagtttgaaatgcagaatccacataaaggaaaagagatattcaactgcacaaaggtgtcctctaacacaagacacacaaacacacacacacaatttataaaagatgttcgccaatggattgattatacttttttgagatgcttttctatccctataaattcagaatgtctgccttcctttatgtatgctgtcctttcgaaagctcaacatccatttattggctgtattactcctagcattttctttttgcttcttaggtctttgagttttgagacatagactcactgtgtattttgggctggcctttgtatcttatggccttgaatccagcttcagccctccaggtgctggtgctgctactacaggattaaaggcttagactaccacacctggcactcttgcttttgttttgttttctgatatcacttctctccacattttgcagtatttattattttttattaagccccaccttataaaaatctgagcttttcctcaaagtcctatgtagtaggtccgtggggatgtagtccagaattacaaatacctataaccatttgtcaaataactgggcagatatggtggacattgtttttctatttctgtgttaggtctgacacagtctcttcacactacttcaggatcctaactctggtttttcatttttaactttgccacctcttctttatcttggtcatatcttggtttccttttctttgttctccaaacttggctgtaaaggctgtctgtggctttgtttgcctcctcctggccctcctggccaggacctgttatgataatcactcttgagctgtgcatatgattccctcttttccttccacctatacctttcttgacatgctctcttggtttcctgctctcttttctctcaagagtaactttggtcacaaaatatagtgtcccaccttcctaaggaaggacatttaataaggtctctatatgccgcctcagacgtcataaattacagcatggttaaatagctagaaacaaaagatgaacacagtttgagattgtgttcattgcatcgacaatccagcacttaacacactactcaaagcatatcctacagggaaagcttctaagaaaataaatactatatgagatgtagcttcacaaagctctttaaaaaaaaattcaggaaattgattccatgtgcatgaagtcagcgttttctctcagcaggcactgcaactaatgacattaatgagacccatgccatattaaaaagagagaaagagaataaaacagacaaaactgataatttaagaggaaattatttccagtggtctgtttgaacattgtaattaaccaagaaataaaatgagaaaaaggacctttttaattgtggtttttagcactccattaagaatggctcaaactctacgtgaattgggacaatataaaatgagtacttatgtttaagtgggagagccatccgtactcaatatagaggtgtggatttatttcagaatatcttagacttaagtgagtattggcattgtttttggtaatgcttttaaaatctctagtattttgacaagaggttttaaataaatgttatacaggaaaacaaacacaaaacttttctaacatagcttccacaataaataaaaataaataagtaaaaaaaaatttgtttttacacctttttagccccattatagtatatcagtttgctaaccttgaaaacaaagctttataatttgtaacatataaaataatattcccctaagcaggcagttttatccaagattcctggtattacattactaaatgtagtgagtgaaatacttcttaggtaggttcattcacagctgtgctctccttttctatcctttatgcctcctctggtttacttttatgttgctacgtgataaaatattctgaccaaaagcaacttggggaggaaagggtttatttcaattttctctgagaaaagaactatacccacatccctccacatagattataatatcaactcacactacctcagcaatgacacaaaaggaatttctgtcgtagttcattccccctcagcactccgttattggagacaacctctttaagcattatcactgttccttttgtacctaacaccatatactatctcttgactttataattctaaatatcaattatcaccacactgcttcatacgttgcctctcttttccttcttgcttctccttattttcctttgttgatttatttctctttaatttatacttatctttttccccttcatcccatcttcctacaacctgatccttccctgtccccacctgcccgcagtccatgccatatatttttctatgtccccatttctaattattaatacttgggttgttgctataatgtgattttatataattatttattactcctgttgtaaatgcttggcttagttcatgttgggatgtttgtgtcttttttatttatccataggctggcccttgaactgtgtgacttctctcagtacgtacattatttttcatgatagcagagggatccttggttgctgtatcttgcttttcttgattgtcattaaaggaattctcattttcttatgtgctagtgtccctattttctaggtttcctgtatttcttatttttcattttgttttgtttttacttagtagactctctagtaacttcctgagaaaagatattttttggttttttgtttgtttgtttgttttaaactttacatatgtaaacatgtatttatttaattctatgctttgaacagtaatgtagctaggtatatgattcttggtcagatgtaatctctcagggttttgaaaaaatatagaaggtatataaaagtttatgcattgcaattagcttctttatatcaaacctaccagttgtgtgacatgtgtatatcatataacatctctgcctgtttcttcatctaaaaatcaggtatagcattttaccattctgtagaattgctgagaggatttaatgagagatatatctcactaggacaatacctgctcccttgctctcctttgaaagctttagtgatattctgtttgctccagtaacccttcagatttttttcagtgatatgttgtattatgggctcttataaaaatcatgcttggaactctttttatatctagaaacccattgtctttggttccgagcagaaaattcttagataactacatatctctaatttctctgttctgcctttctggtttctgctatttaaataacatggcatatataattagccaccatcgctaaccttttgcctccctgatcctatctcttgttactttgtcctagctttactttttcaacttggccttctaacccttctgtttggatctttgctcaaatttatcatttccagaggtggtattcactgactgttttgtttaagttagtattgtacagtttcctagcatttttacctactgtgttaggtaaaatcgctctgacaacgtatctgaggggaaaactggaaagcaagaatgccaaagggtttagctcatcatggcaggcagggtgtcagtaatttacattattattgtaggaggcagacacaagtgactgcttatactacagagctttcccccattccttctttgctctacttaggagtctaacctataggaggaggatcctttctccatagttaattcctggaaatacctgaggaggaataactagaaatatgctttactaatctaaatgcttttcagaccaaccaagctaactatcaaaatcaataatcacaagtctactctcaacaaccaggcacccaaatatgtctccttaagctataatattttaccctttccccttccttccctcttccccaaacctcatatctaattcatattgcaaaatgcacgtattctatcttccagagtcctctaagtcttaacagacaaaacctgttcagaaatccaatttccaaatctgagacaatgcaaacacttagctgtgagcctctaggaaatcaagaagacattagctattcccaagctcccacaattcttgtattctgcattcttgaaaacacggaatcccatgaactatgccaaagtgtaccacagttctaataggaaccaggatcctttgggctatggctgcagtggcctcagaatgcctgaattactgagtaaaggcaagaggcagattctctgtcagctgtatgtaagcagagagatctaacctttattagattactcattattttaaaaaagaaactttccacttttgaggctccaatggtggcctaattcttgagattctttcaagagatctttcctgttgttccaagtcaaagtgtttggcttcctcttaataaccctgatctcttcagcgctccaagtttccttggcaccaactttacacatttatttcttttctgagcaaactgcaagtttttcagacatttttgttcctctttttgttcactgtttcattatgaacttggctaaaagcagtcagcagtgtccattcttcatctgaatgctggattgcccagagacttcctccaccacattagtctaccgcttttataatcagcttcagaccagatatctaggcaggttttggtcagactgtaattccatggcctctagtaatgtccctacagagtcctcatttccacgtaaaactttatgaagtctttactctctatactcctaacagcattctcagctcagctcccactacaaccactaagttctgtttatagaattctggagtttctagagcccacatctccagacttccatattccttccatggcccagttccaaagacttctaaaccacatagtcagatgggtacaataatagcactacttttctggtaccagtcttctatattaagtacttgttcaatgggcatgacacaataatcttagcaaaacagcagagggaaagaaagatttgttttggctttgtatttcaaaggttccatccattattgtggctaggaaacaatgcatgtggtcactggccaccttatttttcattgttaattccatctagtcctctataggattgtgcatgctatgttcaggaatagtctccttcttgtagttaaccccatatggaaatacccacacaggcacacgttcacaaacacacctagatgtgctttattaatcttctatgcttctcaacccaatgaagttaatcaagattgaccattacatatatcatgttgtatttgacattcccctggtttggcttttataagaaatagcctcctgctcagaattttttttctgtttctttttacattgttttcttttgagaggctttcctcttatatctggtgatctttagcttttctttctgcctgcctgtctctctctctctctctctctctctctctctctctctctctctctctctctctctccctccctccctccctccctccctccctccctccctccctccctccctcccttcctcccttccttccttcctttcgaggggagtattcaacacttgcctagaaaatgtaggtataagagtaacttaactataagtgatcagaaaagaactgagccatatttgacagccccataagttgtctatctgtagggtttgggttttttgtttgtttgttgttttattcttaatacagtcagtttgataaggaagagtcttgtgtgcctgtcttgagttagagatatatctgctgatacgatgagacacacatctaagcctaattacatgagtttcactagacaacattaactaaatgaggctgaagttgttttgtttggcacatgaaatttctaagtgattatcctgtttaaatacagcacttcatttgacctgagctatgtatctggggtccaaggtctccagaaagtaaattacttgaccacagactgggtttgtgcaaggtcatctggtactcttgttttctactctaccagcactactactctgaaaatacctaatgcctcctatttgtgaactttcttcagtagtttgataagcatagtcagcttgtttttcacagtcttcccttgttggaggtatgttagttcaggttctacaaagaagcagttattgggaaatgattaggtatataagacatttattgggaggtgaccaatgagtggaatgggtgggtaaggacccttaggagactgagaaagcccttacaggttatgtatatttgaatcctttagaagagggaaagaaaaaataaatgaagaacagaatgggaaattcttagacagttttaagagtgcttggacctctatagcatacttggattccttaagccaaggttgaccatcttcccatatttcacaaggataaacttgctttagtattatctcatccctttatcagtagctgattatagccttagtaagcatagtcttagaatgcaatgatggactctgttgcatgacttttactgggaaaacatgaacaaaccactatttactctatctggggcactaacaacaggtgaaagaaaccatttatcttactcaaatccagcttatggaagtgatgaatttataggagtgtagatggcatgctacttgcaggagcatgagtatcttaaaggcatcactgaaaagctaaccccagcatagatggaaattaatggaagctgtgtctgtggtgctccctggaggctgatcaaagagtaccctctccccagaagttgttatggcttagataaccttgcaaaggagtgtgtaaatcttcggactttcagaagtttcatagctttttaagttttagtttacttcctagatcgttcctgtttcctttacttcttggtcttgtatgagcctccctcctctccaggacagtgtttctgttgagaggaagtagcatataataaagtccttgtgctatacctatattatcagtcctttacactccagtctaccatcctagattgaggtggcacatcataatgctaaccctaattaaacttcaactttctttgatccactgaccatttactttctcctatctgaaatttgttttacttatccatataatctgcctcctaactcattattttaagcttttaatttataatttgtttattaaattattagctagccttcaaggggtagtagagattggggaaaactggaggatggatttgattgaaacatcttaaattctcatacaataaagcaaaactatgaagaactttcagaaattgtagaggaatatgtgtttaaccattgtttaaatggaaatactggttcacttataaagttcaaacatgatctattaaactatatacattctattttgttgtgttatgtgctctttggtcacctcctcctataatgcagtcctgtgtgggcatgcagacccagtagtgactaaccttagttaatttgaataatgccaagaaattggtaactcacatctcattggccattccatgcagattctccttattggtagtaacaggggctttatattgtagggaagagtatagtctgacttgatgccctcttggttctctatcaaaatcaaattgtatagatatcccatggccagagagcatgacatctaccagtattcaccagatggtgtctgtacttagactagaccttttatactaggaagctgcagaagatggaagttatcagtcctgctaccaaaccacccctgaagctctctcctagttcagaaagaggtgactacaccctgtcatcttctcctaaaccttcagagtttacctggaaatgaagtgaggagaacgctggaagtgaaggtggaggaccagctgctccattggctttttcacctgttccctttaggccttcctcagtatgatatctggagaaggtggttgcctattctaccctgaaaggtacttttaccttaaggagcagatctgaaatccagctgctgaaccccctaaaacagttctttttgctaaacactggggaagtaagtaccccgaccccctgtacattggctctccattgtggaggctcctcattgttctttcacagattctgtagattgtattgaataaatgcttctcagtttgttgtaagccttttgatctgtctccagatgcttttttcttggttctaaccagctaaatacagtaagacctctgtaccttcaggatctgcatccagagacccacccaatcgtgaactgaaagtatttggacctacagctccaaagacctacaatagtcataacacttttcatagctgtaacacttctggctagtatcccaaagctaccaagagttcacatatattgttctttttaatgacttttattttcttacagtctagtcattacccccttcttatccaccctcccacagttcctcattccattcttccttcctcaatctccaagaggatgcccccccacacacacaggcttccccactccctggggttagttgcatcttctcccactgaggccagaccaagcagtcctctgctgtatgtgtgtcaggggcctcatatcagctggtgtgtgctgcctggttggtggctcagtgtctgagagatctctggggtccaggttagttgagactgctagtcttcctatggggtcaccctcctcctcagcttcttccagccttttcctaattcaaccacagggattcctgacttcagttcagttcagttcagtgtaagtatctgcctctgtagggcctctcagaggacaatcatgctaggctcctgtctctaagcacaccatagcatcagtaatactgtcagggcttgaagcctcctcttgagatggatcccactttgaaccagtcactggactgcctttccttcagtctcttttccatttttgtccctgcagttcttttagacaggaacaattctgggttagagtttttgactgtggggtggcaaccccatccctccacttgatgccctgtctttctactggaggtgggctctatgagttccctctcacctcccaggtcactggtactttctagagattcccctccccacccctccagcctccctccagtcccacaaagaccagtttttccagtttaaaattggttaatctcatttaaggctgttaatcctgtgataataaagtacctctcctgtgtacacacttggctgcctgcccacctcattcttggaaagggcaagataagaacctagttggcaacaagagggtcttcaccaatcacctcaatatatatatatatatatatatatatatattcacacacacacatacatacatacacacacacacatacagacacacatagatcttagtgatactgtgcttccttgcaaagtatatgtgattttgagttccctctagtggaggaaggtcagatgtgctctttttaaaaactcagctcctgactagttaaccaatagtaaacagatacacatataaatcccttaaattgataaattttcccgggacctttgttcttaagtgtttttttttccaagaaaaaccttagagctatatgatactattaaatagtacaatatatgaactactcaaaggcatagaaatgccaagcatacattactttgcctaaagttggtgcattctgtggtggcagtaccctgaattttccatttgcagtcatggtaacaaaatgtggagggtaatattcacacccttttgttgcatatagattgtatgttttaaccactctgaaaagtctagtcagtgtgagtatgctactgagaagagattgcctcaaagtttggatgattttagcatcatcttccatagaaagtatgtgatatcagagtgctggatggattgggaatcaaaaacctgtgctcatctttcacttgggttataaattagccatgagaatttgagcatgtctcttgtctaccaagcctcattttctttctgagtaaaatgtgaacataaagaagagtgttacaatgatggcttacagtaatgtccatttttagaattctcagaacttttatgtgacaatagacatgggtgctgccttccagcaagattggcagaatcaccagcagcaagcaaagttggtaaatgctgagatcttaaggcatgggggtgcaaatgttaggagtgcagtgttgctatgtcatcacagcagcatatgcctacctctgctgaagactgttaaaaacagctgtggggctgagtgtcaatgggatttaggtgaatgagtaacattcatcggggtaaagaagcgtgtgaaatgttaaatggggaaggaacatttattgtgatgcatttcataaagatatttttactcaagtacatcatgtacttgaccatattcatcctcctatcccttccagtttttctaccaatccatcccactagtcccttccttttttatgattttattttttttatcaattttttttatcaatttggatgtttcaaaaaaggtgcagttttaggttccctgaccccgcttttaggcatctcgactaaggacacttccattgactcccggagcctcccccaacccaggtctctctgggacttactagagatgcaccccaagcccacccccccacccccaccagctgcagatttccattcattctcctgggcttctggacctctgactttccccacacctgatcctatcctcccatttccaccctcctcctatctcccacccaggtccctcccttcctctgtctcccatgactattatgtcccccgttctaagtgagattcaagcttcctcatttgggccttccttcttgtttaacttctttgtgtctgtgggatgtgtcatgggtattctgtatagtatccacttgtcagtgagtacataccatgcatgtcctttggggtttgggttacctccctaaggatgatattttctagttctataatgatgtcctaattagctgaataatattccactctaaacgaaccacattttctgtatccattctttggttgaggaacatcaggattgcttccagtttctggctattacaaataaaactgttatgaacatagtagaacacatgtccttgtgatacggtaaaacaccttttgtatatatgcccaggagagatatagctgagtcttcagatagaactatttccaattttctgaggaagtaccaaactggttttcagagtggttgtaccagtttgcaatcccaccagcaatggaggagtgttcctctttctccacatcctcaacagcatgtgctatcccttgcgtttttgatcttagccattctgattggtgtaaggtaaaatctctgggtcatactcatttgcattccttgatgactaaggatgcaggagccccagtggaggtataagatcagcaacccacccacaaaacttttgaccaaactttgtcatgtctaaaagaaatgtagggattaaaatggagcagagaccaaaggaatggccaaccaataaccagcccaacttgagacccatctcatgggcaagcactagtctctgacactattaatgatatttagttatgttgagacaggagcctagcataactgtcttctgagaggtttcatccagatgctgactgaaacagatgcagagaaccacagccaaacattagactcaggtcagagacccctatggaagagttggggggggggagatcgaaagccctgaagggagtgagaaccccacaggaagaccaacagtgtcaactaacctggacccctgggagcttccagactctaagccaccaaccaaagagcatggactagactgaggcttccagcacatttgtatcagagaactgcttttcctggcctcagagggagaggatgtacctaatcctccagagacttaatcaggaggatacccagggggccccatcctctcagaggtgaatggggtggaaggcggtagagggattctgtgagaatgggaccaggagggggcagcatttcggatgtaaattaaataattttaaaaataaataaaaaattgaaaaggtgcattttaaagcacataagcatgggtcagaagctgaagggaaagcagctgaaatgtagatatgtggaaattttttagtagaatgaaaaaaagcccttagattccagttgtgctgctaaatatgtctgtggacttagttaagtggttggaggtaaaaatcaaagccatcctgaaggagtataacattttaatgcatggaagagaacacagtggaggggtttggagtatatgataatagctgctttaaattcctataacactttaatgagtagaatgaaaagaggaaactgaaggtaaaggagcacattagataattactgctgtggtccaaactagagttggtgaagactgaaactgggctaatagcaggaagggaaattgacaggtgatgcagaaagacaatggacaggtgatgcagctgtaaagaggaggagaaacagcggtttgtctgaggataattccaagaagtgaatgatttcccgaaaagttatagatgaaaatttacggtgttaaagttggatcgaactatataacagtatggcttagtgatggggtattcacattgccatctttttatctttaaacttggttcaaatgattttggtaaagataagaaagaataatttttgtcaaaaatggtcaaagacaaagaaccatgttcatgttatgtactagacatagtgctttcctgtgcattatgaactctgtaggcttctccataatcctgagtagaagttgttctcttactcttcccattttacagatgaggaatataaggctccaagggtggcacaactaccggttgttgggaacaagacttttaaatggacctttgactacaagtctgttatgctatcagcacaagtaccttcctgcagaaagtgtcagtgctttaaagggtacatggcagatctatgggataatgtgagtgatgtgcctgatgtgctgtgaccaagggtaacttcccaagacacaggacctacagtgctgtggccaggaaagtcctaagtgaaaccaaaaaagctttatatgaaatataaaactttacatgaaatgagccattatgtagaatgatctaaataatgggcccattgtaactgtttaatgtaatgctgtgtcatgagccagggcttttgttatgactaagtgaccactgattcttaaaatgaagaggaggtgaggccggcctatgtgcctcacatcagaccgttttcactagcccagaggattccactcagctatgtgtgaatcagatgcgagaggcctctgcctctcaaattccattgttaaggcaactgttgttttattcatccccagtttgatgaactggcgaaagagctattcagaggagaaaaatgaggaaagacgattgattgtaaatgtatgttctttacagagtaagaaaatgcacgttctggcattctgcctacaaaagctagagaagagcttcagtgtcattatttggcagacactctaaaatatatttatttcattcttgtaaacatttatacactaattagtacataatttatattattttgatatcaagatgggaaacagcaaattggactgcatagaatgtccccaagggaacttcttataatttttttcaaagaatagaggaacgcagttaatggtggttttatacattgcacatagcacagtgctgagtttggcagcaaacagctgaaatgttatgagagttttactctttgaaacctcaacagttattctcaaaactgctcattgctggagtgcatgacactgcctgagttccccatgtcataacagccaggaggtacggtagacaattacctgtctcaatcctgaccttactcatagcttttgtgcttcccttaaatgtcaccgaagagtctttggaggcagaccacctactatttcaacagactttctgaaatgagttctggctcctaagaagttttaaattgtgtgtctagatagctactatattttgagagctaaataagacacttcgttatttttatgaacaatgaaatgaaaagtttgttatgagaacaagacagtataatacacctaaaatttattaaaacactgggaaaatagagccctttcagaagactcttcccttataccagagttttactatatataaaacatctttttgccactttgcggcaattgctgggtgattctcctttgaactaaaaattttctagtatttttcaagctttgtgactagtttaaaaacttaagactaaatggctatttacctacacctattcatatgcttctcttgataatacactttgttagtagaccatcaaaataaattacacaaataacttggtggttgtatatatgaatttgtaagtatatcactatccctgattttacagtgcttaatacaacaactaccttattcttttcattggtgttttccacagttaatgccaaaattgatacttttaatatagacttgtttcatacttatttttgagagagttccactctgtagcccatgccttgcatccttctgctttggactcacaattgcagggatgccaggtgctaactgtggtacacagcttttgtactattctatgatactttgttgacaaaagcattttatgactagatgaggaatgctgtgtaattaaaaccattggtaataatttcactgtactgtagacatccttggtcttagttatttacttatttatatattaaactagatcataagttgttttctgaggaaatttttggcctcacttgcagtgccttcataatggagaaaggcttagtagagaaaagtaaatggtaagaaaatctatcctggtatgtatattttgggggatccccaatacatttatttatcaataaatgaaaataggaagtaaatcttgttaacatatcaggaactattatgcactagatatatgagtgtttgctactttgacaaattagttgaacttctgctttattattataacttttttgctatttaaacttaattggataaaatttatgtacaataaaataaacccacctaagtctgtagttcaatgagctgtgtaacaaatgactgtatttcattttcttacaaagtatcctcatctattaatatatatatgatgctttttaagacttaatattgagacgtaattgaagcattaagtagggtttctccaatttcctcttataaagtgaaaaatacaatgttgaaataggtgtctggtttttgtcatcctaaaatgccctgattttcctttccttggtttacacctcctcaaatgaaaagcaagccgaactgtacctattagagacactaggaacattgtatttagttattatcatgcataaaatatagtctcaatagtcattcatatgtttgagaaaatgaagcactgaacttgatttgctctgaatatcagttacctctgccttactccttttagctgtttgattaacatgttttattagtcggatcccccaaagacttccaccattttcatggttgagtaactccttgcacagaatactgaaggctatattttctgaaacaaataagttggtttctttttaatctaatgttgattcttacccacaaatggcttttaagcagatgcttttctttaaagacactttaacataccagaagataaatattaataaagagatttgaatttgtcacctggaacatttattaatatccaagtagaaagatcaataaattttttgatataactcacagcagggtctttattctatttgagctagcttgccctgcctccaacacaccaccatcacataggatggttttggtggtgggagagccccaaatgtctactggggcaagggtttatagtaagcaacaagtagggagtacatgtgcaaccatctaattgaaaagctactgtggcctttaacataattggctgatgctgggagtcagatcatgaacttaatttctgctcccctctgcattggtggtctttaggcaaggggtgggcttgtaacctggggtgcaggtttgttgggggaataacctggagacactggtcttgttgggggtataacctggagatgctggtcttgttggggattagcctagagactggagctaggttcaggttttgttagtgggcaacttggaaattaatgctaggtactaaccagatagtttacctgagttcaaacgtaggtcaggttctctaaaatggagtctaaattttaaagatttggcatctcacagggcattcatgccctgtcttaggttgatccacctatgagtgaatcttaccacctttgactaccagcctctgcagtggggtatgtaacctattcggctacagttttgggccacatatactggagatctgcatggatgttcaaaaagaaatggaaggcacacttaaccacaaggggcaacatgtataatcctttaaccactggagtacccaaggcaagaattaggaaggccagggagtacaagaagaccagagaggcatgttcttcctcaatttctcttgcagcattgaatttcaggggtttagcatcttttagacaaaccattaggtctgctcaaaactttttaaaattttattcaacacatgtaagcctctatctgaataccaaggtttttaaatattaactggaagcaaaacaaatgaacattgataacatgccataacagaaattccttgtacaatgccagatatacaattaatcaaattaccatcatagaaagttacattaaagctggacccatacagttactgacagtgcaattgtcacaagttacattaaacaaatatccagacatagaaacattcatttgcccaatcatcaatacatgaggcaaggatacaaaagttgttataaaacctgacaagagacacggggttattttcgtagtgtaccatggttgggtggtgggttcctttttgacccagcattccagcctgtagagtgggacgacaaatgccatatctctcttctgtatctgctttctctgacattaggatactgcaaaggatctcaggaaggctgaaatgctagtcaaaggctgggcaatagggcatttatcaaaatcatctgattagctgatccacatgaaagatagggagcaatcccattgactgaactggttatcattagctttcagcaagtccagagttcagcagctccacaggtgatacctcagctccacaagtgatacctggatagagtctgtcaagcaggcgaaaatctgctttctctctggaacccagttgagtcaccgcatgaaggaaaacaccacacaaacttggtttagaataagcagataacataatcactgggcacaacaactagcatcttaatttgtaagcttttcttttttttttcttttctttcttttttttttttttttttttttttttttggtgttttgagacagggtttctctgtgtagctctggctgtcctggaactcactttgtagaccaggctggcctcgaactcagaaatctgcctgcctctgcctcccgagtgctgggattaaaggcgtgcgccaccacgcccggcaatttgtaagctattttaagttatacatcctccggtagcaaatcccagtggatctgccacctgaatacctgaaccaagtggggtcttccgctacctacattttggcctccatgctctctccctgtcccaaaagccaagatgagtgatttttagtacttaaatatacattaggaatgttctgacagttttataacttaaaaccaaagtaaagaaataatattcttaggcagctatttaaccacttatcctaatgaaaaagaatgacaagcagctatcacaataagctttattttatagatgattggtattggtacatatagtattggatttagtttgaatttaatattaaactgggcagtgtgcgtgctttaatgtatttgttacattgaaccagaacccaaaactttgagaaatatattaccaaactctcattcattctgaaatactcagtgcaattaagagtaatttctaatcaatttacatttctctagttgaaaacaacaacaaaacttgttagtcagatatcctcagtcctcagtttcctttcttcttcaaaagacaaatgagagtttagcttatagaaataaaaggtgggtgagaacacaaagaagttagaaaatgcacagaactctgtgtgtggaaagaaataataaaaattgtagaggtaggattaaaatgtgtaaaagagcaaagaaataacttgtgaggatctttctgggcctcatatcattactagttgagaaagtatttcttgatttatagaaaaagcgttattaaagcaaatccgaactgtactttagccttcatattggttattatatgaaggtagaactcagcagcagcaaatgactttactaatgtaatttctccaaggttctgcttagattcctttcttaaaatattatatggttattaattttatgacaacaggaaaaatgttatcaatactgatttcatttacttattttgttcttaacacttgttttaataaacacattactactggccctgattatttctaggacaacattaggatactcggtgtgagtttagagctggggtgagcttttagtgaattgtaactgtcgagcttatgatgcaacttcgacattatttacaagtggataagagtatttctgtgctttgtcaggaagtccatggcaggcttctggccgtcagtggtgacagtgcaacaggaagaagctggagtgtataacagttttgctagctgcacagccgagcatgcattatcgggttagcattgttccccattagatcttgggacatatgtaaatgacacagtcccgggtgtcatagtggagtcatgtcaagagcactgagcttttgttattagtcttacactttatttagaaattatgtgatttttttcagcaacttacatcattgaactaggacctcattttcttttctctgtaaaatgagaccacacacaaacacacacacacacatacttacatgggtgatcacaattatttagtaagtacttgaagtgggtgcttgaaaatcacaaatgaaaatctcaaatattttattgcatattctagagttagaatctataaaacaattcatttcattaagttttaaagcacacagctatattcagtgtatacaactatataccatcttatttggtaaattaagcaaaataaaattagtttaaaatgacagaacaaataaatgatttagattaacaatagtggaaaaacttcagatttagttattaattgataaattatagttattaagataagccattaagttttcttgacatccttgaactacacataattgaatgtagattcttttttaaattattaactgcaaatgtctgcccaaaaatggcacaagaaagcttggggcgtgtaagttatgggtagaatgcttacctggaagtttgggggtatgaatttgatgggggagggagtcatagaaaaaataagaattaatgtaaattgggctggtgagatggctcaacagatcaagtcccttgccatcaagcccaatgacctgagaacattcgtggaatacatggtggaacaagagaactgacttccagaagttgtcctctgacatttacatgtaactgtcacacatgtgcacatgaacacacagacaaataaataaaggtaatacaaaaacaagtctatttatctagagctgtaccacttgtagctgctactcacatgttgctgctaagcatttaaattgtgactagactatttttatataggctaagtataagacacacacactggttctcaaagagcacaaaagtaacattttattaattttaagtacatgttcaaataatatttttcatacatttgcttgaatatgatataattaaaatagctgatctaatcttcattgaaggttcctgggcaactgaactcttctttttattctttttttttaattaggtatttctttatatacatttccaatgctatcccaaaagtcccctatacaccccccgcccgccctgctcccctacccacccactcccacttcttggccctggcgttcccctgtactggggcatataaagtttgtaagaccaagggcctctcttcccagtgggtaagtgaactcttatgtgtaggctttttaaagtacagatactgagattgagattgctattccaaagctaaaccttgaaattgctccttcaatcatatttataaatatcaaacctagttgttacccattgtcaaatgagcttgctgcagaattacagcactaaatggcaccaaatttttataaactctaataagtggttgtaaaatgaataataaattttttcaggaaaatcgtattttaaacttattactgaagtagattctctagctttcccttatttaagagtactatttattagtaccgtgcagtggcactcacgatattattgctattggtcagcccaaacttcttaggaaattaatagtagttttaagtttgtatagtatgctgatttaatttaaatatgttactgacttgagctataaaattaagtatcattagtgcctcttttaaaaggaaatgagttgattaaatatagttacatagttaaatgtgaaggcactaaatatagaaatcgaggattgaaagtctctttcaaaaatttcctaaggaagagggagaagagaaggggggagggaggaaggtgaaggctgccagtgactaaccaagcagtcactccaagcagagatggccccactaagccacgttcctcacaggtgggtttcatggtagcatctgtaagcattcacacagtcatgccaaagtattaccatctgctttccagctcttccatccctgcctcatgagtcaccatgtaggcaaacagtagttttaccccactatgttatcatggacttaacagcactcaacaggtgcatgttctcttactcacactttcaaatggccatttgagtttccttcttctggactctaaagttaaaatgcatatacaatatattcatgcttttttgagatctttgatttaattttcattttgatacttgttttttaaaaggatggtttttatttgcactatttacttgatacttgaattatggaaaacaattgtgctttttttttttttttacattgctgtccctatcatctcaaatttattttcatattgtcagttttgtgctatcctgtcagcattttggctacaaaatgtcagattcaccgacatttatgtcacactgttattggaaagcaggggccccagaaattttgcctttgtttggagagtggtaggtattaaactaagagctttttcagcccttcgccatgcggagcgcagggcagcgtttggcagatctgtttctactaaaagctttcagtgtaacaaagctgtcatgtagcagagtgggaactgaagcatggtgtagttgcatgaaagggacaaaatggaaaagaaactgcagagtggaaaagagaccaggcttgattgtggcaaacactcaatgtgtttgcttcatgagtgtcagagcagagttaaaactgccttgcatcagaacagaaacgaaggagtcactaatgtgaaagggtgacctctgataaaacgagactctagagagaagataaaacgttttccctggagctgggaagcagaccattcttgagaagagagagccatacaggtatctgatgtcattaggctcagtctggccctccagcacacttgttaaagaccttcctcatggttagttagcagctccctacacaagccctgcaactgcttgaccctctcctcctgcagggccttcccaactggttttgaacataaaggcatttttcctcagcctcagtcttttccttttttttccccctttttcgaggtgaacacacacacacacacacacacacacacaccttttggcctcttcccccacatgctgtgttctacatgatcctctcccacatggctacttgttgtgatcttagcactgccctttgaaaccaattagtagactctgaaggtaccacatgacctctcaccattcccatttcgttgactaaaagcaagtcatttgtagaagtcggtacttggtatgcaggtggaagagacaaagacaggattcacaccatttctgactccagattctgtgcacttcttatcagtgcagggccactgaatgcctcaaacagtgttgccttcacaaccacagggagcaaataagcagaagttgctttggcccagccatttcttctactagtttttcttccttccagattctttatctgggatcacacccacatccataacactgcataatgtaaagcttgttgactttggagtcagggttcaaagctcactcctgtaatagctgtcgagctgtgtgatcttgaacaggtttccaatcctgagggagtttcctcatcagcaatgtacctacctcacagaatggttggaattttcagctcagtgagagaaatgataaattttaatctaacattaaacaatggtctcttgtataccaagttcagccctgacctgccacatccttccatagcctgggttccaagaccctgcctaggagtgatgagggaagaaaaacggacagatacaagaaaagatgggatcaagtggtctgtgttctaggatggagaagctgtagtactcccccaacccccaagctcagcataattataatctacagctgaatcaaagaggcagggcttatggtatacagctaaatcaagcaggcatgcttagcaatcataacagcaactgtgtctgaacagaaacagtcctcaagctgtaaacattgtgtggaggagagagaaagctactgtgtgcattttctgcatacactttcacatgcacacttgaaccaggagggaaagctttgccatttccttgagcctaagccaagagaagtgtttccatttcccacgggtctaaggcattggagtccttgccatgtatgcccttgtcaaccacacacattcactcgggacttcatttgctccctacatatccaccttctttatttcttagatgttcaacattcccacttggaccccaggaaggctttgccatccctctgagcctcacttggggaaggctgtgccactcccgtgggtctggaacttttgggtcctagacacagctgtgcacatgccaatagcacacgttcactcaggacttccctagttcctgacactgactgacctctccttggaactttaccagctcagaatgttcatggctttttctcagattccaacctttatatacctttattttctctatgtgcttgactttattaacattgtattattgatctttccgtttctcatggtacctattctgtactgccttcttttctttatgttgcctgtatgtgagtaggttttgtaaggttttatctgcaaccattactcttgatgacaggactaagtttgaattaataaacaaaaaaagagttcatgttgtctattgcattgtgcagtgtggacttggtactctcttgtctccccttctactttcagatataacaacaccacattgtattttatgcatcagcaaacaggtttagcactattagtagtggaagactttagttatatataaaacaagtgatgtccctgcccaacattaatgtgaggatgttgatattaattttgttttccaaataggattattttgttgttgttttgtagttgttattgttataagatattgtctcatgtagcccaggtttgccttaaactcaccatctaggtataggtagccttgaactcctgatcctcctacctccaccttccaagtgctaggattacaaagagatgctaccatgcccagctgcaaacagtactttcatcttatacatggtagtgctacctgcattatctgtttgttcttttaaagatcctgagttagtcaacatgttttgtagataatattttaaaattccccaggctagagctgtaatttaacaacagaccaaatatttataatacagaagaccctgaaatccttttccatcactgcaaaacctaatcagttgattcatcctaactttagctgtgggaacagtgcctttttgtgtaaaccatactatttcttattatattccacataaattctgtgaaatgtctctaagtgctatattttattcttatctggcttaaggaaaagtaagataaaggtaaaattcaaaacaataaattgagttacttatcagcagatcaaggagaagttatcaatttggaggctgaaacttgactggaagagtttgtgggaatatacatgcacttattttactttgggacaagctgattctgtgcacaaaggaatgagaacctttattagtaaaagcttcctcccatatctggatggaagctgacaaagatggaatgttgtattgccatagatgtgaaagggtgagaagataagcttagtttaaatgggggatttcatctttttagacagagaagtcttcatgttaccatagatcacatccatccattcattcatccttcactctaattgtctcttgttcctacctaatgaagtgtgctgtgtgtttgttttgcagatctaaagcgggaagccagtatctgtcatatgctgaagcatccacacattgtagagctgttggagacatatagctcagatgggatgctttacatggtttttgaattgtgagtggacattttatttctcgagtaaagttttaagtgatattggttgcagaaaatcttaacacctttttcttcaagtttagcaacagttgtggactcatctgattcaagagacctggagtcacaggtaaaaaacaaggactttctcatttaaggacaaatggcaaaggcaacaaaagctggccataccaagtacgcttacattgtcagtactcttcagagaagaggctctaaaatgacctagagtctcccaaaatcttgagtttggatcttagtgaagaagaggaagatgaaagtagaggattccacatagaaagtctctctggcaactcaaaatgtataataacacacataactttctctttttatgtaatcatattgccataaaaggaaacttctccactaacagtgtcttgatttcaatatgctacttcactttgacagtcacataagtttgtttaagatggagcagtgtgagccaagcacaactaaataatctatagatgcttggataaatgttcaaagagattatgtaaagctttatgggatatcattattcaatattttgtctttaatctctttctatttaaaattaacccatgactttgattaggaaaatagaaaaaggaagataaccagcttcactattcaagatatcaaaataagatgatgtattcatgtattcattgtctattgcttcataatacattactctaaactttagtgacttttaagcaatatccatgtattacctcactctctgagcatcaggaatgaagttcaacttagataagtcttctggctctagatcactcacaagatgctaagttaagggccagagcatcttaagactctactgagggtggatgtgcttccaatttcattcacatggctgctagcaatcatgtaatgagtgaggacctcagttcccaagagccattggccagaggcattcctttgtcccttgtcattggacctcttcataaattaggatggctactagctttgacagagcaagcaacaaaaatagacatcaaccttagaacctaattccaaaagttgcacaacatctcttctggcatattgtattatctagaaatgagtcattggatcaagctcacataccaagacctacatagcaagaagtgggaacctcagggaggcattttacaagttgcaccctatagaaggctcactaatactttacctatctatgtagaagtttgaatctaaagaactgaaacaaagaaactcaaattgaagaaaagttcagctacataagtgactttttactgggaaagatgtaaatgttttgattagttgtttgcaatagcttagaaatcctaaatagaatcttaggccacattaattagaaagtatatagaattcaaaacaaagccacactcccacccttacacactactttttcaccctggagtattcatggttagcaatacaccgcagtgtttatagaaaaggatcaccagaacaaaaacacgcggaaagtccattagggtagagtcaccgtcttctagcatgctagaattttgagctgggtctgctataagttgatatataaaaacttctattatggagctagagagatgacttagaggttaaaagcactggctgctcttggagaggacctgggttagattcctggcacccacgtggcagctcacaactatttgtaactccaattgcaagagatcccttgccctcttctggcctctgtaggcaccagacatgtatgtggtacatagacatatatacaagaaaaatacctatgtataaaataaaatctaaaataaaaattaaatcttttattgtaagaaaatttctttcaacactttgaatgttcttttagctatatttccttcacatttaaggaagtatgtactatgtgatctacctagcaaaggaaatcctatgtcatagagccagtcagacttgatttctgtcaaagaaaaaagtctaactttttttaaaataaaattaaaacattaatagacatcccaatgacattcgtctaagtgttgattttaaattctaaaatagtccaagctctcttatgaacacattatctagctatgaggtgcgagctcctttcattcctcagggctaggctttgcttctaggctacttctaggggctttgcattccctgactgtctgtgaagataggcagactttagaggataggggagagaacttgctcttttgagaaggcagactgtaaatccagaaatatgaaaggaaaagtaacaccatagaatttgttttcaggcagactaggttatggtaagggaggaaatggaaattaattgctttaaaacatcctagttctggagcccagcaggatggcttcactgggtaaaagctctggccgtgctgcccagttctgatgacctgagttaaatccccaccacataatagcctggcagctgtcaagcaagctagcctgaagtagagtatatcagaaacaagggagaccctgcctccacaaagtagaaagtgagaagcaactcttggaagttgtcctctgacttccacatgcatagtgtggtgctcaggataataataggtaatttttttaaaaaaaaaaatctagttcagatgtcccttggaaaggcttttgagtacttctagacatacttaaatcccaaatgaagtgctgtggcatggaagagctcttaaacacattgaagttgggctgaagagatggctcagaggttaagagcactggctactcttccagaggtcttgagttcagttctcagcaaccccacctacagtgtattcatataaatacaaataaatacaccttaaaaatatcattggaatcatagatgcccataaatgtattgattttcatattctaagatacctatatagggaaaacataatcagtatctgcagttatttgaaaaactgtgatctgtaagaatatgtgcttgttcactgtggcattagaggccaccactagaatcaacaagagacaaatttcacctttaagtaagaaaggttctctaatgataagatttagtccaggaatgaagccactgtcaatttttaaattcacattacatcccaattgcagccccctcccacctctcctccctgtcctgctcttacaaatccttcaccccatcaacccctcccttcacagggcacacacttgcctccttgcactcaaaaggatctgtagccatccaaaatggctgaaggtagagggccttactttgagactagagaggatctctaacttctcactcaattttaagatgattcttttaaaatcacttttctggtttaattttattcttccctcaagaactctgtttctatccatatttttattctgagggaactaaaagcagatttaatcatatatcttaaaatgacaagcaaagaaagcaacatgttaaaatttacctaaattttgatccccattctgcttgtatcagggccctaaaataacactagtagagagaagatggtctttgttgtcataaaatctaggatttgggcttcttagtattgatgcagtccttatgagatttttgtggctgattttatatactgttgtgattaaaacaatccaatgactgaagatgacatctcattaaagattaacatttatcaatagcctaatcctaatcttagcctaaattaatagaatgtagctattctctttttttcaccttctgttttgggaattttcaaatgaaagggagactaatataacgaaagtcagcactgagctctagcagttatgaaaacatttgtcattctctgttcaaactatcctttcctgttatcatttgccactgtagattgctacagcagtttcatttcaccagaaacactcctgttttaaatgataacactattatcatgcctaacaaaatcaccaataatttctcaatatcatatcttattaacttgacattcagtttttcctaattgaacatgaatcttaaatgacagctatctaaatttagaacttttttatgagctctagggatctgaaagtagattataaattcacagctaaattaacagtgatttcttcttaaaaggccagaaccaaaatagaaatatcaaactcttcttctctaccattattttataaatctatcttcacagctatctttgctcagtttctctacctcttgatcttttggattcaaaggatcaaaccagaaagaggttactctaaaactactctaaactgtgatcctatgtatggctcacagagcaatgctggtacacttgtgtatgcctccacctactggcccagaaagagaatgcatctacagctgcagtgtggattaagctattccagaatccggtccatatttctggcaatagatgtaagctcccctggcattcaagggctcattgctcaagttacgagggatctggatcatttgcacagttttataatgttacatcaatacataatagatagggaaagaggaaagaaatcaaattaggcccattgattttcttgtttcatggctttctggaagctcttatgaaggaaaaagctagactgaagaacatatttggattaccagcatgtttttatatttggtatccatatctgtcttttcctccgtctatgtgtgtccaatactccttctaatttgcactcatgaacttatatggcataattatgttgttggatattagaaaatcctaggaaatagttgatatatgcatgactagaaatagtgtgcttagaattgagaacaaaacacccatggaaggagttacagagacagagtttggagctgagacaaaaggatggaccatctagagactgccatacccagggatccatcccataatcagcctccaaatgctgacaccattgcatacactagcaagattttgctgaaaggacccagatagagctgtctcttgtgaggctatgccggggcctagcaaacacagaagtggatgctcacagtcagctattggatggagcacagggcccccaatggaggagctagagaaagtacccaaggagctaaagggatctgcaaccctataggtggaacaacaatatgaactaaccagtacaccccagagctcgtgtctctagctgcatatgtatcaaaagatggcctagtcggccatcactgggaagagaggcccattggacttgcaaactttatatgcctcagtgcaggggaacgccagggccaagaagtgggagtgggtgggtagggggttggggggagggtatgggggacttttgggatagcatttgaaatttgaaatgtatataaagaaaatatctaataaaaaaagaaaaaaaaagaaatagtgtgtaaatataaggcatacttaaatatagactcatagaaccagaattgtagaactggaaaggatttagagcagtagatttccaaacttagaatgcctagttcaagctggtcttagtggcacttacctttaatcccagaatttgagaggcagaggcaggtggatttctgagttggtggctagaatgagttccagaactccccaaagctacacaaaaaaactctatcttgggaaggaagaagggaggagggagggagacagaaaggcagaaaataaatcctgtgtagagtatcttaggcaagcatgtatctaggtcccatacctgagttcaatttgaacagatgcagtcttcatggcaccaggtgagagacgtgacctttaaagcaggagtaatgcttagagagtatattgttaatcccctagcactcacaggaagacagttgacaagtgtgtgtgctggcactatatccattgctttgggattattcttaaatatgaacctgtttgtagtgatttgccaaacttattttaaaatatagattcagatttgaagatagggctgagttgtgtttccccctccaaaaaaaatttaaatatttgtttctcagtagcacattcaggcttgtttttagtagtgtctggtacttgagttaagctgtaaatcctaaattggctggctaaggaattttaattaccttattatagtgtgattacatataccacagggagaattttacagtaattaaatatggattttaaacacgtctgacatgaaaacaatagtttttttatcttttaaaataacattctcagtttgtatttttgaagcttacaaaggagataataggctggaactgctctttttgactttaatttttttgtctgatatgaattcatggggaagagaatgtgtgtgaaattcattaactaagtggaactaattattacttaccagcgaagttgccacttaagcaaaaatgtctctgtctcctatcatacaatgaaaatctggactgtagcatcttaatttatttaaatgtatacatctcaaatagccttctctagtctgtttgatatttttatgtatgatgatgcagattactatttttgtgaagcacagtgacatttttcttgattcttggtcaaaatttttcatcgatttttttttgttgttgttgttgttgttctgaataccatttcagggtccccaagactactcttgggttgatgcttcacttaaaagattaaaaggatgcaatgttactgtatccatggatgatttattgcaacaaaaggaaatggtgcataagatccagggaacaagcttcccatggtcttttccagcaattcaattgtgacctgctgccaaccagagaatctcatttgagacgtaatgcccagagtctttattcaggggtggctgcataggtaccctatacctggcatgtacccagactccccaaacccaactagattttcagcataaacaaaactcctgtttgcagtttagatgcaggcagtcattcctttcagttagtgagataagaacttcctgaggttcaagccctcagatgcctgcctatcagggccaacattggaagtgggcatgtcagaactttcacaagatctgctatggtaatcctatgtaaactaaaacagagaaataggagatggattttttaattggttaactcgctccacaaaccaaatgtaattgcttatgaagataattataagctttgggtttggagttgtttttaacttttaagtgtaattatggtatcattttaacacgtagtagaaaaaaattaggtggccagatcactgaagcaaatcattagttgagattttataatgtagcagggattttaagcttctaagttatatttgaaaacaaagaatactctgatactattattagaaaaatacatttgaaattgtcgctctagtaatttttgttcagcatattaaatctgatcttcaatcaaataaaataattttaattaatgatatgccgataccataggattaattcagttgattttttttctggaatttaaaagtacaattaatcttaaaaaattataaataattttaagtatataaaattggtacaatatacctactttgtaccaattgacaaatggttaaaaattataatgtcacaaaaaaatgtcactcacaaaccttcatcagtggcgtgtttaggattatttttttctacttaatagccttatacatttttgtgacattgattttttgagaatagtgttttatgactgcagtaagatacctagaggtgcatataccacatttaatttgataatctccttattagaaatgatgctgtatttaatattctttttaatataatattttaatatattaatatttaatatattatatataaatatttaataagtgttcattattttattgttgtatatgtctgagtatttggcctgagtgtatatctgcataccatgtacatgtctggtacctatagaggccatcagatcccttaacagacagttgtgagatgctatttcagtgctgagactcatcccagtcctctagaagagcagccagtgctcttaactactaagccatctagagagagagagagagattgattcatccttgataattcaataacccactaagtacagtttgtgctgaccttatactcatgagtgtaaggccatccacaggagcatggtccacctaccaggggccacacctttaaagaaaattgactgtctctcgcccagcaggtgtcaactggcaataactgttactcagctaggggtaggtacttgtaagcctcttcctcctccatgctcgaatgaattctatacagatcatctgcgggcagccacaactgcttcagtcttgttatgtccagaagacaactgtttagctcaggttccccctgacctctaccttttacaatctctctgccctcccatccacaacagtaccagagccttgaaggtggggctctgaaataaatgtcccatttatgactgagcataccacagatacttgacaattaatattacaattacttaaacagaattactaggtaatcagaatatgactattaacaaacataatattcatagatttaagttaatacatataccatatttagaataatacatgcacataaatacagactagggaattattctaaaaggaacatccacatagctacaaccacatcaagaaataaaaataattgccaacatttctgtagccttaattctaagtctttgtgaccatagcccctttttctgtacgacagctttaatatgcatgtcatttttatgcttatccagctgtctcatccaaataagcagcatgcataatgtaattcactgccccttgtttttctatgaagtcacacagtgtatattttagatctataagactcatccaagttgctttgtgcatctattccttttcatcactatacagcaagcattgcaatgaacagactttcagtatttattcattttaaagttaatgaatatcagggaaagccctagctttccttgaactgccgtcatttcagcatgttgttggtcattactaatagcgccttctccttacactcattatctatcctgtactgtatagccctcctgatacttagtgatgccagatttttttttttaattttgctaattgggatgaagtttttcctcattgccctttctgattgccacttgtaatcctctatcttcattcttttagttttgttttgtttaataaaagagactttggtagttttaatctaatgtaatcgtcacttgttttgctttttgttagcatttttgtgtctgaagaatcatttaccaagcctgagaaaatggatattttctcttgtattttatcatccatctggaattgatttgagatacactgtaaaatagcagtccaatttcatgtctttccatacggagattcaattgtcccagcagttattaaaaaacctgctctgtggtatagcctttaccataaatcaaacaccatatatgaatgattgtttccaggcacagttcgagcccattggcttgcttgcatgcctggcattgtgccaagactctgttgtcttatgagttctggaaccttgtagagtcagtccttccagctacattcctttacaggcatgcttggaggacatacttggctctgaattctctaaaaatgttttagaatatggccatgagtttccaccaaaaaaaaaaaaaaaaatagaactattggcagttttgacattaatgtttatatttaatctttataacaatttgagaataattgacctgcttgcagtattaatattgaatcttctaattcgttaacgtcatatgtagcttcccatttagctctttgacttctttcaatgaatttgtatgctttctttataaagactgtgtacatctatattagatgtggctttgatcaatacatgttagataatgataacagcttcgttaagtaagttttattagtttggttcttaggtactagctatccatttccattcatcaggctttaattctggtaattagtacagtcatttggattttctgaatacatgatcgtattgtttgcgtatgatgatgtttcattccatacaagttcttttttaaattacattcattcatttattcattcattcgtttgtttgtttgtttgtttgtttgtttgttgcgagcacatggaagtcagtggacaacttatggtagttggttctcctcactatatgggtttcagggattgacctcagctagtcaggcttctgagcaattgcctttactcactgagccatcttgccagcccataattctgttgtgtttctttttcattttattgcctttattgtgatagataaagcatctagaaaataacattgtgtataataagtgtgaataggaagtgaatttcatcaaatgctttttttctgcgtgtcttgaaatggtcagatgctagcagcctttaatctattgatgccctgaattgcgttgattcttgtgttgacccaattaaattgttatgtataaataagctttataatccttcttatatgtgctggattttgtttacatttatgcttatgggataattttgttataattttcttgttctatccataccatgttttcatatctagattacattataaaatagttgaagctcctttctttatctgggttttcttttccttccttatatagttcataaaactcacataaacaaaagtttcttataagaagcgtttctgtttctggtttaattctttaaatgtttgcagaaatattaagaagttctggccattagtatgccatgtttaccaattgcattttactagggaaaagggtcaattttatgtggattctaaacagttttggcataaacctgttctttgggctctgcagccgtaacttttctatttagtttgtgtgtttgtgtgtttgtgtgtgtgtgtgtgtgtgtgtgtgtgtgtgtgagagagagagagagagagagagagagagagagagagatttggaggagttgattctctcactgtctggctcctgggggttaaactcaggttatcagggttggcagcaaatactttagccttcttgcctctctacttcatacctcttgatttacatgtgtcatcttcttgtgtgctttcttttcttcttgtggttgtttgttttatttgaattacatttatttttattatcttttatttttgaggttataaatacattgtactctacttgcagtacccgttagcatttttctttccctttattttatttagatcaatttaaaatcttttgtcattatagcttccttttatcttttttaaggtttatttattttatgtataaataaaatacataagacagtttcagctgtcttcagacacaccagaagaatgcaccagatcccataatagatggttgtgagctttttcttaattagggagtttaaatgctacttactgagtagcccagaaattccaatatacttcctaacctagtacattcaaatatttataagcaattatagtcctgaaaagtacaaattctgtagaatgcattaattccattgaatatcacctttgacttatatcccatgttttatttaacgattttttattaataaattatgaggtacatatattcatatcatttccagcttcttttatttaacttagtcatttagatttaccccacacttacctatctttgttctttattctttgagcatagctatgattttatcttagtttgttccccttgtgtcagtctcctcagtacaaacttctatttttgttagtttcctttttttcttgcagtccctttagtttgaaggctgtccactgtatggagaggtctagattggcctattagacatcattcactcttttccagcttccattgatgttgaaattttagctagcaatctgacatttatctaaaagtagtagtattatttttcaagctattaaatttttccttcatctttggctttctaaagttttctctgtgctatatctcaagaattgtgtctgtgtattttaaccttgacgtgagttctgtaagtgtctgaaatcagtgtgttgatattatttgtagttatggaaacttctctgccattatctcttcaaatacttcctttgtccctttcatttttggaacccatttaaatatatttaagagataataagccttataatattctatgtgtagactacattctttcttggaatttgcatccttatctcttgccttttctgacctgtcttccaggtctgtttttctcttcagcattgctaaattgctgtcagtctgctttctagatttttaattacactttttagtttatagtttcatagtttctacttatttttaaatatttactgcattacatttgtcatttttttacaaaatttttgcaaaaaattaaagatggagttttatattcagtaaagatagtaagcttcattacttaataatcttgtgttcaagaactccacttgattttgtttttaatctgttctctattctggctctttgtcaagctctctgattccatcgagtgcccaattcgttttgactttctgctagatatcatgttgacacttactcgcctaagaatgatgctttcttcctcaagggaggattttttttgccccttctgctagttaccatcaggctctagcaacttgaaactgtcaaagtctaagacttagacttttggggatacctagatattgagtcagggatcagatctggtgattggctaattacttacaacacacagcaagatctctatgtaggctcacattactttccataaatatttacgtttgtatccacattaatgagagatgagcagatccgtatttaccttgtgcgtgtgtacggtagtatgaatggaggccagaggtcgatgtccaatgtcttgcataggtgctctctactatatttttgagacaaggagttttaatgtcactcgagcctgctgattgggtagactagctggcatataaaccccagggatttgcctatctctgtccagtcagttctagtattgtaggcacataccactgtgcctgggttttaagtagatgctgggaaaagaaactcaggtccaaatttgacaagtactttatgaacagctcccttgtgcacattttgatgtcaagtgatgttatgggttaattgccatttattttgccattagtgctataaaatgcttttaaagcatgtttactagtttctcttccattcagtttctttagggtttttgggagtttttttgggttttggttttttgtttgtttgtttgttgtttgtttgtttgttttagttttttgccaatttaaagaattcctaattggttttgtttttatttttttattaaatttacttgttttatatgtagatgttttttcttcatgtgtgtatgttgtcacatgcatgtttgatgcttttagagatcaaaagacatcagatcccacagaactggagttactggtgtttgtgagataacatgtgggtgctgggaattgaacctgggtcctctgcaagagcaacaggtgctcctaaccaaggagccatcgttccaaacctaaagaattatttcttttctaagcatgcttgcctttttcgtgtatttgcaaatgtttctccaaaaagtgcttgtttaattttgtttatagtgtttgattattttacttgttgatttaaaagaagaagaagatgagctaggatctgaaagattaccgggtggccaaacctagagcagttggaacagccaactaaagtaatattggattataacaccaagtgtaccagaatatgtgactacacatagcttacaaaggacaatgaaggaaagaagcagagctctcaggaatgctgagcactctgtaagcacactccccctcttcacatgagcaccctccaatatgtgataagaaaggcatttcacctctgatacacttctctccacccctaaaacaataaaggaacataatccttacatacagaagacaaaacgatcggacagtacccaagttgaggaacattataaaatccttcaccagggttttaaaattatctatgaaaaaaaataaggaactgtcacccaagatgtaaattctgaggaaaattgatgaggtatgcacaatttctcatatttgcaacttatatataaatataaaataaaaccttatgtttcatggtgctccttgaagaaattgtcacttaatttctgtgcttccacagcactgtgtgcatggcacttggcaccataatttttttaaagttgtctttagttaaacctaaaaataaaataaaaccacgagtttacgctattagaagctaagattttcttttttctttttttaaaaaagatttatttattttatatatctgaatacactgtcacagtctttagacacaccagaggagggcatcagatcccattataaggtggttgtgagccaccatgtggttgctgggaattgaactcaggacctctggaagagcagtcagtgctcttaactgctgagccatctctcccacctagaagttaagattttcaatcattagataatacacttattatataataaggttattagacaacaagttattagttctttttattttttaaagatttgttttatatatgtgaatacactgtagctgtcttcagacacaccagaagagggcatcagatcccattacagatggttgtgagccaccatgtggttgctgggaattgaactcaggacctctggaagagcagccagtgctcttaaccgctgagccatctctccagccccaagttattagttctaatatgtaattttgctgctgtgattattttaccaaatgagttctttctgtctggaaataaatagtgaaatatttatatattatattttactgatatccgagatttgtctcagaatcaaccaagtagcagtccaagtcatctctgtctaatatgatctgattaatcattatcttggcctctcaaattagaccattcaaaaatgctggtcccaagaaggaactgctgttgtttagatactcctactatagaaacccaccctgatcttaaattttaagatattcaccaacaatacctgttgttcctgtaatccaaggttacattaaagaaaacctcaagagacttatgaagtagggaaaataatgaggtcagtgactgggccccccttcaagacctttgggaatggggctatagatgggccccatctcaagactataggtaaaacaaaatttggtagtgtgctacattttttacagaagggttcatatttttaatatttgaaattttctgtagttatgttttttagtaaatgaaattacacaatgttttaacttttacattatcttatccctaaatcatatctctaaagcatttttggttctttaccacattaacacacttatttgcttcatctcactagtttagctatatagcataagtgtaagtgtgaaaagcaggcttgtctttcattgcatttagtttctcctttgcttatatacttactcaggtacaaaatcaaaaggctaagttctaaagtaatttgaaatagctcccctttctggttataccacagactgatgtggatcaattagatttatttgggattttgtttgttgcatcactgcagtgttttgagacaatgtcttactacatagttctggttgtcctggaagtctgtatgttggccaggctggcctcatactcatacagatctgcccgactcctacgtgctgagatttaggacatgtgtccccacacccacccagttgtttagttaaaaattttattgacataatatgtagtttcacatgtagctgtaaaaagtaaggtagatggctaaaattctgcaaaagttgtataatgttacagcaagactactgataattgatacaatctaggaatcttatttagatgtctgtatccatttgtttgtaattaaagggattatctctttttttttctgttgtttttagtttattaaaatgtttacacggctacacagtcaaatttaggattagggcttcagaaagatttagttttcatcccatcagccccttacttccttgccctcatggaaactttttaagatttattttgtttttctgttatgtttaatatgtgtatacatatatatgaaaataactgttttctagtccacccctacacgttgtcgcatactttcttccatctaaaccttgagttttgtatttttaagaatgtggaaagcagctgggcgtggtggcgcacgcctttgatcccagcactcgggaggcagaggcaggcggatttctgagttcgaggccagcctggtctacaaagtgagttccaggacagccagggctatacagagaaaccctgtctcgaaaaaccaaataaaataaaataaaataaaataaaaaataaaaaagaacgtggaaagcactgaaggattccatagtagtagctagacattttccttcctatttatatctgcttagctgcttagtaccccatttataatacaaactagtcatcaaacatttcctctgttggtagatatttggattgtttccaattttattctattatataaataacattatgcaggcttcatttcatactgctgcaaatgtcaaatattaacctactagcattctatgaaaatgtaagctttgattttacattgtgatgaaagtcctgagctgaacctcagtcatattagctcatttccctcattataaaacagttgtacttatgtgtatatatctggagaaggatggttatagataaattattatgtattttattgaccttatccatatctgtgggattgactaacatgttgttaattacagtgggtttcttatcaccatatgattgctgaatccaagaaaaatgtaatgcttgccgttggatactttaaatgttcacagtatcattggatcttagtaaaagtatgtgtgtgcgtgcttgcatgtacacacacacacacacacacacatgcacacacacacacatgcacacacacagccaaactctttaaaagtactgcttgtcctgagtctcaagcataccattcgggcaacaagagaatgaatcacaagatcttgatgggtcttttaatgtatagcaaggagtcaggattttattctaaagatgtgattctatcacaaggtgtttattctcaaacagtcatttaatgatttgtttgtctgttttattaattaagttatttatttactttacatgtcattttaaaaagactttttaaaaaacaatgtgtcatgaggaacgtatttggatttagggagaattatgaaataatccaagtagttaagtatgtatattacaatgataatcaaggtagatgaatgtcaacagacagcaaaagaagcaaatacagtttaaaagtacttagaaattagaaaaagcagggcttgatgattggataaaggtagttaggaatgaggaggaaccaaagttgagtctccatccctgacttgagcacttgatatgagataacgcctttgaatagcttaggcagtcctagaagtaagtgataaaatacaatttgaatatgttgacctgtctatgagacacccaaatggcagtgctaaccacatggattaggaaggtagagatcttgggtagaaacagatttacaagtggccattatagaagcaataatactgagacttggaaggatgggtaaccaggagtttgctgggtggtagcagcagggatgaagtctacaaacttaagcaaaattataaaaatatggcaatctcatgaaatttggagaagatacacagaatgaggctaggtctgatgcatattggggacagggaagatcacagaatccaaagttaatactcccttctgggaagtggagaggggcatctttctattaactttgctttagaaagatcaaccttgcctgtttacataaaagggcttgtacttgcctctcaagcaggttccctagtttccagctctcatgatcttgaatcataaatacctttaagtatctctttagattccaaatacagagagaaaatactaatagctttatatgattgtctcacgtcccacctcttttttctttcctaccatgtagtgccctaagctatgtacctggcctactatggatagactgctttgaatccagaatattttctttgttaatccagagcaaatcaaagcccactgttgtttccatagtgggatggatggataaatttaatagactgtgggtggcagattgatcacatttgtgggaaaggagataagcattacagccaggatagcaaacatgcagaatggccagaaatgtgaggcagggtatgtgcctgaggcatttctaataatgctaggtcttgctttgaagtaaaatataagatgagagcatgactggtgataagtttgaacatgtaataataaaaccatcagtaatgtgtacattacttcatgctgcactttctattttattgccttttaaggcttcttaataattgactaactttaacggcagtgtccattttgtagttaaaaacaacctgaaacataaagttgcagcttgctcaagtttacaacactatgtgctgcagccagacttctaatttaagcagtttgattgtagggttccactcagaattactctgctaagtctatgtcttttgattccatattactaaggtctttaacccatatattcatcaagtacttatagaatgcatgcagtgtaccaggcactgttctaagtgctacagatttagcagtgagccagtctaagttcataaacacatggacttagtattctagtggaagagactaataggtatatattactaaaaataagtactgaatgtgccattacaagggacaccaggtgagaaatagggaatgctgagcgttagagagtactgcttcagataggacattcatgaaagccctgtctcaggaagctacctttaatcagatgtaaagctccactgcagaggtgatagagcacattagaataattttaccaaagtaataatataaccagatttatacatgagagagagagagagagagacctctaaattcagtatgaaaatcagtagtagacacttgaaacaagtcagtgagtaaccccgtgcaaaatacaatttggagctcagcttcttcactgagagggccgaaaagctcatgcaggggagaggaaaccagagtcaagcccatgaatgaagttaagacaggtggcgatcctgagcctgctctaatggctgagaaagactctgaccatcagatgtgaaggagtaattcaaagggtcagaaggagaaaacaaaatctctgcttagtattcaaattaaaacattaaaagttccatggcaaagccaacatcataaaactctctgcatggaaaatgtgaatatatatatattagaaaaaggaattctgaagtcttcaaacatttgagctcaagaaaataaagataatataaaaggggactttgaaggaataacaaccacagaacaagaggctgttctatttggtaaatgttgaaaaagccttaggagtgtgtgtggtatgtgtgcacacatgtgtgcgtctgtctctgtctttggaactcaatatgagccagttgaaaggtagcattgaataaccaatagagaacaaagaacagttagctagaaatcttaaattaagtataaaagagaaactgagaaccatgaaggccaattggagaatatctgacatgctttaggaacagtaattctgtaaggagagcatagaggaatgatgaaagggaaagaaaggccttattaaaggaacaatagccaaaaatggtcccaacttaaagaaacactagctttacagaataaactttgggaatagatattacttgtagacttgggtcttttgcatttgcgctgattatagaacacagagctctatattattgtatattatatataatttattattttattctatattattacatatataatattatacatactgttgtccattacaagccaccttatgagcctgtctcccatcacaggtagaatatataggagtcactcactaccattgacacagggtatcttctatacattggcacctcagtttctactttgcctggtcataaaatgaagtgaaatagatgagtagtccaatcagtgagctaaatattgtcttcattgtcatagtcataaatgctatttagtatagagccacaggattagagattaagatctcagaatcccagagcccattgcttacattcaatttcttactgtactactttgtagctatgtgaccttgaacaagttacataacatttgtatgtacacatggtgggactcatggctctagctgcgtatgtagcagaggatggcttagtcagtcatcagtgggaggagaggcccttggtcctgtgaaggttctatgccccagtatagggaatgccaggaccaggaatgggagtgagtgggttggggagcaggggaaggtggggggaagggataggggaacatttgaaacatttgaaatgtaaataaatgtaaacaaagaaaatatctaataaaaattttttttaaattttaaaaagcttcaatttgttcacctgcaaaataatatctgtctctagtatgtttatggggattaaattaatacttacaaacgatttaaaatggtgcttgccatgtagttaaatgctcagtaaatctttggtattagctattaacatagctgcttttaacaggaacatatagtattttaatcctgaaggagtaactaatataaaaatcatagtatataaggataataaacttaggtttctgcgtgttcctgtaatacacaaaggatcagtttagttaactgctggattttatttgtccatgtaaacagttttgtcactgtttgaaaattggccttgatactatttgaacattcaagggttcatattttttctttataatgtctgaaatctgaaactttgaaataatttacaagcatataaaatgtcctcctcaggaaaaagcagtggttgttttgttcttgcttaattaagacagttaagttttaagcacataccaatgtttgcacctgtttttgtttatatttgtatacctataggtttataactaccagccattaacatttcattttagctaggaaatgcctagaagtaagaattaaaccagctggtttgattttaatatgcaaattacagtcaaacaaaaacagaaaaccaataattaactgcatgattattttgtaatctttgttacatttgttcaaggtgagatcattttccaaattggcctactctcctcatctgcaggggcacatcaaagcctagcatgattgttttcagtcctttaaatgtttataaaacagattgacagaagacatcccaaaagtagaaactgtcagagaaaggtgctaaatccttaattctacaaatactgtgaggaacctgtgtgctttccattactttttctatccaggagctttgtgtttagtgttggcaataccaagagggaaaccctatttctatggttaaacgggcaagaggatttatagatatttaatattacacacatgtactcacctacaaaagctgtaagaattgaggggtctggggagatagtgtctgctttaaacataatgtgaaaaagtcggtgcggttgcacatatctgtaagcagaggtggggacaagtggatctttttaactctctggccagccagtgtagctgaatctatgagctccagattgaatgcagaccctgtctcaaaaaacaaggtagaaagacatcaggaaaaagacattgaacattgttctctggcctccatacatgtgcacgcagtctctctgtctctctctctctctctttctctctctctctctctctctctctctctctctcttgaatggcagaccgtgtctcacacacgtacgcatgtatgcatgttctcacttccacatgaacacagactttagatgagattggaagcaatcaggtgcattgattgtgatcagtttgatgtggcaggggtttttcccaagctctcacaagggtgtgcaggactagaacggactccttaagaaatttgaaatccgtttaaactagatgagctagtatacacaatggatgaagaattgtgtgttacagtatttatgcaattttatcttagaaataatgatggtaaaaaaaaatagaggctttctagaaaggagagactaaaagaccttggactttagacactgttgtgtgcatgtgtaagtgttctggttaaaatctaaagatagattggaaataatggtagcttggaaacttgacttacctagtgagttccaggcccgcctggacttgtgagaccttgtctcaaaaacaagttctttggttgactatttgtcattgatacctagaggttggggacataggtattcaactgtggggattagtgagatcactaagtgaacagccaagttactatgtatgtatgaacaggactgtagctcccgtctgtcttactttttgactaggaagttcgcagaactttagagaggtatgggaacagctaatacttcggaggtctgctgctaatattttaagatgctctacagtcccttgaaagaattttgaatttggcttggtttttgttttttatccactaggaggcaccattatcaaacagttctaatgaggcgatgtgaggaatacaagaattccaagtctctttaaaactctgtttgcaatttgtcaaggcatgtagaacttagtgtctgtctctctctctctctctgtctctctctgtctctctctgtctctgtctctctctctctctttctctctgtctctctctctctccagtgttgccctatgtggcctttgtctcttgagttccagatttggagttgtataccaccacactcagccttgtagaatatgtttagcaatttgtaagtttaatggatgtgttcaatatccccagtccaaaaaaatccaaaataccccaaaatcataaaattttttgagtggcaaagtggcaaaggcaaagtaaaagcataggtggaaaaatgtacaccttatcatgtaatagatgacagtaagatgtaaatattacatgtaactatttagaaaactgccttcagtttatatatatgtgtgtgtatatatatatgtgtgtgtgtgtgtgtatatatatatattccatccttttaatataacacataaataaatgtatgtcctcccctgtttcccttcagacagggatgccagttgaacatgacataacaagttaaaataagactaggaacaaaccttcatattacggctggacaaagcaacccagtaaaaggagaaaatggttcccaaagcaggcaagagtcagagacagccctgactcccactgttaagacttccataagaacaccaagctacacaaccataacataaattcacaggacataacataaattcagacacatgtaggtttcctgatagctgcttcagtctctgtgacctcctatgaatcttagttacgtctgtggaccatgatcttgtgatgtccttgacccttctggctcctacaatccttcctctccttcttttgaagctctgcctaatgtttagctgtgggtctctctgatgacaattatgctaggctccctgtacaagtatagcagaatatcattaagaatccgttttattggctctttgttttttgtttgtttgtgccagccatgtttggatctgccctagttctctggtgtctgctcctccaggcagggtcaggcatgggctccctctcgtggcacgggctaggagtcttcactagggtcatcctcttcgattctagggaggttctattgccttacatgtctacattaccccctaaagtgccccccaatttaagtcatctctcagtactttctccctccactcctgacctgatccctcatattcccaaccccagttcatcctcgaaatcgattctatttccccttcccagagagagccatgcgttcgcccttgagccttccttgttacttaacctctgcaaatctgggttgtagcatggtcatcctttgctttacagctaatatgtacttatgagtgagtgcataccatgtttgtctttctgagtcagggttacctcaatcaggatgattttcttttctagttccatccttttgccggcgaattttatgatgttatttttttaacagctgagttgtgtaaataaaccacattttctttttccattatttgtttgcaggatgtttctgactatggtgtgtcctctcagtatatacccaggagtagtagatcaatccccaattttctttttttcttttggttttttttttttgttgtttgtttgtttggttggttggtttttttgtttgttttttttttgttttgttttgttttgtttttttgttttgttttgtttttttgagacagggtttctctatagccctggctgtcctggaactcactctgtaggccaggctggcctcgaactcagaaatctgcctgcctctgcctcctgattgctgggattaaaggcatgtgccaccacggccaattttctgagaaatggctgtctgtattgctttccaaagtggctgtacacgttttcacccccagccgcaatggtggagtgttcccctttgctccgcagcagcaggagctgccacttgtgcttttaacataagccattctggcagatgcaagatggaatctcaaagtcgttttgatttgtatttccttgaatggctaaagatgttgagcatttcgatttaaaatgggatgaggaactgtgggaaggcgaactgggatgggggtaaatgactggactataaaaaataaaacaaaatcttaagaaaaaccatctatccagctgttttgtaagggctactgtagtactgtcctgaaggagtcttttcacatttttaaatgattagacctgatttcatgtgataaatgcctgtttgtttatgaaaaaggaaaataaagcaaagtgtttcaaaaaccatcttatttatcaactgtttaatactcttactatccagcaacttctgcatctctgcaaacagatatagatatctgttgctgtgtcttcttaaattatgaacatctctttatgtcaataaatatatagcatcatttaatattctccactatgagtttgccacaattcatatgcacactcttctattactgacatttaagttgcttccaacttcctattataaataattataataaacccttagcattaaaactgggagatagccctaatttttcctttagaataaaattcaataagtcccaagcaacatgtgtatattttaaagcatttgacaagcactataaagttgtccttcagaaaggttatattgattattgatgtgtttttccatgaacaatgagtttgataactaaagaaaagtttccccaatgccaagttgtatatatgtgtatgtgtctgagtgtctatgtgtgtgtatgtgtgtctttgtatgtctgttacatggattgccatcttcttacactggaagattaaactatgtcccagcatattcaaatgtagttctacaatatactatgtataccaggttggcctatgactaggggcaatctatctgcatctgcttcttgaattttggaattaaaggtgtatactaccacacccatgttgatccctcaattttatacaagttttgacacttatttttttatttttaatgttagaaatattttctaattatcattgtgagttttttcttgattgataagttactgagtatacattcttcaattaacaagttttagaaagactttgttaatgcttcattaatttacatctaacacaatttatgatcaggaaacataccctgaatgcttgcttttgctgaaatttctaggtttatctttatgtacataattaataataataagcttttagtggtttcctgtgctacaagcatgttacacaagaaagtactctatacccagttttcaaaatgcagctgtttcgtgctaacaaggggtatttcttcaggacctttggcagactcttcagacatctaccaagcaagagttcagtctctcctcttagatctccctggtggaaaagcatcaggactgtgccatttcatagttccacaatagtgtcctcccacagctgcctcctttgtatagctcgctgtctgcatgcctcctcccccaccaaggcagaagcagctcttcttgttctctcttgtctttgagctctcatcatccatcccctgttctcaagagattgtttcccactctctgtgctgcttgttctttgaaaatgtaaactattatttttctaatttctaataggttgtatagttgttttgttatctttagaaaaaatgctggtcagagaaatttgtctgtcctttataacagtgttcctcaaagaatcatttgcatacaaatgccaatataccatctgttacatgttggtctgctgtgagatagatacagaaactgagtgtagacatgtagaaaattgctgttgcaatttgacattatgacagaatcatgatatatgatgctgtgctttcagctcagagtcatccttaggccagattggcagaattgggtgtggcatattctcatccctttcaacatgcacacaatcagaccttgtagtttcatacctataacctattttgtttgtttaatacatgtattttggctcatttttctaattcttgattcataaaggatttctactccctcacacttcactttctcagagtagagacaactaagagaataggagaatacaagatgtgctttttgaagattcctgacaactgaataaacacccaaagatggaaaaccaaagagaagagcagcaaattaggccttctcactgttttttacaagtattgaattttcaaatgatctatcgagggacataaatcaattttgtgtaaaatgttcaaggttattatataaggattgtatatatcatgaatatgtataaattaaatttttgttgaatgaaatttgcataaataacaatagttttagtttttaattctgtacctaataaaatttaaaattagtgcattgcttttagttaataccaattaatgttataaataatcaaatggctttaacagtagaaaggtactttcatggtcattattctttcagagtaatccttcctaaaacatgctacatattttaaaagttacacctgtggttttttcagtgctcctggttataaatccctgaatttaaaaagatagaatgttcaacatacctcatttttaataagtaaaacaccagagctagggatggagtttggtagtagagtgcttgcctagcatgtgtaaggccttgggttctctcctcagcactacagtcaaaaagaaaggaaggaaggaaggaaggaaggaaggaaggaaggaaggaaggaagaaaaaggtaactatttatatagagatataatacctatgcataaaactgaatcagtctttggaatcagtatagaaaaaacttaaaactgtaatttagagatgtgaaaagaagtaaaagatacgtcattcagagatttaaaaatattagaaaatattaaattctagaagttaatatataactaattccatcttagctaaaatataaagatactttacattacacaaaattgttttaatgttcaactggagtaaaatgttcttaatgatactatgaaattttttatttttaagttattttatttatttatattctagttgttactcccctcagtcccccctcccacagttcttcaatccattcctccttccctttgcctctgaaagggtgctccccactatcagaagccttccctttccctggggcctcaagtctcttgataattaagtatatcttctcccactgaggcctgaccaggcagacctttgctatatatgtgctaggggcctcagaccagcctgtgtgtgctcctggttgatggcttagtctctgggagctccctgagggcctgggttagctgagtcttctgatcttcctttagggctgctttccccttcagcttcttcaatccttccccttattcaaccataggggtccccgacttcagtctaatggttggatgtaagtgcctctgtctcattcagctgctggtagggcctctcagaggacagccatgctaggctcctgtctgtaaacacatcattgagtcagtaatagtgtcaggccttggtgtcccaccatgagatggatcacaagttgggctggtcactggaccacttttccttcagtttcttctccatttttgtccctgcaattttttaaaattaggtatttatttcatttacatttccaatgctatcccaaaagtcccccacacgctcccccacccactcccccaaccacccactcccactgcaattcttttagacaggaacaattctgggtcaggaattttgactattggttggtaaccctgtccctccacttgaggcccttttatctactggaggtggactcttccagttacttctccccaatgttgagcattttatctaaggtcccctccctttgagtcctgagagtctctaatttccctggtacattctagaagattccctaacccccatgccctgaggctgcttacttcccttcattctcttgtccctctggatttccctcctgtcccccaccccatatctgatcctgttcccccttacccctctccttctactctcccacccaggttcctctctccctctgcctctcatgattattttcttcccccttctaagtggggttgaagaattctcacttgagccttctgcttgataaactttttacagtctgtgagttgtactctgtaattttaggctgatatccatctatcagtgagtacatacatgcatgtccttttgggtctgggttacctcacttaggatgatattttctagttccatccacttgcctacaaaattcatgttgtctttgtttttcatagctgaatagtattccattgtgtaaatgaacctcattttctgtattcattcttcagttgagggacatcagggttgcttccagttaccggctaatacgaataaggctgccatgaacatggtggagtgcgtgtccttgtggtacaatggggcatcttttggttatatgcctaggagttatggtgtagctgtgtcttcaggtagaaaattgtataatactagatacaagaatagaccagtcagtggaagggagcagaaaccaaaggggggaagtatctatatgctgtatgagcatgtgtacagattgccattggagatactagtatttcagatatgtccagaaagaaacagatttatccgttccaataactatagttatgtcagaacatggtcccctacttacactttgaccttgttattactttgccatatcccctccaccatctcctttcccctctcttgccctggatccatctcataagttttcctttagatctcaagacagattcaaatttttattactgtattatgcaacctatttggctttctcctccacccaattttttgagtagtacttatccttaaatttcagtaaaaagggaaaatacctaaatagaagaaatccctcactatgagatttttatttttattttttagtcctcatacatcaacctacttaaaactgtagccagttttaaaagtagcattttcattccaccataaaaagaaataaagagaatactcagcttttctagtaatcaaggaaatataaattaaagcaagcataaatgactcttttcctcctttctggcaaagatgaaaagaggagtcattgtgagggcacgggagaggaaagggcacattcacacacagcaacgtcagtacgattggtaagatgtgtctggcaatatggattgcaaaagcattattgcaagtaacttgacctagaaacttccactccagaatgctcctctagcacatgatcagaattgttcacacaccatgtgagccttgaatacatcggggaattaaaaaaaaaaaaactcaacagtattttcataatgaacattttgaagaatttgatttcacactgaaaaaatgtccaagaagtatggcatgtaaaagccttatataaatatggaaatgcttcatttgcataaagccacactgagaaccaaatgatacaggtaaaagttctgtgtgctaggcattctgcagagtattgaattagactgtgttgaaagtataaactgatttttaggactttatactcttgggttgttataggatgtgatggtgtacacgtgctctttgcataccatatatttatatatgtgtaatccttcgggaaagcaataaacacaaccagatagatttaaagcagtggacacagccaggtagatttgagtccccatcactttatgcaataactagatttacttgagaatcaaaaatgttgactttatggagtgcttagctgtaagtatgaaaagagacctgacagactgcttctcatggaatctcataatatcatgtgtaggtcccttgaatttgcattttgggagtttttgtgttacctgcaataattatttgaaaactaacctaagtgaatttcaaaatatcttataagccttaaagcattatgaaaatgtttactgctaatatttgaatgaaattttaatgaaagtaatcttatatgactgtcatatatctgcatatttgtgtgtgcttaggttgcataaagcctaaatgttacaatgcaaactgtagcttgttagcagttaaaaactgttaaggactgagggagttttctttatagatgggaatggaagggaattttgaattaatgcaggcttaaatatgaaacgtggtatatacagaagcatatgcctggtaaagataaagaaaatggcacattaagaaagtactaacagaaaggaggcccgctcttttctgaaaaggaaatggagggggagtggacctacagagatggtaggggcagagtggctaggaggagtggagggagggagtggaaacttgttgggatgtattgtatgaaagaagaatctattttcaataaaaaataaagaaagcaataagatcagtctatgtacagtttgattttcttaaaaatgtcattggatagattaggtcaaagtgatctgacctgccagataagaaattagaaataacttacattctatggcaatgtagtaacaggttattaccaacacattagtgtaagaatatgtctgcagtaattggaaggtaaaataaataaattctgtgctggcttatttttttttcctttcatagcatgtaacttaaatttcccacttattggtaataactgttgcaaaatattataaaaagctttgtattcttaaaatacattatttgacgtggagaatttggagatttaattcaaagcttatccccttcacctttagagttgctcccacgtgagacttattactgtgttttttgtgttacttggtacgtccgttggcttatctctcttaaagattcctttttctgtaaatattcaacagctggtttacactgaaagaagggagctttaaataatgtagtcagtagtcagctcccaacaatggtatgttcacttgaagtattgtcttggaaggttttctttgctaatattctttttcacatttctctacagtatggatggagcagatctgtgttttgaaatcgtaaagcgagctgatgctggttttgtatacagtgaagctgtagccaggtatgtaactgcatctaatccccagaagtaaagtgggaagtaaaagaaggaaatgaccaagaaatcacaggaagtagccagctcttctgtctgcaagcacacacactgctagcatctctgcaaatgacatagatgcttcagtatgtgtggtagcagctggacaatggatggaagtgtgtaatcaatggcaaacattggatctattaacattttgcatacaaatgcttctattttactgattcctggtgcctttctacaaagaggggtctgtcagcccaggaattaagcttgagggttttatatgaagctcagcctcatcagattgtgccttattagttctttgctttgcttctttgagatatcagattattatgtgaccagttaatctaagaaaagcacaaaagagtaagaggagcaaaaataaaagcaccattttcctgttgaatatattgcttcaggccactatgtggtctctcaaccaagccatgactattttactaagtggggcagtaaacataaaaactgaatgactccaaagaaaagtaaatatggaaaattatggtagccatgaatgcattacaccactaacttacagacatgaagcaatgcagctttctgctttgggttgtattcagtcacagcgtaattatgcactggcaggttaccgatttgatacgtgagatggagcatcccttcctttctccctccatcagtcactgaccacagtatggtgaagggcttacactcacaaacctacaatgatcgataaaatgttttgtcagttgaaaaacagtcacatcgagtgattataacgtccctgtcattccttttataactataccaccctgggacatagttggaaacaaccaggcaactaccttaatacattttttagccccatgtagattggctgaggatcaaaggctctggtgtcaaggatgaagtggatgtaactgtcgcacagaataaaaatatcctcagtgtgggatagtcgcttttttagatatcctcttggatctgggagaaagaagcaaaggaaagcgtaatatgttcactgcactacttgcttgtatcactgccatatggcagaatgaaagccaagcatcttctttacttgtatatcatgctttctgaagcatgtttttaggttccacttctctattttgagcttatatcacaatttttaaattgtcattcttgattgtgcttccaaagtaaaaagcatgctctaaaactccaaactgtcagtattatctggattttctgtggcattgttgtgagacacctcctcaaagtaaattgaattcagacttttgcatacacacacatttcttacttctgtaagaagaaacttctgtacgttttcttaccatcaaacaccgacctggacctagaacctctcacatgcccatcaggtgctcctatcccctttttcatacagttattataaataatagaaagtaagaaaaatccaaatttcagaattttcattcttcaaacttccttaatgaggggaagtgatttgttgtcgatatttttttttcctttttgaaaaacattagcactggaacaactggcatacatggtggccaccacgtttcctcacatttccagtttgtggtgacttttctgagttttcctttaacttccttcctagctctacagttggcctggatctcagcatagacatgaccaggtgatgtcatgcagtaattgccatctgggctctctcatcttgagacttaccaaaaaggttaatgtttgtgtatatatcaggatgaaagcttattgattttttttttaaagactcacttagatttgctgttaaaatggttttatgaaaggaattcatcagaatggagtgggaccagtaagtgacattattcagagagcggtttgaacatgctttattgaagtctttccttcctaacaatgaaaatggaagcagggagactcaggtaccattcattattatctgtgttccctcttacaccagatcaataactcttagtggtggggagtgtgtggccaggtaacttcgaatttttccttttttctctccggttctatgattttctgttaggaaattcagcttgtgtgggtattctactgagtgcaactgcaagacttagagactcaatcaaatggctaaagctgtttttatttcaagaagaatagcaaaacatggcacaaagcacagatatgtataatgcttatttaatacagaataacacagcccagctaatgatagtccctgttcttcctttgtggaataagttaacataaggtcatcaactccaacttttaaaatcagagttatatcttccctagtagcaagctttcctaatgatgtgaagtttgaagacaaccagaaggcccatctgaagccctgaactaacaagggctccccatatcacttcttcccacattaactaactagcaatacacctgatccagaacaaattctctacttagggcaagtgggattccacgaatttcagggagcatttcaattatgaaacattgttttatactgagactgttggttggcttacatttctattctccctgaagctggccatgtctgcttctatttaccatagataatatttagctgggaacatttcagcaaatatttagaggggttttaacccatttttgaccacaggaggaagctgagtcatctctctttgtcatcaaaaacatctcctagagaaagtaaatggactattggacagttgtttctttgtatagaattatcatttttcctgattcttttttttcatttctttttttaattagatattgtctttatttacatgtcaaatgttatcccctttcctagtttcccctccaaaaaccacctgtcctttaacccctccccctgctccccaacccacccactcccattcctggtcctggcattcccctatactgaggcatagaaccttcacaggaccaagggcctcccctcccattgatgaccgtctaggccatcctctgctacatatgcagctagagacacgagtctcaccatgtgttttctttgattggtggtttagacccagggagctctggggttactggttagttcatattattcctcctatggggctgcaaaccccttcagctccttaggtactttctctagcttcttcattggggacactgtgctccgtccagtggatggctatgagcatccactttttatttgtcaggcactggcagagcctctcaggagacagctatatcaggctcttgtcagcaagctcttgttgacatctgcaatagtgtttgagtttggttgtttatgggatggatggaagtaaatatatacattgctgaggttctctgaaaaaattaactgtgattattcatgaaatgacttatatgacataaagattctgctgtgtttgcatatttgaatcaaataataaagtaccccattttctagtggctgagaattaaatctacagctttttgcttattaaataaatcttctgtcactgagcttcattcagccaaataatgaaatacaatgatattcacactttaaaatgcccagccacggagttttctttggatttttaagactagaaaatgggaattttcttttcgctgaagataatttaggtgactagctcagtactatgtatccaaaatagtctgttatgtaggtacatgtccactttgcttaatttaaaccctccattttgacatctcgattgacatttgagactttgactgagcttaataataatgttataataatggtgacttcagtacaggtttcaaaccatcatgatacttgttattagccatttcaggtgatcacagttcctccaagatctactttgaatgaccaaaagtccccaatgctaggttaaatctaccctgatttaaacaaaacttaattatagtctacactggcacagacaaagcccttacatgtccattctcaatggatcatcacactaagaactgcttagggcccaggtatgaggagatgatctatgtagaaaaaagggttgctttgctttaagtttggaggatattctcctctacctcttatttttaagggaaacttgtaatccattataatacataaaataatctatatcttgactagatggatgtttgtatgagcatgttagacagtagtgtaccaaagaggaaccttgatagaaatctttcagttaatttgtcgaaagttataaatacattggtaaggtcttctatgagtactctattttaaactgtaagtttaaattagtgtaagaaatatactgtctgaaagtacaaccaagttcaataaaatggtgaaatagagcatttctatactatggctgcttgagatgaaaagagaggacatccatgtcttgccttagtttgacttacaagttttatactttgtgatggcattaaaaagatgtgcagtcagtagacactacacttccaagttttgctgggctattaatgtgtacacactatgatgtagctaatgttagtgttttgagaatgcttaaagcaaaatgcaaactaagcttagactctcatattcagtaacatgttaggggtgtgtttgatgcactttcaccttgccatattttcagcttcagatgtgttcatccagatataaacccataataacagaagaacatttatattcctgttataatctgttgctagttgaccctgtcagaacttttaaaaaacattaattccttctttgttcttttcttgtacccagtggaaaactctgcagtccccagctgtcaaacaataactttgctttattcaagagtgccctcaaataaagcctgattatgttgcaaaaagaaaccacatttgattaggttctgtaggttcctctcatggtcaaatggaaaccaagcagagagctggtttgagtggcagacaaaaggctacaactcctttggtcagaataattccaatagctccaagcggtttctttcatagaaatatagtttagctaaatagaggtagccaaggtttcggttttgttttgtttttttaaaatattttaggcttgctcctttagtgtgtatagcaatgttgtttattaaattatgtggaattcttttttgacttggctcagaagaacattctgtttcttaaagaagcatataagtttggcaaaatttttattaagtctcactgacttatctactcaaatgaaagctatttgtggctagctaatataaagataggagttataaagcagagaagctgtgtattaatttttgacaatggaagttctttacagttttaaatttctcttgtattttacagccactacatgagacagatactggaagctctgcgctactgtcatgataataacataattcacagggacgtgaaggtaagtattttttctcactaactttaatgtttctgaaagggaactagataataataatgacaacaacaacaaccaggaattttctttaatatagagagcatcttaaactttatttgaaaataaaaaataatttatctgctttatattgagtcattgtactaatttttaacaggaacactgtgatttcagtttccttacttttccctaaaagatgtgtgcaaactaatgtttttcctcttttgccatcagaggaaaagaatcacaaagccagtaaaaaagggaaacaaaactatttttttaattaaccaaatgcttaaatttatcacttatttttctataacttttcttcaaccagatttctgtctttcaagtaaagctgaaggattgtaaactgaaagaaataagagacgagaatagtgccaaagtaacagacacccctaatcaaaagcatttatcacacaagtgagaaagttgctttagaatcagaatcattttcatggtctttgctgactcaccactactttacagcatcattgctatttgctaagtagtaaaacacagtgtcacaaaagataggaattatgaaagaagccagttcattccagtaagttaccttccaacttcttacacgcatacctatcagcataaaataattaaaaatgatgcctaagactagaagaaacttagtgtaggttatgaatcaaattaaagagaatagaaccagtagggttaaaaaaaatcctctcactaaaagtcgttacgaaaataagaatattttaaaatgaaaatagaatcaaaactctagtagtacaaactagcctgaatagtttgataaatgggggattcagttaactgtcactgtactttgacaagtggatgccattttaacatttcatgttaaagtggcacatggatgtaactgcataaaggacaactgctatattttgataggactcaactagttaccttatatccaagaaataaaatatagtttactttaataactgtctgcatatgcacagactctgtaatccaagcctgtggtggtttgctgcacagtccttaacagttatttttaatgctttgctgtaaagctttgaccctatggtgttcatagcactctaattgccctccagtatgcaccttattctctgagcactaagttgttagattatgagaatcgaaggtaactaaaccacccatgaactacagtgatattaaaatagatagtattgttctggttaggtctttctttgtttgaaatgcattgtaaagtcttaaatagaggaattcctatagccagatttctgtaaccttcaaagattttcccattaatcacaatgctggtgtcatcactaccttcccttttctgttcacctagttgtggaagaaattggcaataataagaattctcatttggcctactattaaaatgatagcaaactctttctgatatcattttcaacttgcatttctgaggatggtttcatccagtctgctcagtaaacatacctcaggagcaagattttcttgtaatggcagatccctcatgaaagcttattatgtcctctttggagaagatatactctttatcctcaagagtcttttaatgccagcagtaaaaaggctggtatccttggaataccacagtcaagggtagtctgtgagccaggactgaaagctctgggtctgtggcattagggacttgagcccaaggaggaagtgaatgataaaggaagtgctatcagtaagcacttgttggcatccacaacagtgtctgggtttggtgactgtatatgggatggatccgcaggtggggcagtctctggatggtcattccttcagtctctgctctacagtttgtttctgtgactcttttcatgggtattttgttcccccttctaagaaggattgaagtatccacactttattcttccttcttcttgagtttcatatggtttgtgagttgtatcttgggtattccaagcttctgggcttctggactaatatccacttatcagtgagtgtatatcatgtgtgttcttttgtgatttggttacttcacacaggatgatatactccagatccatccatttgtctaagaatttcatgaattcatgagagcatcccactactcttccctctccactcctgctgctgcccaagcccacccctcccccttctccttggtgctgtcatacagctatttttttaatatagcagggaatcatgattccaaatacaatccactttgtactcttagaatatcagtgagattgttattctttcttccttttccatccttttattgaattagtgcgaattctcagtccctgttcattgttgtcaaaaaatacagaaacaggccatgcaggagcggtgggatttcccactcaggcctagcaccttccaaggtgtttaactaccagagagtctctgaagtctgtagccgtgggatgttttcatagttagctgtgttagccctggtctatcaaaccttcagcatgcagaggtggtatttcttccttctaggcatatttttaaaggccttactctttggtatactttaaattgttaaggaaattaggtagaggttagtagtggaaattattgtagctaaaagctgagaactttcatgagcatttccaaaactgtctaattaattgtaataatagcaaatgaaaatcattgtaaaatgaacaaaaatttccattactgcaaattagttgtacaatatcttattgttcattcttttcaaatgcaggtctgatgttggtactctcataaaaacttgacactaaacaatccaatagacacataatacttttatttttaaaaatctttagttatgcatagagagtaaaaattgtacaaagctgtcttaatattctattactctggtgaatcactatgagtaaaggaactcataagagaaagcacttaattgaagacttgtttacagtttcaaaagattagtcatgagtatcatagttggaaacagtcagattctgagagtttttgcagtagctgagagctttgcatcctgattcttaggcagcaggcagagaaagagaaactgggacaggcatgggcttttgaaacctcaaagtccacccccagtgacatacttcctccaacaaggccacacttcctaatccttcccaaatagttgaccagctggtgaccaagcattcaagcatagagcagcagggtgtgtttctaggagggtggtctcacttgaaccatcataagagggaatagagggaaaagaatcaatagagttttaaaatgtatgcttctttgcatcattctgaatgaatataagtgaatatatatggagtaaaattttctccatatatacatataggacaaatattctataaaatacatccacgagctggggcctagcaaacacagaagtggatgctcagtcagctattggatggattacagggcccccaatggaggagctggaggaagtacccaaggagctgaagaggtctgcaaccctataggtgcaacaacaatatgaacaaaccagtaccccggagctcatgtctctagctgcatatgcatcaaaagatggcctagtcagccatcattgggaagagaggcccctaggtcttgcaaactttatatgccccagtacaggggaacaccagggccaagaagtgggagtgggtgggtaggggagtgggggggaggtatgggggacttttggggatagcattggaaatgtaaatgaggagaatacctaataaaaaatttttaaaaatacatccaggaaaaaatgataatctgaaagcttaaaatttgtaaaatagatcactagtttatgtaatgcaattgtgtttaaaacagtttgctcagcagttttattttgtgtgaattctgctcttcacaaaaattttgtcaatattataagaacaaaatatgactatatataataagtaattatagtaatatatttagattctgattggccatggtatttgatataatggcaagcccaaccaaataatacacaaaagtggttatatttggcttcatcttctactttagcatctgtttatatagtctacaaatatttggttgcctacttcacccagagtgtgagctctaaaagtatcaggaaagagactaagtaacatttttatcacatactgttggagtctgaccatttgtcaacactaagtgactttaaacaacagctggcatcatttgctccctattgtacagtttagttagagccatggaggaactgctcacctctgttacccagactgttggccaggatcatgggaccagctgcccaccagctcaagtaacagaaactagagagctgctaagctttttccctctgtcataattgacacctcccccactctttttatgtggccccatgtccaaaagtacagtggctcaggtcttcacagaaatggaagttagcagatgcgtaggtgcctaggtctcagttctcgtttcatgttggaccttttgcatttgattggttgtatcagattttaaaagtggaattagtctgagttccagtgaaagaaacagagctgtctttttcgggatctttttttgtttgtttgtttttcttggtttttggtttggcttgggggattcatttttgttttctaagacagggtgtgatgtttgccccagctggtcttgaactttctgtatagctgaggttgacctcctaactctaccaacccaagtgctgatattatagaaatgtgactcccaccccaccatgtctggtcagctgcaacatttttttaaagtgctacaagtatacaagggtaaaataagttgttgggtatgatctttatagacagacaaacaaattgctatagagagtggtgctaagtatcagtaaaagacagaatctaagggtttcctgaaggaaatcttgaatgagggggtaattgtatgaggacagggagatatttcacatagaagaaacagtgtgtgcaaggacctaaaagtagttttattttgggttgtgttaaattagtttctttttccgaaggacataccatgtaatttttaggaagcacttagaaacctgctgaagaaggaaatagagaagtaattctcagactgcaaatcaagaaagcactaggcaaaagcaccatactccagctgtcagtgagactcaacagagggcttacattaatgttgataccctttataccatttcaggtaccattatgttgaaggtacctgaaatatggacgttttgcatgattgaattcaatgttccacttatttaattggcgttgttgaattgggtatatttctctaaaatattcatccaaaagatatttttcaagtgcctactatgtggtagaaactgtcctaggatctggagctacaccagtgaacaagacaatcacagccctagtagagctgacagggagacagctagaagtcaatgtgcaaaaagaagtaaactggcagtttagaaactgagagaggcacttgggaggcagaggcaggtggatctctgagtccaaagttagcctggtctacagtgagttccaggttagccagggctacacagagaaaccctgtctcagagagaggggggagagagtggggagagagactgagagagggtggagaggaagagggagaggagaggagaaaggaaaagaaaagaacagttagattgtagctgtatttagaaggttgtggcaacagaatttcttaataggactttagtaacttacctaaatttagtgtgattccggtgtttattctagtgggtaatcctgcttgccagtcattgtaaaaccttcatagctgttaggtctcaggacatccatatatatccagaaatcccccaacttcacccctcacatataataccaatatatttcacatgactaattatttaaaatgtcacttgttttgttatgttaatctttgtttacttccttttaattagttaagaaaatagaaggccatgacaatactccactttcatgagggaatcttcagtttaatttgtctcgtctagctaacaattatatgtttgcattctctctctctccccctctctttcctttccctcttcctttcttctccccttcccctttcctgccttaccagattacctaaaagcagatttttatgttgattaattacatttttcttctgcttggtatctgtttccttttgaaatcataataatgaagttgaacgaggtgttttggttagatttgagtacatagtaccacgaagccacagtggaaactgctggcattggagaagcaatttctcaagaaattgcactttttaaaatggtgagtctttgcagtttagggagccgtgtcatgatgatgtaggatctcgcagcagtctactattgagattggggtttgacacttagttttgggaagctgtctaagatgttttaatatgcctaaacagtaccctgacctttgcccagtaaatgccagtataatatctccaaccctccaagttgtggcaaccaaaaacgtctcctgaggcataaaactgccctcagataacacccattgttgtaatattatattgcggtttacctccttgtagacattaattgaggtatgtatattctttttttcatccatcttcttccctttctttatcttgtaaaaagttggggaaatttccattatgatgaagtgatccccctttgtcctctcacccctgactccagagaactttggatagaatcagaccattgacaaggtcagtacagcttctagctccttggctgactcttgactctcagctcccctgaaccccaaagcatcgcctgggtttgcagagacacagcacacttcagccctctgtttctctctcactctggtacaactttagtaattgaagacaaagtaaagcagtttggcgtacagactgctggccaaacacaattactttccattctgagtggggcctggcccaggaggtttgagagctcagtatttagttctcaaaactgctagcctcaggtgcatatacactccatctaaggcctcctacctcaaggtttctgggtgtgcttcctcaatggtttcctttgtagcctttgtcatcacgcctgactgctctttggaccctttctggtctcagttctcctttcacctgctaagtgcctgactttcttataaatgtgcattctccacagttacagtaaacaatggtggccgcagcagtgtggatctcatgtagtgttccttcctcttgtgctccctcactggcatttcttttataccaactaccacaattccaaaagtccctgtgttatagttttaaagaattacttctcatcaaaaccaactcacatttaattcttttttaattgaaaatatttttcatcacaatatattctgattatggtttttcctccccatactcccagttctttcccatctcctctcccatccagacccattcctttctgtctttattataaacagctcactgataattagtacttgagaatgactttaaggtccttgagcatcttacccacattttatctgattataggctcttaatcattggactctaaaaaatttctcacaaatttttaaaggatgaatatttcttttgcttattggaaatagttccttccaatactcctcacctgagcccaggggagcatgtgtcatataaccagataggttttccatcagttataaaatgtttctgtctctagtaacttttgaaatgatatcaaagggggtaggggggaccagatggcaatccccagctttaggccacactactgaaatgctcagcaattccctttgtgtgcctgctggctttcctttcacctacttatctatcatagctcccatcctgacaggctgtaaggaagtcctcatcaaatcagaaccaagggccatcttcctctcctacccagggaagacagagttgcttcagattaaatggtgcatcttaaattttgtttgcccagtcttaatggtttaaattcctggtttataatttcacaattgccttaaggaaagagtgcatgaggaaggaagaaaagggaatcattcctgttttctatagttaaaatattatttgagatttctaaaatacaaactttaaaattaggatagatttaggaagttatactttataaaatatttttctataatatcaaataaccaactctttaatactttgaaaaattcaacatgatttatagaaatcatacaaagacaaatatattaaataagctcaatgtataatttaatatagcttccatttcctgccagaatgagcaatctgaagagaaactgcatacctctttgcatatcaccttttaaatattagtaattctagtttgccaatatcatttatctttaacatggtaaatagaactgtaaagcaattttcaaaaaacagaaaaccaacagcaacaacaacaaaaagataatatctcaactgctgttcacgtggaacccttctccacttaggccttcaaagttctcaactgctgttcacatagataagctctcatcctgcagccctagctggcctgaaactcgaagatctgcctgcctcttcgtcccaggtgctgggattaacggctcaccaccacacctgcccttaaaggggatgtttttaaattattttattattttatgtgtatgggtattttgcttacacgtatgtctgtgtccttggagggcattagattttctggaactaacgttacagacagttatgaaccacagtacgagtgttgggaatcaaacccaggtcctctgaagagcagcagtaaagatgagccatttctccagccctgtaaagtgatttttaaaataacactttttaaaagtttatatatattttaaactcagtgcagtgagttaatatgatacaatttccataaaagttctgatcatttcagttcctcttagtctaatcagtttggggtttaaaacttttttaaaaagatttatttatttattacatatgagtacactgtagctgtcttcagacacaccagaagagggcatcagatctcattacaggtggttataagccaccagatggttgctgggatttgaactcaggaacgctggaagagcagtcagcgctcttaaccactgagccatctctccagccccgggactagaaactgatttaaggataagtggttgtaactttggagaactctgggcatttcagacagtctcctactggagttatatggagttattctgtgctttgcaggtttgcaaagtcactatattagacatctcagttttcagcctgtacaggtcaccgggaatttccagttatcctttgtctctgcatgttactgagccaaaaacttaattggtcctatgaaaaaaatgggtactcagactgggaagataggtacagactggagagaagtacttgagttcaattcccagcacccaagtaaaaaggtagtcttagtgacatgtacttgtagtcacagtgctggggagaccggcatatccccagcacttactggccgttcagccttgcttgtacaatctgcgagccccatgtcccactgaaagactctttctctctgtcaaaatcaacatggatgactcctgaagataagaactaaagttaaattctagtctctaaacccaagtgcatgttccaacacatgagcccacacacgtttgcacgtatgtatgcaaacatacacagaagaatagatatacactgtaagtatctgaaggcagaatgtgttcctactttggatattttcatctctcagttaaagaatgagttaaaaaggtcaagtatttactaggtatgtttcagttttggattttgatgagaactacataaaatgtctactaattttgagcacatggctctagagaatctgttctgtgaattgcttctacagttcttgttcaggaacaaaacctgctatgagactgtagactcacatgaacttaatgtaaacctctctttgaataccaaagtgatcaccatgtggaagagaggaaagtgagcctttgagcagctcctaacagcgtgccgagttgtgctcaatggttgattttactcagctgtttcatttggttccattcacgaagagaatgcaagtgccatggaagtagaaaaggaagatgcggcttatgatcatttgaagaacactttttttattttttaatcataatgtatacaatacagaatataatcactcttttcgttactggcaagattacatgaaagaaattatcactaagaaatgattgcttcttaaatatacttaaatactggaggaattgggataaccacttcacttcatatctgggttttttcatcagtaagtacattaacatgctttgtggttgtgatgattaaaattataatcatgaaacatatacacagagggcctagcacatagcaagtgctggtagctcacagtaggaacagtatctgatttaataatagtgatatgaatcaggtcatattttctgttccacgattaaagaaactattatgtaaagagagtaagtagtttgcccaaaattctccatctaaataagagatggagacagtataatacccagacagtttgaatccagaggccagccttttatccaacatggttacaattctttatacttcatttgtttagtttacaaaaattaattaaatagatggcaggtactatcattgatagcaccattatttatattggaaatatataaaatagcatatagatggacatataattttatatttttttattttgacaagtgtaatccaaatgtgtgtaagtaaaatctatgtattaaatattagaatcattgaatattgcctttcccagtaaaatgagccaaataataccaaattgacttcacactgcattattcatgcagttagatgggatttaaataaaaacatttcttactgctcgacttttccagtacttacattttaaaattattttttaaagttaccaacaatataaaatctgaccatagatgggtacttgcattaggttagaaagcaggcaaacccataagcctttttggttcttcatcctatagtcataaaatattgtgttttgaacagaatatccacaactgactgaaaacaaaacaaaacaaaacaaaaagtctgacttcacacacagtagaatccctttggtatgcttgacttgtctctgaaagtctctgccatctggtctttcaatataagtagaactgtaagtccaattttatgcatatatctttttttaaaaaaaccatagaggttttcttggtgcccgttaatgtcactaagagtcacatgcattttttttcctattttgtggtgttttctatccaaaagtcaaccatatgttagaatgtgcagtgaattaagattttgtaaggagaccatatagtgtcttcttgaatgttttatctaataaaagaaatataatggggtctgtactacttctggctgatgcaagacaagtgaggatgttttttgcttctattaaataattcagctgctgacagtctccttctctctggtgcagaacataaaaaatgggtttaaaaatactatatggaagaaagcaaactactaggaggacctggatgatcaaaaggtgtcttttcacagatctgtaggtcaaatctttctcggtaatggaggtacaggtccttactcttcgcagatggctgacaagagaatagtatgatgtcactactactaaaaaggagaatccaataaatgtggttccaatgagacccgcaatctgagaaggtctggctcccagttccatctgccgattgtagcactggctctgtccttcttctgtagcctcgactactgagtagtatagggtaactggaataattatgacaagcacaactccccatatgtaaatacacattgttctggcaaagttgggctggcgaaatcttttcagtacgtgaccataaaacattctctcgtagcatgaggtggcctcttgcttggactcctttttcattaaggtagcatagcggcttatggcaatccagcttaaaattaagaggctgacaaacatacttacatgcatagaaagagttcccaaaaaattgaccagtctgcattgtacagattgatatttccaataaaaacctctcaagaaatatatacccatgaaaggcatagcagtgcacacaagtaagtttgcagtcacaagatttgccaagtagatatgtgttgatgttttcttacctatttttgttaaaaatacccactgagcaagtgagtttccaaagagaccaataataaacaaaaagatgtaagtgaccggtaaagctgtggtagaaatcacggatggttgaatgcatgtcgagttattagtcatttatattagattttcttgatttttgtcacaggagctagaatggaattatatatacttaatattaaaactaacaacaacaggcatttttggttttgatggagtgagaaaatccaggttggttcttaccttttctcgttgtcacagtggtctgcttaaagtaaaagcaacagtacttaaagcgatggataagtccttcgtctaaaaaaaaaaacaacaaaatttggtagaaatagttaattaaatgcctgagatttatcattcgtaggttagagaaatttatacttcttagattataaagcaatatgtaaatgattatagattttgcctagaaatctagaagcacaataaaaggacagtggtacaaatgtgggcacattaacagaccagtaaaacacatcactttataaggtgatttaagaattaataatttttattagaaagtttttatatttaagcttttattttttaaactaataagtaaaagctagtttttaattccaacattgattatatccagaaatccagaagtaaaccccattccagatgaacaaaatactcagacaagatcctgaataaagataaactccagaacctatggtcattacaaggtcatcagtaatctcccattccaaataatgctaaactctcacacttcaataaattacattatgtgtcaaaattatacttggtatgcttgatggctagagtaccctaacgtgtcctctaatatctgtggttttccagggtttgtttatttgatataggtttccaacccagcataaatgcaggcgtgggttttactttcttaaaaatgtatttttattttatgtgcctgagtgttttgcttgcatgtatgcccatgcattgtgtgcatcaatgcctgcagacttcagaagagagtatcagcttccttgggactagagttacagacagttgtgaattcctgaatggctgctgagattcacttaaccttggcttctctgaaagaccaaccagggctcttaactacctaggcacctctccagctctggtgtttccttttaagtcttccctgtgaataagtgagaaatcccagtcaagctctcttctttttcaccttacttactttttttcaggtgagaataacagaaaagttactaggttctggtcaaacaacaatcctgatttctatcttccaaagttgcagttataattaccaacttaataaattatatttattgatttttaaaggcacatgatttctctattttcaccattgacttttggggcaccatattttgcacacttttatgatttataggagagtttcttaatcttttgttaaccatcttctctcttttgatgatgaacataaaaaggtttttccacagagcatcttctgatctctgccctttcaggattgtattctctaccccacttcagcatcttggtcttattattttctgcatcttgaattgctttaaaattacattggattttattaaaaatgaggatcatttcataatacattatcattctgaaacaacttttaagccaatctcttacctaaatacttaaaaattttctgcattcaagtactgagaccctttatcaaggtctgccactatcttcactttatttctttacaatttttattcagaaactgcatcatatgtttcagagtgcctttatggataggagttgtagatactcttaatatcaaaccttaatctgtaaccttgctgatttcaaaattaggcaaataacaattgaaatgaaccagttcacttattaagaaaaatccccagccgggatgtggtggtgcaccctttaatcccagcactcgggaggcagaggcaggcggatttctgagttcaaggccagcctggtctacagtgtgagttccaaaacagccagagctacacagagaaaccctgcctcaaagaaagaaagaaagaaagaaagaaagaaagaaagaaagaaagaaagaaagaaagaaagaaagaaagaaagaaagaaagaaagaaaggaaggaaggaaggaaggaaggaaggaaggaaaagaggaggggaggggaggaaaggaaaggaaaggaaaggaaaggaaaggaaaggaaaggaaaggaaaggaaaggaaaggaaaggacaggacaggacaggacaggacaggacaggaagaaagaaaggtccccttctgttcaaaagaaatgttggttttactgaagggccaaagctttttttaagagatgaagcttcttttatgcaaagcttccagtagcctctgcctcatagagataatgcattccatgctgaaagcagcagaggttcctctatgaatatcagtagcaactattccctaatgaaagaagagcagaatactattacttagatgttaggtgatggtgagtctctataaaacaaataacaactcactccccatcttcagcttcccaaattcatgccccattcagtaacagcctttgattcaaaagctactagaaatttagttttaaaaatttgtaaaatgcaattaaacttgagaaggcaaataaaagtgagtcttacagaattgcttccaaggatatctctccaagtgtacattctcctcagcagaatgtctgtgtacacactgtgctaatttgacaaatgagaaaacttgtacaactctagcagttacttgtggctatttaaacacttcttgagctgactaccttatttaatgatcagatttcacaattcaaatagtttagtccttttagacacttacaaagttaacctttaagctaaaactgagcccccccccaaaaatcatccttacctgtctgagtagcttatgctcattgactgtttcacactcacagttctctgatcttcactcttccagtatccttaatcagtatgagtagagtcttgcatgacaccaagtacagtggggagaaaaagggaaattagattgttgaagaaagtcaacagttacagtaaatataaccagtacctccttaaaaaaaaaaaaacaaacacaaccctcatttctctatttctttagtgggaggaagttagtgggtaatacatatatttagtataaatatgtactgtataaataaatatatatgtagtatacttatgatgatttcatgaagtagttagctttattgttgtgattggctgaagttgcatttctaaggtttaatcacacatagctaattatttttctgtgagcatagtaaaaggaacttctttccagtaactcaataaaataccaacataaatttgtctctaaacttcactacaaaatcatttgtgaacagcttctttgcaatccatcttttctaagagtagaacaaaacaaaacttgaagttttcttatttataccggcttgctcaaatcaaatatcactaggctggattaaaattcatgctcatcagtggtctctgctgttttaagattgaaaaaaactgatgcccagagatgcttgctctctgtgtgctcagagtatatatagggactagaacccagtttggttactaataaacaacttttctctacttctaattggcatgttctacctccatttggagttgtaataatgagtacatgagttagaacattttatgatggattttggaggtagcaaatgtgtttcaaaacaaattaatagttatagcatgtagtctgaactgaccataaccgaaggctaaatgtgcatttagcactgaccactgagcaacctgcatccccagcccagttctgccaattcttgtttccaaacccaagtccacctcatttgcttaccactcgtctagtacgtagatgatgagaagttgggcttactcaaagattgatcctgagaagctggagagggcaaccatcagcaaagctctgtcttggagaattgggttataagaagggtaggaaagcctgggttatacagtcgaacgatgggcaggaggctctgtgcccattcccctgcccgcctctggctagaactgtaatcaaccttgaccttctgaaaatagctacaaacacattagttatctacaagttaacctccacagcaatttgtatgctttgtgttaactgatgcaggggattaaaagaacaaggagagctgcacattcagatgttatcagaaagtcaccaggagttggaggtgggggtgccaataaatccacaaattgtttggcaattaacatttttgtcatttaggtgagctcttctttagcacaaaggtaacttctggagaaggaaaggggaaggcacataatttctccctactgtcccactgtgtgttcattgtggcccatctccaggatgtttgcatagccggcaagccctttcctagacctgagttccccaagatggacaattccttaaaatggtggccattgctccattctcagaccattttggatttcactatcatacattttccttaaacagtacagttcactcaaatatttattggagtttctactacatttctagtagcacatggaggtcccagaagtataatgctaaccacaaactagagtgtcttcaaatccaaggaagatgtagatgtgatgtgtctgagaaataaaaacttagtgagttggtaaatcacaatggttcattaaaagaactgaaagggaagaacagagaatgtgtgatagatggtggtggaaaatgaggctcggggaagaaacgactcaagtgagacgactaggtaaatactataaaagattttctaagacagtaaacaatactctccagtagtagaaaaaagtaatggcaggaaatactaagctaacaaaaatattccttgtcatggagctatttcaagaatatcaaaccaagttgcaagttctctaggacatagtgtgcccctttggacttcgggatcacaaattttctctggctctttgtgttctcatctttctcctcttcagagtgcggtttcctttgtccacatgtaaatctccttatctgattacttctcagatcatctgcccaagcactctccagtacatactcttctgatccttctgatctgcctcaggtgatggttttaaatctggcccctggaattcctttggagtattttagtaagagtgatccaaaaggaaagctcattcagttttgcagcccatggtgagctgttgttactacctctatcaactttgaggggtgggtttgagggtcacttaccagtttccctcaaaaccaaaagcaggaggacatgagataccttagacttatctgaacttgtgtgtttcaaatgggaacttactttttggctctccaagctaatatctaaattggctacaactggacagtttaaaatttgtccatctgaccaatcagtagctcagggcattgagagggaagctattgtgcaagacaagaacacgtgtctaaatgtgtgcatattagaacaccattcttaatttccctcaaaggggaccacagtaagccttgttcatcagttcaatgcttacacaagccagttagctttagatgtgcagtgcagtcctgttactcaaagctgtggtttgttcaagttcagtgaaccttctgttctctttaggatgtggtatctggccatagccttgtttccagtgctactgctctcaggtcctcacattctactacaagaatctgtagtcgtggaagacccaagtgtaactagagttttaggataaaagcgctttctccagcaaccctaacaggctggccttggccacccatcttaatatgccaactcaagaagcaaatgacaaatcgtgaaaatcagagacaggagaggtaatcatgtgcacatcaaaaagaggaacagtgtctggtgaccccaaatccctctcagggtactgatatcagctgtagattagaggacaaattgaggcaaggaggcaagagttgtgcataattatacagccttagtcaaggtgtagccagtagtttgtgtgactcactgatcattgtctcagttatggttcagcaaaggtagtctgtaggctttcttattgttcaagggaacagggtggtccccaggagatgattgctcacactctagtcctcactggttaaatttcatcatctaggtgatagaatccaagggagtcctggtttaggataataactggatatctttaggcaccttttaggcatccggaacagaacatggtaaaaagctgacactaagatgccccctttagtcctgtctctgtgtccttggcctcaaaggacaatggaataagtgataatttgatagacactccttgagtgattcatattgaaagaagtagacaaagctaatgagccagattaaaagagatagatgcaaaatgaaggcagacacaccaggcttacactgtgcttttaggtccctgggggcctgaatgagaagtcagtggtttttaggactatcagggggcttttcccctctttttatggatgtgtacgtgtgttcatgtgtgtgcagttgcatgctcatatcatgtttcagaaccaaccattcttccctgtgggtactttgaaagccaaaggtaaagatgtaaatgagccagcaattcttgtgttactgcctgccgtgcctgtgctacctttgaagtgtacaaagaaacttattttctttccttaaaagcaggcattttagaaaataaggcatttgacaagagtctgggagaaatgtgacctatcacgaattaccacaagtaaacacatgcccatatcacaacacagcaactgggaatgcaaagagattacgatcatgtatcagtgcccagaattctccatgtttctttccaagaacaaggtcatcttatttctagccacttctttttaatttctcgataaaattgttttaagattaagactgtgtttgtgtccctttttgtctttactcaaggaggaggttatatcaatggccagggaaagagaattgggcacgaggtgttctttcctgtacctgttagtgtttgaattcaattgctcatattgagaacccccaaaattgaagtactgcagtttatgtgaactgctagaacaattgataacagccaggcatggcagcacaggtctttaatcccaacactctggaggcagaacagatggatctctctgactttgaggccagcctggtctacacagtttcaggtcaaacaagtctatataatgagaccttgtctcagaaagcaagcaagcgagggagggagggagggagagagagagggagggggaaagggagagagagaggagaggagaggagaggagaggagaggagaggagaggagaggagaggagaggagaggagaggagaggagagagtttgggtgatggtggcacacccctttaatcccaaggagatctctgtgagtttgaggccagcctgttctgctacacaaaaaaaccctgtctcaaaaaataccaaaatttgataataaatgacaaccacttaactatattttatatttatgtacatatatacatacatacatacatagaaggtttaagatatatcggagataaatgcttttatttcttcaacaggacaagcatatcatgtgttgtaacacaactagggcttgaattgatcccaagtgttaaaggttgtttatcctgactcacattagataagatagcactcatagaatctgttattttttattttattttaaaaggcatttcatataatatatttgtatcatatcctttcccatcctccaaatcctccctacccaaattcacattctctctccctccttcccctccctctcaactttgtctctttctgtctctctcaaaaaaagaaaagaaaactaaaacaaacaaaaactaagtaaataagataagtaacaacaaaaagacaaggtacccgtacaaaaagctgtttgggcgttgatgcttctgataaggtgaccaagtatctcatatctcctttgaccaaaaatagcttttacttatgtcaactttttatgtaatctgaagcttatattttgagatcctaaatttaatgttacccttttacacagtggattttagcagtcactgataattcctattaaattaggagtctcatccattggcacttgcatcttgatgcaaccttttgatatgtggaaataatttagagttgaaatcagtcactctagacaagtatacatacctggctgtttctaatattttcttgttgcctttattttaggaaaaaccaacctgaaatacctagtagaaaacaattggaaagaaaagctttgttacattttaacatggaacagctctgtaaagtgcttgcttctttagagctctggccagcagagggcagtatatcaccgcaacacagttctttttttttttttttttttttaaataatttgcttagtttccagctggaaatgactgcagtacaggctaggggaaatttttttttttaatattgagggttttgtccttttaagctctaagaaatctataaatttactttttctagtgcatgaaaaccactttaaaagtgataaagtgaaaataattttaaaacaacaaattctctcaagatgaaagcccagtgccactcatcagccatgaataggataaatcatttaaggcttggctttgtcttattttgttttaatgattatcatgagtcacgtttgtgaaatattcatgactctaattatcctggaggttaaaagaaagtctggcaagctgagtgtggtggggcacacctttattccctgcactcgggagacagatggatctatgtgaagctagcctggcttctaggacaacccaagccacatagtgagatcctacacccactgaaatgagaaaaaggaaaaagaaaaaaaaaacagtctaacattttagcatgggacaattttgtggtcaccttgtgggatttaacttctaaaataaaattatagcagctaatggatacagtttgaaaagtcaagtaatgctaaagggcttataatgaaaatagttaacaaatgtattttatagtacattttatcctctgaagaaagtactagaagcgatgccctttctcctccactgtcctcccttcttccagtagcaggccaactatgccgatacttcctcctcgaagtgcctcgcagcttagctctctacatcaggggcacatccagggttttatccccgagaacgtgtgctttgtcactaaagcttcagtcaccaccttccatcctgcatggatctctcacatgagtacacaactccctcatccctcctcacaaacaaaagagctggcaagaacatactgttttcattttcatctaccacatttctttgaatatgctttcacttttgatgacctgactaggcttttatatttttttccctttagtgcagtaaaatggctctctccctagggattaataaggtatgtgtagcttagagtccactgtttcctcagcaacattcctcaaaggaaagagaattatgctttgcaaagagacctcacatgtccaagtgctggaagtgtggaactgctttggttccttctcataccaaatgtatcacaaagctggccctttgtaattttcatctatgaatatctctttctgtgcttctagaacagcaatctagcttggcaagaaagctagaagaaaagcctaatcctgctagctctagaagtttatttgctccttagagctaggtattgtcactaacatctatagtaccacagcctgaaaggatgtagaaaaatggtcctttcagaaggttaagggagcagcccccacgcctctaggctgtacccatcactcaaggtttcactattatgagggtcataaatatccaatcattggatcaggagactcacttgctacttgactatcttctcttcctagttgccacacatacttggaaccatgtaatctttacccacaagatctgaccccatgtgtcctgtgtttttcaagccttgctggccacaaaggggaagtgaatataagcatgcatgcaaacctgtcagttccctttgcagccagctcaatgtcttcgcttaaaaatatagaggaaacggtgtttttcttctgagtacagactgaatttccccatacagatgagcatttctgcttctgacagatggagagggggtgtggaaaagaagagcgcatgcagttatgagaaaagggtcttaaaagagaaagtagggacacagagacaaaactgaactggggaagagaaaggtgctactgagtacaggaaagaaaaacagcaggagggagtgtccggggtgctaagaacatctcatttggaggacagcagtaagaggcaggaaggaaacagagaaaggaactgctattaaatgactctttgtaaagtctatgccagcaggattagcagaaggcatgaagaactttgatctagaaacttgcagttggccaatatttgaaaatagggtagactggccatgatggtattcacttagaatccctgaacttggaagactccgtcactagaatagcatgttgaacaccagcctgggctatgtaaagagttcctgcctccaaaagaacaaaagcaaaaataacacagcagagggcagaactctagggaagtgaccttgttgctattttccattgcaatatgaagactagttcagcgatccagattatacagaaaagtcaaggctcagatacatattaatgtatcttttggcatctgcccagataccctcacagtctttgcttgctgagccttagagtatggcctggctagcataaagcagaatctatctgctacatctccagaagctaggattcagttcgctttgtgagtttcttctagagttggcccacagtcactttcattgtatacctctctagatctcatgtttaccctcagcttccagctgtgtatttctgcctttcccctggtatttggctatttggataacttaccaaatattttctgattgctgggtacctcaggatcattcagccctcttaacaactctgagtgaggtccagcaattactcatgtttttctctgtaagagaaagaacgtgtccgaggcaacttataaatgatggagcaaatatttgaactcaggcagtcttttagcctgtctattttgctagctctctgttcattctttactgaagtgttattaagctctaagttgcatttggcctcaccaggcttcttcccatggtcatatcaataagtcacatattgtactccatatccattggccaaactaacccactggactgttggactaggcaatactgacattcccccacacagcttccccttaattttctttccttttctagagaaccactaattctttcccgtgacatgtttagtatttaatcaggacatctgatcaagacattgtgcttcttaaaagtatttttatgtaattatacacaagtgcttaggttttgtagttttaactctcagaaaacatttctatttttatgttctcaggggtccccacatttaatacctcagtactatttgtaagtaaaatgctaagatatcaaaaatatgatctgatctatgaatttgagagtccttgaggaatgtatattaagactagtgactagctagatttagtttttagttacttagttcctgactacagtttcccctccctcctttcttcctggtcccccactaccacctcccctctccacccacccatccactcatcctctatttctcttcagaaaggggcagccctctcatgggtatcaactagctacagtatatcaagttgcagtaagactagacaccttctctcctattaaggctagagaagtcaaccctgtagaaggaaagggtcccaaaggcaggcagcagagtcagagacagcccctgttcctactgttaggagtcccacaagaaaaccaaggtacacaactgtatcagatgtgcagagggcctaggtcagacccatgcaggctccctagttgttagtgggtccctatgaccccaggttagttgattctgtggattttcttgtagcattcttgatacctctgactcccacaatccttattcccccattaatgcaagattccacaagctccacctaatgtttgtctgtggtctctctgcatctgtttctatcagttgctaggtgaagcccctctgatgacaattgagctagacaccaacctatgcgtataacagaatatcattaggagtgtttcattgcttggttttttgtcagtcatgtttggttctgtcgtaggtctctaggttatctagcctcttgttcctggccctgcaggcagtatcaggggtggattccctctcatgctggatcagtcattggttggccactcccatactttctgtgccacctttaccccatgtaggtaggacaaattgtaggtcaaagttttgtggctgggttggtgtcccagtccctccactagaagtgttgactggttacaggagatgaccaattcaggctccatatcctctcttgctaggagtcttatgggctctatttattgataaagggtgttttttatttctttttattttgtccttgctattgttgcctggtagaaggagcctctgaactaagtataagtatatacaagttgaagttatttgtgacccatttcaacaagaaatgattgaggcccagaatatataaagaagcacttcaacaataaagaaagaaagttaagcaactgaggaggagggggaagtgaagctatgaacagaccattcacctaagagaaagcctacatgcaggaagtattacaaatgacactccattgccctagtgatcaggaaagtgcacactgaagccacaaggagatattatcttacacctatctgattgacaaaaagtagtgtgtgatgaaaccaagtgttagcgaggatgtgggcagctaggagctcatttctgcccacttgtgagactgggtgtataagtagtaaaattgctttggaaaattatcagaactgggatatgctgaaggccttcagtcttacagccaggcattgttgcttgaggggtcaactctaagggacctccatgcaaggacctttggcaagcagaagactgctcctactaacagaaaaactggaaaccacctatatgtccgttggtgggggaaatggagaaatgaactcatgttgttttgtgtcctataacacttcatctatgaaaagaaataaagcctttgtgctagacatagataagcataattacagtgggaaagagctatgaggtgataaaatagtagttacaccacatgtaaactttttttttttttaaaaagaaagtgtaagccaggcagtgcatgcctttaatcccagcacttgggaggcagaggcaggcggatttctgagttcaaggccagcctggtctacagagtgaattccaggacagccagggctatgcagagaaaccctgtctcaaaaaaaaaaaaaaaaaaaaaggaaggaaggaaggaaagtgtatcttgttatacacatgtgttataaaagtacaaaaaataaaccctccttacccaaggttaataatgcacacgtgtaaaaccccagtatgaccaaacagtaagataacaagttcaaggtcagcctatactacatatcatttttctgtttcaagaaaaaaaaacatagtttatatacatataaagtaaacttacacgtgaaattaccaaataagataagtaatggctaactgttgctcctgaactaatttcactgggtgaccaaagctaaaagtgacatatccaaactgcaactgaaaatctttttcagaactcattctgtgatgattctttacgtgttttatgaacttgaaaaaaattaaattagataaaatgtaccaatttatctttttttttaaaaagtatgctccgtgtgtctgggattgcagtgaattagctttcaagagtcaagtagagtttgtaaggtatacaaatgtaagacagccagaaagccagtcttgcaggtttggggatttgggcaccatacaattttgataaatgctaaaagtttttgcattaattgcatattaatattactaagttttgaggtggctggggttgtttgtttttagtaactatcatcttggaggcttagggaagtagatcagttgataaattgcttgctacacaaacagtaagacctggctctaatccccagcctggatataagtacacatttacttggattcctattttgttgcttgtaagcataaaggaagaaaataagaggcaaaatggaatttaggacaaacctgtttccataactagaaccattgctcccaccaccaagtcttcatctggaaacccaaactgagctaagacattacagcagccattcatccaagcataacctagacatttctctataaggattgctatcattgcattaatagaaaactatttcccatcctcagatgatttagccatctatgttttttttttaacaactaacttctttatttacaactaacttttaattccatttaaatttcctttggtgtggtacaaggtgaggatataatttggctttttattttaaatttgcacaacactatttattaaaccatctcttccttcttgaagctctttgcagtggttcctttatttgcaatgattttctctcagggaaagggatgtgtaagagttaccttagaagcttttcaaaactatgcgcaccataagtaacaaagctttaggttttcctctgattagttcctacccacttctgagtgtcagtcacatgccaatactctcctcacatcaccaagggtctgcttcaggtgtatattccattcccctcgtaagtttctctgcatttactcccttgtttgtttgttttttaaatcgaaggttacaaatgtatttaatacaaataaagtaagtttctatcatcagattaagtatcccttatccgaaatgtttaggactataagtgtttccgttttcggagttattctgatctaggaatatcttcacagactttactggttgaacattcctaccctaaaattccagtatgtaaaatttttaaatatttcagattttggagcattttaactttcaggttttgaaattcggcattctgagtatgtactttagaaacctaaaaaataataattctgcagcattcatattgtctcttgaaattttcctacttttgtgttttctgggtaactttaaataggctttggttgaaattgttgtaatttgattagttctatttttgtataagcaggataaccaaagcttatatagaattgttttttctaagatggtggagacagacaccatctagcctggctctgtgcataatactttccaaaaactaacagcagtgcttagtactgagatgtcactcagggagccaggcagttcatgttgcccttatatggcattgtacatgtgagatagtatttggaagcttattctgtctgaagatcttttgtaaggtgaagatatgcatgtacttctgaatttccttttctgtgtatatgtagaactaagccttgtgttggcagttggaaagtcagtatttcctaagtacatacaccaatgatcactaagacattatatgtgataaatatctctaaatttagtgagtcggtagcatgctttttattaaattctagaactctccagattcaggctaatttaaaggatgtttaaaaatgaaatttctatcagtaaaaaaaaattacaggattactataatcaaattttactttattacagttaacataagttaattcagtaaaacattttcaaatattttatagagatcatcgtttaatatagatagtaagatcacttctagagctatgagtattttattttaatgttcctgaacattatattaactgatgataatatagtttgtgtgtgatacatgcatgtgtacgggcatgtgtctgtgtgtgtggtgtgtatggttgtacatgcacatgtgttctgatgtgtgcagaggccagaggagaacagtaggtgccctgctctatgtatctgccaagtcacctggccatcaagttcccaggatatgttccaccccatgtgctttggttacagctgtgacccactgtcttagatacagttaccattgctgtgatgaaacatcatgaccaaaagcaacttggggagggaagggtttatctggattatgagcttccacatcacttcatttttgaaggaagtcagggcagaaactcaagcaaaacaggaacctggagcctggagccaaagcagagaccatggaggttgatgcttatggcatcctcagcctgtttcttatagaacctaggactacctgcccaggggtatccccacccacaatgggctggacctgcccccatcagtcactaattaagaaaatgcctataggttatcctacagctcgatctttttctcaagacattttctcaattgaggctccctcatctctgatgactagtttatgtcaaaaagacataaactagcaagtacactgagccatctgtacagctcttgataacatttaaactgtgtttcttaatgtgacattaaaaggtagggaatgcttaccactgataggatccaagttttcattatttaagattacacaaacagttactaaatttaatttagatattatctgataccattgtcaggacaccaactaaaattgttttaacactttttataagcctctaatagtttttatcgacaaatgttatttgtatttccagatatacttctgcttgacctattcttttttgtttggttggtttttggttttttggttttatggagacagggtttcttctctgtgtagccctggctgtcctggaactcactctgtagaccaggctggcctcaaactcagaaatccgcctgcctctacctcccaagtgctgggattaaaggcatgcgccaccacgccaggcttaacctattctttattcaacctgtttatgcactttctgaaatatagtgccaaatgaaactgagtgctacaactatatacaagcaaatctcattgagatcaggcccaaccaaaaatctgcatgcttttttctcatccaagttattttttgcagtttttaaaaattatatcatttctccctccctctcttccaactaacccatcctatatccccacctcactccctcttattcatttcattattattcttacatatatgtgtaaatatgtaattttgtaaatacagcatactgtttaatgttgcttgtgttgtatatattttcaaggttaagcacttggtattggataaccaattagaggcacctccctgaggacaactagtttttttctctcttggcaatcactgttacctttacttcttcatctaagggtttggccttatgacatttccctcatccacattgacaaatcaactggtgttgtagttattaaatcttgcttaagcaaccatattgttgagacttcttaggtatatcttctgtgtcctatctagaagcaaatattctgatcttctggttcttaaatttttcactttcctcttctacaatgttccttgagccttatgtgtatgggttttgttgtagatttatcagttggggctaggcagcccatgatcagttgatgtctgcattttgacaagatggtgcttttggtaatagtctctgtctgatacaaaagaagcttctttgaggggcaagagccacttatctgtatatataaggagtatttagaatgccactggatctgacctgaaagctttatccttgaggattagttttcatagtactggaaagtacattacaagctgccttgagaggaatacaaccaatagtcctacccagctatgacacctattagccacaacaatgaccagcatagcaacatatctctaaaggtgcaatagtggcacatattttggtagtaaccaacagctttctaattgggcttaaggcagcagggaaactatgcctgatactgtaaacttagagctaacaagatcataggtcttagagaagaacctgctactgccactttccttaaaccagtataattcataactgcattctaaatttttagtgctttatgacattgttttccagccactggcttaacttgagttttaagacatattctaggctggacatgacatatacctttaaccccaacacttgggaggcaaaggcatgtgatgtgatctctgtaacttcaaggccagtttggtctacatagtgagttccaggccagccagggctccatagtaagactcctcaaaaaagaaggaggaagaagaagaggaagaggaggagttgtcgttgtcatctatgtgtaaaactaactatgttggaagagtgttaagagtaccaaagcattctgatttttaaataaaattccatattctgtgatagaaacttaatcaaagattcatggagtttgttacagcggtcttttatatattcagacaatggcattctggttctgtgtttagcaagatcaaaacctacacaaacactggccaaattttttttcagtttctctaaggacacctcctgtctggattgcaatgtataatgtttcttcagctctatccagaataatgactggaaaagctaattagcctattttttcttttacatcttttcctccccatcttatttgttcatctatcttttcttcctttgttcactcaactactcggaaaatattgcttctgacttgccaaactacactgacctaggagtcagtgatgagtcccttctttttactctgtgttcttgaacatacatgaagttttctgtttgcgccttttaatgtcaaactccaggttttctgtattgtcaggaaatgtttcactcagaaatttatcagactagcacttatgtacctgggtttaatatacattaagcttttaccatgtttgtgccaaagtcttcacatgtgaccattaagtttaaattggtctgtatgatatatatgttatcattcatgctttgatttttttatttatatggacgtaaagaaaatgataatgttttaatattttacataaatgatttcatatagtccatacctttttactcttgggtatggttttctttcctgttcaatactattttttattcgatactatttttttaatgtgtatggatgtttacattgccccaggatgccagaagagaatccactgaaactggagttacaaatggttgtgagctaccatgtatgtgctgggaatcaaacccaagtcttccgaagaataccagggcttcaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagctacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacatttttccctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcagaggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccaaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtggaattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcccaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaagatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaaaaaaaagaataccagggctttacatttctccagcccattcaatacgatttttgctatgttcccatgtctgatgtgtatgtgttgaattgaagtgttaaaggtatttcatgtggtaaaccacagtttatttctttctgcttttacttgtacatccttaagtgttctgagtgatgagtatcattgtatatatgctcgtatgtatgtatctgcatgctcctgtaagagatgtacctgcagtgaacttgctggtcatatcatcacgtgtacagtctgtgtctcactgtatcaaagtgtgaagtggatggataatttatgaatgtgcattaagtcattccttttgccaggctatcatgttcttagcttgactgtttgctatttaaattcttcacatttttttttctaagcagcaatagtgcgcagtctcacttttattagaattttattattttcatctgttagcagagatttagacataaatgaatatagcatcaagtgatgtaagattttgaagtaatactcatgttcactgacatttcaactcagtccccagattactttatttttagacatatttaaaattagtattaagtgcctaactttagtaactctttagtgacttggaaaaaaaaaacaatgacatttcatctgttttgttgttaaatccatgaacttcacttaacattgtaaccgttgttaaaagtgttagcttaacaatgtattctgtgaaaattctacatacagttctaaaatctagggattaatgtaagcttttctttgctttgaactactttgcaattaagcaagtgaaagatcacttctaaagatctgagttttgggcatattaggactttgttcgataattttaccaacctcaagaaatgaagagactgttttatatcattcattttagtacatttgcctcaattacccttagtgctgtactggggcattttgactgtcacggacagatcatgcaaggaatgtcctggcttaaattctgaagtgctttcacttctgcttgcttcactttgaaaccttctaaaaagaagttgacacatgattttgcgaatattactggacatcaggaaatacatgacaggatccaggcaactgttgaaagaggagaaaaccagcatgatctcgttagttttgtgaatgatttccttccaataacaagaggacacatttagctgtgaagaaatgtaaatgaaccgaaaggcatggtaaggcacaaagcatatagtaaaaatgatcagtacaataaaggagttccgggctgttgtagcatatttgccagagtttggaaattttgacctccgtttagaaatcctcagtagattcttgccaatcttaatatatgagaggattatcagtaggaaaataagccagaacattactacaagaacaaagttaaaaattgcttctccctttgcattatgtctgtctctgtaatggaaacacattgtggaattatgacctcccttcttcagtgtcaaaatgatcatagttagaaatccagcaagagcaaccgtccatactatacagcaaacataaatactttgcttggtggttattgcccttctttgttgtatagaccgattgatttttatatagcgatccaaactgataaacccaagcaaaataatgctaatgtacatgttcatgtaaaatagtgtccccacaactttacaaagaatcacacctagtgtccacttgttttggttgatgtgatacattatgcggaaagggaggcagaagatgagtagaaggtctgcaacagccacattaagtagataaatttgaatggaatttcttttacggtgaatgcccagaaatacatagagggcaatgatgtttccaaccagtcccacgaggaatataacagagtagaaggttgttaacacagtagatagtaatttttcatccattggacagctagtgacatttggcactcctgagaaattttgtgaggcttggtcactataattagttataaagtgcattccatgagaggagcaaagccagctgtcaactgaagtagtagtcattgttacagtgtgacttctcaacgtcttctgtaactatcaggaggagagctaaatgacatgctctttgtacttctttgtgtcttcagattttcctacaacagaaagccaaacattgagtcatttgctgtgataatgacagctactttaacataaagcatagataaggatttcgtttcagacctaaattctacttggttctattttgctatctacacatgcattattgcatcacaaaacagcagtaaatatggtaggatctctctaaccttttctgttgctgtggcatgctcatttcatttattatattaaagtaaataattgaaagaaaaaataaataattgaaacatatgataatattttcttagagatactgttttaggactagaaatagtcaaaagaaacagcagctcctattttttaaggatgaatctcaatgtcccataaaggtgcttctagccatgagtgagctgggtcccttcctgatcctgcttgactttaggaatgcttcctgttctgcccagtcccctcatagctggcatccattcattttgatatatgttgtcgtggtagtgatgtaccttttcacagtaagagtaagaaaggggaccctaaatttccttcttcacctaagaccaagataggagtattaaaattacttatctatagaaatatgcagttccaaaacagaccaaggtggcacctgcctcctttcagagattcttgtagcacttcaccagagaccatactggtcaaataaaaccagatcagatagcagatagctgacagtaaacctctgccagcctagaagcataggacagtaatatagatgggaaactaactaaacattaattttaccctgggttatatcatttgagattgtcaccagaaccttcttaagtatgtcaattttacttgttcccagtgctacttgctattgaacaattcttaggcatttgacttttgggacctacaatatatgtaaggagaattcaagaaggtctcctcacattcttttcttagagcaactgccctgtttatctgtaaatcccttccgtgggtgtaagatagagtacagatgagacagctcagaagagttaaggaacgttgtgccaagcttaactacctgaaactgatctccagacagaagaagagaactgtccccacaagttgttctctgacttccagatgtatgtagtagcacatacttgtcacaaacaaacaaacaaaaagtaaatacttcaaagcaggactttcgaaattatatttaacttcataatcaaagataaatgatcattactaagcctattttctcatatgttaaaaatgcaaagttttgccgggcgtgatggcgcacgcctttagtcctagcactcaggaggcagaggcaagcagatttctgagttcgaggccagccagggctatacagagaaaccttgtctcgaaaaaacaaacaaacaaacaaacaaacaaacaaacaaatgaaaagtttttatgtgaaacacttaaccccgatgcatagtaagtactcaaaatagttgtctttaggcctgggtcttgtagctcagtgatagaacacttgcctagtatgtgtgcaatcctggtttaggtctcagcactgaaaaaaaaaaaaaaaacctaactttaaaaaactaggtacctaatgatcaatctaaacattatatatttgtttaaatactgcttggctattacgaccaatattaacaatattgcatattaacaatattaagacagagaccctgttctcagtaatcagttttagaggactgtatgttgaaaccctaaatgcagtataataaagtgtagatttttttgactcagggtttctttatgtagctctggctgtcttggaacttactttgtacatcaggctgactgtaaacatccgcatttctgtatctcctgaatgctgggattaaaggaatgcaccaccatccagctataaagggtagatcttaattatgataattaatttttcatgttgtcattgttttatggtactgaggattgaacccaaaaccttgcacatagtaggcaaacattctaccactgaatcacatctcagcacaatggatttttcagttttttcttccttttaaaattaagcagttttagtatacaaaatgtatttcactaaatatggcattttatacatttgttttattgtgcttccactctcctctgcccattgtctgcttccctcccccagattgtacctctgtgctgtgatgtcatatggatggataggtatttaactgtataatcctcatgaaagaaaacattcagtctttgtgtttcttcaccttcattatttctccttgttctacctcccttagatccattcctctcccacaacctccttctgttatatttttatatctagattctatatatgaccatgtaacatttgtctttgcataatcaatttcttgattggatgttatatagagagaaaatatttggaaaaatgtagcctctcttaaaactatattttggtcaagtacaggcttttagtagaaagtagcgttcagctttgaatgtttacagactgaaggcaggtcttggtttcaaggaagaggaagtggctggtgaggaggaagttctgttaagccatcttgagaaaggtctccacaatttaggactatggaaggagaaagagagaagggcactgggaggaagggagaaaggaatgaaggaagagctggggctgtgttgcagatgcaggaagacagatttcacaatgcttgtagaaacatccaggcctgtttcttgtgatctgaaacttaaaaggaagaaacaatctaggaaaggtagcaggctgctgatacttcaaagtacattgtcagtaatgggaagagaaacctgtgctgtgtggttgcacaggaagcactcagaggctcagatagaaacatccataggtgaaaggatactgagattcaagtgataagactcaagaaggtgaattgacttggaataggcatctgtaagtagtttttcttcctcataaagtttaaaccctattaggattaagaaccaagttcgttttgtttgcctctctgtgtaccaggtatttagcacaataaatattactgaatgaaagaaggagtttggaaaagtagatgtaaagtgttaaaagtacaagtactggaagcttcaactgtattcacaataacacaattccctgtcctctatcagcaatgtaatataaccattacaaaaactaaccccatctttggtttaactcaaacttctgtggtattttaaataaaaattgttactgctgacctgaattctgtctcaagctaatagtctcccctaaaatatctttttttattaatcatccccagtggtatacttaagaaagaccatgcaccaaacaagaagtagaattcagatattgtagatataagttgaaggaaataggcacattaacctatagatgaaaatgttttgcaaggccatgaagagggtctccccttcttattcatgtgtgcagagatccaagcaaggacaagtactggaaaagtgcagagacaggtattgtctccttgtgaggtaatgcttttgcagaatgaagcagtctagctcagaaagtactaagtcttcaagctagagacccaaagctgcagcgctctataggagggattctcagtggtactctagtctgtagatgagcatgtctttgaagataccaatgtctagcttcttcccagataccctgatacagttgttctggaatgggtttgatacgctggtttaaaaattcatgagaggtagccagtgtgtactcaaaattgaacacttgagctaaatggtcaaatgatcaattagtcattatttagcacttactgtgatccagatactatttaaacacatgatataatttcttttatatagtcttttttttaaaaagaacttctatttagtttatgtatgtgagtacactgcagttgtcttcagacatcccagaagagggcatcagatcccattacagagggttgtgagccaccatgtgagaattgaactcaggacctctggaagagcagttagtgctcttaaccactgagccacctctctggctctatatagtatttataatagtgtgtaagataaggaaagagtcataggtactgtggtctcagagctcttaagtggtagtacccaagttggggctcaactctgactctcaaagaccctgaaccgccttggtaaacttcacttctatcataactgatcaccgtttccttactaatgttaaattctatcaactaaagtagtttaagaggattcctttaccactatctactttagttgttttatgaagaggttgtactgtctagctttgctcctctggaagttattaatctttccatttgctaggtccataacaatatgcaagtaaacctagatttcatggaatcaaatcattaatcagaatttcttatttctgggccaaagagcaataatcaaaatgtttctaggaagatatcagtgcagagaacatatcccgagaccatttcttcaactctagtattcaagtaaaattaagtgatcaataataatagttggacaaaagcacgattagtgatgctgctagtgtcaagttggagaataaagcaaaagccgtgttgtttcaacaacaacagaagcatggcatacagtgccagatagtacctggccagcagcaagtgatttatcaatcaattcacaagttacagcctgtctcaaatttggtaactagtgtcacctttaaagtaaattgggagctgggcttggtagttcatgtatgccagcaatcatagttccttttgagtccagggcaggagaatcacaagtttacagcaatgttgtctaacttagtgagaccctgcctcaaaagaacaagttaaaagagggccaggaacatatctaaatggtagagcggttgcctagaagtacaaagcccttggagtttgatatccaatactgcaaaagcaaggaagtaaatgagtcatccataagtcatctggtatgttggtatcattcactcagtgatcatcatcaccaccatcatcagtattataattaatttggggaggtcaagacagagtttctctgtgtagccctgactgtcctggaactcaaactcaaagagcaatctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctcccaagtgctgggattaaaggcatgcaccatcacacctggattcactaattattcttaaggctacttattcatattttacttgttcgctataagaatttgccagtgaagatgagaaataagtgagcatagcctgttggcatggcagagctgacttgtagctcatacagtagtcccactcattctctaatagcaggtagtgtttgttactcagcaagccccattcctgtttgcagccctaagtgagcacttgtaccccaactgccaccatcctacctcccagattttcttcagtggctgtagccaagaaaagatcatgtaacatgttatttgggtgttatttctatcaatatcatgtgctgaaatacatacctatttgacaatggacttataataatgactgaatctattcaggccatacttcagaagctgcaggaactgctgcatacagaacaattgaaagcatgttacttgaaaaataacgatattagtactatatttagttttgttataaacttaactgtttacttttaattgtttgaattaatttttaaaaatatattgtggtttatttttcttttctagagtattctctttatttagttccaaaacatgaaacttaaattgtaactggtctgtaccataagataataaaaatataataaaaatgtttaagatggggaaacagtatagcattgtgaagtcaagagataataaataggaaatctgtagtatattgcaattaaatttactatgtctgaaaataactttagttgattcaaatacaactgcaaataattatgactacgcaatgccaataaacaatgtgaccattgttcttagttattctatccaaaaagaagtctcctttgaaaagcaaaggtgtcgtccaaagcagtttactcagtgactctaaaaaacagagatttgctgaaagcagaatagtgttaccagcatacatcgagcttcactctgaacattcaaataatcaagttttaactaaaacaaaggctgctgtgtgtggcttttaaaaatcagagaatacttacagttgaagctttcctgaagtaaaaggagtaaacccaaaactccctagaccaggttgtgtcagctgggctcttccatccggtggtggtggtgcaattggctagagttctcttcttttttatatccacatgtggtacagttgtttttccccttttctttctcttttcactgtgacagcccttgggtcccgtttggagctaagaaaagataccactcttagcaacagcttcaagttgaagtttaggaaattgcatcttctgtatgagtcccttctagcctaaactaaagagcatttgtcccctaagatgccaacaaactataaaatacaatcagaagtgggcagatgctctctttcctaagaaatgatgagtgatgtcctgtatggattttagaatataacccctgaatttccatttccttccagattcattttagaagttactaccatcatgaagtatatgaactttctgccccaaagtatactagcattgctaatagttggcttttgttttgttttgtttttactctttggttctgctgaagttttatttactctctatattattttagtatcattttgtatcttccttaaagaccatggattcatttcctaaaacatcttaaaatttggagactaggtgggatttgtagcactattttcgcctcagcacaatagtaaactcacccaagtaagccgaagtgctctctcctatttcaaggaaaagatgctgaggctctgcagcttccattctggtcacagtccactgtttaaccaccatcaattcatctgtgttactgctggccctgcactcgagtgtcatttccccttttggttgttgtttggaacatgattgttatcctccagctttgtctaaatctaacattgtaagtatttctggaaatattcttctgaacttcatagtccccagaacttttagtttagttttttgaagaatcataacatgtgagaccataattttacattgttagaataaaagtattttataactcttacttccccctgagaatctctgagcaggaagatggttactgtatctgtccagcagtattttttttcttactgtggtaagcgacacataccactagatttaccacatagccagttttgactctatcatgcagtgctgctcagtgtacatataccatcaggcagcagatcaccataacatttttatgatgcaaaattaaacctctaaaccctctatacacgaattttctctgcccctagtcttaacattggcaaccatgattctgtgacattgagttccattataaaacctttttgtgacttgtttattttacttagcctactatcattgaggttcacctataacgtgtaacctaatttcctttgtttttaaggctgcatatttccaatgtttgcctatacttcgttttctttattatctttcaataagcatgtaaattttctctgctttggggcaattatgaatattgcaatattgctgcaaccaacatgaatatgcaaatatttctaagattctgtcaggattttcatgactaaatgagtcataatgtgctttttatctcctgaaatacaatataaatactagttttgtattgtactattgtcctacacttatgacatcccatttcaaaattgcttttcagcttttagtgttctcatattgtagccacattttctcgctgatgtaaggtttgaatattatgttctagttcctgatcattctgaactttgtcaccattccttcattatgtgaaacccaaccctagtgaagttcagcttgccacctcttccagttctgaacctccccagtgaagatgaggactgctggctacaagcacacagccatacagaatagcctatcttcagattggcaatccaaaaccttaaggggccctgcactgccagaaatccttagtgtgaattctaatgtccttagtcccgtaattctcaaaggatgacttccagaccagtagcaaagtgggatcagggggagggggagggtataggggattttcaaagagaaaactaggaaagggggtagcacttgaaatgtaaatgaaaaaaactctaataaaaaattcttcatatatatatatatgtgtgtgtgtgtgtgtgtgtgtgtgtgtgtgtgtagtcccacatatatatatatctcattcagaagcttgcaactgaagttcatctagacccaagagtctgtgtgattctggagttaaaatgtaagggccattgccctagttaatcctccctcagaaatagcttttcacacctttgaccttctcaaactgccagcaacctcatttccttccccactctcagctaggagttgctttttgtttctctaattaaagagaaacccttagaaaggaacctcctctatatctacaggcacattacaggaaaggtctgtatgtctctatgtatgttatttcttacttttaatatcctacaaagaaggagggaaatattgaagcataatcaaagaaaagaaaaattagacctctgaatataatttgttttgcaattttgagtttggaagtacagacatgttttctgtaattaaaaccccaaactgtacaagtctaattaaactaaatgagcctcattatatgacaaaataaaagcataaccacatgaagaagttattttaggttcctttaaaataggattgggggtcaggacatacttttagacttatgaaaaagctacattatacagcacagtaatcaaaattgggaaatttatattaaaacaataccattatatatttgacaatccttgttacaaatttcatcagctgccctaataatatttttagagcaaaaataaaaagatgacatttatctgtgatacatctttagtttcactgaaatccttgagtccaaagctagttttgaagagcataagcctgctactttctagaatgtctctattattagatctgactgcactgtttgccaaggataccacaacattatttttaagtcctctgttagaggctctgaacttggtaaataagtgaaattttatgattggtttttgaatacttaaacaaagagtaacaaatgaagctaaataaaacaagaatggcagaagggtggttcagctgataaaggtgagtgccaccaagcctggtgactaagtgtgatccccagaacctacacggtggaaagaaagaactgacatgtacaagttgtcctttgacatggcacacaattatgcacacaaggacatacacacaagagtgtaataaaaagctttggagaataagaggatttgttcatacaaggtgataggtatgtggaagtttattcattttcctgcaattgtgttacactgttgaaaaggggtttcttcaattccacatgatcctctcgctgcatcccctgcctccattcctagcacagaaaactttgaaacttatctttacttactgtctccacacccattccctgcagaacctagaccaatggacatttttatgtctatcatgccaccaataccacttttgtcattggtactattgacttccaaactgccaaagctaatcatctgttctcacttctcaatttaaatggctgtagtaacactgatcactactaagcatttcttcttgacaaaaatgtctttccattggcttctgagatgcaaactctgatgctcaccttgtttccctgtctgaccattggtttccatttgctagattcttctgatctttctgccctccatttacccactgagacccaactcccatcgtcttctctaatagtagtcactccctcagaaacttcattcattcattatcttggctgttgatccccaaattcacatctctaatcccagctcctatcctaccctatcttataaaactgaataatagtctgtctttcaaactcttcccctagaattctccatttcagtaagtagtatctttatcttcactccaaggctcattgcaagaacctgcttctcaggcttgacctcctctttcaatgtatccatcagcagctcctgccagctttacctttagaacagaagttcttgccatcgctccatagcaccatcctctcatgtctaagcagctcagggggctcttttttctcattcctgtttctgtagttactggtctgcagagtactcaggatgatcctttctaaaccccaaagtgattacagtgctcactcttcagagtctccgggtagttttccatcatgatcagtgtgaaatccagtgtgaaatccagtgtgaaatccagtgttgaccatggttttaaggatgtgtgatcacattttctaccactctgcctttgcttattctttcctagctatccttcatatgtcttcatatccttgatatgtcttcatacatatcaagcctctgcacatatctagacctttgcagttattaacttctctgcccagagtttgcttccatgtggcttgctttttttttctctcctcaccctagtctctgtttggattttgtcacaataagaagggctcctatgacacccaccaaataaaatagcagttccctaattttacattatatgctttgggcttattctctctccatttgtatctatggatatagttttttttttaacctggagttcaaattttatcactcttgacagataattgaaaatggcagaatccacatagtgatgagaatttcatagattacagtttaacattaacttcagaagacataatcaacagactatgaagagtgtaccatgagcttctgaccctaggaaggtgataagatgcttccaccgatgtgaccaagagaccctatttgggtctaagctataattttccccctgcatcatgcccatgatttctcaggcatgcaggagctaggaaagagctctgcactgagcagcatccacagctcgcatacattcttctcactgctttgtcatgacagtttgttcactattcatctgtataccagcttttccttccttccttccttccttccttccttccttccttccttccttccttccttccttccttcctgttgttctcatatactatgcacacttctattagaggattcatctttctttatgacagactatgtacttttccacagtagatttctgatgttctcattaggaagaataagatccttcccactcccatttatatcaccatcaatatctgtgtgggtacactagctcagttttgttgtacagagtggtgggggcctttgtttcaaggcaactttcttatcacctaaactttaaaatgataccaattcccagcacacatactgggtggcttacaagtacttgtaaatccatcatataaagagagaataaaaagtgtcataacttaaaaggcttgtctttttatatttgagaatcatccaaatgtactgttaggtgtgtcagagaatagagtatgtgagcagacaccaaaggtcactactactacgttcttctctgacaccacctccaacaaacttccatagagaaatagatgaagataagatcccatgggaaagcacattgttaccacaaggtaggaaggaaagcagatccacaggcaatgcccagaaagaaatccctgggaacacagctcaattcaagttagtaaaacccaacatccacaccttccatcccagcacttgggacccagaggcaggcagatcgctgtaagtttgaagccatcctggtctacactacaagttccaggacagccagagttacataatgagaccctgtctcaaacaacaacaacaaaatagccatttgatattcctattactctggggtagaaaacataaagaaaagaaagaagatggggaaggtgagcaaagaaaagaccattggcattccctaagggtcaaagtgtagtgactttaaataaaagcacttatgtagcaggaagaagcatgccatgcatttctgctgaaacaaatataaactttaaatcaaatacagagactattacacacacacacacacacacacacacacacaaagaaagtatatctgcacttgtagaatacccatgctttctgggtgataatcttggaaacaaataattcctaaagtctttagagaaagaatttagaagtgagaaaaggacaaagaacttaagcatataaaataattcaaatgcttttatttattatttattttttttaaatttgggacaaggtttctcagtgtagtcctaggtgtatggaactcatacacctgcttgcctctgccccccttgtgctaggattaaaggtttgcaccaccactgctcagcttcagaaacttttttaaaattgaaatttgtttttataataggtgtcttaatacatgtagtttttattttagggagggttgagaggatcaggaagcaatttgtaggagtctccactttgtgagtcccaagttgtcagacttggtggcaagtacttttaccctctgagccatcttgccaaaccaatttccaagttttgttttgtttttaagtacaactatattgtattatttagttttatgcaaattgaactcttttgcattaaattttatctttgatttgattgttgcttttttttcttttcagccccactgtgttctccttgcctcaaaagaaaactcggcacctgttaaacttgggggctttggggtggccattcagttaggagaatctggacttgttgctggaggtaagaccactttaacatgctcccccttcaaaacctgggtggtatgtatgaagattggaaggaaggatagctgggaaagaacgagcaaaggcagggtggtagaaaatgtgatcagacatccttaaaaccatggtcaacactggatttcacactgatcatgatggaaaactacccggagactctgaagagtgagcactgtaatcatagtgcacaaagagcttaccatttggaaattgaactggacaaataaagtcacctctagtataaatgggtttgccttttaggatcacagcatgcctaagcttaaatttcctaccattttcctttttctatatatcaaagaagcctgctaaagtcatcagcctatgtgtctgtgaagagcaaatggaaaagaataacaaggctggttttctcattaaccaaaacaaaacatgattttaaaatgcctgtgccatagtagaaagtgaaatttttcaccagagtacagaagtggatgctaattcagattccactattgtagagtttttatgaattcttttccagaattcagaccacagcagtgcccagggtttacttctatttcttagttttgcaaattgcagttctccattctgtactgctggtgtaggcagtgctccgaatactaacagcttcacgaggaatcaaaacttcatgaagcatatcctttagcatagagtcttcaagtcaatttgccaaccttcagaaaacctctgttaagccaggtgtggtgatgtacacacagaatctcagcgcttaggagactgaggcaagaagattgctttgagtctaagaccagccttgagaacctagcaagatactatcccataaaagaaaatgaaacaaatgctcatgttaaattcaaatgctttccaaaccctaacttttaaaatagctgtctgtttcacaagatagttcgttcaatttgattgtggctagagcatcaagcagtaataacaatggccatcttctgaaaaatgagcctgaattatacttgtattttaaaaatcactctctgccacactgctctctgagattaaattgtgttaagatctaatcttacatacttttctagctaagtatttcctgtaaacatgggaataagagaaaatgagccacagtccttttatgttatatgctaagatgattttgtgtctgttactctggatctccattctgttcatattcattgtagcatagactatttcacaaatcttgatgggggtagattcactaagtttgcctccatgttcacctcttttcctaaagactataaactcatcctctaatttttattttttcaacaatattgaactcacatgttcattattcaaaaattactatttttatactctaaaaaggttttattttacattgagaaagaattttatatggtccagagtggcctccaagttgttaaagagttgaagatctgaacttgtggtcctcctgactccatgcctgaacagtaggattacagatacaccatcacacccagttgttggcgctgggggtgagactcagggtttggacatgctaggcagggactctgctaagctgcaccctagtcctaaagtactttctggtagttaaaatattgtcatttcttaatgtacctttccatatacctttcaaataactattttaaagattacagtactttaaaaaacacaatgtgaataggtaagagatacatgattttccataggaaaaaaagcttttcttctgtttaaagtacttttgaaattttactaatatttatcaattttggaacagaaagctcttttcctgtagattggaatctttgactacctgggcttccaaagagaaaaagattatcttcctttacatgttctacataccaaaaccatgtaactccattgcatttcccctatctaacattcaactgtttagagaatccacttactctgaatacaatgtagaaaacaattacagtgtagtaaaactggttacccttaaaaagtcctctccattgaaaactaactacatacataggagactgccttcctctgcttttcattaaattgtatagatttgtgtcccctcataatttgcacctcctattccatttgcttagaatgcctattgtcattttatctgtcgcatttaggtgtttgcttgaagactaagctaacaattattgccttttaaaagcaagcctattataactgccctagttatatgacctatcccctcttccatctaaccagaactatctagcttgcttacttcctaacaaaatgtgatcaaacatgtaatagcagcaaaggcaagagtgagtggtaggagagccatggctcatccctccaaatatctgccccagctatcacagtgcctaggtcctggcacgcactctagaaatgtttaaatgaaagactagtggctagccattttccagtcagtagcagattataagcaacaaatcaagacatgccaggacttgagaaagcatggtgagaagaaagaaaaggaaagccaggtgacaaaatgcacagcagccatctgataccacagaggttcatcgttacatacctgtgaagctcctgagagaatctggactgtagcattgttcctttgttgatagccagagtgacaagtgaagtcaccacaaaagggctaaatgctgtgtaacagcctatgaaaaactagtgaggaaattgtaaaaaaacaaaaacaaaaaacctacatatgaagaagataacagtggttgtatgtatgaacattcaaatcctaaagtattaaaaacataaccactcagaataactccctccctgaagtttgaggcaagggttattattttattgaaattagcatttaaatatttatgtacctttctgaggtatttcaaaaagttacatgtttggtttggtaattggtttcctgttcttagaattttgtgatcaaagtcataaaagtcaagtggttaagagaggggagggagagggagagggagagggagagggagagggagagggagagggagagggagaggagaggagaggaagaaaattagtagcaaacacaaggggtttagtgaagtctttcacattctactgatgttcttgacattaaaaagccaccactgttatctgtcaccactgagcaaatttttgaactcaaagtacacatcttcctgaagaaaaagcataaatttcttcatagtgggggcatgcttcaattcatattaatggagaccacattgatggagagagcctctttaggatggctgggcctgactgtggaggtttcgattattcctcacaaggaggccccccacaatgagtcactctgcctgagtaggaagtcgtaggaggtgcgtgtcaaagtaccatctgaacttttcagcaggtaccaaatgggttctggtagctgtacttcaaatggtaccctgagatattcgccctgcttttttttactcctcgtagctcctgccctgtccatcaaaacaatgtttattttcctgggaccctgccttacagaagctgccaatgaagtgggaagttcagttcccaatactataaaatcaattttgctgcttgaagaaacaaaatcagacaatcaaaaaaattttttctctcatcaggtccttatagccaatgctgagttctcattgtacattttgagtgaaggtattttccctgctagaatcctgagcttaatctcttcctttcagaagtgtgagagagacagctctatcagggtcctttcagcaaaatcttgcaggcatatgcaatagtgtctgagtttggtggctaattatgggatggatccctgggtggggcagtctctggatggtccatcctttcatctcagctccaaactttgtctctgtaactccttccatgggtgttttgttccccattctaagctgtctcatgtgaggctatgccagtgcatggcaaatacagaagtggatgctcacaatcagctattggatggaacacagggcccccaatggaggagctagagaaagtacccaaggagctgaagaggtctgcaaccctataggtggaacaacaatatgaacaaaccagtacccccagagctcatgtctctagctgcatatgtatcagaagatggcctagacggccatcattgtaaagagaggccccttggtcttgcaaactttatatgcctcagtacaggggaacaccagggccaagaagtgggagtgagtgggtaggggagcagggcgggggagggtataagggacttttgggatagcatttgaaagtaaatgaagaaaatatctaataaaaaaatagaaaaaaaaaaaagaagtgggagagaacacagagtgacctgcagtagaggcgcacctgtaatccaaattgaggagctaactagcctctccacccctgctgaatttgataaccatcaacaggccttggcagcatgttctctatagatgggttaaacggtctcttaggttctttttaaacacaggaccacagtgagataaagtattttacaatctccaaagtaaaaataatcttggattgagcataagagtcatgcagatggtcaaaaaacagaggaaggaagggcagggctgggcctgcagaatgtagacgagctgccaagttggttaggcagtggcctgtcccaaagtcctttcccggcacagttgaagccttttattcctccacagaggaaaagactacctcaaggctactcagtgaaagatggttatagtgtacatgcagctccaaccacattcctcctagaaaactggtttttgtaagagagggaggaaaatatgaaaacgctttaaagaacatgagagtcaaagaggattgcgtgggcgggagttcctgattttgctttagtgtatgctctcattcccttcaaatgtttacattaggaataagctaagtattcccattccagtagccactgagaattgctgattgacctaggaacttggcagttaaaagtcatctttttgccatcaaactgttgttcacttatgcatgccctcttcctgcccctgcctctccttaggacaggtacagactggccaactcactcttccccttcctctgctctaaataggaacatataaaattcttcaaggagcaagaaatagaagacctactatataacatacagaattcaaaaaagaggaccagagtcctgttctaggcccagtcttttctgacccagtgatcagataaactatttttgctttctatgaattcctttcagaaagggaaaagaagtactagaacattgatattggtaaattttttatccagactgatactgctttttttaattttcagatttcacaaaatcagttttccataatgttgctgttttaaatacaggccgcgttggaacacctcactttatggccccagaagtggtcaagagagagccttacggaaagcctgtggatgtctggggctgtggtgtgatccttttcatcctgctcagtggctgtttgcctttctacggaaccaaggaaagattgtttgaaggcattattaaaggaaaatataaggtaatagactatggccattttattttccatacaaattaaatgatcctgagaaaggtacttgtcttgaagttgttgtctgtctttgctcattaacttactactgcctgaattcctaccccgccagagcaaaggtctgtgttgccatcaggacccagtagccttgtgaagcacagtggggtcttgggaagtttgagtcaccatgagctcaactcaatgagcagcagacttctgtgggccttttttgtatagtttaaagcccttcatttttaaagcttttttcttaattcataacactcaaatggaaatttcactcaggtactttttcagtcatttcttatcttaattttaagtttccaccatcatagccaaaaaagtctttatattgcagagtgaactgacatgtgagctttacaacatgtttcataataacagttcacaggtactttctttaaagaattctttttttattagttttgtgtatatgtctgcatgtaggtaggtacatgtgaatgcaagagtctgcaggagatgttggggaccctggagctagagtacaggcagtagtgatcccacccaacacggataataggaagcaaactcgagttctacggaagagctaagccacctcttcagtcccatcttagggacattttgatatgacttacacattcatattccttagctactatgcatcaaaagcctgaaatattatcactgtcttgtaattactagattactgctttcattattaaaaatcaatgctgtgactgacattatggagagttatatcaaaaaagccctaaggactctcagaaataaataagctgaaggtccattcacagtcccaacccatcttactctaactatgtatcaatacatatatctggtaaggtctagagctgtgatagtgtgtatctggtggcacttaatgctggggaaccccccccccattattactgaagctcatactttctatacaactgaatcattgcttcatttttggccatgcctgataatgtaagaccaaatataaatttatataacactagactcccaaactgtgaagctgctaacatttcttttctatttgtcagtaatgttataatttttaagatttattttatttttaactatgtttgtgtttgcatgtgggtataggcaccagagagaatagttgccagtggaggccagagacatcagatctccctggcgctggagttacattacaggtagttgttagacaagtcatgtgaaagctggcagttaagcacaggatctctgcagcaccagtattcactcttaacagttgagccctctttccagcccatcatatggaaaggtagtttcagagttacagccttatccttttaaactataaataagcacatggaggtgaaaatggcaaatactttagtttaccttgtgcactgtccactcatgagagcaaacggtatctttctgaaacagaagttgtaagtatatgcttttctacttgtcttagagtcagttgaccagaaaataaaagtaatacttttaaagtattgcttattaagcaatggtccccctcctatcctgggagattgtgaatgttaccagtaatacaaagactgggctttctggtcaaatattaccaaatcaaatgaaattacacatgctaatgtattggaagaaactcagttgaaaatgaagggccaggcatggtggtgcatgcctttaaccacagcacttgggaagctgaggcaggagaatctttatgagtttaaggctaatctgggccacatagcaagctccagaccaaccaaagctacacagtgaggctctgtttcaaaaataccataaggaaggaaacaacaaagtcaagcacaggttactaagcatagcagcagacagtacttcatctgcagcaggacctgaactttagctgagcactttagtcagtcttctcagcagctgatggcgtacttaccacatgataaaaatctcccacctgcctttttgagttataagcatttgctaacaatagaattcttcctttgtgtttgttcatttgcttacttcctggtttccaaggcaatgtgcttcgttccaacagcgtctggtatttgattttgtctatttttaaagcattgaatacttattttttatgccttggtaagtaatttcgactgcttgtactgtctaaaaattaagttattttaaaatttcctattcttagcaaataatggcaatattattaggaagcgataaggtagcagccataccatgatttctgtaccaagggtttgcagccttgcatcttagaatttatttcccattttatttagcttttctctcttcttgcttgtcttcatggtttcctttacaaaaggcccaggtcttcagcagcagtttaaagcatggagtccacttctgccacttctatgaacttcatgggccttgactttctgttcttttctttttcttctttcttctttctttcttttttttttttttttgatatagtgtgatatgattctatcagtatgcattgatgcttctttatcatggaaatgatcaaacacacaggatagtggaaagctctcagcttcaatacttaatatattaccaatcttgttatgcatttcacgcacttttatgctattctaaaacatctcaaaaaaatcatttcaacaccatgatggtacttaccaaaagaagcagtaaaatcctgatcttggacatttgtaagaaaagctcaatgaaatcacatgaggcccaggacagggaagaagggtgttttagttaggtttctactgctgtgaacaccatggccaatagcaagttgtgagggaaagggtttatttggcttataggttacagtccataattggggaaagccaagacaggaacttagaggcagggaatgaagcagaggccatggaggaatgttgcttatgggcttgtgctttgccagtctgatttttttaatacaacccaggactaccagatgtagccctcccctcccacatcaatcattaatcaagaaaatcccacagacctacctacaggccaatcagatggaggcattttttcaactgagctttcctcctgaataactctagcttgtgacaagttgggggttgggggacaaggaagcatactatctaggcagtggctaatcagtcaccaccatgcatttcagacattgcaacacatgtaccaaagatgagcatctaaaggtccattgaccacaattccaatagaatgacaatatttaagcagtcttgtgccagttaccgcatgagattcaacaactgaaagtggttgctttagtaattttgcctctaagaaaaggaaactagaacattgtccaactgtaagagctctccctagcatacagatgctttgccctccccatctgtaagttcaaagcctcacctgagccaaagcttggtgtctgttgctagcccttggccaaactggaatgattcctttatgctgtgatgcaagtactgtgatttcatttggctttaaattattatatttattctccatcattttctcttaagaggtggcattgatctctaaatggttaaggtcagcacactgagccagagatgtagttccttggcagagcacttggaccagggttctgtctccaacactgacaaacaatagcaacagttacaaaagctggatactataagaagcccctggtaccaggcaactcccatatggtcattcagtcaggcaacttccccttttgccactaccttcagttcccacttcccttcccagctccaagctctgagcaatttccttgagtgtttttctcatttctggccttagacatgtcctctttcccaggagccttccaatttttccctcaaagatacacatccattatcaatagacttgaaaaacgtgtaattctttttgtttactttcactcagttttaccacatgaattagttgtctcgtctctaaaagaaaggacttcactgagtagtgtacaagtggaattggctattttacagagatatgatgataatatattttttcttatatattgaataccccagtcagaatatccaattaatgatttttttatagcttcacaattaatgttgcccccagttttgttttagagcttgtgtgactgtttctttcttccctttaggaatttttccccagtctaggctgacctcaaactcattattcccttgccttagtatctcagttgctaagattaaactggtgcataccacactcaacacctggtcctaacgttggaagacactggttttcaaatctttagctgggtgtgatggtacagacctgtaatcccagcacttaagaggctaaggtagaagcaactggaggttcaaggtcaacctggactacactgtgagttctagtctatcctgggcttaaggaaaccttgactccaaaaaggaactttctttaagttttttcacttcaaatttatttcagtggaccagtatattctagcctttttagctaaaaatcaaaaactagaaaccagcgtcatgagcagacctttcaaatattgaaaatattataatatagcagcaccaatacaataattgctgatataaataatgaggaacaaaaccacaaagcactgcatgtcttcttccttgggaagcaggtctttttttttcaagacatataaagatgtatttatattatgtatgtgagtaccctgtcaatgtcttcagccacaccagaaagggcacctgatctcattagagatagttgtgagccaccatgtggttgctgggaattgaactcaggacctctggaagaacagtcaagtgctcttaacctctgagccatctctccgggccctttaacagatatactaagtcatgaaaagtgagagaagttgaattgacttaaaattcatttttctcatgatcctcattaataacttatttagctctgaggttaagaagtagaatatgaattactcctcaaagatataatataatttccatagctatatcacaactgttaaatacataatcaatgtttcttatagttgttacacttattttgaaagatgtgtcgcaaacctggcaaaggctcaggcaaaatccctatttgttgttgttgttattttgcttgcctgtgctctcttatttcacctgttgtaactttaagaagttatgattttgattcaatgtgtatattttacatgttttctcaatgtgtctcttgatagtcttgttctaatattcttgcaaatttgtgtacttttttcttttttttatattactgggtatttatttcatttacatttccaatgctatcccaaaattcccctacaccctcccacacccactcccccacccacccactcccacttcttggccctggcattccccagtactgaggcatataaagtttgcaataccaataggcctctcttcccaatgatggccaattaggccatcttctgatacatatgcagctagagacacgatctccgggggggcactggttagttcatattgttgttccacctatagggttgcagatccccccagctccctgggtacttcctccagctcctccattgggggccctgtgatccatccaatagctgactgtgagcatccacttctgtgtttgctaggccccggcatagtctcacaagagacagctatatcagggtcctttcagcaaaatcttgctagtgtatgcaatggtgtcagcgtttggaggcttattatgggatggatctccaggtatagcagcctctacatggtccatcctttcttctcagctccaaactctgtctctgtagctccttccatgggtgccttgctcccaattccaagaaggagcaaagtatccacaccttggtcttcgttcttcccgagcttcatgtgtttcacaaattgtatcttaaatcttgggtattctaagtttctggggaagcaggtcttttaatctctgttatttgccctgagaatgttacaccgaaagagtataatagtaagtgttgacttcttgaagataactgtgtagctttccttgtttcctcctcagatgaatccaaggcagtggagccatatctctgaaagtgccaaagacctagtacgccgcatgctgatgctggatcctgctgaaaggatcactgtttatgaagcactgaatcacccatggcttaaggtaccgttgctcccaggtcaccatccacactgcccttaaagaattctacaacatggaccttttcaccattacttgttcctcagccttaccatcagctttgtccattatgtttgctctcttgcaccttgtccaagacatgtttgatatttagctattggactgggcacaaaatcaaattaaaacaggctattgtccagcaaagatgaaaaggaacatctaaagtaaccatttcatcttacattatctttacattgcatatgactgtatactctgtaggatttcactggttttcagtaggtgtagatttacagttttagaggagagacacatgtagaagttggttttgtatcccatttttctggattaaggaaaatcaaatcttaagacatcagaaagtagtattgtttcattaaagcattgtgccataattccaggaaattcttgcttcataaggaagaatacatcctcagagatgttcagaattttgccataagtcacaaaagtttttactgttagagccaagattttatttagttcagcctaccatacccattatttatgctatatatcctgtccctctcactaacttgatgacattgctccagctacttccctctttcctacattatcagttttctggatcttttggagttaatgtgttgtgattgtttttattgcttacatacacatgcatgcataaacatttgccttctcttgatcctacaaattcctccagcttctgcccctactccttggttctctcaattacaaaacttaaaagaattatctgtacccatttctccaatctttcctatccctttctcttaagctcattcatactagtcgggatctaccaaccccactaaaacaattcgtattggctatgggtatgcttcagtagagtacttgcctgacatgtgcaaggccctgagtttcaacccagaaccgccaaagctcaaaagaaagccaactcttgtctagtcactattgaccttcacatcactaagtctactgctcaaattccagagctacagctgcttaatctgttgacaacatttgacatccatctcgtgaaactttctccccttgactgccctctgtttctcttctactagtctgactgctcctcctccagtcttgcagattttccatcacctccttatatgacatcacatggatgtgccactgactgacctccatcccagctctacatctctttctccatctcactctatatgtgggaggcctcattaagtttgactgtgtttaagtatctgtacatgatgagtcctgaatccaggcctctcacctgaagtattcttccttaacctactgtctaactgggtttcctggtaccttgctgatttaaccatttcctagtctcctgtgactcagtttctgtcattctggcctccttgctgatcctcagaccacagtgttgcctcaacattcctgtagtaatcatgctgtctctctagaatatcctttttctaggtcactttggggatttccctcacatcaaatcaatatttagataccagcttcttctggtgactattatatcatgatgcttcctcagaggttatgtaaggcactaagatatgtaaaaatatcgatcaaaaatgtatcttggtgactacgatgtggaatgatattatagagcaattttgacatttcagtgaatcttgatccttcttgggctgaaggggtccaatgataaagcacccataaatcctagcatgcataaatccctaagtatggtccccagtaacatttaaaagaatattacttttgaaatcttcattcagccttttgatatcttactactagtatttctggttttcctagcaaagaatagattattcagtactttctttcttttagtaagttttagtatgtttttctccctgatatgaaatgaaaatcttagaagattcctattccttccttgcttctctcagctttttctaataagggtcttttgtcatttagaagttactttaaatgccaaataaggacactagcagctgtttaagtcatttttaagatcctttataaaaagtcttagcattatacagttgcagtggcttacattatcaaagcttatcttgtgtaataacgtacttcttcctggaaattcttgtttctaccgatgattatagatagttctcaccctaagtagtctgagctgtatacagaatagatttctggcaccaaaaaatgttttaaaatgtcagtaatataaaaagaaaagtctggaaagctgaactcagagtcacctgctgtgtgtgaactactgcttattcacattgtttatgtgtcatctggagatgatgcagtcaataaggagcttatctagctggagggagcaactttagtttacatttagtccttgttcctgtagatatgtgtcccattacagtgggcgtaagttacgttgatttagaaaggccaaaatgtaagccttcatttaataaaaatgcctttaataactacaaagcaaagaaagggaataatgaaacttatgcaataaagtatccaaagtcaaagtatcattgttttaagtcaaaaataagagcaaaaagaattatttctttggtttaaaaaaaacagatatttttatttattccatgttgaaaaagaatctgagtattaaaccaagtaatatatgaatcccttatagttattgactttcacccttttaatgtctttatcttattaatgaaataatggattaatgaaaacttgctatgaatattcatcctaaccaaagtagaattaagtaaatactgagttcagggtcatagttgtagtgaattttctagtctgaaaggaagcccgcgacagactgtaaatagagttttcgatgttactcatggggagtaaagacagagggttttctcctgcatggatagcttcttctgtgggcatttcctggggctcattttctcagggtttcttgtcctttgacttcccaagctgaatcaaaaaaaaatgaaataaagcaaagtaaatagaataaataaaatcgcagcaatatcagcctaggatctctcctctaaccctcaggcccctaaactgtctaccttcctttctccagctttcagtcttcagccattacatcagggaacctccccagggcctttaatcagcagaagcatgcgatgacatgtgattgcgttgtctcaccactcaccactactcattcctttcagcacgtcatttctgaactgatttccttattgtcagtacctaacagtttggggaaagtgcttatgtattaggtagggaatattgtcacaatcaaccgtaaaccccatttgttgatgtgtatccaaataagacatgcatctttcaagctgcttgtcctagtcttcccagtacaggaggaatcagacttccatttactcatacccaaaattgtggtatatcatggtgtcttcttcctcccattacccatagtccgtcagaacaccctattctacctccagatacatacatagctaaaaactgttatttgagggacactagtaagaggatgagaaacaagctataaactgagaataaatctttctaaattatgtatctgataaaggacagaattcttttttttgtttgtttggttttttttccattttttattaggtatttagctcatttacatttccaatgctatagcaaaagtcccccatacccacccacccccactcccctacacacccactccccctttttggccctggcgttcccctgtactggggcatataaaatttgcgaaggacagaattcttaaaactctataagaaaacattgaatctgatgcaaactttgaaaatacttaagcaaacattttttacaaagatacgcagatggctgataagcatgttcaaagctgctcagcattagtagtcattagggaaatccaaataatgccacagagagagacacctgtacacttgggttagaatggcttaaataacaattgttagggctagacaggtagctcagtggttaaaagcactggcttctcacaacaatctgtaactccagttccagagaatctgtgccatcttctggtcttcaaaggcactgcacacacatggtgcaaatctacaggcaaaatgtgcacattaaataaatccaaacaaagaattaataaatgtgactaatcacacatactgttaacagagatgcagaatatctataactcatgctgttactacgagtgtaaaaggatatgttcagtttgtaaaaacagtttgactgcctcttaaaaagttaaacataactcatttacatggcctaaccattctgtctgttccttagaaattaagtgtatattcatacaaagagtgacttgtgtctgaatgttcataagaaggtttttttttacatttatttacttacttacttactgccatgtgagacacattctcactccttggacctttgtgctaggtactttgctctatttcagttgctctctaggtaaatagtaccccatcatatgttaattgtttgcttactgattgccagtctggctagttgtgacttgtattctccaaggactaatgaggttgaccattttttttcataatgtttattggccatatttatttcatctttggtgatgtatccatttcattagcccagttgttgagttggttgtttcttaggtctcgttagtcctttgtacattccagatattacgtttctgtcagatatttgtctagcaaagatttttctgtataggctgccttttcagtcaattgatagtttctttgttgtacagaagccttttaatatcatgaggtccatttgtgtgttgttgaccttatttcctgagtgaccagggtcctattgagaaagacctttcatgtacctaaatcttcaagtgtttccctatttttttttcctttagcagttttagaatttcaggacttccattaaggtatttgatccatttggagttgacttttgtgcagaataaaagatagggatctagtttgattcttctaaaatagagtttgaaattactctcttggaattctaaagggctgctacaaaggaagttatttctttctgggcaagggcagatgcagaccctgtatggatgaagtggttgaattagatgcccattgaaaagtctgtcctagttggaagactatacatttttttgatgttcagttgttgctgacagtacagaatgctgaatcagtatagacttcatttttaagagctcattttacctgaaagttcataatgaagacaacttcaatacaacatgtgtatgtgtcttcaaaaaaaaagctgtaaagaaagctattattttgcatgctaactaaaaaattaaatagaaaaagataacttcatacttttataattattatgaaaactttgtctaaaaagtagataatctattactttattcttactaagtccttcattcttactagaaaatattatttagccatcaattttaatattcgtagaacctctatcagaatttgtatcagtatatagaataaaatagcctagccagttccctaaaattaaatctcaacgtcaaatcgaagaatatgaccaacacaatttatgttaagcttcttgattttctcagcggttatgtatgatcataatcttcttttataggagcgggatcgttatgcctacaaaatccatcttccagaaacagtagaacaactgaggaaattcaatgcaaggagaaaactaaaggtaaggttttaagaccctaagagctcactagatggagtttgtaatcatgcttctgttaggtttggatcttcataatcacatccttgtgttggccattaattttgctacagctaaattatctctaaaaattgttgctatttcattaaacttttgggtatttaaatcaaataaataagttaatgtttcagtatgaatcaaaacaaatttagcaactagaaggcacatcatattttagatttgttttgttctgctaaacttcatagcaaagacatggctacattatgaatctaagctatgtttttccaaacataaatatctggacaataacatggcacgtgtctgtaatcccaccactaaaaaagctgaagcaggaggtttatgcatttcaggccagcctgggctatatagagacactacttcaaaatgttaaattaacaatgataagactttaaaattgttaaatgtgaccttagttctctggaaactgcagctgagtttacattggctctagggttcaacaaccatcttaaagcaataaataaaaggcacactgccataatgtatgagaaaatgtttgcagatctcctattatcctttattctttctccgtggcttgcttaccactctccctgccctctgtctcaaaaagtaaaggagcacaaggataatggctcctcacagggagccattgtagttcagaactttctgacaaacacccacaattcagtggtggagctccccagctctgggaggaaatgctatggggcagcagaagctcgccacaaagatccagaggaaatgattgatgtttgtttgatctgtgctactgaacgtgttaggtctgttctagaagtagctgattggataatagtctctaatcacaagactcctaccaactacaaaacttctggagtattttcagatgtcttaaattataatactatttatcattctttatgccttgaagattatgaatggttttacacagctggaaattatatgtaaatgttttggggagactctcagggtataatagtaccatagaaggcagaaatgcccacaatggtgtccattagccacatgtaggtgtgtgagtctaagttacttaaaatttaaaaatccaagtgctagttccccattcataccatcatgtttcaagagctttgtggcctagtagttaccttactgaacagcacaaacacaaaccattcctaccctattaaaagattccactggacgtgggatgctgctgaacagcagaacttttcacacatcactgttaatgatgagcatttttagttaagcttttctcctaattcttttgttgccaggagttcgaacgggctcttctctatgttttttgtaaaatccttggcaaaaaatagttattaatgatatgccattgttgagatggtgcccggagaagtttcttaaggcttaacatctttactttgacgtctccctgaactgctataggctgcaaaggaaagaaaagctggtcagagtaaaatttgggcagctctcttgcacttagttgtttgtccaaagaaacaatgtctgagcttctttcttaactcttctctaaatctctttcatccttggctctgctttggcttcacataacattactctatgcaaggtcaaggcttcattgcccaaacagaggtgttccactcaggcttgagctcacccatcacaggagacatgctcttcccttggtgccacagaagcagactggaccaaaaatagccaaactggtgactgagattcgtttggacagagctaaactatcacaacaagcaggggtcatgtggatttaccacatccctttacagggctattaaaagtctcaagacccgccaagctgtgtggaattagaaacatcagcctgatgattgtgggcttgttttcagctaaggctacattcccagagttgtcagctaccaggttagcacgtgcaacaccttccttcctcagggagcttattctccttcttatacttctatgaagttctacaacaaagatggtaatttccctggtttccatcacccaccaccccacagcttatttccacaaataaacagctaggtgcctgctcatctttacccccagacactgatttaaagttcctcaaatggtgcagcaaccaaaattttaagaccactttagaaatgattctaaaattcactgaaaagatgctgaaagccaattactgaattttgattaatagaaaaaaaaaagaggtatagagcaatgcaagaagaagtacctcaaactctgttgagtgggtgaatcctggttctctatgcttcagtcatctttatctgggaagtatacatagtacaaaatgcagctaattcctaggagtagcaggatccaatgagctactgttacagcagttagaagaacaccaggatgtggtaaatgctccaaagatctcttttgctattaactttgtgatttttattaatacattattaagattttaatggtactaccttagatttattaatctataaagactgtaattcccaaataaatattgtatgccattttagagtcttgctagtcattcactttaatattttagaacttttagaaacttttaaccttttattacttcttatttattttgtgcgcctgaaggtcaggaaacagacatgccatgccaggcatgtggaggttggagggcagcttgtacgaggcaggcacctttacccactgaacactcttgccaggcctgaggaacactaaaaaaaaatgtataaaacattgaaaacttttactgaataatccttcttatatttcttccaaagtaattatgcttagacttttctcactacttattatcatttccctctaaattatctacaagaagtttttatacttgtaggattatactcacttccttgtaactattttccacaagtaatatagccatgtaacataccagacccttactaggtgcctgaaaaatttgttttgaattgcatatattctgctgttttataaataaatatgcttctaataaattataataaatcaggcacattaatatttataataattaataataaatgcaataattatagtaatatgttattataaaagtcattaaaacatttaaattattggtgcctagtatattccctgtaatattttcatacaaggaatgattgtaagtaactagaactgaggaaaggcaaaacgagtctatgctcctcatgtggggctcttggaccagcagatcagcaccatctggagcatattagaaataggaattcctaggttataatatattcagataagaaaacacttccatttggaaaaaataacactatctttgtagatgacgcagttccatattatagaaagtcccaagaaattccctagaaataacaagtttataacaagtataggttatgagtcagaacaaaatgattcatatatatatatatatatatatatatatatatatatatatatatatattacatctatatccacacatattgagcaattaatagtcttaagaagaaattaagaaataagtctattcactgcaacataacaatgaaatgttcagaaataaatccagcaaaataaatacaagatatataaactaatattgctgggagaaattaggaatctaactaagtaaagggtgatttatctgggaagactatgttatctaggctgcaaggaagatctgtgccctgaggtacaggctccttaagtggtatattagttacattctcattgccgcaacagaatacctgacaaaaccaactttggctcactgttagagggtatggagacataacagcaagagtatgaaagagtagtcatgttgtgcccacagtcaggaagccagagagatgaatggtggtagccccttctctttactcagtcatagtcctgagcccgaggaatggtgctgcccacaattagggcagctcttcttccctcctcagttaatcctctctaggacactctcctagactcactggcagtggtgatagttttggtgattccaagtgcaggcaagttgacagtagaaatgtaagtatcatgacaaggcacactgtcttctaacctaagcatcagccactaaaggagttataaacaaagggatgtttgttggtatatggccttgtcaatctagcaacaagctcaacagggtatctgctctaaaagttatcccctttgcttcaggaattattttgacccatagaaagcacatttctctataatgaagcaaaatacattatatatgcatgtatgaaattctaaaatagtttaaaatgtttgctaagtttaaaaaaatctttaatcaaaataacatgttttgggataaaatattttcatccccttcactatcattattgatttttgtatacacagaagttatctattataacaattttcatttcattgtttgtatttaaaataatttctattaaactgaaatataatggaacataaatataagatttgacctttaaaggaaaaaatatatctaaatagaagcaatagtctatgtttgagtgaattaactgcaatcaatttaggaagtggtagtttgagccaagcagggtgttgcactcctgtaatcccagcacaagttcaaagctctcctaggatatctagccgtgctgttgcaaaccaccaccaccccatccaaaactagggctacagtgagttgaagccaagcagttcaattaagaggataaagccacttatacttttaatatagaaagcaaggaagaacctcctctcaagaaggctcacatgaactttccccaactgtgatttcctacatagagtctacacaagactgaggccctaaacatttagtcataggtggcagaggggctcatggggcgccaacccactcaaagaagctaatggcagactgagactgctaggggagaagtcatctttctcagtgtagtcactggtaagttacccatgttccagtggatagctcgaacctacatccatgcaggtggctcaggttaagccccatgaagtcacaaagtaaaatcagacagaagacaaaaaggcgtgaaagtaggataagaacttagtgggaggatataggaggttggggtggccaaaaaatattaaatacatggagaaattgtcaaataagaaaatcaatttataaaggaaatgaacacaagggagatttctgagaactctttacaacttcgttgtttttgcaaattgcaaatgtataccttattataagaaaacacagtttaggaatgctattttagttctttaaaagcagaaagttgcaactttatcatagtttttcctaacagattttaaatagtattaacttaaaattatgtttcatccttaaaacatgctaaagtatacctaataaatttgaagagatttgtcaaagttggataaaccagaaaaaaataagagatgtttatttaagcgatcatttatattgctgtacccaataggctcttcactagaagtatactataggagttggcaaacaatgtccagggagtctagtccaccccactaccttgtggaggaatataaagttttattaaaattcagtgtcatatattcatttacattttgtctgttgcttttgtgctttaataacagagttgagtagtagcaaaatatggacccttcaaagcctaaaatatttatgctctggctctttacagagttaaaaaaaagttaactcctagaggaataaaaactcctaaattaggaagactaatcgatggatctcagttctgaccatgggtgattgcatctttaatcataacagagcactaagcctgtctggacctcagttttccctcctatgagatgaatccttttgaatggctcatcaccaagattgggtctcaaactgtaataaaattctgtgaatctgagctgttttgaaactgttttcctgtttcacataattgtcttgcattgggtagtagaaccatatatggtcactgaactgagaaactaaataagccaagcttctaggaacttattgtttcaaagctgtttttctctcaggctcttttaagtaccagtctaagtacttgtttatagatcttcaactacagaagtagttggggaaagcctttagatgtaacactaacatacaaagaaactcagctcaactcacttggaaataaaaaaaaaaaaatctctaaaattctggtttgggtttgtgggaaatatgatttgatacataagaattccattccacctagcttttagggagcatgtataatatgcaaagtgaaataagattcttctgtagaaagaaaattcaaccttcactctattttcctatgtgactgataaagttctgcagaaaagcttccttgttttagccccatactgtgggaaatgtaggcagttgcatcaaatggcaatttcaaaaccacttgtatttttttgtgtgtgtgtgttttccccattttttgtcttttttgttcttgctgctgctatttcaagacatgatcttgctatgtagcccaggctagcctggacctcccaatcttcctgcctcaactgcaggcatgcaacatcttattggttcttcacttcctgtagtccatttttcaagtaatatttatagaaacttaatgtgatcccccaaaattagaccttgtggaaatgctgctaacattgtcatgtatgtaccaacaagtgcctacatgcatggcagatttatctttccttgcagaaaactcatgagcttaatatttaaaatttacatagaaactatgatagacttagaccacttcagtgatttgatatttaaactaagtgaacaattctatgtagagcagtagaagattcactcatgttctgcctctgttttagtgggctcagtaatgatttatacttccagaatgtccaacagttttcaaagcacttttgtttacattaagactttaggcaatgtaaaataaggcacatcccctttcatactctaagtttacagattataagacctagagaggaaatgaggagatcaatagctcagtcagaaaagtacttcctgcacaagcatgagaactgagttccgttcctagcaccacataagaatacacctaaggccagcactgaggcctctgggacaagagagaatacacaaacgtgccctggggcagagacaagaggatccctggggcccgctgaccagcccagcccagcctagtctcatcagcaagtccctgttcccagtgagactctgttgcagaaaacaagtggctgactcctgaggaatgacacctagtgtagacctctggcccttacatgcacatatgcatgcacattcatataaacatgctcaaatacacatatgtacgcatacaccatgcaagaacaggaaaacctagaaagtatgaatgatctactcaagcaatgctgtggagccagaacatgacgaagctagaaagcaagcatagcaactatgagtcttcctattgctaaaacagtaactcacattgctgtcccacacagtagtcctaaagatggcagcactctggatgacaaagcttctctcctatggttcagtgggtcttctctgtggcttctagaacccatctgtaaccaggtatgatgttgcgtgtctgtaataccagaccttgggaagaggtaaagataattggatcaagagtttggggcagcctcacctacatagcaaattcaaggccaacctgtacttcatgatatctagtctcaaaacaaatttacatgtagttgattcagatgtgcagtctgatagagagttgatgtgcgagagtaacatagtcattgttacacaaagaaagcagggagaaaaatgagaaactcataatcctcaatgataccattgttaacatgctgatatatgcttattagtttataattgttaactatttttccaaaaaaagaaatcagaatatgcactgttttgaaaccttttaaaaaatatgatttattacaagaatcttcctatttcattaaataaccttctacagcatcattttatgacagaattttgtaccatttaatatatgtgcaagtccaaaatgtaattagtttatacacttcattctgcatatggaattcatgtcaagtattccgaagttgttttgtgacacccccccccaccctctcttctagccaacgtgacttacaaatgtcactttctgactaatccttaagcttagaataacaattagtaatgccttatgtttgcatgtttgttgtaattgtgtactttttcatcttctcctgcagggtgcagtactagctgctgtgtcaagtcacaaattcaattccttctatggggaccctcctgaagagttgccagatttctccgaagaccctacctcctcaggtaactgggtaatttgctcttcaccagtgggaatcacttgccatctcttttctcttccattctgaatagtctttgtgggactatttagtcaagtcctctgagagattctaaggaagtttgtcacccacaaaatcatacttacatatgtctggttcctctttatttgaataccaaaactgtcctctctgaatgctcccaaaccaacattatgccagtttcttttttacctcaatacttcttcccctttgtacagtccaaactctgaactgcatttccttccctctattgttgtagttagattcactggatctcgatgatcatcttctcccactgcaaaaccttctaatgtcctgctttgtttatttacttagctctcttttgtttatttacttagctcctgactcatatgtcatctggcctcagctttacttctgttagagacgaaaattttatgtggtggaattttcccctctgatttgattttttttctattcttctttaaactggcttctttaatatttgcgtatgagcattagaaacttgactcaggactcgtcctacagcatgagtagtatgtcctacagtcagcagtagaagagtgcttttccctggagggtctggaattgtctgtcagtgcttagcttctgccctcttctcatgcacatacagattcaaaagctcttgccaatcagtatgtacctataccatatgcaaatgaccagactgagtttcctagtccagcaggtgtgtgcttcctccttttgtcttttacaaatcgggatatgactcttcctcttttgagcaaaggtgatttccaaacatattcagaaacttagagaagtgactgggcttcctcttgtgctgtggcatggttgtgactggccacgtcctctggatcacttcatctctgcccttcttttcttcctactatatgttgttcccatcccctggaccatttttagaagttgaacatctccctctggctttcagcatagattacagttggccctatttagggaacatggatccaggcataatttttattttgtatctgtgatgacatgaaagaggcacagctttactatatttagaataaattatctcttcaggatttatggtcaacgactatcactttcatttttgaaatgagcctagaaaacagtatagtccttaatcttgagaatttgcctttaattaatattttcctctgcccactgacaacttaatagcaccttaagtgttcttttcctggaagaattgaaatttttctttacaaaaagaaattatatttgtaaacatgcttgcttatattaaatatattttatcacctggtcctctttagtatattttttaaatgatttgattgaaacagttcctttagtgtaaatctatgtttttaaacaagcaaacaaacagcaacaacaacaacaaaaccttccaccgtcttgtaggctgccttcaggatttcatattaattgtttccaattgaacatttcttcttcgctttcctttcctgcagtctcactttgttacattcttttttcgtctctttaattctgggtacgtcatgatcttctaagcagtatatattttatttattttttttgataactttgggttggaaggcgattttttttatttctttttttaattaggtatttatttcatttacatttccaatgttatcccaaaagtcccccacaagttcccccacccactcccccacccacccactcccacttcttggccctggcgttcccctgtactggggcatataaagtttgcacgaccaatgggcctctctttccactgatggccgactaggccatcttctgctacatatgcagctagagacatgagctctgggggtactggttacttcatattgttgttccacctatagggttgcagatccctttagctccttggttactttctctagctcctccattgggggccctgtgatccatccaatagctgactgtgagcatccacttctgtgtttgctaggccccggcatagtctcacaagagacagctatatctagcagtgtatattttaaatggccatggtaaatatctgtaaaggactttttcagtgatgctatctgggtgctacaagcgaaaagtagaattagaatcaagtgaaaagtaaaattaaaatctaaatggaaatcactaccccaagtaaaggagacatttttatgtggtcagaagtcagaagcaaaggagatttttaaagacaagtgtaatgttttcgtacacatttcacatagctatcagaaatcatacatttccaaaattaatttttaatgctaagcaaattgaggaaggcattctgccctaatcaacagtattaaccgagagccatctgccagcccatggcctttctgcagccaacagtagtgtatcagcttcagaaagctgtttatgtattttatctggactcaaagctttgcacttttgtaaatgaaaatatctacatttgtttttcattatttccatctcatttttggtattttcattgctttctaaacctaaaaaaaaaaatcttccttttatccttatgcttgtttatttcaaattcccaaagtaacccttttcctgtcttgatgtttggatttgtacgggtttgttttacactgaaaaaaaccaggagcactttctgtaattacctgcaagtgcatccaagcctgagatacgagaaagaaatgactgcagagcatacgcttgtagggtgctgactgtatctacctggaccatggagttttaataccaaaatgttccttgaaagcatgacatgaaatttcttaggagaagccacctagctactgacctagtttcctttctagtgctgtgataaagaccatgaccaaaagtaacttagggaggagagggttcaccttaaagtctacagtccatcatcaaaggaggttgggaagggctgggaagatacaagagaacagtgtatttcaccagcttcctattctctaaatgtactgtctttgtgttccacattacaaaataccttttccagtctaatgaaattatagtgggtccattttaaaaaatataagcctaccaaaagtaataattgtccatcccaattttgtcccccaatatttttttcaaaattccttctacaacattctgaagtttggggacagtaactaaaactgcttagccacaaaatgcagcatgttgtttccttaaattaaaattactaacaaataagagtatgcatttgagaaatgtgagtatttaaaatcacattctaaaaagtaatcagcgccacagcctaccatccagagagaagctgaacatgttcaggtgtgtcattgtaatacaaaataatttttttctgaaaaatacttttccattttgattattgaagtttattcattatgcttttactggattaatcttatgataaacagtatcttgttgctttgttacttaattaaaatgaaaatgttctcatatttcaaagcaaagcatttagaatgagatcagagtaatgtctgaaattgggtgggggggtcagcatgggggctgtgcttgtggattatctaaaggacccaactatggcttaatgacctgcttgctctaaaatcataacgtttgtcctttgtccatatgctgccttcctcctaggacttctagcagcagaaagtaggtatccctttgttttcctctaaggtttatctttatgcaaaagtgtttggctctgcatggttcataattggcttgactttttccatggctgcttgtgtttagatgtttaaaagtgaattttaacactgtctgaccataaaataaaaacttgtatatattgattttctggggcattgttatacagctgaatttctcaattctttcaaggggtagggaggaggcagtgttaaaatttcaactatatttaatattatttcacatttgaaattcaaacacgaatatattcattctggggaaaaggtaacattttattttgaagttggctcccaagaaaacttttagggtaagtgagtttttctttcgacaattttgttacacatgaatggtttttattactgatacaaaagtcattctgtttatcattgttgggctgtgaagtaaactctgaaattgtcttttaacaacccccatcatcagatacagtggccgggaaacatacaggtatactgatacagtctcacactcatggaaactgaggcaggaaggtaacaagttagagaccagtcttggctatgtagtgagaccttgttgcagaaaataaataacaagtaagagtaataatagatatcctttaactgcaaagagatataatttgaatatgtaaaaaattaagctgtacaaaatatgcacaaacagaacatacacaaacaacaatgtgtttgggggttttgtgtgtgtgtgtgtgtgtgtgtgtgtgtgtgtgtgtaaaactgaagttgtcccaataaagagggtagattacaacaatattagtatttaaaatgcaattaaaatttaaaatttacctcaaagtaatgctgactaaaggaaagtaatgagacaaagataaattagaaaatgtgggtgctaacaatgaactgagttgccacttttgttgcatttactatttatagctaaaattataatacaaaaatctcaccatatactagtggtttgtggctgagaaaggcagcacctgtggatcacaagtagggtatggctttgctaagtgcctctgcccacctttcagaattttgcagctcacacagtagttaatagaaattttcggtttttattggataatttacttatttacatttcagatgttatcccctttcctggtttcccctccagaaaacccctatcccatcccccacccctgcttctatgggggtgttcccactcccacctccccaccctggcattctcctacactgaggcatcaagtcttcacaagaccaagggcctctcctcccattgatgccagataaggccccttcccttcggctccttcagtccttcccctaactcttccattgggttcccagtgctcagcccaaaggttggctgcgagcatccacatctggattggtcaggctctgacagaggctctcaggagacaactgtatcagactcctgtcagcaagcacttcttggcatcagtaatagtgtctgggtttggtgtctgtatatgggatagattcccaggacgggcagtctctggatggccttcaaagtgtggaatagaaaatttctaatcttcactggctgtgggcttgtcaacaaggctgttcacaacccatcagcttgctgccccaaataaatgactaaggggaaggcaggggttgttcctcattgttcccaagacaaggaacagttttttaaccttgcatcagaagtaacattctctatgctcaggccccatgccaggagaagtagttgtgtgataaacagcaggggactggatcttaggggttcagaggctaatgacatatccatgccggtgactataagaatggaaatcaatcaagcaattaatctattcttcccctccctccttcctctcccctttccctttttctctcttctatccttttttagtcagccacatctatcaccatatttgggaaggaacatcctatcggtcatacctaccagtctgtataaataacaatgcaaatgagcatttaaggctagcagaatattgtcaaaatactttgaaaaatggtgctcaaaaatgttactacttgtgcctagtggtgcacacctttaatcccagaactcaggaggcagagacaggtggatctctacaatttcaagtccaacctggtctacatagtgagttccaggacagacagagatcttgtctagtttattaaaagaaaaaaactaaaaaagaatattactacttggaaacagactattttaataaacataatgtcactagaattgtagcccttgtatgctgacaaaatgtatatgtagaattccttaagaaacttaagctaaatacatttttgaggtgcctgtgccataatctacacaacaagaatctaagacatttactatcatatccaagttttcacaactagaattggatatagtacacctgccagcgctcaaaatgcagtttccactgtgaggttcactgttgcttataacatgattgaaagcctgaatttgctttattttcatgcattggaaataaaagctgttggctaggggatggtggtgagaagaaacagactgcaggttgacaaggggggatattttttgagtgataacactgtacacttaaattggtaagtttaaattaataatgtatacttcagtaaggaaaaaaatgagaccaggtctctcactatgtagccctggctagcctgggattcactgtgtagtagaccaaactggctttcaactcagagatctacctttctctgtctcctgatgctggcattaaaggcatatgccaccacacctggaaagacaaattttttcagcattatattacttggctggggacagggttcccacctataatcacagctcccaaaggtggctgagacaggataatcataacttcaagagcagcctgagctgcataatgagaccctgcctcaggaaaggtatcatgttgcaagggagagtgcatgtgtagtggtgtagtggtgcattagtgagccactcgtgggataggcatagttctacatgtaaacaagaaatgcacgtggatcttccctgaaacaactgccaggtaaatgtgggagcaccaaagcccattaaatggtaaacttaacatgcgtgtactttgctgtatttgaattgtatctgagagaagaattgaaatcttcgctgaagtctctatgaggaagtgactggtgtcagccattctgccacttactgtaacaatgagaaatgtgatgaattgccagatggatagctggtgatacatgtgataaagcatacagtaagctgtggcctatgtggttgtcagactttctgcctgcttggaattgctcagagtttgctctgtgtggggaaaagggtttgagagagagcccacatcagcgctgagaacctcttagtttaaacagtattctgtttatttttctgtcgtccttttgggtttatttttacttggtaaaatttttttgtgagacttttccactcttataatgaaactgctctgtatcccaagctttgattggccttaaaaacatattcctctttaaataaatagacctaaaaaacatttttaaagtagttgatatatttatgctattttgactgttgtttcataatagtaagagaagacttttcagaaaacctttcttagaagtgagattctttggaaaaggataagtgtttaaaattcagttgtatagtttttcaatctgaatttttagaaacaagattgattattgaatgaacagtggaaaatgttaccctaagacaggtataattgcttttagtaaatttgccaatgaaaaagtttgggccaagtctgggccagcagattggtcagtggataacaaatattgctcttacagaggacacaagttctgttcccaggacccacatcgggtgattcataagagaattcataactccagctcatctcgctttcacaggcacatgtacacaggtatatatagccatgcacatactcacataaataataatttttttttaaaaggcaagtagtggtgacacatgcctttaatctcagcactcaggagacagatttctgagttcaaggccagcatgatctacagagtgatttttcaggatacccacggctacacagaaaaaccctgtcttgaaaaacaaatgataaaaataaaagtgtggcccaaatgctaaaaagaacctcatatggtaaatacaaattggaattaagaagaaaatagagttattgcaaagcacagcattactgaacacatgattcaggtgcattgctgaaggtaatctgtggtttgaggtaatagagaagagcactgcaacaggagtcccaggtgggtgctgggattcattcctctgctccctgtctgtttgtggcccttggataggttattgaaccctcataatatgcctctagtttttcaaatacaaaagcacttgcctacatagcaggttattgtaaagtcacataagatagcaaggataaaaacataaattgtcatatgtgtgttattatgaagataatttccattatgatttttttttctgtgcatggtagctcacacctgtaatcccatctcttgggaccacgagacaagaaaatcaggaacttgaggtcatcctgaactatatagtgagactctatgtccaaaaaaatatttttttcctatgggtaaaccatctattctaatccttacctctaaattcttaaaaatttgttcaggaaaaatcaaggaccctttgaagcatccttctcaaccagacattctaaaagtctagcccaaaacacaagagctgatagggtgtctgtggttatgccattagatagctatctcctagagaaagcttgtgaactacttaatggctgatttttgtaaggcagttagaatttactctagggttttatagggaaaacatcatcttcaatcttggaaaagaatgcctggttcctatatgacaatattgatctacagtgaatactagtaactgcttaaacgtgtgtgtctgtgtgtctgtgtgtctgtgtgtctgtgtgtgtctgtgtgtgtgattgccactacaacctgtttttaaaatctgaagcaacagcaatggggaagccctaccaaagtctttgtgtccattcattttttaaatttttttaattaggtattttcctcatttacatttcaaatgatattccaaaagtcccccataccctaccccccccccactcccatacccacctaccttcttggccctggcattcccctgtactgaggcatataaagtttgcaagaccaaagggcctctcttcccagtgatggcagactaggccatcttctgatacatatgcagctagagacacgagctcctgggggtactgattagttcatattgttgttccatctatagggttgcagatccctttagctcctttggtactttctctagctcctccactgggggccctgtgttccatcttatagatgactgtgagcatccacttctgtgtttgccaggcaccagcatagcctcacaagagacagctatatcagggtcctttcagcaaaatcttgctggcgtatgcaatggtgtcagcgtttggaggctgattatgggatggatccccgggtgtggcagtctctagatggtccatcctttcatctcagctccaaactttgtctctgtaacttcttccatgacctgaaaaagtgtccattcatttttattactttttttttcattgaaacatggtaggtcttttagatgggcttggtacatgattagagatacctgttgtacacatttgtcagacctaaaatgtgttttgtggttctgctggtcaaacccaaagaaagaaaaaacaagactgcaggacatggtggtacaagcagaggccggaggatctctcagtataagtcccaggccagccagggccacatagtgagtgactcgctgtctccaaaaggatgagagagagagagagagagagagagagagagagagagagagagagagagagagagagagagagagagaaaagaagaagaagaagaagaagaagaagaagaagaagaagaagaagaagaaggagaaggagaaggagaaggagaaggagaagaagaaggaggaggagaagaagaggaggaggagggagggagggagggagggagggggaggggagaaagccttgggttcaatccccagctctgcaaaaaataacaatagtggccaaaggtgaagaaagattttatgattggacaaaaacattcattcaatttaaaagatggaagggaaataaattaaaacaatagttctcctatataattgcaaaaacttgaagttagggaccttttgcagagctggaaataggtaacttgcatacaactgaagaaatgccccgctttgtccattaaatgaatcctgtttgtgtataagctatgactataataagtcacttcagaagtgacaggtaaggaggtttagtaggccactggagaccatgggaatgcaggctaatagatgtcttcgatgttttcagaaagataaccatccgctggccccatcagcagatacatcccttggttaagatgggggcttcctgctcatccccctccccagtcctatcccaggactattcacttcaaggtgtagtttgcctattgcctacaccaacctgagagtcccttgaggccttgagagcatatttctgttttccttgaagcccttacctagtacctggccaaaggaggaacattcagttcagtaaggaacctggtcattatctgacccagtagggtaaagttgtattggctagtaatagaaactaaagaattgggagttgttgttattgtgaattctcttttgataacctcagtatcattttattccactagccatgatgtggtttggagaaccaaagattcataaggacattggtgactacttttttttctacatgttctctttccaaatctttcaataagggaacaaaattgattttgtgctattttacaagggtttgttgttattattctttggggctcttgtttgttttgcttttgtttgtttgtttgtttgtttgttgctacactgagcaaggtaaaaaatccaaagaggaggattgtgtccttacatctttaggaataccagggacaatgggagctaattcctaccttgtatctttttattccatttgatatctccttaaggttcctggtgaaaaatctcaatagcctgataggcataaattatccaaaatttaaaagtaccaatagttacttcccaacaaataaatgattaaactggcatatctgtgccatggattatacaactaagcaatgaaggagaaactggatgactacagggacgtatgctagggttcaaaaataaagaagagccaatctccaaagatcatatgctatgtgatttcatttagatagcctccctaaaacagcaaaattagagaagtggaaaacaggttgttggttgtcaggaattaggaaagagcagaatgggaggcaaatgaatgggtctaaggcatcatgacaatgccttgtagggatggatgttttgtagcttattgtatatgtcattacatatgtcaccatattgtatattacatatgtcaccatcctgactgtgatatctactaagttctttttcagatggtattttcagagaaacttaaatctttgtgtcattttttacaagtacattacatctataactgtctcaaaataaagacagatttttaaaatagtcacagtagttttcatgtggaatgacacatgatttgtgacttaaacaccaaaatttaatgtaactaaatagcactacaaatataagtagcttatgcagcaatttgtttttgctgttgtagaaaccttggaacatatgagcaaaaaacagggtgaactatgtaagaaaatgataactactgttagacttctgctgtatttagatttattttttccactgtgtgtgtgtctatatgtctgtctgtcttgttttttttactataattagggaaatataagttccatggttttgtgtctacttttctaaattttatattataagaattctcctatgtctttaaatttttttcaaaaacaattttcattcatctatacatgtcattatgtaagcatcctaataatttacgtgatcattgtctattaaatttatctttcatttataagataaacatccttgtacagaatccttctatttttctctttagggtagatttttgcaaatgaaattagcacattgaaacacatagacatttaagggttttggtatatgttgcctggttaccttctggggaaataaccctgatttacattctcaccaataaacacattgtaatattagggtaggaactgagaagaagaagaactagaaacagttcctaaagaatattttatttttgtctgaatcagggtttttcatactgaatactgacattttgggtcaggtgattcttagttgtagggtcctgtcctagatactggagaatattcagtatcacccctcacctctactactacaggccaccctcccttcctgctgttgtcacaacccagagtcgccgcagaaactaagaaatatcccctaggagagcaaaatcaaaccgtcccacacagtcaaggaccactgatccgaagacttagctacaaatgaagcacttattttcagacttccttggtatatacaaatgcgctcaggcctcttgggattcttttcttatggagtgtatatttgcatattatgtgtagtgtaaaacagattggttctttaaggctgtgtaaatgactttaataatattcatgtttatctttcactaatgatacctgcctactgtgcactcccattttctttttcctacaaaagaactttctttaacatatcctgtggtaattggatgtatccactatgcacatgtctgttaacctaccagccctttgtcattgagtctgtataaggatctgagacagtgacagtgactttgcttctcttgactccatatgtaaaatttcaaaaaggaataaatagactgaggtctttgctaactaaaactaaaaaagcctccaagcttatattaagtaccaagagctcttagttgatggtctctgactcttatccatagtttcttatactgtcagtatgtaataaaatgtgtttataatattgcaaagagccttaggatcccaatacctttactgtctagctgatgtataacttgcagcacccagatcatctattatagtagcccagttctgttgacagagtgctttaattttaaaaaaaaatatttattttatgtatgtgagtacactgtcactgtcttcagacacaccaggagagggcatcgaattcccattacagatggttgtgagccaccatgtggttgctgagaattgaactcaggacctctggaagagcagacagtgctcttaactgctgagccatctctccagcccaagtgctttaacttaaacatacaagattaagttcactttaaaagcaaaaggcagaaatactttgttgaggacataaacacaaggtattctgcccttaaatgacatgaagcatttgagcttctccttcataagaacacaagccttctcagttctgatactcattgttattaagtgtaagcttagggttggaaaggttaatgtaacactgactatgcactagcagtttctttcccatttgtccccccaggagccgtctctcaggtgctggacagcctggaagagattcacgcacttacagactgcagtgaaaaggacctagattttctacacagtgttttccaggatcaacatcttcacacactgctggatgtaagtcttgtctttttttatttttcttgtttgaagaacatttagtatttagcagacctcttcatagagattcccagatcttacagcatagtactcccttttcaacttctttgtatctgtgaaaatggggaaaaccatctagtaccggttccaaactaaaataatcatatgcgcagtacaaatgcagtatagcctaaccagccacaacagggaaattgtgtgtacttataatttgtgcacacaagtgatgagcaagattgttagagtgtagcacaaccctaatttaccaaggtaatttttctactataacaaattattaatcttaacagtgatttctctctattgccttaaaacattatttctcaatcatgcatacagaagtgataaaaaactaagaggatactgtgcaatggagtaggtctacacacatacatatttaatatcactgggacaccaacatttgcaaatttggtatcttcaaatataaaagagtgtttcattattaaatttggcagcagattaggacccaaataacaacaaaaaaagcccagaagcataaccagatgtggtggcacatgcctccacactcagcactcagaagatagaggcaggcagatctctgagtttgtgaccatcctggtttacatagaaagttataggacagccaagactacatggtgagaccctgtctcaagaaaagaatagaaacagaaactgaccattcgtgtctgttttcagtatactctcagaaagcatagttgatttctacagtgaaaatcgtgggtggttctgatggtaatagtgcatttcaggtggtgtgcaggaaattctttcccttaagaagagaacataacttctttaggagacctagaactgtttggtgcttcttgattcacccaccgttgatgcagattgcactaaggcacagcaggatgtgctataaaacattctgctaggtaatgcggggcaggaaaggaaaaaggggctttaactgattggttatttgatgactaaataagtgtggggttcaggtgggcattgttaccagtgctaagatgtcctgacgaaaaggaacttttttgacacaggatctctcactaaacctgcagcttttgatttttctgggctgactggccaatgatctctaaggaccaccctacccccagcattgaagttacagacacaatgctgagcccagctctttatgtagattctggggctctgaaatcaagccctattgcttattacctggtgcacacttcactcacagatcatctacccctcccctggtttgttttatatatatataaatcaactcactaactgttataataaacagttctaaattatgggtataggagctggaaagagagcacacctggttatccagaggacccaagttcaattcccaccacccacattagacagctcacaactgcctgtaactataagagatccagtaccctcttttggcttctataggcaattctatatgcatttgcacataattaaaagtagtgtagagttggtaaagtggctcggcatatgaaggtgcttgctgccaagcttgatgacctgagttcaatcactgggtcccacatagtaggagataatcaactcttttttttttttaattgtatttgtaattcattttttacactccatattttattgcccccacccccatccaccctccgactgctccacatcccatatcacctccccaccccacctcatctccatgtagctaaccccacccccacccccaccccacctgacctctaaacttcctggagtctccagtctcttgagggttaagtgcatcatctctgaatgaacacagacccggaagtcctctactgtatgtgtgttgggggcctcatatcagctggtgtatgctgtctgtttggtggctcagtgtttgagtgatctcaggggtccagattgagacttctggtcctcctacaggatcacccttctcctcagcttctttcagccttccctaattcaacaacaggggtcagttgcttctgtccattggttgggtgcaaacagctgcatctgactctttcagctgcttgttgggtctttcagagggcagtcatgataggtccctttttgtgagcactccatagcctcagtaatagtgtcaggccttggggcttccccttgagctggatcccactttgggcctgttgctggaccatcttttcctcaggctcctcccaacctcctatttcctgaggttgcctgtttaaattctttctgctgaccctcagggcttcagtccttttccctcacccaataccagatcaggcttccctctcccccgactccccaccccatctgcttttcctctcaggtccttccctccttccctgcttttgattgttttcttctctctctcaagtaggactgagacatcttcacttggacacttcagcttgttgagctttttgagttctgtgggttttgtcctgggttctgtactttttttggctaatatccacttattagtgagtacataccatgtgtgtcctgagttatctcactcaggatgatatcaactcttatacattgtctttgacctctgactttagaaggtaggggacctagaaaatacaatttagacacaagcatagatttgacatgtaactcagtggtaaaacatttgtttagcacgtacaagatccttggtttgatcctcagcactcacgagactgaggcaggaagaacacaagctagaaaccagcctagtgtgcatagcaacagtgtttcaaaaaagagaatgtatggatgaatagctcttgggaagaaacttttcaaactttgcccatccatttattctccttctactactccacaccccatgcttaatatggatcgttttgtttgacaggggcctcaacagtgacaaccactgacagaactgattggtataagtatagatatatagactgatggaacaaaaatatttagaaataaactcacatttataactaagatgtcacagaagatgtcaaggcaattaaatggcaatgcaatagtctttagatgggaccaccactattgggcctccataaggaaaaatatgaacttggactcttataccacatacaaaaattatctcagaatgaaccataatctcaaagggaattatagattcattttaagagtttaaaattataaattttgttttgtttttgtggtgttgggagcaaacatgagataacatatctgttaggcaagtgctttgccactaaggtacctcactagtggcatggcccctaaaactttgaaaatacacacacgtatgagtaaatcttcattgcatgcaatgggcaaacacaagggaattgggagaaatgttctgaaactggattgagataattatgtaactattatttaaggttttctgcagtaacagaaccaatacaatgagcatatactaccaagggacttacacagtgtagtgcagaaatccaacagtgagtatttacacgctggaaaggctaagtactcagtagctgttcagtccatgaggttgaatacctcagcaattccaatattatactcaaggactggaggaatcctagacagctgctggtcttcactctatgttggaagaagctagattccagtgtcagcaaaatatggccaaagcagtatcggcaacaagatgcatttgccagcaaggaacaaaggcaggcaggcataaaaaacagcactgctttttccgtacactcctttccccctagactgtggggtgctgcctactctaggagaaggtctttcctcttgttcacccatccaggaagtcctttatggacctggccagaagttcatggttctaatttaatgccagatttaattcaagttgacaagcaagataaaccatcacagctatatgtttaccagccatcatcaatctattcacttatagtggccacgccgtgtacttgaacaaagccctcatagatgagagaaagcaatcaggtttttctttaaacttatcttagcatttttgtaacctttcaagataaggtgattttaagaactacaggtgtaatgcttacctagcatgccgaaagccctatattcagtcctcataagtcagatatgactgcctgtacatgcctgtaatccaagcactcaggagactgtggcaaaaggatcgtcccctggtcatcttctgctacagaaggagtagacaccagcctgagggacatgagacaatatctcaaaaaaaaatgaagaaaaggaagcagcagcttgttggaaaacactgagttatacagtattatacatcagtgaggagagcgcagcaggacagtgttcttgtgatcattccatctacattcaagtatgcatttgccacttcccacatttcaaagattttggcagatataatataatataatataatatcaacatttggacattttatggttatgatatgaacttaacatttaaattgaccattgcacattgtttttttttttggttttgattggcattctctaatcaaaccattttttaatgttcatttatgagagaaaattatcttaagattcagaacaaagttaaatcgaggctaatttgtcaaaaaattgtcatgattctgtagattagaatagtttcctatctttttttaaattttctgagatttatttttaattatgtatatgtgagtgcaggtacccacagaggccagaagagagtgtaaaatcccctggagttggagttataatagttgtgggtgacccagtatgcatgctgagccatctcttttttttaactttattattttattagatattttctttatatacatttcaagtgctatcccgaaagttccctataccctcccccccgccctgctcccctacccacccactcctgcttcttggccctggcattcccttgtactggggcatataaagtttgtaagaccaaggggcctctctccccagtgatggccaactaggccatcttctgatacatatgcagctagagacacgagctcttggggtactggttagttcatattgttatagggttgcagacctgggggtcctgtgttccatcttatagatgactgtgagcatccacttctgtatttgccaggcactggcatatacgagacctataacagggtcccttcagcaaaatctttctggcatatgcaatagtgtctgggtttggtgcctgattatgggatggattcccgggtggggtagtctctgggtagtccatcttttcgtcttagctccaaattttgtctctgtaactcctttcatgggtattttgttccctattctaaggaggaatgaagtatccacccattggtcttccctcttcttgattttcttgtgttttgcaaattgtatcttgggtattctaagttcctgggctaatatccacttattagtgagtgcatatctaatgacttcttttgtgattgggttacctcactaagtatgatatcctccagatacatccatttgttcaagaatttcatgaattcattctttttaatagctgaatagtactccattgtgtaaatgtaccacattttctgtatctattcctctgttgagggacatctgggttctttccagcttctggctattataaataaggctgctatgaacatagtggagcatgtgttcttatcaccagttggaacttcttctgggtatatacccaggagaggtattgctggatcttctggtagtattatgtccaattttctgaggaaccaccagactgatttccagagtggttgtacaagcttgcaatcccaccaacaatggaggagcgttcctctttctccacatcctcgccagcatctgctgtcacctgaatttttgatcttagccattctgactggtgtgaggtggaatctcagggttgttttgatttgcatttccctgataattaaggatgttgaacattttttcaggtgtttctccatgctgagtcatctctacagcactattttcagcactgtaaaatatacagttctatagggataagtgcatttacattgctgttcaactactgcaaccttctattttcatctttctcaactgaactaaaacataaaacaataccatcatcctctctcactcttggctcatgacagtcataattctacttactgtctctatcaatgttattattccaagaacatcagtgaatcacaaaaatttatctttttaatgtttttagttatgtgggtgtatgtgtatgggtatgtgtgggtgtgaatgtgtgtgtgtttgtgtgtcctgctacttaggtgcatatatgccatagtatttatgaggatcagaagtcactttttaggagttgactgcctccttccaccatgtgggttctgaagattaatttcaggttatcaggccttgggacaaacaactttacccacttagataccgcagtagtccagtatctgtctttttattactagcctattttatttagcatcatggtccttatggatcatccatgttgtattaaaatttcctctctttttaaggttgaatagtagtctattttgtgtgtgtatattgcatttttttctcccgctctcccactctccatgttatgtggtaaatatgtacaggaaaaaacagcttctcaaaatgccaatcacagagatttctaccttggttcattcatcacataattgcgctttctggatcccaagttggttcctatattctttctcatttttaaaagaatatactatcttctctgagtatgctatggattacaggggtttattgtggctcctgtttttgggggggttggagttttggggggttttggatggatttgcataaaccagagtttgaaattcactttgtaatactaaagtagatcctacaataataaattcaagttcaagctattcagtatgtgctgggccctacccaaggatatgctaaattccagagtaggactctaatcgctgctttactccagtcactagtttctgtggtataacatacttcttcagatgaaatacaaggttggtttaagatttctaaaaggtgctttgtttagtgatgctgttcaaagaaatggaagttcaattttctagtaatgcatggaatggagaatcatctgtatgactaatattttaatgtcttctttttaactactcaaaatagactgggagctagagagttgataaggtgattaagactacttactgttctcctgaggaccagaggtcagttcctagcacctatatcaaatagctcacaaccatctgtaacaccagctccaagggatctcacactatcttctggactctgtggatacctgaacatatgtagaatacattctgtcacatacagaaagaggtgagaaagaaaggagaaaaagggagagaaggaggaagaagagagagagagattttaattaaatagatttgaaaattctgtaatgcataagtttttagggagaaaatggtactgataggatagacaaatatttactccataaaagaaagatcacccagtgggtttttattggggggtatatacctcagcaaaattgaaatttatttttttatttacaatccagtcgttccccaccctaaccccctcagtcccctctcccagagttactcatcccatttcctcctcccccttgcctctgagagggtgctcccccgaccagaccttcccctttcctcaggcctcaagtctctcaaagattaagtgcatcttctcccactgaggccagaccaggcagacctctgcttatatttgtgccaggggcctcggaccagctcgtgtatgctcctggttgatggctcagtctctgggagcttcctgagggtctgggttagttgagactactggtcttctttgggatcacactccctttcagcttcttcaatctttcccctaattcaaccataggggtccctggttgggtgtaagtatctgcatctgtctcactcagctgctggtagggcctttcagaggacagccatgctgggctcctgtctgtaagcacatcatagcatcagtaatagtgtcaggccttggtgccttcccatgggatggatctcaagttaggccagttattatactgactttccttcagtctctcctccatttttgtccctgcagtttttttagacaggaacggttcattatgaattttgcaggcaaatggatggaactagaaaatatcatcctgaggtaactcagacccaaaaggacatgcatggtgtgtcctcactgataagtggatattagccaaaaagtacagaatacctagaatacaacccatagaccataagaagttgtaacaaacagaaaggcccaagtgagtagacttcaatcccacttagaacaggaaaggaaataatcatgagaggcagggggatggagggacctgagtaggagagggaacagggaggggaaagggggaacaggatcaggtatgtgggggaacaggagagaagcccagtgacaagagaatgaatagagataagcagcctcaggggttggggtgggagatgggggaccctctagaatgtacaggagacccacgaggtgagacactcttaagggctcaatgggggtgcccttagccaaaatgcccaacattggggagagggaactcaaagagtctacctccaatagatagacagggtctcaagggggagggacagggttattaacccacagtcaacatttctgacccaaaactcaccatggtggcttttataacattttgtaaattgtggaatcacaatgatgcataatcattcttagatgtgtaaaaaatttttctttcagtttataaatttatagttcctcaatttttctgaaaatgcaattttaagatgtacaatattcctttcagacctgtactatctcatttttaatgtctgaaagggactttcatttttggttttgtttatattaaagagttgggtttccccgggctatccaggaactatgcggtttaaacttcctgggtaggtatctaagctgaaaatctcaagttggtatgttaatttgggcaggaaaatatagtttagatctctgaaacttttctccagtttacaacttcgaaaaatcatcttcaaagtgatagctgcttgtcagttccctaaatattagtattaagtcacctgcctttccctaacattttgatggatttcaaatatataatatgtgaaaaaaaaaagtccttttgcctagcacttctcagttcactaaggcacgatattggaacttggttcctgttccctgagactgtgaagggagtctctgacaggctgtctctcatctcatggctgccatttcatatagtctttctcacactcttactatctgtctcactacagttgcgggcacatttcattattttggagctaaaaatgaacttgaattatcttccaacaaaaagttgcttcagtgtctttaaagtaactggccgctaatgaacttaactgttctttgaagctctagaaggaagctcttcatttattgatctatatttagagtcttgttccaaaagttacaatcttgtctcaagtggtacatattcttgtcctttataaggttttctctgtggaaaaagaaaaggttgatgagctacacaacccagggatagttatttcatagtatcttcccactaactttaattatagaatatttaaaatagatatggaacagatacctaaatgtggaatatgtgagcaattatttctatttgaggactaagaaatcaagagtgaaatgtaatgctgtgttaaaataggagctgcctttaatgctttacaagtaaagtaaaagtgattgacttcatctatctgttggaaagtgcatgcttaggagataggaactgggtattgccactgagtttactctgctttgtttgcaccatctgtagaatacagtttcccaatggagttgcagtgactccaaggcggaggtgaagtgtgtctgtgcagctgtgtgtggtcatatctgacccagtgccaaagactggcagggagcacgtctgtctaggagtgacacagtgtgagacagcctgtttcccttgcagctgttcacatttccttgtttttgccttgattctatgtctgtggtttgtgtgtgtgtgtgtgtgtgtgtgtgtgtgtgtgtgtgtgtagtgctgaacttgggtagctaatttctttagaaaaagaatgcaaacagccagagctcctcatctttgtcttccttctaggaataatctattaacatctttctatcccctctcccactcccttcagcatgccagccttataaatatgctttattatcttcagatttaaggaatgcaaatgacaaaaaaatctattttgatgttaccagtctaccttgaacttataagtctggagcagaagttgcaagttatcaccctcaagccaaatccagccaaccacttatttgatacatattttactgaaacacagtctattcattgttaacagctgcttttatacaacacaacaggctgtaatagtagtgacagagaccagatagcccctaaaacctaaaaagttcccttttggccaggagaagattaaggttacttaacgtgacaaaaccatgcagttacttaacatgacaaaaccagcaactgattaacttccagatcatatgtagtttatttttgccatgatctatgaatagcattttctgcaatttccccccaaaatattactaaaggcaccttcctagcacgagttgttagttgttatctatttctaaattctaacataacccagagaggtctggtgtgatccagaaggccatgctctcatgccctgctgctctgcttgtgtaaccctaagtgcagcatttcacatacctagacattagttttctcctctttgttgaacagctttcagttgctatgacaaaacacctgagataatcaccttaaaaggaagaaaaatattttggctcacggttttagaggtttccatttgttctccctattgctttgggcctatgggaaagcaaaacattatggcagaagaagctacccacttcatgacacacaaaaagcaaagagaagaagtgaatggaatactgccatctatttcaatggcacagtcccactgacctagcttttcctaccagaccccacttcctaaaggttccaccacctgccactagtgccacaagctggcaattatgccttttaatacatgggtgcttgggtgatatttgtccagactataggattctctttaaaatagagaaatagaattgtatttatatctaaggtcttctctatatttaaagaaaaacttgtttagtaagtcagacttgaaagacccacaaaaaaataaatatgtacaaaatgtctttgatttcaggggaaaaaattttagtatgcaagcaggatcaaatagaaattgtatctggttcccaaagaaacaagctaaaataagtattctgctgtgtttatttttgtgctactctattttttttacaaatatgtatttataatcgctacatacaagttcaaatttttattttttgaagaaaacaattatgaaacacacactgtgtcctgttaccttatattggaaaactcaagggtcatggagaagaaaaagaatcccttacacagcatgttctataatcaccaacattagacggccacttcctttttggttgttgatgcccttggtgtagcagacatgccagtgttggtgctgggttgcaaatttgcagccttggcatagttggcacagcgtacagctagcctcagcagcacactcttgtctcctgccccgtgatgttactcatagctcctatttctggttcttcttgctctgttcaggcagttctcttggacaggactccatcagaataaccttgctcaggttacctctcatacatttctttgacttataggaagcatgcattcttactttaagatgtgctgcaagtgtgggctatcccaggtgaggcagaaaaggaagccctcacatactaaaggaacagatacaagtcatttttcgcttaacctaaaataccacatgttgagcctccccaaggattctctgaacaaagctatctttcctagtgcaacagtgtaggactggactataacttgctgcaacttgacaagccctggccagagaccaaggcaagaagctccactctctggaacttccagttctgggacaagattttctggaggactccctacccttcactttttatagggggaagagtaggtccctctcctttccttctcaagaaggggaagggaaaatcaaatatgagctctccctaattctgtgactcctacacatgtcaggcttctgcctccgtaggcagaataaggcttaggctgagtgtggaaggaacactggctgctgtgcagcaagctctacaccagcactgtcagcttcctgttggccttagatgacattctttttttattattaaccaacgtgattttattgctcttgtacacaagagaatttatgccaccagagcagaggttgtggacaactcaatttccaattgggtggaagcacctgcttagtcttttagtgtcaagccaactggtaatttctgctctctatcagaatcaggtggaatttaccatccttatcctttctgttcctctcaagatgcttgtggacagcagctgctttcttaatcaaatggcagagattcttggggagatctgggacaaggccttgggattctcaagattttattaccagtgacacagctcccattcatgatggtggaggtctaatagcaaagacaacgtttatgtgtgtgtctgtctgtgtgtgtatgtacgtatgtacgtgtgcacgtgtgcacgtgtgcatgtgcgactgcagctgtatgtgtgcatgtgtcaggccataccaaaagcacagagttttatctgagcaccttccttacaatataggcatgaaaggtctgagattctaggaacctctatgccactcaggaagtcatcctaaagctagaactttactttaaagctagttctgacttcactgtcgtctgttttccccatctgtaaaatgggaatgacagaggcaccagccttgcaggagaagctgtggttaagtggatgcatttatattaaggtctttgactagtaattagcatctagtaagtgctcagtaaaagcactcatcattgttcctagtgtgcaggttaaatatctctaatctgaaatgcttgagatctgaagggttttatactgaggatttcttttccaacattaaatatttgagtacacataatgatattttggggttaggagcaaagtctaaacataaaattcagttacgttccatatatagcatgtacacacggcctgaaaagaattttatgcaacatttttagtgtgtctggaatttgggtacaacctctcatgtgaggttaaatgtggaattttccacttgagagtcagtatggtattttagaagtttcagatttgggggcatttcagatgttggagcatttctagttttaaagcatttcaaatttgtaattttttctttcattaaaaagtagattttgttcttacataatatatccataaactttcccctccctttaccccatccagtttctccccaccatctctcccatccagatccaacccctttttgttgcttattggaaaacagattcctatgggataatcatagtcagcagaagcagaagagctcaggaaaagacaggaaatattgcgtgagtgtggattttagaagacaacctttgagaattggttctctcctgccacccaggaatcgagttcatgttaacaggcttagctaaaggtgtctttacaaactgagccatctctcaggtctagtgtctttacatattgttttattttgctaagaatacaacatgggggctggagagatggctcaacagttaagagtaccgactgctcttccaaaggtcctgagttcagttcccagcaatgatatggtggctcacaaccatctgtaatggggtctgatgccctcttctggtgtgtctgaagactgctacagtatactcatatacataaaataaacaaatagatcttttaaaaaaaagaatacaacatggtatttactgtcaataaaaatgtaagcctgttatcgacagatgtaatgttataagattttttattcaattcttgtaattgtaatatatttaaatatttataattcagagtgtcttttgttttggattttgtagtagatggcattcacgttgatattttatatatgcagtaattcatttcatagattagtctgggaagctaatcgctacattatttctgtaagctgggcattgtggtataccctttaatcctaatactttagagtcagcacagatctaactctctgaattcaaagacaagtaggtatctacaaattagaggccagcctgttctacacgctaagttccaggccagccagggctacatagtgagtccctgcctatttctataagaaagtacttttttttttcattctaaattttagttagcaaaccactagagatggaaaccttaagaagacagagactatatctatagatagatagatagatagatagatagatagatagatagatagatagattgattctccaaggatttggtcaaaaagcatatcacctgtgccctaaaatgttaataaaatgtttgaatagcattttaccattctgctcaaactatttattcagccttcaattcagtagtactttcttaattaatggccctttctcttggtcgtttttgttacctcattggcctaaatatttacaagtcataaagatttatctcacatctagctataatttgaagaatgtttacagtcagtatttcacctctggaatagcattggtgtacagagggagaaaaaggtagggaacaaaaccatccccaaaatctcaaactgttttagagaagttaggaaatagaagccatcagacaaacagaggtcagttttaacattatacttttcagagcaggccagccactgactgtgagccattccatttgaggtagaactagtgttttaattacacttctagactgcagtgtattttctctgactaattaatgttctttatcaagttgctgtttgattctttcaggttggaggaattgtaaatatattcagatttttttcagtcttctcacactccttgaatttgcaaagccaatagaaaccaagtttctgtccatgactccctgttgaagtctccagcactgattctattaatgaatattcctactaagacgagcacaaacctctgtaagaacattccttcctagaaggagttacatttgccctttcccaagatcaaggcttctatgaaaattctttcagactcttcttggccagaatctgttcttcatttgactccacactcccgttagtgagcattgcttctgtctggaggaaaacactggggttgctgctatattgacaaatgtgaattgctaaggatagagttttggttcctctctttaaaaacatttactttaaaagatgtgcataaaacttatattctgaatgatgaacaattgcaaagaagactcacttatatcatctctctgactttttaggaggacaaatgttgttttctgaaacaataaaccaaaagctataaactgtagcaaaacacgatgtgtattgatcggattttcttctttgctttttagctgtatgacaaaattaacacaaagtcttcgccacaaatcaggaatcctccaagtgatgcagtacagagagccaaagaggtaagtggcatatttttctcaaagtacatagcattgtcacgtttgccacctttactgaagatgtctttgcatgttaagggcacactgtttaggatggcagcttgaagcatactcagattctggttgctaagtttatcattgaacatccatgtgggaaagaaaaagtctcagcaacaagagtccccaggcttctccttctggttctgctgtgcaaatgagcatattgtttggggtgggattgtctttttaaaatattattttactgtacatggaagaaatagacatgcttcaaattttttagttgccttttaaatgtggtactatgtagtggttaattgactttccagaacaattaaatatactgagttcaaagaagtcatttttttatgcatcatcaatatataaaagtatctcccacaagctttttttcatacttgcttatcatagaagcatggcattgcagagagcttggaaaacaaaattcacccagaatcatttgcatatagaatttgatgtattaccaatcgaaatatgttggtttgagcctagaattgtgtaataagcattttacacctttatttggtctttataactatagcacaatgactaattttttcctattactaaaatgatgtagaaattaccattagtaagtgccttattatttttactgtttgttttaaagtttttacgcaaataaacctttctttttaaaaatattttataaagtgtgattagtaaatgtgattactaaatgtactgaagacataattttatccctttcctagcagatattgttctgggttttgttttattaagatagaatctcaccatgtactcagtgttgggatgttaggtgtgtaccaccccatctagcttcttagcagaggttaaacatgacttttgataaaaatatacattgtatatgctcatatactcactgagaaattagaccatattggctgccaggcctgccctcttggtgagtctccggtaaaagaagtctgtcttagtttgctcagcaagcattctttgaaaggaattacactgtcaggcaggaatcatgagtcgctgcccaatcttaacaatacccaaacagacagaagcagagatactctgggcgggggtggggggacaatcctttgtcctaactttacagtggaagaatctcccctagctcaggaggtcagactcaatacttaagatcatgggctatgaaagtatcaagggaaaggagagagtttgtgctttcccctgttgtttcctagaagagaagctgaaaatacaccgaagaaaactatgttaatatcattaagcaatataaattagctgtataacctgcagccattaacagagcatttgaaaaaaaatactagtatgtatgtatatgagagtgtttgttttgttggttggtgtgtggggtgtgtgtgtgtgtgtgtgtgtgtgtgtgtttcattcattcattccttatgtgtgttttgtgtgttcatttatttcttcactcactcactcttccccatgcttaagtagcagagctcattacatgctagaatgctgaaatctgagactcaagcagagtgagagtgagcccctttctgaagtccttgaaggttaaggcaggagagtcctactggttgaggggatgtgtgccccttacaacccatggtgctaaggcaatactagataggctccatgattagaattcagttgagttcagtgtagaggtctctgtgagccatctgcagtaaaaacagtaacaggtgcctactcagagaaactccattcctgggtggaagggagaagtttttaagaactgtttacttgcaagcagcattttcaccaatgcagagaaaatgttaatgcctaattggcaatgaaaagttgctgctgaaggtgtttaaatttttaagtttggtcttttgtttgctggagtttcatcaaaggttcatttggtagaagcatgcttttctctgtgttgaaagataagcattttactcctgccaggctacaaggaaaatcacttacatgtgttcttagttaattatgctagttaattagcagtcttatgtatattgttttcattgaacctgtgtcatcttttaaggaactagcagtgttgttaaattttaaagggcaaattgatttggggagggaatttgtaaggcatattttccttaagctacttaagttacttaaacctgtaataagtatgtgttacaagcttcccattttgcttattagtttttttgttacctttggatcatagttgggtaatgaaggcaaactattattacccaaaacatttcattttattactatcaatattcttatacttcaataacctttgaactcaacaaatgttttgaaagtaattgactttcctgctacaaaaatatattcatggtttttaatttaaaggagttccatgctttgtacagctcattttgcattagtgtgtatcttatttgtttttctaggtattggaagaaatttcatgttaccctgagaataatgatgcgaaggaactaaagcgtattttaacacaacctcatttcatggtaagtaacacatcactagacatacaacaccatttcacaagtcatttttaataaccttcctaaaatattgctactgtcatcaaatgtcataaatatatccttgtacacctgctggtgtgcattttagagaatatgtcattaggcagtttgccattgaaagtacatcacagggtgtccttacaagagcctgggtgatagaggctactagtgtacaccaagctacagtgtgtatggcagagtcctgggaggtgcttagattcccatgcagaaccatatgaaatttaacaagcactagagagtgataaaatcaagagacaccataacacaagcttgtgaggctagtgccaggataacataacatacacttttacaggaaacatgttgtttctttattttcattttgcttttagttttggttttatttttgatgtaagatctcactaggtagctcagagtagcctcaacttcagaatcctgcattgaactcctattaagattataagcatgtgctaccatgataaacttttcctaagtagaaggggcagactgtgaaataatgatttaaggactggagagatggctcagcggttaagagcactgactgcacttccagaggccctgagttcaattcccagcaaccacatggtggctcacaaccatctgtaatggggtctgacaccctcttctggtgcgtctgaagacagcaacagtgtacttgatttataaaataaataaatcttttttaaaaaataatgatttaaaaaagtagtaactacctaagccagcagcatcacagctctcaagtctgatcggccattcataactgcatgcatcatgctctcatctgaactaactgcactagtttctttgcaccagcatcaacaccacaaccaagtaactaggcattgtgcatgaactcactaggccctaggaatattttgctttcgatataatcttgtttatgtagtgtctcattggctcaaatatcattttgtagttcatgactataatatcagactaagattataatcctaggtaataacacattgttttgtttcattattgttgttgcccttgtatcacagttgtaaacgtgccacttgtcaagtgctcatcaaggactatgtagaccccacataatgatctgcttccctgtgttctcacatcactcactgcaactctatgctacctaaaccacaaagagctgaaattgacgacaactttttaaatgaaaagctgtcttcagttttcacattatatttatttacggggcacatgtgccacaatgcatgcatggaggtcagagaacaagctgaaggagtctttcttccaccatgtggcttcaggaattaaactcaaagtgtctttgttttagacagtgcagaactcccatacttttttgttgatttctatgaaaatggaaatagcacttatgtttagccaattattagaagctctaagtcgttaagaaacatttttgtagaaaagaagttcacagatatctacttatctacaattcacaagtagaattacagggctgacaggacagctctgtggtggaaagggtctgctgctcttccaaaggacccaaggtcagtttccatctcccaagtcaggtggcttataactgctataactctagctccaagggagccaacatcttctgacctccaaggtcataaacacacagttgtatagacacagacgcataaatgaaaataggacagatttttttttgaaaaaaaagcacaattataggttaaaatccttgatgaatataatgtggaatatatgcaaagagttaaaaacccagctaacttccctctgggtggaaatgtgattttaaaaccttgttgttcttattacaactatttattttaagtgttagttttaaaatcatagctacaatgaaacatatgtatcatatcaatgcctgtaaggttttaagtatatgctatttctttgtacatgcagtgcttctaaaactttaccattgtccttctaggttattatctatcattttctatttcccttccctaatttttctaagttttagtggccaaactcaagcacatctctggaagtgtctaactctgttttatctgatggtagtgaattagaaatatacttcagtctgagcaagcacacttttacatgatatgtgtcaattcagagctcagttcgaatctcctttgctgtacttggcctggtttctgcctgacatatgcttaatgcctcctcagtgttagctaatgaggattattacctaccgcacagtatgtcatctgcctgtgcacagagcttatattgtaagctctagtaggcgctgagcatatttgacccatttgcaaggaggttcaccttactactcactgctctgtgcactgtgttctccacatttttgaacagactacgaattgctgtatagcctgagctacttcagagaattatataggaacatttcagactagtaaatcttttagatttgatgaagactacataaattagcatatccccaaataaggccttttttatcgggtaaatttttttccaggaaaaaaaatcattaaagctcatgcagaccagtgcctcacagctcaccttccttctaagccttgatctattttttatgtctaaacttagaagtgtgtgtgtgtgtgtgtgtgtgtgtgtgtccctatcaggaaacattttcagaaataattcctcaaattccttgaaaacatagctcagtacttaaaagacatctttattcatataccaaatatctaagtgcctactatgttccaggttctctatgctggccactaaggatctagttatgaataagaaaaacacagtctcaccctcaaagagtttcccatctcagtgaggctgaaggataggggtttctgattagaaatagactgaacacatcagataacacaataatttcatatagttacaataactatgaataagagattgtggtatagaggcagtagtacaagtgtgagctattttatatcctcaggggaaagccctctgaagagttagctaaacttgttctcagaagagctgggcccctgaacatccaagcgggaggaagaggcagaaggaagttgtgtaggtttagggaaccgagctaaagtccattaaagattggatttaggaaaagagaagaaagaggtacagaaatgcttacagagcttggcagaggccagaccaaggaggctcttccagaccatggtaaagagtctagagttttctcctggttaaagtagtgattgtattgagtgattgattgcaatcaagaaaatatgagctaagtcatgctttcatggttgctcctaggcatagttacacattcctgtagccccaacatttgataggctgagatagacgttccacaggtctgattcttttttttttttccgatcctcccatttttattgaacatttgatgtacatttcagccaccatcagggtgtacattgatatatataccccttaagacaaatgttaaaaaagggcataaggtaaatgaaatagaaatactacctccaattcaaaatacactagacataagagcaggcaaaaactaaatacttaaatatcagatgggctaacacacaggtctgattctaacctgaggtatatagtatgtatcaagccagccggtgctacagagcaaagcactgtctcaaaagtgagggggtagaagatgctggagctcacatgctgtgaatggactgtaggagaaagaccagttagaatactgaaaggaatgatggaggcttagagaaaaatggggatggtagcagatgggcaggttgggatttcatattggggatggtaggaagcaacaggacttgcttgtgattgggatgttaagttgtgtgactagccttagaagtagaaattgccctgtgaggtaggaatttgtttaaagtcatccacctagaataaagaaggcttccctaagactcaagccaaatctgactagctcttaaaaagcagactgttcataacacaaatgaatttccctgtaagcctatattaagcttattaataattcttgaacaagcatacatgtggatactgtctcttgaaagaaaattctaaaatatatattaaataggcttttaagtattaaagctcaaccctgctgtctcagaatggtaagacaggaaggttgtaaactctaggccaacctgggtatgttgcaggactgtgtctggaaaccctagtactaattgttcagtcatactctataggctatttaaaagaaaatgttcaaacttcaatttccttatttatatcttatgtattcttttttaaccatattatataagcattctgcacatgttccccttttctgtttgcatgtgaattagagctggggatttagttgtattttgtggcagcaatcactgaaagccgcaaattctggttaatatcaagtgtgaccttatttggcaacataatttaaactttttaaaaattcagcttggcactatttcgtgaatgaaggtttatttttccttataaataatacattaaatgcaagcacctgtttatataactttaaaggatttatagaaatcatctacaaaaagcaatgtaaacattttacccagttcataggacttgaaggctgacatcattcccatgaaaagcttgcctgtgtttagcaatcagacaaagcatcttgagtcataaaagacatctttgaacttagatgatgaacctgatcttaatagatgaacttctctacttggcccattcctgatttggcctctctgctctaaatcttagtttctttggtggctacagttaaaccacaaagaaggccttgcccatatagtccaaccttcatattttgtagccacatctcctggcccttcattgacctctgctttaaacctatatattggcacattgtcagtgccctaaagccaccctcacccaaatctgcagttgagaacagtggcctgggattgaggtagtgctgaccatttcaatcagaaacgagtaaattgattactcggagtacctgttgatgatgactcatcactgtcttccttccttctggttttggttggttggttggtcttggtttttcgagacagggtttctccatgtcgcactggagatcctggaactcactctgtagaccaagctggcctcaaattcagagagatccacttccctgcttcctttctaatttcaacacattattaccttatttttgcctttatgtgtgactttaaagtagctaagtcatggctccgataagccttttacaatatttcagatagcaaaatactatttaatcacatttcattatttgtgcatatctcattaccacacatattacagatgaaaatgagactaaatttagacttagcatatacatacttatctgtataaagttctaaaccgaacaataatcagttgtaaattctctttaactaaaatttctcatgtttattacaaagggtttgtgatgggaacaaagggtatcccttttaaaaaaataaaagagatttattgctgaagtttaccaagatgacatacagatgacaatataaaagaaatcatttttctttgttagtgcattttgcaaaatgaataagtaatcattttcaagttaggagtaggggtgtagctcagttgttaagagtgagcttacttcattcccaacatcacatgaaacaagtatggtggtgtactcctgtgattctggaacttgggaggtagaaacaaagtcatctttccctacatagtgacttcaaggccaatctgcaagacatgagaccctgtctcttaaaaagtaagaataatgatcagatttatgtcaaagccccccaagttaaaaattacaaaacatttcctttttgagatgaaatggctcatcaggtgaaggcacatttcaccaaatctaacaacctgagctccatccctgggactcccaaggtagaaggagagaactactcccacaggttgtcctgtgacctccacatgaacaccatgacacatgtatgtattcatgtgtgtgcacacacacacacaaacagtaaatatgtataaacaaatttaaaagttctaatttgagttctataatgtgtgtgatacttctaaaactttatgtcttaagtatatctatgcagttttcattttatttcttaaatcatgttataaattgtctttatcctttaggctatataaaaattgaaatcactatgtaattgtccattcaattgtaagaacctgaagattatagattctccttgatctatgcttctcccttatttccattacccaatctggtagtacgcaataccaatttcatcttttttattcatatacagaagatgcttattcagtacagtaattattacataatatcttttaaactttatatcagtttaaagccccagtgcaaatttgttggttctttttattattggctatttctgctaaattatttaaaatttcagtctgtcagccttgatttggacatgtgtgttaaatacagatttgtagcctaacaccagattgacaagcccatccattcattcttttgctctgtcacttgttcattctatttttaaaaagaaatccatctatctgccacaaagaaattgaggtctgatagtttggaggtgtacttcatttgtggtctcttcagataaaaaatacttttgagaagtggttatacatgtgtttatgtaacagatttctgctagaatggtaccataatattttccttctttcataaaaatgccaggccttacttcagactcatgatgtagtggcacatgaagtttacagtgatgaagcattaagggtcacacctcccccgacttccccctatttaaacggtgattctccagaaagtgcaaacggagacatggacatggagaatgtgaccagagttcggctggtacagttccaaaagaacacggatgagccaatggtaagtaggaagagcttcgaacttcaccctgtgcagactgctactcaaggagggagggaggatggagggacatggatggtcctaaagaaatcagtttccagccaggcagcggtggtgcccgcctttaatcccagcacttgggaggcagaggcagctgaatttctgagttcgaggccagcctggtctacagagtgagtgccagtacagccaggactacacagagaaaccctgtcccaaaaaaaaaaaaaaaactaaaaataaaaatcagtttccagatcatcaccagttctcctaccttttttgccaagaagtattctgcctaaaatcaggtcttagacatgctgatcatccacctctcctgtaccaattacttttcaactttccaagaacacggtcattactctggaatgttaaaaaaaaaaatctcatataacaaagaaagagggaattaagtaaaagagaaatttcaatactttgcatatcttttgctttcaccaaaaaatggaagaaaagtaattcaggaaatgttcagatctcatccattcacattgaactgtttgtctgttttcccgtgctggagaactgagactgtgtgtgtctgcactcattcttaggagcatcataggttgagatgatcaagaaagggctctggggtggccactgagcagacaagaactgaaaaacatgttagaggcttcaaagcagcaaaaggctgttgaatcattgtaagcatggagccggattgggttttcattttagaacaagcactttggaaactgttacagagtttagggagactagatactaaagcagaccctgccatggtatagggaagagatcatggtactcagaactggtagcatgtacatcaagatagaatgaaagagccagatttggtgaccatgcctgtaaccccagcactggggagacaggagaatcaattcaaggtcatcctcaactgcataacaaattcaatgccaacctgggctagttgatatcctgtctcagaaaggaaggaaggaaggaaagtaaaccagttaggcaaatagtaggttgcaatgagagacacaaaactcaaggatgaccctcaaacttcaagctcaaacaattgaatgcacaaggagatagtgagatggaacactgggcacatttcaagttgaaaaatgggagcacgtttccagggaagaaaacattcaaagatatgcacttatatcctttccttggagttcttaagagaagcgaaatacctacgtaagaaaagtttcaccagttgccttccagataaggaagaaatatagaagaacgggtctatgatcacaatttccagagagtcctcagatctagacactgcggtttgtattcttgttcactgttcttagtaagttgccttaccattatctggcagcacaaaggaggcatgcaaattggctatccattctggtattctcaggggtaagtgtaacacaacaagaatatatatttatactgaattatgttaacaatcatactaaatcttaataatgtaaattctcctattaaaaagcagaggttgacacacctttaattccagcactcaggaaacagatggatctcagagcttgaggctaacctggtccacaaaacgagtttcaggatagccaggactacacagagaaaccttatctggaaacacacaaatacacaaagcgattgtagtggcaaattcacacatgcatgcacatattaaacttgccaaattttacagtttgaaatatcttatgtgggttacaaaataaaacttattttgtggaagaaatataagggatacactaatataaagtatatacctttggtaggaataaaaacctttttaaaaataattagcaatataaaaaaacaaagtaaagtgaaaaataatcataattaaaatattaaaaggtagtagataaactgtattcttgctatttagcgatcaaaataccgacaagtagcatttctgtcatggaacaattttatatgtaaagtcttcattttctatatgttctcttctatttaaaattacctacaataaaaatcacaaatataagatagtgctttcatttaattgtatccttacgaactttgttttctttaacagggaatcactttgaaaatgaatgagctaaatcattgtattgtcgcaagaatcatgcatgggggtatgattcacaggcaaggtgagtcccaccagagactctttctttaccttccttaagtcttcctagacttctgatggaagtaggttttttatcattcacataaaagagctgtttgtcttttcagtttcagttattgtagaccttgttcctgaattccatccccaccaccagaaatgaaataaaacctccaagtactcttttatctgtatcccaccaattttgatatgtaataatttgttatgattcatttgtcattgtcttacatttccattatacttttattggcccaaaagttatttagaaggttggttttttttacagatttatttatttatttatttatttatttatttattttatatatgtgagtacaactgttgctgtcttcagacacaccagaagagggcatcagatcccattacagatggttgtgagccaccatgtggttgctgggaattgaactcaggacccctggaagagcagtcagtgctcttaaccactgagccatctctccagccctagaagtatttttatttaccatttttaaagagatttttttaattaggtattttcttcatttacatttccagtgctatcccaattttttttttagacatctttctgtaattcacttctgacttaatcgcattgtgctcagaaggtgtggtctgtatgacaccattactcacagctttgttaagaccttccctcctggaaagcactttcatcatttttatgcgtatatgtttatgaagagcctttatttttcaattgttgcatacagagttcccaactggcttggtgttgttaatctttctgttcaaatcttttatgtgttgattaattttttgtatgcttgacccacaaatacttcataaaatatccatttatcatagtaaagtatttcagtgtctatttataaatctctctttggacttaaatatttgactatatgaattaggtacatgggcctcaaactcactgtgcagccaagggtaaccttaaacttgtaatcctcctgcctctacctcctgagtgcttagattaaggtcatgcactattgtgaccagttctgattactatttttgatagagtacttcattaatattcaatgtaatgattctactgttttgctttcctggttcattttttggagatttttgttttattagcctctagcttctaatttcagcacctatttctgtgatactagtggttacctacaaattttaagtttccatatattaaagttaaacaatatctttttttttttgtttgttttttttttttctttttggtttttccagacagggtttctctgtgtaaccctggctgtcctggaactcactttgtagaccaggctggcctcgaactcagaaatctgcttgcctctgcctcccaagtgctgggattaaaggcatgcgccaccaccccccccccagcttaaacaatatctttatgtttatttatttctctgtacacacacacatgttctgtacacatgctgcagtgtgcacatagaggtcagggagcaatctgtgggaatcaattctctttctaccatatgggttccaaggattgaacatagattatcagacttgatgaaaaagccttttgcttctggcccagatttcttattttattaatcttatttttcctaggtctgtatagtaatgctttcatcagttcaataaaatattcatccaatcaaacattgccttttcttcattctctttgttctttctgaatttcagttagatgtacattaaacaatcctatgccatagctatttttatatttttttcttgtttcctggtttccctatatctttatttccatgaccttaagtgatcttttgttatatcttccagttcattgacactctcctcagtcatgtctgaattcttactcaatgtatccatttattatcttatgtcgccatttatggttttgtttagatgtagtagtcatttgttttgttttcagttctgtctgctcattcataatagtctcttattgggtggtcaacaagtttctttggccatccatcaaaactgtgctttctgtaagtaaatgtatctatttgaatggttttactacacaaaagtgaagtaattctatagctaaatgcagtcctatctctaaatcactggcttttagatctgtaatttatttttgtattacattgctacctttcccttttcattattctaaaaacagttactttgttcctgtttataattgtgtatgattttcttaggtacacttcatgttggtgatgaaatccgagaaatcaatggcatcagtgtcgctaaccaaacagtggaacagctacagaaaatgcttgtaagccaatggaagtttccccttctctaagattcatttttagttcattagcctagattttgatttttaattatatttatttaatgtgtattttggtgtggctgtggatgcatacacgcccatgtgcggtttggaggacagtttgaaagagttgcgtctctgcttcctccagttgggtcccaggcattgaactcaggtcatcaagcttggcggcaaatgccttcacatgctgagccatctttttttactattatatttttaattaaaatataattatatttccctccttctcctttctctctctaatctcttctatatagcactccgccaggtcagtcgctctagttcatggactctctttctttgtattgttgcatgcgtatagagatgtttatacatgtaaatccaacatgctgagtccattaagtgtcccttgggtgtaaatgctttcagagataaccacttagaatgggatgaccaagtgggaggcccatccctgggaacaactacttctccctctcaaccttccttagttgcctgtagttctttgtctaggggtaggtccccatgagatttccccttccacaacagcatgtcactggtccgctcaccgtataggtcctgttgctgagccatcttgacagctctattaacttattttatacaaaacacacacagaaggtatggaaagatggctcagtgggtagaagtacttgtcagagtacctgagtctggacgccacacccaggtaaaaggcagagcatggtctcacctgcctgtaaccccaactttatgtctggtagagacatgagggtagctggggcttgctagccaccagcctagctcaaggttcactgagagatcctatatcaaggaaagaaggtagagaataatggagcagaatatccaacattctcttctggcctctacaagcacatacacacaggtgctggcacctgtatacacacacgttcatacaccaaacatacatacagcgactgaggtatccccactcatacctaacacacacactaaataaacagatataaagaaaacacatctaatggttcttcaatcctagtcagaatacttcttgtaccatcatttacgtgaagctgaacttgcacactattcattaaaaactgacaactaggaaaatgcagtagctgcagtggactttgaaaccattttgcctgcctttagcagtgggagtctgcacactgttatccttccttggtttcttaccaaccagatatttacagaaaacctccccagtacatagtcgtgtgaactagtgtctcgctgacctcaaaaggttcctgattaaccccattagaaacctctttcctgtttagctgagtcatggccagctatagtgtatctctctacgacacaaagaagaggaaggccattattggctatactcgaaaaaatccatactgaaattagaccttcaataaaaagcattgacatctgctgacagacccccatctatgctgggttgtagcaaacagagggaagcatttgttttatgccttgagtcctccctgctatagtacagcagcttctcgtgcggtaaatacctcttaggcaggaagcaagcatcccgggcttgccgtaatcaaaaggaatgccagaattaataaagtataaaagcaattttatgttgatagcatctgagagtagcatattaaatagggattttatataagtacttattctcttcttcgggtcagtgtatagtcatttttgtaaagcatatcatttcgaccgttttgtattcatgtgtacaaaagataaccatcagagatcttggagaccattcattgctagatacaagatagtcagccttgactttgagggatctttcccagaaaactctaccagtaacctgagtgtttcctgctttataattaggggttttttagggctgagtgctgtcaggtggtgtggactgattacacccacacattttgagtggtttcttctgtgtttttgtgtgcaacatgtgtttgcatgagaactctcctcttttcttctcccagagggaaatgcgagggagtattaccttcaagattgtgccaagctaccgcactcagtcttcgtcctgtgaggtaataagtctaacaagcctctcctacccccaacctcccccatctcctctgagttcttaactaactgtctgctgatggctgaatgtttttgctttctgggaaattgtttctgcctgtgctgttagatcactgcacaccaattttacaacaaagataacggaacagaggaggtcccacccacctcctcagccctacttgcatgtagatatcttcagcctttttgcagcaaaatcaaagccaaatatagaaaagctacaataacataaagcttgataacaaaaagaaagaaatccctgagacaaaaaaaaaaaaaaatacagcagtgtttccaggaagtccattcacttcccttgttaagatatcccacaggtagttcttctttccaagagtcaatttctgttgaggtatcagtgtttaaatgagtgacaggtctcaagatgagaccctgatgaattggtaactgacttcactgaaaggacacaggctcctgtgacctttctgcatatctaaagtgagaaatgatcttttgtagaataatgccccccgtgtttctgaaaacagactgtcctctggcaattagaactctttcaacttacggctttatttttttagttttattttgcttattatagtcaaaaatctattctttctatattgggagacataaattatcataaacagaatcattctttggttgtagcacattcagttcaagtgttacttattaaaccttattttccaatttccctgtggctcttccaggtatgttaatatgaagtgtaagagctgggaatatagcacagcgaatgcttgtttggcatgtgtgagtccctgggttcaatttttatcactgcaaataaatagatatgaagtgtacattttctaaagctaagttttaagggctggtagctgacttactggatctgtgcttaagaaaatttgaaagaaagattatacttttcaagtctatagtggtgctacaaacttcacaagaaaaccaagtacaaggttcaagtagattttaattgtcaattaaagtgtcatattttattgggtcttgagctcctcttggtgacttcctaaggaatgtcaattaatagtatatttcaaaaataagcagcactgctccagcttcaagattcagagcattaagttttgttacttagagtataaacctgtcctggaaagagagaatggcatacatgcatgaagacattgaatagattggattgggggtggtactaaccagaagatattgttagttatgaatacaagtttctccttttttttaagttgttgaactagtttgagggagacaccagtatcatatatataaaatctacacctttaaatatttgaaagaaatgatttcctcctcttaatctgctcatagatacacgacttttttttttttaacccacctgggttggactcttcttagctgggcaaggcttctctaataaaggctctcatccacttcccccagaccctatccctactgatttgaatccctaagggtgacaaatagagatcaatccactgcataatgtttgagaatgttcctctaaaggatctcattctatttcaggctaaccaattccagaagtattctttcaatatcctagagagaaacatatcttttggacagaagtggatacagaactctacacatgaaatgtcttaaaggacttaatttcttcttctgatagttctttttattaaagttgtcttagacactaaggaacagaacctgaaaaggattaggagtgggttgaacagcaaagagtgtgggctcctggcaagtttggccagaaatagagcattgttgcttggagtcactgtcttactcagtctgctaaaatgttacaaagaaagagatttgctttctggtgcaactttctctttttaccccattagtaatatttattctagaaaggtctaagatgattacaatatgtaaagtctttctcttaggctcatttactttcagtggagttatttggtagttcttgacagtggggtacctaagaacaataaactacttctcaaacccattgtttaacctattcaaaactaggcagttgagatcttcagtacaatagcactataatatttattgttgtgtgccctttgataagtttttaatatcactgtcctgagatcccaataaaaaggcaaagattgtagaatttgggatacaggaaaagaataatcaataatcaatgacagcacagccctcactaataatatgggaaccttcaaactgcaaaaaagtatttttatacttctgtgaaatcatataagtaggtcagcatgacaccttttatagcattaacctcagaggaaatagttgtcagactgtggttgggactgttgatgtgaatatctgtttctgtgctagtgctctgtgttaatgaaccttgtgtcttatttcagagagattccccctccacttccagacagtcccctgctaatggtcatagcagcactaacaattctgtttcggtaagaactctagctccacccagccaagtgtgacgattttgttggtgctcacctgccatgagtgtttagttccatgtgttcagtggaaagattgtcttctgcagacgcacatggcgactgcagcagccttgcagttgactcctggaaaacctccctcaacatttccttcttaaaaaatcagtcacatttgaagaaatatagttcaagactgctgtagttgttctaaaactacctctcagccaccccaccaatacgtatggctgctcaaaggatataaatagaaatgtgtttaaatttctttaagaattttttaatttaaaatgataaatgtaagggatttttgcagaataagcatttgggtgttcttgggcttcatagttttccattctgagggatatcagcaacgtcttttagtttccgctatctaagtttacgaattggtgtgccctcttgttattgtggtacgtgcacatatttttgtgaattttaagccttgcctggatatgaaaagcaaaaggagctggcttcaaactgcacttaagccacgctggtatcacatctttaacacaaagtacatacttgacttaaacttggaaagttgccatttttcagaactctccattttggattacagaaagaatcatttagccaaacagaagcatttatgtgcatgggtttgcaggtttgggggatagccaaatcttctctgaagttgctggtgctgctgcctgtcaccctgctgtaattataaggcctctaagaatgcagcactgttgccttttgttctgacttttaatttgccctttaagaatatatcaactttcttatccaatcaaatcattagtcattcaaagaccatctcaaatggaatgatatcccaagtatctaagtaagagaaattgtgtgagaaaattgtttataactgtgtttccaatgtgaacctaggttctcaaagaattcctttttaacattaacatgtaatgctattaagatggtaaaaaatccatagagccattaaaattttcaaaatctaaacggttgcaatgatgaagttgaaaaggacaaccgttcttttgtactcagggggttttgtaataggctgtttgaaccgcagtggcttttgtgttgaagatgctgagttgtttcttaagaacacattttctctctgcttcaacttacctgctttcttcagcttgctgctaaatggcctgggtttgattttttttttcctaataactcaacatttctaagaaatgtaataatgtatatgatctctttacaacttaaatctagttcatttttaaccatattgtaacaaaaacacacaaattactttgtactcttgacaagtaaatgaaaatttttctcctgggttggctttattctacaggacttgccatcaaccacccaaccaaaaggacgacaggtgaatagataccctctatagaaacttctctaaaccaagctaatagctgatcctttattaaccctttccatcccataatgtctgcattttggaccataacatttgagcattgaaagcttgtaccatttcattttaacacattatacatgactaattctctataaagattttttttcctcacatctctgtagctgtgatggttattgtaattacaagctgatcattttttgctggcagtaaagaggttttagccttagagagtcttacctgcctctggtgcatacaaaattcatagaattctaagtatgactaagtcacgccctaatgaacaacttaaggcacttttctgacattgaaatctgaattaaaattaaatttctacttgcttgtgtatctaaaagttacatacgatgaaacagcgtcagtaccttggtcttcaccctagtatgcctgtgctagtttagaaatgctaagtgctgtccagcatcagcaagcagctttcaaacagccagcgcttttaaagcatacattttaggtacaaatgcagagattcattaattttaagggttgggttgctaaaatgaaatatcacacaatagttccaaagccttcaggttggttttaccatgacttaaatgggacattcaagcttaatatcaatagaaatatcatgagaatgtttttcttgaaatgtaatgctaaaaaaaatactaaatctgattttaagttaagaattgtataaattaatgattagtagaatatccccacagtttagtcttaggatttcataactggggcaaccttggatatagatagtgccttattttaaagcacttagaattccagtcattcataaaaccctatgttataacccctgtctgctaatgtgtctcctcaattcacataccataaagctctaggccttgaaccatgcatgctttagtgctctgtgctgatttcaagtgttacattgtcaaagcaagggtttagattcatctttatttccccagaaaagtaaagcacaaatccaaaatctctctaaagaagtaaagctgtattttgaatgttttactattgtttgggttacatatagctctgtctgcagtatatagacacactgccagttgtcatgaaaacatggcatccaatatcatgaaagcaagatcccatcccagagttcttgctactttaccatgaaaacctaccctgagtactagtctctatgccttaaaggctgcctcatggtcatgacaatgtatccatgccatcaccgtggccatagcaagtttttaattggtgagcttaattacacacctatcctattactaaaagcagaatttattcaacaagtattttaagtgttccttccaaatataaacagcaaaaatgaagctctgtgcatcagatatggcaccctgtttctagtggtagttgtttcttgtgtcctacctccatacatcgtttcagctttcaccatctgatgtcctgttgtgttgtcaatgttgatgtgtggttattagagtagcattcactgtttttcttcccatcactgtggcctccgttcttacaagctcctgttttatagatctatgtaagagcacaatttgaatatgatccagccaaggatgacctcatcccctgcaaagaagctggcatccggttccgagttggtgacatcatccagattattagtaaggatgaccacaactggtggcagggtaaactggaaaactccaaaaatggaactgcaggtctcattccttctcctgaacttcaggaatggtatgtttttgttattttatggtgaaactgagccctctcttccagttctcagtttcatatttcatattataaaacttgcttgataaatccttttctttggtaactatataaattccagttgtctaagatcaaatccaaaaattatctgtccaagacttaatcttcagcttatggtcagatactaggtccagttagagccacactttctgtgtaaggaaaagagggaggagataagctaggtggctagcttcagatcatttgggcagagccctcaactcctacaaacttttctaatctttttacaatggcctttgctttcagatgtatccctctgtatccttttatgaccatcttaccccaacatcaggaaaaaatatcttcaagtgccatgattcaatgtcactcgaggtatttaaaaatgcagcctgtcccactgttgggagaaaggacagtcagaagctttgttcttggccttaccattctttaagaatgtgtttttctgagttgggggctgcatagcttagaagtagatgtttgcctggttataccacagaccaagagacagagacagggaaagatgacctattctgttagaaggcttaaactgtgggacaggatgaaatcagacaggcattttatacccctcccccatttaactgagagaagacaggatgtgtatcatctattaaatgcccataatctaccctcttaaatatttgcccaatatctaccagaaatctactacaaaaaggggtaatttaatacctgggttttgttttatataagacttaatctgccaaaacctggaattctgccactccctaacctatccctacaaaaatacttgaactttgttaaaagtaaccaaaaatattgagtccgtaaataattcctctttttcaccagtccttctcactattaaagggttttcttggttaatctctttgacttgattgcccctttcagctatcgtatcttccccaaaattattcttacatttagaatgttaaagtagatgagagcttcaggcgccatgctacaaatggggaaatggggcccaaacagagaagcaacagcctgccatcctgcactttcagtctgatcttaagcagacagtttaacataagcgggaggaacgcagtttctaagtctttctaatgctgctgctgctgctgtgaatgatacattgcccaaaatgtcttctgaagagcaatcacatgagcatttattcagaataatcatgtgtgggctggggatgtagtagctcaggtggttaaactcagtgattcccagtaaagcaggtgtggtggtgcaggcctacagtccagcacttgggaggctcagaagctcaagggtcatccttagttacacagagagtttgaggacatcctcggatacaggggctgtattggaaaaaaataacaaggaaaggaaaaaacaataagtacatagattccaggtttctttctagttagagcagagatataaatcatgtgctcttagtcctctgcagaaatcttaagaagtcgcagtggaaagaggtttgcttcttgtctctgctggcatctatactgttcagatcaatctttctactgcaaagaaaaaatgctgcagaaaataaaggggtgttttgttttgttttgttttttaatgaacttgaaagcactgaataactcaaagagtaccggggaactcaacaaccaggtcctctatgaggacttttcaccaaagctgtaagcaaactcttagagtaccaagtatcccatcttaccaagaaggcatttgtaattatgccagagaagcaagagtaagaccacaggcttaaggaagatggacatcctgtcagggaaccctcctcacattgttagactacaaaagttggtataccagagacaagaaaagcaggctggagcatggtcacatatacctgtaatcccagtatgcaggaaatggaggcaggagaattgtgcgtccagtctgacctatatagtaaatttagggctaccctggactacatgagaccctgtctcaaaaaagaggaagaggactctagattatttccctgtttacaggaaaataggacatactaaagacatagaagcacaatttaaaaacaattcattcagctgggtattgtagaacccatctgaaaccccatacattgtgcactaaagcaggaaaatgtctagaagttcaaggataacgtaatcaacatagtgagatccaggccagcatgagctacagagaccctgtctcgaaagaaaaaataaagtcaactctcctgaaactacaagataaagaactggtttctaatttcctgagacaagggtagggatatagctcagtggtagaatgtttgtctagaatatgcaaagcctgagggggagttttgaactgggagtggtagcttatgcctgtaattcccaaaggaggatcaatttaaaaccagtctcattttcatagtgactttgaggccagcctgggctatatgaaaccttgtttttaagaaaaagatgtcagggagtaatgatacacatttgcaatcccagaacttagaggtacaagcgagagcatcaggagttctaagtcatccttggctacatagactctcaaaccactctgaggtacatgagaacctggctcaaaccaaacaaacgaaaactcaaaaaggctttaaagaagacagagaaacattgcattaattgactataagactcaataatgtaaaaatgtctatccctcctacattaattgtaccaatgccatctctaccctttcttagaaatgggaacaaaacacccatagaaggagttacagagacaaaatttggagctgtgacgaaaggatggaccatctagtgattgccatatgcagggatccatcccataatcagcttccaaatgctgacaccattgcctacactagcaagattttgctgaaaggacccagatgtagctgtctcttgtgagactatgccggggcctagcaaacacagaaatggatgatcacagtcagctattggatgggtcacacggcccccaatggaggagctagagaaattacccaaggagctaaagagaactgcaaccctataggtggaacaacaatatgaactaaccagtacccaggagctcttgtctttagctgcatatgtatcaaaagatggcctagtcggccatcactgcaaagagaggcccattggacttgcaaactttatatgccccagtacaggggaacgccagggccaaaaagggggagtgggtgggtaggggattgggggggtgggaatgggggacctttgggatagcattgaaaatgtaaacgaggaaaatacctaaaaaaaaaaaagatacaagagcactgaaaaaaaaatagacaaattttaaagtttgaatggagaggttggagagatgactcagaaaataattaagaggactagctatgcagtcatgaatctgagttcatatctcagcacccacatagcaagccggtgtatccctgtaacctcagctcctaggaaagtgaagacagggaaagttacagcttgctgatttccagcttatccaagaaaatctgagcaacaggttcagggagagaccctgcctcgaagaaataagtggagagtgacaagggtacccacactcatacacacacacatacatacaaacacacacacatacatacacacatacatacataattatctttaaagtttgtctggaaatgcacaaattcagggatagccagggtgttcttgaacaaagaacaagatcttattcaaccaaataacaaaactaacgaaggtgctcagctagaccaactaaagagacagaatcaaagcactttcatagctaaatagctactttctacgtagcaaatagcattgcacagcagtgaggaagggtcttactttttagtatagcctgctaggacaactgagtatatatgagatacaaactaactggtaggaggcaggggttcttaagaaaagagactggactcctactttacatgataagcaaaaaaaatttcttacacaataaaatatgaaagacaaaactataaactttaggaatttctgtgcaatttgtgatacaatttagtttgtcaaaaatattgcttggtttgatatgtgaaaaattcctagaaatatgcctaatactaagcacgaagcacttaaaacagaccaatgcataacatatccaggatgcaaaacaggcctgccttgactcacaatcccttgatcatcaccctgaatctcacaaccagatgttgggacttctgacccttattatcagctcaaggaacgcatcagttttaacataaggctgtagtcaaaccatttgtaagaagttgtcatgaaagccaaagaaccctctttatggccatgatttcaagaactgagaaggactagacatcctattgtgtgtagccttcaaatgactttttctcttttctcaacataaaactatgcattaattttgttggatttccccctccccctttcttccttccttccttcctttgtgtactaggcgagtagcttgcattgccatggagaagaccaaacaagagcagcaggccagctgtacttggtttggcaagaaaaagaagcagtacaaagataaatatttggcaaagcacaacgcaggtaggaaaagcatgtctgtttccgaagctgggtcaaacatctccaagatgtaagcagatagagcatttacatttgctcttcagagttctctttccagaacattgtatcctatgaaaccttgaccaacttgcagatgcattaagaacccctgcctcctaccagttagtttgcagagctctattttctaggacaaaggtgctatttggaggcagtattcctctctgatgaaaggaactcagcatgctaagtcctcccttgagaaagggaagctggggtatgctgagtccctggggctctctctggcagagagaggttgaccttaagaggataaccctccctcctagtttctcttggtccttggatttggacccatgacaaatattagagacaaagatacacagaagggctgagctctgaagggttctgtagctgatttgaaagggcatgggtaacatggatactaacttgggttagtttctgtgactattcacctttcccagctgtatgtcctttcaagttctcaaaaacacaagatgattagctaagccttccctcccctctgtctgtattgaagctggggtttcactgaatcatggggttcactgttatgttaaaaactgcatgggctggtgagatggctcagtgggtaagagcacccgactgctcttccgaaggtccagagttcaaatcccagcaaccacatggtggctcacaaccatccgtaacaagatctgactccctcttctggtgtatctgaagacagctacagtgtacttacatataataataaataaatctaaaaaaaaaaaaaaaaaaaactgcaatgcgcaccaagtaaagcgtgattggttattgcacttgaattcccagaagacgcacaggatatcatttaagctgaaagaaaatatgtgatggtatacttaatttcaatgacttctcaatataacttcttcaataagggacttttactaagaaattcaaagttggcattagcttcgttcctaagatttcagaaataactatcaagcatgtggccttaaaaagtcaaatgactgcagccatccatgtgcaattcagtgtatctctgagaaatctggaaagcagctttctctatgcagcattgtagcgtgcatcagcatgtgctaggaacagttctttaggacttctgaattctcctttcttaaccagaaattaaatgtaagcatttctgaactgctgtataatccagaatgaatgtgactttccacatggattaagtgggaatggctcaattaaatgagggctctttccctccctgccagttacattactcttattcccactatgcactagccacacaatggcttttgtgtttgtttcataaaggaaagaaatacgtaaagccacatatctaaatagactctagcagccactctgttcaagtggcactgtttgaaaaacattatcagtagaagttagcttagcctgagatatcactcttcttagttgccttctcttcttctgtctgctttcactagtctaaaacaatctaaccagctcacaggagattagttaaatctaaatcacattagttaaagacaaaacaattaatcagctggggatgtctatcagtagtaaagtgtttgcgtagcatatgcaaggccctaggtttcatccccagcatccaaattagagaggaaaatttctaattcaacttgtcatttgtatagtgttaaatgatacataaatactgatgacactcaaattaatttaagcctataaaagcaaagaaaaggctgggcaaatccgctaatatgttattagttttgtaatctactaattaggagtgtaaacatcagtattcaatttgtcaatattctttaagttggctctgaggataactaagtgaattggtcggaaaacttgacctcttcaactgttgacaaagacttagtcaaatcatttgttgaagagtgttgccagagaatcaacacccaatctcatttcctgctgttcatgttttctgttcttggagcactggggcatcgctgtgcttcttctgtcatagccatttggatgccccgtggtcaatgtgactatcagcctaataggcaacctgagacaagatcattagttcacccaaggaagtgtatgacttggtagtcacttagctcactgaggccaaaccaagcaatcaggttagccagtcaagatggtcctttctaatgcttatacctcagtagatctaaggttttctcattactcagcctggccaaaaggtaccctcatggtagatctgagtaatattgcaataccctgtgtctctgagaaacactccctatcaaggttgggaagtatttatccttgattttagacaatgggatacagttgttttcttctccatcctttggcctgacatccccattatctcaaaccatgtgccaaagttctcaaaaactcaaactgaggaaacgtaatcttagttgcaccggggacagggccaccactctttgttgcccttggtgttttcctaactgttgagctcttctagacatcccagcagtccttgttgtgcttgagggattgtcctacctaaccaagtctctctggctgccttcaaaggagtctgagtaccttggaaggaaggtccttgaatagccacttaggtttctaaccctttctgtttctgcttgtctgtgaatctctagacagaagattgctgtgcgggttcctttccctgtagagtcgtgagcgttcttcctttctctatcctggcctacctgcactatacttgcccaactaagcttaacatttctttctgtcaccatctcttccgcactcctcaactttattgattaatgtttccctcttgtttatcctaaaatccagaagagcaaattgcttattgcattataagaagccaggctttgtctgctttggctaggatgagattccctcatgaattatcagattgcccatataaagaattgctgtaaaatactgttagcctccatctatgctatgacaactttgaaacagtatatttttcatagcaacaactcgccagatactcacagatcaaacaatacagctcaaggatttcttttagaaactgactatgaaatacagcaactctgttctttctatggtgtgcagtaattcaaaataaggacatgggatttgttacccagatgttcattgatgacaagctctaaatcttataatcaaagttggaaattacttgtatcatcaagtaaaattaagagtagagacttttatcaacagcaccaagaatggaaatcataacatccaaatctattttttttatcaccaggaaaattctcacatctagttaaagcagaattctgcttaaactgtgcaccctacatcctacataatatagtggcataaataaattttattcatatacagtattgaaataattttatgataccacatttgaaaatcaggttatgtaacataaaactttgggttttcaacatcccttggtaaaataatcactaggccacttcctttctttgggactaagggtgctgatgtccattgaaatccattcttgggagtttttgatgtggggttggttgctttgtgattttgttttgcctttgagggcttttttgtgtaatatttgaagctacttacagcctttcaaacggaggcaaagattcagtgttacctgcttgctttttttctgccaatatagttgcttaactacttcagcttactaggaaaccagagaaatataaacaaagtatgccaggcaatatttctaaattcctgggaataaattgtattatatcattgtaatatttatgtgaaatataatttctacaagctcgtgagacctttagccacctgctaggcctgtcctctggaggccctgtgcttcttcagcccaagacttcaagaattcacttttagtttaagttactgacttaaactttttaacaaattacaaagtctatattaatatttttaatatgagccatcaaaacagcagtatttagtgtcctgaaaatactgcttatatgggtagatatgaacttaggggatttctggaatagtattcataatatttaaattatgcttaatactacaaactgtcctaaagaaaagtggcatataacctcactgacattggcaattttttaataataaaaatagggatttatgtatagcttggtgatagagtactttattagcatgtgcaaggtttgagcccaagctccatgaaatataataataagataatagacacacataattagaaaccacaaatgatacaggaatgcacaatgtaaaaaaaaataaaaggcccctacatttgttttctctaaagatggtttcttatcatttacacataaaatttccatatacatgctagcatataaaattcactggctttcatataaaggtatgattgaatttgtattaaaatgagtttgtttcttaatgtggtttatttaccttgtgtttaaaatattgcatgataaagtttattttgtgcctattatacttttattttactaatatataaaaagtcatatttcaatgacccctgtacatttttcatgctgtctcactcccaatggcctctgtgcatgtaagtaacctgttgaataactatgcctctatgttttaatgatttcattttattaagccctttgtctttatcagcaagcaatttaaacccttcataagttcagtctttaattactctcttcaaatatcctgttttgttttgcattgctttgttttgttccgttttatttcacaaccctatgactacatgacaattttatttaaaccagagtaaccttttcatgctgctcattcatggttcaaattctaatgttcaacctatatgttgctttgtttgtggcgtattgactgttaatccctaactcgtgtacttttagacaatgacaaaaacataaataagcaagactcaagttagggctctgtagaaggagagaggggtgtctccctttcagaaaacttcgtgtcataatcatcttgtgcttttataaaacacttgatggttttaatagtttaaaacaacatcagcttgctggtgtacttcttcccataagcacacttttccttgatggacataggattcaggacaataggtacagaatgccatgcagtaagcactcctgcctttacttctgcggttcccatcattccattcccactgcagcacagtgaggtagctctaccacagggagtctcgtgtacatttttattttgtgaccatgacatcctgcaaatgttcctccaatataagctattgctagagaatatggtgtaaagattttttacttaacttttatagtcaagctacccaaagaaaagagatatacaaaattctattactatgcactagcctttattttaatatattcctttctctatatattttgagaatgatgcttttgttcatttttgtgtttgtgatctattgcattccatggtatctttttttaacatcataaagttttgctactgtgcagatcacacgtgaaaaggactgagctgattctcaagatcatgtggccatattattgcagggagcagcagcttctctgaatgattcaaccatagactccatctcactggattatttcactcacttaaaatcctgggagaactcaatattttaagaagaaacttcactgtgtaccggggatgggaggcagggatacaggaaagagatgtaggatctcagctttctcaggaaaattttcaaacgtgtgtgagaatcagaccccattgaacttcaatagcaatgataattcactgtgataacttccccatattgcttgaaattattcccatcagagtgttgttaagaggcaggtttcagaaacatatttttttaagtatttccctgtctataacatactgccctttctcaaaggcctctaagctcagactgtccctgattatttccatcctgttcatcctgatttaccatatagcttcctctataattaatggctgacatggtttctgggacaggaatgcatgcttccctacttaaaatcccaagacctcagttatagtatagtttgtgaaatggtcaattaaaaccttgtaaaaatcattccagaacttggctctaaccaattctgacatgccacctttatcagattgtaagaagtaataaagagcagtcccatgaactacaaactggatggccatgcatttctcacccatctctggaagcgctacagctggccctccctcgcttgactttagttgcaccatgctccacttgtgttggttgctgatcatacatagactcttctttttagtattgcctatttcttagagttgtgaaaatatgaacagcatgtggttctgagtgaattcaaatgatttgttggaatactgcatgaaaaaaataatatgatatcctctagatttggacctgcatgtactcatcatatctttgattattcctggttcttgaatcattttcatgggcttaaaaatgacactttctcccataatggcactatgaattaaatcacatgtaagcttcatgtcataagcgggatttgtggtgttactgtaacttaatttttccaataataaaattgtaattcacctacatgagctatccattccataaacttacctttcttctaaatctttgcattgtagtgtttgatcaattagatcttgtcacatatgaagaagtagtcaaactgccagcattcaaaaggaaaacattagtcttattaggtaagtttggctgattgtttattcttacctccaaactgttttacaaatgttatttctagttgttaatgtttccattgtttataaaatcacataggtgcacatggtgttggaagaagacacataaaaaataccctcatcacaaagcacccggaccggtttgcgtaccctattccacgtaagcaacagatcaaactctttgaattctttttctcctatcacattcttatcactgcaatgtgcatatttttctaattatcaatatagtaactgtttaggaaatttgtaaaatccaaaacaaaagcaataaagaaaagaaggtaattcaaacttcatttttccaaattctaagtaccccatggggagttgcagcattagtctattccgtgttgtttgtaaccgaatttttccaagaatatgtcataaacattatctaggatgattctttgaaaaaataagctttaactgttttctaatttctctgatacaaccctgttccctccactcatctgtattattgagttcttatctcttttaaagcccagtccatgtcctatctattgtttggaaaagggaattcaggtctgcagtatttttcagttccccttactagtctatttcatattatcaacctcttgccctctttcatttcctcaactgtaaaatgaaataaccccatggttgtaaaaagggttccagggtatgtatatgaagcaggtgatggctaagtcatagctatatgatagtcagacctatcatttcattgtttatgtcattattctaaaggttaatatttcaattcccaaaactatccagaaattagttctctgttcaggttaggcagagcaaatgaagaattgttctagaactacagaagtaaccagggacggtagcacatacctatgatccagcactcaggaggcagagacaacagaacccctgcaagtttgaggccagccagggctccatttcaaacccatgcctccaaaaaacaaaccaaaaaaaaaaaacaatagaagaaaatatcaagacttgtttcttccttctgggtgcttataagcaaggtcagtgtacacctcagagagtcaggaggcttcagaagtccaccaattagtacacaaaaaaacttaccaggtattgcaattggtgctcctgaaattttatattcagacattttgaaatgttcttccagttttcatgtctatgtctgtatcatgaatacaatgagtttggggaatgtttagtttcatcttgatcacatagcaggtaaacttcctggttattaaacatttgcctggctaactagatcaattggaaagcttacttttgatgacatcaaccatttcttaatttgaccccagctgcataggcactgtacattatctgatatagctgaagattaggtatgccaacttcagcttttggtatacctggagaaaacattctttctaagttgcatttgtattcatcaaagagaagcataaatttgtctttactcaaggaataaaggagtacagaagagaagtggttaaaagatgagagaacaaaagcagggaggaaaaaaggggagggaagaaagaaaaaagtatatgtgtgtgctcacaattcagagatatcagtccatgggtggcttgcttactccattgctatgagcctgtgatgagacagaataccatgatggcaaaagcttatatcaaagcaatgatacttacctcatggcaaccaggaaacagagaaggcaggataggaatgtggtgtccaaagaatatcccctcattgatgaactacttcctccaactagattctacctccaaatgctatttccccagtaacgccacccaattatgaatccatgaattattaggtcaaaaccctcttgatatagttactgttcaatgattggatgcaccaactggaaaccacgcctttaccacatgagcatttagggggggacattttgtttctaaaccgtaacaccaattttcccagtttgtttaactgcagtatgttctgcatattggcacttattttagtgtacactgacttgggaggtgacaaaccctttctttttgagtctttgaaggccacataacccctgccagaactactcatctctgccactaaagaatgaaaatagccctagacagattatcaacaaatatgcacaattatgtttcaataaaaggttaatgcagaggctggagagatggctcagcattaagagcacttgctgctctagtggaggactcaggtgtggttcccagtacacacatggcagctcacagtagtctataactccagttctagggcatctagtgccctcatcctgatgctgtagacactaggcacacacatgggcacaggtatacatgtagacaaaatactcctgcacataaaataaaaataaatcttaaaaacaaaactttaaaggaaagcagccacagtggtacacacctgtaactccagcacttggaaggctgagacaggaggattgctatggatttgagtccagcaagagcaacataccaagtaccagacttgccagggctacaaagcaaaaccttatctcaaaaaacaaacaaacaaacaaacaaacaaccacctctaaaagacaatttggcatataaaccagttcacaacttccttgcctcaccttttgctttagtttttctatgataatcatagccacgccttttgaaatccatttgttttcagtatgatgtgtcttttgctgtattctagcatcctcatctataaagtggtatagactagcactttcaatatctgaaatgtccaacacagtagtcctttgtggctcttcagccattgaaatgtggctcatgagactaagaaactgaatgatttcactatcattcatttaaatgtgactaagcacacataattgtctactctgttagtctttcttctttctgcaagggaccaaagtaaggatagtgagttatgttaatcttgagccacactattagtgatatttctattgttacgataaaatattatgaccagagtaacttacagaaaaaggactttgttttggcttacagttccagagtgacaagatgctatcatagcaggggaagcatagcagcagcagcaagaagctgacagatgacatttccaacctcacacaaagcaaactggaagtgggagaaggctttgaactctccaagcctgtattgttagacattctctagcaaggctcaacctccccaaacagttgcacccacagaagaccaagtattcaaatacctgaccctatagggccattttttattcaaaacaccacagtcacttcaagtctttcctccaagagtggcatgaaatatgtcacaacactgaaatattcaccaaacaactagaaaaagaagctgctatgctgctatctatgcacagataaatatagtttttaaattgctttgtttgaagtcatctatttgatggaacacagggcccccaatgaaggagctagagaaagtacccaaggagctaaaggggtctgcaaccgtataggaggagcaacaatatgaactaaccagtacccccagagctgtgtctctagctgcatatgtagcagaggatggcctagtcggtcatcagtgggaggagaaacccttaatcttgcaaagattctatgccccagtacaggggaacgccagggccaggaagtgggagtgggggggagggttgaggagcagggtagggggagggtatagggcactttcacaaaggaaactaggaaagggaatagcatttgaaatgttaatgaagaaaatatctaataaaaaattgctttgtttgaaaatctgcaatgttagtagagatggaaacaggggatatgtgacactctaaagaaacaacagccttttttccttttgagacagggtctcttatatcccaggctggccttgaacatgcaatcttcctggtgccacctctcaggtgtgccattgcagctatgtgctgtcattaaattgtggcttaatgagcttttgagaaacaattgaggagctaagtttatagagctcagtggtagaatacttccctaacatacacaaagacctagatcccactcatgcgtacacacagtacacacacacacacacacacacacacacacacacagagtgattgagttgaatagtccattgggagtgtaactcaccagtccagctgtttaaacctctcatgaacggaactttgcagatacaaccagacctccaaagaaagatgaagaaaatggcaagaattattactttgtatctcatgaccaaatgatgcaagacatctcaaataacgaatacttggagtatggcagccatgaggatgcaatgtacgggacaaaactggagaccattcggaaaatccatgagcaggggctgattgcgattctggacgtggagcctcaggtaatgtccgagccaccctgaacctactccatcttgcctgcatgctcataagctcagattctgacatcgaaaattccatcagaaagttttgggtcacaaaagtaattctctaagcttaagtactcaagacctcctgggtcaccagtctaggatgcaaactaacctgtcactgaactcagtgtacacagcatgcatttaaggagcaaattattctcttctgcggcttatactcagaaactcggtgaagtacccatttgggtctctgcctgccagaaatcctacactgacctgacctcaggatgaggctctggcagttgttatcatggcagcccacttctgttctcctggtacagccatgctggatcttacattgccaatatgttacattgattgcttgtaagaaactgatcctgaggtctggatgtgaaacagctctagcttaatgaaagcaagtgtgagtgaggccagtgttagacagagcagggattaagagcccaggtgactctcagcctctgctctttcctttcctgagagagaaatgatctccaagaggactcaaaaaggagctagatacaaagatggttgatttagtgattttgtaactaagtcttatgtaggaagcaatagcaatgatggaacttgaggaacagaaggctgaagacttcacatagggattggcatcatcttagctcggcggtagggtgggcacatgcttagcatgaacaagtaaaacagatatgctgactgacaggctaatttttcatgcataagccaagtagaaatggggcttaaagcacaagggaaaggactcgggaatgatagatatcagaggcgattcggggccaggccagtgggagctcttagtgactcagatgtaccatttctaagatggatctatgtactcacacctcgcatcacttaattaggatgggcgtgccacctgctaagatgtggagacgtgctcctggttgagcagactcggcttcgcaggaggcttatgtacctgtcccaggcaggggaatcccggttgagaggccactgcgtgagacttgctctcatagccatccctaagtgctaaagcagtctgtgtgacctgggtcctgatgactctgtttctgggctccaagattctaacccatggccaataggttcatccatttccagtccagcaccaagtggggttttgtactcggaagtttggaaagcacaatgaggttaggggctagggaggagtacgacagtcggataaccattagtagtttacttaacggttaacttggacctatagagaactaaatatgatgatgtgtaacgcagattgatctttgtttaactactaatccctccttactagggattggaaaaatcttctggccaggggtggctagaggcaaagtctcaatcctggtcctggtcttcgacatcctctccttgggttccacactggtcttcacctgaacgtcgttttctgctggtagtaatgtctctagcagtatgctggctgcagggctcctcagatccctctgcattacctcaggccacttccaagggctttctgccttccctgctgctgctgctgctgtcaccgccgccgccaacaccaccaccaccaccaccaccgctgctgccgctgctgctccactcatagcacccaactctccctgtccccttgcccttgcacagccatgcactgctctgcactgctgagcgggagagccatctctcagcctcctcaggacgtccacagcagatcctttctccattgcacttggcccggcaccttctcctgcagggcacactggcccctgctgctctgactgctggatgagctcagctgcactcctctcctgcttcctgcttcccctcctctcacaactgtgacctttcagttctactgacccctgagggtgggccctaggcatccttgcctctgccctagcctctacagggctgaggctctggggacaagaatggcccagggccatctggcccctgtatggtctggttgaccactctggtcccaggccctccttcccagtctagactcctagctggatgttatatatgatagtaggaccagggatacttaggagtccatactaacagggctcccctgggcctccctgcccttggtcctctctctccagggctggggaacaccctcatcctgctttcaggatgtctgtggccatgaatgacttactttcaggcagagctttgttcttagaacattttcctccactcccctttcccaccccagctggttagattgaggcctctactgtatctctgacagacagtctgatacaacacacttatactgagagcaagaatatgccaggctgtgtgcccagagccaaaagtgctaaagactacaaggtgctgaggatgaaattccttcccaagtgtgcctcagaaactatccaaaagagggaaagtgccttgtgccttttcttgtttgaatatgcccaacatatactccacctgaaggcatttgtcccatagctggcccattggattaccacctaacactggtgctcagctcccttcagacatgtctagtgctttgtgccaccttagtttatttcagacaactgaaggtaaatttaagtaccaatactaaataaggtatgatggtctaacttcaaacctagaggaccctggcaaacctagagaatcctaaactagggaaaaaaaacagtaacctgcctgctttcacattagcaaggggctgtatttcctatagtgccagtcctgataactttaaggaactctaccagtacctactgccatagatgaagagaacaggcttaatgtaactgtgatcaaccaacattttccagctggtagaaagtgagatttgaactgggttgggtggtaactctgggcaatctctaggtctcccaccttgtgcataatattacagttaaaaccttgatatttgttttcttttaacaaataggaaagtttatagggtaattaaacctgaaaaattctacaaagctcatttttcatggaaataaaactataactcgaagaactaatctatatcagtaaagcagaaaccataaaataactgtattgtgtaatgggaactttatataatggtttttaacttgcactgtattctgatttaccaatcagaagcattacaaagtcaatgctagctgctgggcatagctgtacataccggttaatacccgggctcaggaggataaggaagaagggtcagaaatccaaggccagcctagactgtatatccagattctaggttaaatatgattaatagcagattacttgtagctttgcctttgcccaaagggtgaaaagttgtcattcggagataaatctcaaacttagtaggaatgttaaacttaaaaaagaaaaataatcagaacttaggacctagctcagtgataggggcactgcttagcatgcaggaggagcatgcaggaggagcatgcaggaggagcatgctagattccctcctcggtcccaaagcctaagccagagctgttctgctctctggttagcactgtggacttactgtgctctccctgaagcccctgagtttgtgtacaagagcaacttggccattttcttgtatactttgtagctttgtatacattgcaaactactttagtctaatgacacctgtatcttacttagatccttgggtcaaatgagttcttttttcttggcaacaataacctgagattagttcttgcccataggtaaaggaactacaaaaatgaatttatctccataaattacctcttcataaatgaatgatactttttaaatctagggtgaatgtagtaattattttaatccagtatgtttcccataatttttctataaaattctctctctctctctctctctctctctctctctctctctctctctctctctgagtccatccctccactcccctctattccccacctctttcccttcttccctccgtccgctccctcctcttctttctttcctccttctcatcctcctctcctcacatacagatttacctgtcactattaacaaatttgtatctcaccttaaatccaaggtttaaaattcatctttaacttggttgttaacagcctgagggaggggcatcctatgagcagttctatttcctatccctaaagtgactctgaatctcagctaagcagaacctggacctaacctggctcctgcttgaaacccctaagtagaacagaatatgaggatagggattgacagaaacaaaggaggtattagagatgctgaaactgaggcctgactagacaagaaaatcgcagttggtatttgaggcacattggaattttgaaaaatgcaataatacaggatagaaatagaagaacatgaaaaagacaggggaacaaacatgctaaccacaggaactactgtacttattgtgatgaacattaaattcggtccgaaactttgggtcatggaggagggtgccaaaaaccttggcaatgtgatgagcatggccttccttgggggattttccagagttgagttgggtggtcctccttgtctgctgtagacttgggacagcacacagtgcacgtgtggctaattcactaggagctaaagtgctgctttccaaggaatggtttgtttggtcagtaacgtgatggcaggctagaaatcaaaagcacccacgggaatgggtgggtagcagggtggatgactaagaagaaatccatctcccccctgggtgtcattgtcattgtcctctctacaggctataggccattccagcaggcactcagaggtagcttggggggggggggggaaagcaataggatgtttccatatcttagttgagagagaggtagagacagacagagacagacagagacagtcagtccagtggaaacgataagaaagccttataccctacctacttgtcatatacctttcctaccagagcataggaaggaaagaacaatgacccaaggtaatagagacaaagtggacatttctaagtgaggactgtgttagacttacttgaatcatgtgttcagtcacaaaagaagaacaaaagaaatgggcagctagcaccatcaaaaattaacatggtgggcctggaaagcatttttagaaggggacttgggcttgaccaataaacagctttgggcagataagacagtgagcgaggttcccctcatgcacccaaagacagcatgtgaccaaaatctaaaaccagaatcctagtacaggctggacttatactatactcaaaagtgagaacctttaatatcagattggatcttagaattctgtgtgctcagagataccaagagaacagcagctctctggttagacctgctacaaagtccaggataaatgttgtatatattccatttactgtttttacatttttactgagtcataaaggcagcttatggtgtaccatattgagtataagagaaacaactgagcaacacacagcctttgccctcagaccactcccagagactgtttccagtgtggctgatggatacttcaggagcatacagcagggcctcagagcctaacagggaactttccagagaaactgccaggtgtgctatcatcagcacaagaggatctggagcttaaggtccaagtcagtcaatcaagtacatggctagcatgcatgaaaccccagattcaacccccaccactacataaaactggccatgtctgtaatcccagcactcaggagatggaggcaggaggatcaaaagtatgaagttatttttctctttatgagatcatgttcaaaacagaacttttcagaaactgggctccaacggattattcagccacacagaaaggacagtgggaaagaaggaagagtgcaggtagaagaagcaccaagcagaaaggccaagaagccagaaagagttgggcattttctaggactgaaagtctaggactctaggaatgaggccagtctactcaggaatggaccagagctaggcaggagtttaaacatgggacccagccaagggacatgtgtttttccctacaatgtagaagtgggctgttgaaggattaggagaggaagagagagtctgcatcccagaaagatcagctatcagtgggttgggatatggattttaaagcccctaaaactagaggcagggaatcagtctaagggctatactagggctagtactataaaccaggctaaggatggagtacaagaaacaggaaagaaaacaaaagcaaagataatttacaaagcaaaatatataggtaacaaaagacacatgtttggttcttgtgtaaagagcagcaagcagtaacgccaggccaatacagaagggttgtccatttgaagccagcctggatatacctgtttctggggaaagaaaactaaagttaaacagagagcagcaaggtatttatttcccaatgcctatgaatcactcacatgtcagtcatgtgtggattacgtacctggatgtggtcagctttgtcccagaattgatatttataacctctgagaatatcatgacttcccagaggaggaatagaaacagtgagccttcacagagtcggttcctatgccacctcatcacaactcaggcacacatctaagcaaactaatgacttgtacagatttgccacgttttggaaaggtactagaaggaacctcagagggccttctacttgaatgccatatcttcacatgggtcatgacgtttaccacaaccatacagtgtctttagtggcaggaattcatgattacagccctggacaagggtctccctttctcacttgagtcccctgggagggcgactttcatcagaaggcctttgtaaatgtgacagcccacacagtgatggtggccaagatttgctctctttggttagcaactggcagtttgatatgtgacagagtgggttcccagtcagtgtgaagccagcttgcaactctccccagaatgcatttcccatcaactgaaattcaggctccatcaaatcaccaggtttaaacaaacattaacccacatataagctatgagattcataacaaacaggtccaatttatcagctcttaacttcggagctgctggccaccctttaggaggaaagcaatgtataaaatgtataaagttggtacatttacttttatcttgctaaaaacgtaagccacggccttgacgttttcagttgggtcacgtattataggctcctctgcatgttatcttggtgatttcttcttctaagtgtcttccttttctgcacaggcactgaaggtcctgaggactgcagagtttgctccttttgttgtcttcattgcggcgccaactatcactccaggtttaaatgaggtaagagtgaacttgcccttgtccggataagcacagtctggggtaaggaatgtagatgtcctgcacggaggacacctgagcaaagctctgctttgtccttttgctgggcactctgattcccagagtacaaggagctcattcagtattgagaattagaccacataggcagggtgtttcttctgcgatcagaacagtagacaaattccagccccatccctaacacagcaggaggtctgccccagacctatgatgtggactagaccagtcagtgggacagcctgtagccttccttaatacatctacttgggaagtccagggagaaagccgctcagttcccaaggaccgaggtattccaagcagactctttccatggcagctagtctactgcctccctaacaggattgtattaagacaggggcagctcctggagctaagaggggctataaggaatctatgaccttgatggggcttcccaggttccctgtcttgtgaagacctctggagactacgaaacctagagatgagctggcctgggcagggagcctcatttctcacttgcctagtatgtacacgtccctatgttctatttcccagcaccacaaaaagaataaatcctgggtgctttcaagccaactcaagtcagtacttgccagagctggccccaggtcttaccaagcctacacaggttattccctgggaaggtaagggtggcagcatatgctggcatctgcttcctgagctaggaagccactcctgagtaaacttaccctgaagagcatgattttgcagattctagaaaccagcagatcctcgactgtgtccagtgatcagtgacccgtttatatagtacagttatattgaggcttgaaagttgggtgtgcccttaatatttaggttgacctttagtgctcatattttcaatctctgttgtttgtttggtttgtttttgtttggttttttttttgtcatttcattggcaaaagacatattcttttataaaattctactctcccatgtgtgtttgaaactcctcattgtggttaatatttttccttggttgctatgtatttttcttgaattatcatctttgctttgtttttgtttctgttttgcctgttatcctacctttttactaattttccatagctgccaaaatggtgcagaaaattgcctgtaagtaccagctaggaggtgatgaaatacagtctgtgtcttttaatagatgtagaatgtagacatttggttcccataaatccttgcttttgctgttagaataaaggcattttgttttcactgagctaagcctgttacaggcaagggaacaagctgctgcaaaagaagccgacagagcctcaccttagaggatacagacacaagggcgctttgttcttctgcaaaaagaactctgtctagccataaattttcttgaatgtttgcatcaacccagtcttctgaacaaaccagaacctgctagcagcgtcctgggcccaagaccacatagcacaaagaaccccctggcacagagactgacttcttagaaacgtgcctctaggcactggtgggaagtgctcctggctctgatgaacacctttgctgaaagggagttttgtttcctgtgaaactgagccacagtgaaaatattatgctttttcaggtacaagcataatgtgtgtatttagcctcaaagggtgactagtgacggaggtcttgcaaccatgggatagttaacactgatattcaaagcatgctgtgtcctgctttgaaattcctgtagagggtgactaaaccagtagactttgcttggtcagaatgcccagataagagtttctggatgctcttgggtctgtccctgcaaagggctggaatagtatgcccttgccagagagctgtaccctcaaagaacaagaagaggggtccttagccagggctagacacacagaactccttggtccctgaaggtatcatcagagttttggcattctccagagatcagactctgttactctgagtcccacttctcaatcacccagagtcttgacagttttttttttttttctaaaaatcctaatgggaccaatatcaaacaaacactttttcttttaatagcatttattgaacatacactatgtgtgtgccactcagcttagcaataatctgggacaaagcaatagcaaaacacacaaggttttatgcccaggttgaagagagggataataatctaataaacataaatttatggatgtgtaaatatataaatatgatctaagatctaggttacccaaagactgcccctgtctcttcccaagtgtttgggaagtagggcaggaaacttctagttcatttcactcacaaaattcaaatttgaatttggcctttgtgaaatcatcataagaaatttaacctggccaggcagtggtggtgcacgcctttaatcccagcacttgggaggcagaggcaggtggatttctgagttcgaggccagcctggtctacaaagtgagttccaggacagccagggctatacagagaaaccctgtctcaagaaaaccaaaaaagaaaaaagaaaaaaaagaaatttaacctgtaaaaacagagcaacagaccttctttctggtgactctttagaacactaaaaaagtattcaaggtgggtattatgctacatacctatctaatacttgggaagctaaaacaagaggattctaaattccaggctagcctgggctacatagtgagactctggctcaaaaaaaaaaaaaagcaatgggacaagcttgagacccaaggttccctcctggtgttgattcagcctgggggagttttgatagtctgaggccagctgaatacaggggtgacagcctgcagtaagcctacttagagttcaaggtttgggggcagttttcttaagaggcatgagtacattcacaaaccctgacatttttctggccatttccagtacagaccaacttgggggcattcttcagctgccagttactatgtatgtgggaaatggccttattccaccattatttatagcatcctgaaagttttgcctcttacatggactgctgtcaaatgagggctcttatgtgccattgcattcccagaacacactaaaccttttaagtagatggagggaaatattattagcacaaacatgcgagactcaaatgagctttaaggtccaagggaaggagattcgagagtttacctcaaccacactagcatttcaccaaaaaggctgtagctctggttctcactggctcaaaggaaggataaaagaactatagccactagaaactcaagccttgtgtagtctcccaaaggggactctgagaataggcccaggtaggcctgggtgggggctttgtgtttgctaaaatgttggctttagttacttttcacagagatccctgttgcatgtcaaccagtcacagttgccagtgggagctctgtgaccctgccatcacaggacagtgaccatcatctctgtcacacagccatcttagcctcataccccactattgtttagttttgacccgttctaacgctgggatgaaatgtagaaagagaaaggcacggactgacttccaccttgcatttgcttttcccttctcccatccctccccgtctcccataccaccctatgcaggatgaatctcttcagcgcctgcagaaggagtccgatgtcttgcagagaacatatgcacactacttcgatctcacaattatcaacaacgaaattgatgagacaatcagacatctggaagaagctgtcgagcttgtgtgcacagccccacagtgggtcccagtctcctgggtctattaggcttctccttggctatctgagtataaaactgggagccacctcctacgtggaaaaagcctctttgttatcggccttgtgtcagcaggtcgtggtccctagagactacctagttgtagtgtgacctacatttataattattgtcatgtccgaatagataggaggagaaaatcaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatacctttctttcctttatttatttgaaatgattagtctagtgattacaaaacagtcataaatttttaaaggcctgttttctctctttttttaagtcctttatgtaacatgcggatactgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaattacagccaagtacattccgttcacggggcacacccaggggagtaagaataaattgctattatgactaagttgtaaacctatgcacatcccttgcatttcgggcaactttataaaacagaaaaaaaaaacctgatttttattaataataatcatgtagtgaaatgtgtttgtaattttgtctcaatttaatttgttgtaaggtgggagggggtattgctggtttcgccatttcagatctgtgttgtctaagagtattaacgttttaattaagcaaagaaatgcggatttttaatctgtatgtaattgttttaagcacccatttaaagagaatatactgtgcaatgaagaaaccagtttaggcatttgctacaaactgaattattccaaaagaataatctataacagccctgtaaattcctttaaaatgataactaacaggacagtctgaccattttttttaaatatacttcattgtatgtgttcaataattaaatgcctttgggtccttcatttcattatagatttgttcaggtccaagctggtaatcttttaagttctaaaatttgttagatgctcactgacccatcgaaggcccaggaataagtatcggttggtagggcaacaaagcagcctgccagggcacagcttggaccacatgtgactcacaaggccacctgtggtctctccttcctcttgctctatcccttggcacaggggagtcacctgtccttgttgctttaaaagcattcaccatgtcatcccccgccatgctgtcagaatcactagaggaggcccaggctggggttctcagactgccagaggtcactagagtgttgccccttcatggatgagagaacagggcactgacatgactctggtccttggaaacacaccatcgttttcatttcttcagggttagctggcctccatcactttgtgccttggcagaatgagttctggcctgaacagctcctcttaggcactgaacagagaaggcatttttgtgttcatactcctctcctgttttcagcatctcacccttcccaactattattacatgataccatttggtttctgtttgtagaccattctttgtcagtgcccagatggtcacaacttaccaacaagatactgtgagaataacttgtgttcggtcccacaagtaagggtggcctaacagcacaccagagacagactcaacagtgagctcttgctaggtggagggagaaaacttcaggagttgcttagggctgtgtagtgctgacctcgatcctaatcagtgcccaggccagacatcattactgcagtagtactgagcataaggcacccttttcagtggctcagtacctgctctacctcttccagtaaagcacaactaaggtgtgggaaaaaaaagaaccattcctccctctggtagaatcccttatgctccacttgctcttgagagcacatctccagaaatgctggcaaggcctgtgtgtgaccatctaccacgtccccccagacagaatgagcataggaaagtgaagccagctgaagttcaggtgagcacagactgaaaaaggtactccaggactcggggacatggggaacttctgtcctcactggccttctggagtctgagagaagagcactggtggcatccttcctgcccttatacaggtggcgaaagcctgcacctagaacccagcggctgccccagcagctcacctgctcttctccactaatacacagctctaaagcagtgtgcttatgacctacaggaaaacaatctctgaagtcagagtactatcagtacagccgtaccccgagcaatcagaggaaattgctcaaagcttcttgactgcttccatttcatcggccagaacacacacacacacacacacacacacacacacacacacactagagcaaattaccagagattgctaaatcagtagtcagctgaaatgttggaaagccagagtgcaggtcctttctgccgccccagccctactccccacaacaggagaaggagtgtttggatctcctaagttcgttgcttaaaagatgaagtgagctgattttctaatcataaagcagtaattacttctcacatgcatcgtattcctatctgaacactgaaaaggaatgtgtccctcagcttaattcatctggaagtttcccaatgtcgagataacattggaactgctttagcagcaccccatcagaggagatggcttaaaatatcagctcagaaaggcaaaagaaagagttgacctacttcttgctatttgcattcagaaggcagagtctcaggctattggtggcagaatagataaagctgcagagttccccagcaaaggaagagtggcaggaagcggtcccttccctatatctaaggcctggggcaggcaggccaagcattcctttgaagctactgttatctttttaagctttttatctgtgagttctgttttccaatcaggggtctcttcattaaggttaccagggttttggtttgtttttttttttttttttttttttttttttttttttttttgcaaaaagttaaatcaactgaaccaccctccaggaaatggggagctactcagaatggaaactgctccttaagggtgaggcagcccaaagcattctcttgtctcccactgatgggatgttcctttagcatctcaggtcagtttcttacacgggggaaaaataagcttagcttgtcacaaacgctatggagaaaatggcttgattagtgaattcttaatacaaatgtctccttggaaagaatagagggcacactgctaagcattccaaaaatcaagcccctggcatgcctcatcacttcttgtttcaggtcagcattctggtgggtagatagtggtggctgtttgtcagaactgaacacagcctgctccatctgttctcttcgcaaggatgctgatgctgaggcacactgaagcccctgaacacatctttcttgatgcctcgtttcttcctatggctttcagaagggctgcatgttcttctcatcgctgtttttatttgggggcacttgcccttttctggcccttttagaaatagggtctccctctctgtgtggtaccactggctaaggaaaccgtacttgggaggcctcatttgtaatcagctatgcctgggcactgcacacgtccatttgccttaaacttgtgggaagtctcgggttgcccagcttacagagtgaagttcagctcccacatccatccggaagtaggggaaaagaggaagcgcgtccaaccttcctatctgcacttcctgttggtgccttcaggccacagcagcagtagcagctataggcaaagagcagcaccgtctctgggacgggcatccgcaagtcttagctgttagagggatgggagagaccattcctgacttcccactgtttgtcacccgaccctccattaactcccttgaatgaacctgtgcaaatggaccaagcaaaagaaaatggaaggagatgtttgcagccacatgggagaccacattgctggccccaagcacaactccagctctgtgtatgtgcaaaaccttggcacttggctactgcttagagttcaatccattctttatagcatgtgactgagtaaggtccggggatgatgagtcttttggacccaggagagaatctcaacagagggatttgtgcttgggagtagaagtaggcattcctccacagagagtggcattgcctttatttttcatttggcagagaccaagaattggggggtaggggttgatttccagtctttgatgtcgcctgggatgtcctctgcaggcaggtggtgctgagaccacagcatcgtgttccagtgcagtgtaggtgcattgccattcagactcagttctggggtggttttgcataaagctttgccaatgtgttctttctttctgtatgtattattgcctttttataaaaggttttgaagtattgtctcagtgataaaaagagagagatgttaatggttgttgtatatttcaccgtatccgattgtaagtattcgcagggtacagcaaagccttagcttgcaagaggagctgaaggggttggaaaggttcggattctttgtaaatgtcctgcttttctttctctctgtgtgtatctatttacatgccttagcacatgccctcccatcccaacccctttgccctgtcacctgaacaaccacaagggtggtggcaagccagcacagtacaagtcgaaaccctaatcagttatctcgtgtgacagggggagaagagaaactgcatagtattctttgtagaatatacatacctgtaggatgctgtgtaatgggaaaccatagacttgggcttttgtcatttcaaagttggagaaatgtatgaataaaatgtataaaacatgaaaa

SEQ ID NO: 673 - DNA, 2373 bp, mus musculus; identical to SEQ ID NO: 96

SEQ ID NO: 674 - DNA, 294476 bp, mus musculus
tagtccgcgccaggcgggtgctcgggctcgggagcctggcggctgctgaggctgaggggaggagctgaaggcagcggtcgcggctcccgcccgcactgaacgctcatcccgcgaagccccctcccacactcgggagggcggcggcggcgggaggaggaggagaaggaggagggagcgtctctgccgccgcctcctggtccccagcgcggatcagccgccaccacctcccttcgcgacgatcctccctccatggtgctgccgcggccccccctgtagcccgagctgccccgcgccgcgccggagccggtctcgggcagagggagcggtcgcggcctcgcggcccgcgcgggctgacgagcggagagtgcggcgcttcgcggtccccgagggtccgcacgccccggcagcgcggtcgccagccaccgcgcgaggagcagcgggcgggcgggcggcgccgggcccgggccgccctcgctcccacgccccggccccgccgcccgcgccggggcggcagccggcagaggaaaggcgctgcagtctccgggcctcacggccccagtcgagcttcctcagcaccgagggcttgcgggtcctgagtggaggacacgagcccggagccgggcactgagctcttgggcgcccccaacccagttttcagaaccctccacgctgcggccgctgtccccttcggaccatggccgacgacgacgtgctgttcgaggatgtgtacgagctatgcgaggtgatcggcaagtgagtctccacgcgagggagcgggagtgtggaaaaatgcttttcagcgatgcccggggcctcccgcacccgttccgggcctgccccctgccctctctccctcccctctgcctccctcgttctcttcaccctggagaatttttagacgtgtacctgggtttcctgccaggaatgggtctgggggcttcttagtaatgcgtggaggccaccgagccccggtcggccaccccataaggcgtggggcgggctccctgcattttatctgacggttacacagggacgtggcaggaccgattttgtagttgcttcctgggaacagttggggtttttgttacctttcctgtaccatagacctttcacgaaaagagcagcctgcatttcatgagcttgtgtggagagagcgagagagcgcgtccggggtttttaattgtggggtgtgtgtctattgtgccaggatattagacagatgcctttgtgttcaccccatgcccggatttaagagggtcattgaagacggatgcgtccagtttcagcaaattcttcacctgccatagacaaacatagaaagagttgggggcacccaaatttttaatgcctcgttatgcaatgactgtacaatcagtgctcgaggctcccttccactgttgttgggatggtggttagcgtggtagagccgtctgctttgagtcaccgggctggtctagaatatagaactgacagtccaaatgctcatcctttcatctgtgttgtataattacactagggaaaagcagggaatcagattaatcacagtcctgattgagaattaaatctgcagttcctcatctaattgtccagtcctgaaatctgttttgaattgtttccttttcattcttgtcaaacagtattccaagtgcacaatcctgctaatttgcttgtgagggaaatgctggcaatctgaagttgatttcctagttcagcgtgtattctctggctttggaagttgagatcagatttaagagcgatttttgcttatttaatagggctcgttagatggctagtattagaatattttacttcgttttggaagcggtgctttattgtctattttaaggtccgcagttgggaaatgaaaccaagacagcatttggctctagctcttttaagttgtctgcactatactcagtttcaattttttgagtacgggtaactgattttttttcctccatgttgagatattacaatacggctcacatggtgaaattgtgggtagagcttgctacactcttttcttagacccaaatgctccttgccccattgttcagtgaccagcctatctgttaagaggaggatgtccaaatgtgtctggtacagtctttgtggatgtgctcagagcagcgctgttcaaaagctatttaatgagagccacgtgtaatttgtcattttctagtaggcactttagaaagatttcaaacaaaaaggtgcaattttcgtaaaatatttatgtaatacattatatataattagtgatttcagcatgaaaaaattttgccatactgtatatcttttcctactaaaccattgaaatgcaatgtatattttacactaacagaacatctcaattttgacgctaagctaattttttaccagaagtatttgatctgtatttaggtttcataaaatttgcatgtgcaaaaaaaaaaatagattcacatattcaagttgttccaaacgtacataaaagttttccactaactgaatttactatttctaaattttaatcaagtaagcagaatgcaaaatgcctcagttcaattagtcatatttcaagtgcttaatatccacagcctactgccacaattttagagagaaaaaaattcaaaaatctccttcatttcttcattgttgtgaggacacaaaaaagagaaattcgatgtttctcaaaaaccacacaaatggctatgagagtgagggatacttgttgtatcttagttgtagctgttgtgagcctgaagttgataattagaaaatgtgggattaagctgcttgcagatattgtggtgatggaaatagctatcattgaatcaattttggtgattggttctgatttcttcaggtctgaaaggatgacagtgtagatttcaaacgtggtcagcttcatgttagtagtctgtgttgtgctgacttaaaattgagaaaatattttcagaagacacccctagtagaattaagtttatccattctgttctgcagctgcagaaggaggaagagcaagcgaattttgatatgccacctagtcagtggctgcctgcattactgtgaactgtgaaatttcattcctatcctacacaatctgacttggttggtgtcgtctataaaatgccattccttgaaataatgaatccaagatagactcagtcttaaagactgtaatgatggtgcgcctcaccccatgcaaaggttgaagatttctccgggaaatcgtgtcagtatatattgatcctgaaattgaaattcgcttgaggttttttattttagagaccttgacagcatacacttaaacttagaatttgttcaattataagcttaaacagaaaggccttgcaaatcatcgttcatccggaaaaaaatcttttttgatgatttctagccagactccatggaattttgattttcttttgtatcagattggtatcacaaattgtgtttacaccacaatatcttaagagttttaaattttcactaaggctctttaaaataaatttcagttttttaaggcatattggccacccacccacccactcatgcttctgcctattcacctacctacttgctccttttctatgagactctacttcttcagactctacttggtggtgtaaggaaatttcaatttgagtgagggtgggagagagggaggctctcaggaatgcagccctggctggcatggagcttgttatgtagatctggctgctcttgaactcagagatctgcctgtctctgcttttgaaatgctgggattaaaggtgtatgctgtcatgcctggtttaaatttccaatgtaatctaaaccccctttggtgtctttttcttggttaagaacagaacttgaggtaaggagatttggagagagattgctctttgcaatacattttctttgtagctgttgcaaactttactcttattaaatctgtcttcgaaagaatcaggtatcttaattataaagatcaggaaggtgctatttcttttcaaaaaaagtaaggtgacaccctctgggttttctttctgaaagttgcagaaactcttaaatgatttttgtttccataacattttcatatggcatctttcaagttactgaagcaaatacaattatagtcacaaacttccttttttctctttgtttttgagacagttttactatatgatttgtagatcaggctgtcctccactcatagctatacacctgcctctgcttctgcctcctacatgctgagattcattgtatagcaccaccacacccatctagtccccaaactttttaccttaacaaatgtagcaattgctggaaagaaaaggtattatgcaatacaagttaataactaattttgtcataatcacttactgttccttctgcagatttatagttttgtaggtaaatgtaaaattagtaatggtatatgaaataagttttaaaacagttcatttaagttaaaacataaaacccaccatctttctggtgtaagcagtatattttgaagaggatcatacaatgtactatttttatgtatgtaggatgaatattggccctgggttttagagtgttcagtaacctggaacttctgactctctttttctactagaacatagattggaatgatgaagcaatgactcatggacgacatgcaagtttgccaggcatactatatttgcttataccctgagaacacataacatatttaacatatttacagttacttatttatggtctcgctacctagctaataggtagcttcttgaaggcaggaaaatgtgtaacaaacatattttttcattgctaaacacactacctgccttgtaatagtcattcattagctgtgggataaattgagaagttttaataaaatctcattaaaaggcaaaaagtgtatttatcaactttggagtaattattgtccccaaatgctgaattagttgaaagtggtgctgctttccctggctacatattagaactgtcaggggaactttttaaaaaggtctgtgccaagaccctgttacagaacagtgtaaggcagaatcctgagacatgacacaggtaattggtaaaactaaacgaatcatgtatgaagagtcagttttaaaagctagtttctgggactagcttttcagaggattaaatattttccaaagtagaataaatatgttttgtagtgcacttaaactatcagaccaaaacatggatttttatcttctatgcatttatgtctctgaccctgttgtgtaagaatttagcttcagcctgtgtttggctttggtttcctgggccttttatggtttgcattgatttgtgacactcatctaatgctaacatggtgattgtctcatgtttgcagcaacacagaacaaggattgcttcaataactgttgatgatagctttctactacaatgccttaatttaataagaaattcattagtttagtatggattgtttgcacacacactttattaaaagagaatggttaagttacttatgtactttaagttctgtaattgtaactacaatgatgcaatttgccagagaattgagttaaaaccagtcttatgtaaacactggattaataatatataaaatacataattaagcatagaaaaaaattagcttttctgatttgcgctaattactctggctttcccatgtattgattatatcagtgacttggagttctggtaacccaggggaagcattacatgaatcagaagaattgtcctgaaaacttaaatagacactgtacataaaatagtttttaatattaagcttaggaagtggtggggagtgttctggctaagatcacatgggattctatctgcttttaaaggctgttccttttggccacagtttactggtgtttcaggttatgggaaaaaataccatattggatttctttaaaataaggctaattttcatctttaaaatctattattgtaaaagatgattactttccagttacacttctcacctctttggtggactgtactattccttcttaaattacttctttttttctcttgctttatgactttggttctcaacctgtgggttgggacctctttgggatcaaatgaccctttaacaggggtcacatatcagatacactatatatcagatatttacgttatgactcataagggtatcaaacttaacagttatgaagtagcaatggaaataattatggttggaggtcaccatttcatgaggcactactgcattgaagggtcgcagcattaggaaggttgagaaccattggtctaagatgaagtattagcatttgtaatcaaactaattgataaatctatatattctttagcagtggaaataaggactcttgaccatatgtccacagtataattggttttgaaacgttctctatcccttttactcctcaagtgtttgctccccagactaagtattctaagtttctgagtcagaagtagtgaggtttgcatagaggcgtttgttggaggctagggtggatgatttcttatgccctgtgctacatagtgaattgcatttgactttgaaaaccacgtcctaaactgcagcttccgaatctgtctcagctgccagcactgttcactaaagtagtgaaaaaatgctactgttgtacagttgccactgtagagaaagtacctgtcaccagctgccaggttgatgggatgttctgcttttccaatatggagcttatattttacttgccatttataatacagatttctttttcctgtatttgtgttttatagattttgagtactggcttttaagtaaaatagtttgcttttccaaaataatgccatttccattcactagcttgtatttggccatgaagtagatggaagccttttgttgagtgacaaagaaaagattaagtacaatgtttctcctttttatctttttaagttcctagtatttatcacactaatattgtttccttaaattattccattatagagatgttcattctttctggtgtcaaggattctttgtccttggatggtgttagtatgctcctctcctttcctttctcatcctctctctcatcttaaacagcttttctttatggttcctgcctctgctcctgctggctttcctcctccctggcttccctcaatgacagactagtaccgggtcatgtaaaccaaataaacactttcctcctccaagttggttttggtcagtgttttattgcagcaaactaggacatcactgaaccatagatagattttactgcttattaaatgaagaatggtttattctgttccagaggtctctacccttgctatggtgtgcagatagctattatatcactgctagttcatgcatccaattttgtgctttaaggaaacacattttcagcctttctgcttatcttttttttccactgaatatcggattgctttgctttgtggtttgtaaggcatcccctgaagatctgatctggtaacctttgggtacatttttatctatatagaaggaatgatacctgcttcacacgctatttgcatagattagtgatttaaagtgaaggttaagtgttttttacttgtagaatgtctctgccatactcaaatttcttttgacagttttgtatgtaagtttcaacaattttatatgtgatctttctcagtgttaaatacatgctctgttacataaataatatgttgaaatgaatatgtaggtaaagtatcatttattcattcatgtatttgtagctgtgaagtcatgggcaaattagttaacatctctgatcattagttcctttacctgtaaaatgaagatgatagtatagttttcttttgaggtggattgtgaagattaaataatacaatctatggaaatgtttgcagtttttattttagttgcatcatcatcatcatccagcaaacacttgaattctccagcctcaaggagctctgtaaataagagacagatgattacatctagaccatagcacactaattgttgaatcctgataagtcagtaaggcaagagtcacagctaacttgtccatgctgcttgctgtctgggcataggtttaaagccagcataaagaaagtcgtcagtagttgttgaatgaatatattaagtgagaaacccagagacaatgtgactacctagcaggaaaataaatttgaggaaatctttgtagcggacacaaaacttgaaagggttgttagtccttgggtaatatttaaaattttaggcttgttttttcattcctaaaaataagtagagaaattcagataaaggaactctaataactcttaggaatatataaatatattcaagagcacctagtgtcttttagcaaaaaaaaaaaaaaaaaaaaaaaaaaagttatatgctacgaaagatattctttgtgttcctaatttatttgtaagcctgtctcgggttgtagtattacagtgtggtgaaaagctccaaaatttttgttaaaagagttttatatcatacctttgcatttggacattgggtagaattaattgctcataatgtgagattttatgatgaagaaaaggaaactctagggctggtgagatggctcagagggtaatggtacttgccagcaagcctgactacttgagtttgattcctgctgggactcacaatggtgaaaggagagaaccaattcctgcatgttgttctgtggtgtgtgtacatatgtatatatacatataatacaaattgtgctaatttgtttaaaagaaaaggaagatcctggaatatgtatttaagaaataactatatacacgctttgttaaatttatactgtagtagtttcccaaattttattatgacagcagtttccatatcttaaccaaggacaaatgagtagtgtgtgaaacattgggcactgactctaaagtacctaaatgcacactctgtaagtatgatcaccctgactctctctcctccaaccccatttctccatgacttcctggctggcctgttcccttctttctctctcctctctctttctgtcccatttctttcccagactcccttctcacccccccccccttctcatgccccaaaataaacttcattttataccctcccccacaaggaaaggatcatcctgatgggagagggtggtctacttagacacttgtatggaaataggttggcttcagaagatagtaaaaggtgtcttttcctataatccttggacagtgttatttatattgcatcatttaggttagcagtttcactgactccacctgtctcccttaaactattagtttaaaaggagaactgtctgaatttatttgtatatgaataatttcccatcttctatttaggcttaatattattatcttaattaggcctcagtcaagcagtataatgtaatattgaatttgagattatcaggtttcaggtttcttttttctaaagagattttttttaaacatttatttattaattatatgtatgcacactgtagctgtcttcagacaccccagaagagggcatcagatctcattacagatggttgtgagccaccatgtggttgctgggatttgaactcatgaccttcagaagagcagtcagcgctcttaaccactagccatctctccagccccaggtttttttggagacatgatctcaactgtgtagatcaaactggcttcacagatatccacatgcctctgcttcttgattgttgggttaaaggcatgggcaaccatgcccacctagatactatcttttaaaaaagtctatggagcagggtcctctgcaggaatagcatgtgcccttggccactgagctgtcactgtagcatgattatcttttgaataaatgtcttcttttaaagtacgtatttataaagtaattagatgcttgtaaaacaggaagctcttttcactgagaccattcttaattatatttcacatgaatttgacaaattattactagactatttggataacagatcaaattgagaatataattatctcatagtataatcaacatattttaagacatgctaatatgtggggggaaaacctattactagccatacctgttgtaacctatgctatttttttctttaaaaagatttcttctaatggatatatctacatcttgcatctgaggctcaaggaacatagaagaagaaggggtgaaaagattttaagagccagggagtttgttgattgtaagagccaaagatgagtgaggttgtgtctcgtagtaacatcaggagctacactcataaagccttaccagtatgactggccaaacatgagctgaacaacgatgacatcagtgagcatgccaaactggatggagagaagcccatgaggcttcaaccccacacagagaactaaaagcagctgaggaaagctgggagtgggagaggtggccttccccaggggaaagcacacaagtgcttgttcagtgctgtttaagtcagtcctgaaaacatgcatacaggttgtattatatttatatctacctgcatacaataacaattagtgaaaaaagaggccatgaatttgaaggagcgtcaggagggcttgtaaggagggtttggagggcaggaagggaaaggagaaatgtaattataatctgaaatttttttaaaaggtttttcttatggctattaatgtaatctatgtaaacgtctgttcacatgaacatgctttgtttatcatatttgcagagagagcctggaaatctgaagaggaagcattcagagcttgctgctatacctcttagattcccaatgttaatgtttcgcctgggcctgagtcttcccattagactgctggatcatacttcatagtctatgacttacttgtcctaaaggtccagtgggctttaaattgatatctggagcttcaggcttcttggttagatttaccttggtggcttcagtattaggcttacaaatatgaatatggacttgatggccttattagcacatttcctcttatttccagatcctttcttagacatagaagcagagagagctgtaagttggattttaaaaaaaaaaaagcaatttaggaattggtagtctaggcatgatggctctttgctgcaattccagcaattgggaggcaaagacaggaagcttactgtaaactcaaggctaaaataaaagaccaagacaaatattccaaagaaactttatttttaaaaatggttgtttgtttagcctggcattcacaatgtagagcaggcaggcctcatacagagattcacctcccttagctttctgagtgctgggattaaacacatacgctaccatgcctcttagaaaagtattaagtacattttcacatgacaccagtatttggattatttttctctatttcttcatctcataaaagaatggatagctgaagtgatggcttagacattaagagaacttgctgatcttacagaggacccaagttctgttgacagcacccatgttgggcatcttacaactgcctgtaattccagttccaggggatccagtgctcataaaataaaaatcaaaaccaaacattttaaaaagagatagtaatgattggcactgctgaactttctttgatttgggaaggatttattttttctagaaaatgtgtgtgtgtgagcgagatgtatgtgtgacatatgtggaggtcagaggacaacttgtatgagttggttctttccttccaccatgttgttcttagggatccaacccaagttgtaaggcttgtgcagtgattgcctttatacacagcttgctgggctctacctttgtccttaaactgatttcatgttgtctttatgagccttacataatatgctttgtctcttaagtatgatttagaacatattatgtcgaaatgttgattatacaaaggtaaagtgtgtttactgatggagcaataataaattcacactgaaatcaaagcaaagacacaatagaaattaacgttttttttttctttaaattgtaaattttcgattgaacctttaaatttggaacttcaagtgagaaacatttgtatctaaccagatatgaagttagactcttcaacaaatggttagcctggaaggaagaatttaggtattctcaaagtgtagaaccttttggttagcagctgctcccaggaatgtggtagaaatgcagatctcaggcctcaccttgaccttccagatcagaagctagggggatagagtcccattattgccacgttaacaagatctccaagagaattctgatacatatcacatttttttttataactatccacttagaactctagatcagtaaatgatggcttgtagactaaaatggttcactccctctttcttatgtatggctgctttgtatgctataagcagagttggatagttcttcaggactactgtccgcagagccttgattatttgttatttggccctgttaacaaagagctcattgacccctgtttgaaataaagttttaatattgtttccttgcccaaaattctaaagagtgagtagttaaaatcattagataaatattcacatcttcctttacacatgaccctcatatttctacaaacccattccactttctaatatcaacttattaactcaatgactagacttttaaataaaaataaaatactatgttgccctttcttttctctgcttggtgatagtaccaagcttgataatagtgctatgaccatttctcactgattccatgtggtgtgctttggtatttctatattctagtgtaatctaacttaatcatacattgtaatcttcatttctcgatattcctcctgccttttttatttcctcaagacaaatcccactttgtgactgttttgtttaggaatccatgagctaattgctgtgcctgaagtacctttgtcctgcagtgctgtagttgcttgcactttaccagagtgattgacacacagataacaaatatcttgggtactcttcaatcatttcctaggagagttattgttagcatttacacatccaaccaagaatggtgattcatgtctatagttggggtgcaattctgaactgatttttcctttgtccttgctctcaattgttaagatcattggtggtcagcatcacataaaatatagggagtgattttactactgttcttattgatggactgggatacttctgtttccccatatcactgaaggaaagccagtgggttttcttttgaaagaaaggccatgctatagtctcctgctctaatagcaaaagcagaaaaggtggttttgttgcagatgtgattccatgcttgtatttcttttccttctatgaccgttttaagtaagaaaagaggacttggctaagtgttactgagctgtcttacttgtgagtttgtttggttcatgatttatctcagacaaggaacatagttaatgaattcagactggacatgactgaattagctctttcattatttttagggtttccccatcaacttaattcataccttttgccctacttactcatcccggtggtgagatagaaagaggagacacatacaaaggcaaacacacagaatctggtcatttaggtctattgcccaaggcagcctgtcagataatttgagatttactgttttctgcaaaatagtgttggaggtgaagtatttttttaaaattaaattatggctatgactaaaacatgaactctttaaaagaaggcagtgttattttcccagctattacaatagccacccacagaaatcatctgagccacctcatcctttctgttttatctacctgaaacaggccgggtgggtgatgctaaaagtttggtaaatcacactacactttaactaagaggaatgctctgctggtttatgctgtggtgttctctctggtgcaggggcatctgagacagtcctacacattcagaggtaagtaagcttcagtaattatctttacttccttggcagccacttatgtttgtgaggtgagcattcctttcagagaagcaactgctagataaattctgctgaatgtggcttttgaaccattttcaaggctatgatgttcacattcaaaatgtcttagtaagctgggcatggtggcgcacgcctttaatcccagcacttgggaggcagaggcaggcggatttctgagttcgaggccagcctggtctacagagtgagttccaggacagccagggatacacagagaaaccctgtctcgaaaagaaaaaaaaacaaaaacaaaaacaaaaaaacaaaatgtcttagtaagtaagagagggtgatttaagagtgtctgtggtgcattatcagctaaggctcattaggaaatagactttggacgcaaatctccaggtaacaagtcttatgttcttattgtactaatactttcctactttgaaaccactgaaatctccccatgcctctttgaaactaatttgtaaacagaattgtattgtagatattgaatatagtggtataatcctatctagtactaattactaagtagtttccctagtttctgagaactttcaaagtgtcaggcttcataccacagtttttccagagtttgcattgttttcccttctctccttgctattgttacactcagactgcctagtgcagtggttctcaatcttcctaatacagtgacccttttctacagttcctcatgctgcggtaacccccaaccataacgttattttcattgctacctcatagctgtaattttgttaccattatcgatcatgatgtaggtatcagtgttttctgatggtaacccctgtgaaagggttttttcaacccccaaagggttcaaaacccacaggacaatgaacactgatttagtataacccatgtggctagactcgctttcagtcaactagctagcccaacctgaccttgagtaaaggtaggtaatacagtagctacaaggatgcagctgtttcaggttagtaattattaaatataattcattaaacagaactttctctggagagaatttctaaatcaccagtagactgatgaaaaagtgtacgacactgaatcattgaaaaatgcaaataggaaaccatagtgataagcatgttacacttaggacagctagaattaaaaagatagatggctgctttgcgcaggtggctctggttaaactaagtggatcataaaaccgaaagtcatgaatctgggaaaagggctgggaggaaggaagagcagtgcacatgaatgggaggaagagagaagagactgggaagagaaagtaactagaatgctttatacacatacatgaaattgtctacgaccaagcgtaattaatttgcaaaaggctgatagcaagattataaatggtgagaatataaaatggtacagccactatgcaaaatatgctgtcagttcttcaaaaagttagttttgtgggacccagcaattcctttactaggtatatagccaagagaactgaaaacttgtatttacacaaaactcatgtataaaatactcatatgtacattattcataatggaaaagatgcagaaacaactccactgtacattggtagacaaacagttaagaaaatttagtaattgcacagtgaatttttatttggccataaaaggagtgaagtatttatacagctttcaacatggattcctctaaaacttattctaagtgaaagaaaccaggcatataaataccacatgatgtataattgtgtttatatacatttccagaagaaatacatattttgatagaaaaactaaatttgtggttactaggagttgtggggaaaagacaggatatagagtgactgtaagagatcatggggtttcttctttggtctccagaatagtgcttgctcatcaatgcacaattttgaatatactgaagcccaccaaattgtatatttagaagagtaaattttattgtttgtggatatctcaataaaaatgttattttttaaaattttagcttttaagtcacaccagcaacatttcatatgctcaatagctatgtattgttagtggctacatgttggtggcacagatttggaacgtttttgccatcatccacaattttgttgaatagcacttatctagaggatttgagactcataatttgggacaaaaaaggaaggaaggaagggagggagggagggaggagagagagagagagggagagagagagagagagagagagagagagaggtacaagcctaaaaaccaaaaagagtctagaagtgatttagagaaacgttgatttatgatactttagtgctatctgactgtttcattaagagacaccaccagcctatttttcaaatcattctcaaatgagtgtggtaagtggttatgtcttgtatgtcttatttgtgttagcaattttaagacaatttaaatcatagccagtatcttttccaagcatggtgttctaaaactacaaatcaacaagaataactggaaaattcacaaatatgtgcaaattacgtgacacgttccttaacaactgataggtcatagaaggaactgaaagagaaaatattttacatctaattagagacaaatggaaataaaatatactaaaacttgagaattaaggcaaaaccctattctatgaatgaagtttatggtgctcaacaccaaccttagaggctggggaatgactcaagctggaaagttgcttgccaggcaagtgtgaggaccacaattcagatcccagaattcaagtcaaaaatccaaatgttgatggcacattctcataatccctgcactggggaggtagagtcagacagatccttggaactcactgcctacactctagccaaataggtaagttccaggtaaagtgagagactgtctcaaaaggtaagttgaagataactgaagaagatatctgatgttcacctctggcctacacatgtacacacatgtcaagaaaaagcaaagattacaaataaatatttaacttcgcacctgaagtagggaaaaaaaaaaacacccacaaacaaacctaggctccaaagcaaagtgaaagaataaataagcaaaaattagtgaaatagaagattaaaaaaaaaaaaaaaaccaagaactaacaaaactaagttaattctttttgaagatgaaatctacaaactttcagccagattaagaaaagtaagtaaatgaaaggattttttttcttttttacaacaagtaatagagaaataggattataagagactgctttgagcaattacatggtagcaaattgaatcacctgaagaaatggatacattcttagaaaaatattcctttctaagattagatcataaagaaatagaaaatctgaacagaccaataatggagaaggaaattagtaatcaaaaacctttccaccaagcaaagcaaggagtcaaggttgctggcttcattaataaattctcctgaatattacagaagagttaatgtcagtcctttgcaaactcttaaaaatttgaagaggaggaattatttcaaactgactttatgaggtaagtattactctaatgtcaaagcagactacgagaaaaagagaaaagtacacaccaatatccatgatggaggtaatttgcaaattcttcaaccaaatgtaagcaatccaaatttaataacatagtcaaaagggcgtgcatcctttcctcaacctcaaacgaatgagtgacagaaaaactggctttcttagattgcagtctgctattgtagaagttatgatggatcatagacacaccaaggaggcaaaagatgaactttttaaaaggcaaaacaaggaaagttacatatgttattttgtaagaattatccttggttacaggctcagtaaaggatggcatgtgtggtccaaagttgaacaataatggctgggtagacatccttgtagaagtatttctttgtacaaggttgcaatttttggcaatgtttgtgataacttgtatcacgtatgcatgaggaagattttcatgagaacccctttcttcctggtttcctgattattacactttgtcctaaatggcttcattttggtttttacaactttcacacttgttacaaaaatgctctgcctaaagggactcttgagaaagctggttatcatatagaatgacatggacaaatgaacacacctctttgatttctagtttttttccccccagtgggaaaatggagaggttgacgtcactgataatttttaagtactcttgaactctaaaattagtgattctgtaactgattatttcattttacctttgatactaatcaaactttttatttcatttacttactattaaattttaggtagcatggatgggagggaaagaagtatcataccatcatgattaaataaaatttatctgtagggtgcaaagatgtttcattatatgctattagttaatgtaaaaatattagtagaataaactctgaaatccatgtggttatctcactagaagaaaaaagataaaacggaaaaaatccaataaaatttaaattccttttacgataaaaaaaaaaagaactaggaaagaatgtacatgagcacactgaatgcaatgtgtaaccaccccacagctaatatactgaatctagaaattttgaaagcttttcctttaatttataaacaggttatgcatacccaatcaccaattctttttcatatattactgggagatcaagttggagcagttaataaataaaaggcatccaaatcacaaagaaaataataaaaagttcatatatatatatgtccttaacagactactgaagaggaggaaaaggagacttcataaatttaaattttttctataagttttctttctgttctttagatagaatgccttcatatttgcttatttttcttcttgtcagtttaattttatgttgaattcttctaatgaaaatttcattttgattattaataattctttaaagaaactaagacaaattaaaaacatttcttgcattgatgtaggtttttgatgatacccttggttttagcttctttgctatacttcctagaacaaactctcataaatctataaatttcctcctgcatgcacatgtttacatgaacacacaaacacacacgcaaatgtaagaaaataaataaaaagaggactgagtcctacagttgtcctcgcacctctgcatacctgctgtggcatattcatgtgtgtctgtatgcacacgtgataaaactacaatacaactaaagcatacaactaaacccaacagttgggtctcttcagagccaattttggttggctactatttcccttcagcaatttttttctcaatgagttaatattttcaataatatgttataacagttcttgttatgagtctccaaaggtggttgttttcatctggctcagtgatttgcatggactagttatgaagttatgcttcctctctggtagcatggaactgtttggctttcttttagtcaggatctctggtgcctgggctatctttattatgtaactgatactgacctcaaattcaaagtagcactcctgcctcaacctcctgaattatagggattgcaaggattgttcatcctgccagcatgaacattttgtttcattttcttcaatttattaaagtctgttttcctagggttttccatttggtcagcataatttaatgggtaatcaacgattggccagtttaccacaagcattttgagccagtgagccttacatcttttgttagggagaatttgtatgtggagtggagcagacatttgaagtttaggtaatttataagtctttttaggacctgaagagatggatcatgagttaagagcttatactgctcttgcaggagacctgaattgagttctcagcatctgtgtctggtagtggtaactcacaactacctgaaactccagttccagagtatccaaagcctattttggactctttaggtgcctttactgatatgcacataaactcacatatgcgtgacttaaaaaagtaatatgtaaacatctgccttgatttgtaaaccaaaggaacctagtggaatacccagagacaaacccgtacagcactgcacaccagttattttttttttttacaaagtgtcaataacatgaattgagaaaagacttcatatttattgtataggtgctggcagaaaagggtacctagataatttctctcaccttgcataaaaaaaaaatctcaaactcgatcagagatgataatttaaaacaggaaacactggaactgctaaagaaaaacaaaggatataggtacaggcaacagatttctatctataaccccaataacacaagaaacaagtccaagaattagcacatagaattacatgagaattaagaagctgtgaagcaaaagaaactaagatcatctttaaccatcagagaaatacaaagaaaaactactttcagatttcaccccaccctattgagaatggcaatcatcaagaaaataaatgacaagtacaggttcggatataggaaaggggaacccttgtattctgtgggaagtataggctaatgcactactatacaaattggataacctggctgtaccactcctggaaatctacccccaaaatgctacatcctactatagagatgcttgcatatccatgtttatcactgtttcttttacaataaatagcaaggagattaaatcagcctgaatatccatcaacagaagatgaaattgtgtttctgtgtgtgtgtgtgtgtgtgtgtgtgtgtgtgcacatgcacataatggagttttattccactgtaaagaaaaatatatttaggattttgcaagaaagtgggtggaactggaaaatactaagtgaggtaattgaggctcagaaagacaaatatgcacgctctttcccacatgcagattctagccccaaactggaaagtatgcttatccaagtgtgagggggaatgcgcaaaggccaggaaactagaaacgggcacataagactgcaaaaaagaacctcgagcaatgaccagtaggggccacaattaaatatggaagggaggaataatggggggaagtatgatgaggaaggcagactgatgagggatggtgggggagagtcagccaagtgaaacgtttatgaaaacctattattttgtcgactagttaaaataagaaaaaattacacacacacgcacacaacctgcctgactttcactttgagtttgtacagagcctcaccaccagctgcagttctaggtaactgggagcctccccagtccctctcaggaatgcacatagctctgtacataatgcacagtctttctgaacctccaaaatacattaaagttttaagtcctctttgtgtcatttcaaagttctcctatttatatgcttgcctattgtcttatttgcctcaaagaaatgttgtgagtttaagtagctgtgggttttgattgtgcactgatgattgctattcttttcaccggtgctccaagaatggggttcataaatcgggtcaactccctgcaatgacagtttccacaaagctaggagaccacagaatcctggtaaaggatgggaaccgctccatgtcaagtgccacagaccttctggtattacccatcatctgtaggcagaagcctcattctgccgttttatgccttacctcataggtttacactgtgtctgtaatttgttagcttttcatttagtataagtatttcctcctgtccttgataattcattatactttctgatgactgtgtcatcttatcatttatttgaaagccttataatttacttggtgattcccctattattgtactttagataattacttatataatttgactgacttccccaataggcgccaagctcaggaaggcctgaaactgttttgtttactttgttctacttcaccctcagtgtctaacatagtaatttttgtttcctcactttaaaaaatgttacagttagtactttcaaaaaatatgtcttgctggcaaggttttatccagatgtgtgtgtgtgtgtgtgtgtgtattttaaccaagaatgaagttccagaaatataacagcttagtcaaatgattattattggcttctgtgttagaggacaacttggtagatttgattttctcctttcaccttcacatggattctgggaattgaactcagattgtcaggcttgcagagcaaatgccctggttttgttcttgttgtttgttttcagttttgtcttttttaaagtcatatttgattggtatatatgtatgtatgtgtgtgtgtgtgtgtgtgtgtgtgtgtgtatacatatatatatgcaacctataattaagaatgccagaaatacatagagttagcataaatagaaacacatgtgtgaacagacataaatgacattttaatttgtgtggctcttgagcatgttcattttccaggagccaatcagcattgagcagtcagcatgctgtgggcaatcattaaatttcatactgtgaaatttgttagtggaggttggttaaacatatctcttccctagttataacctatcatctttttctttatttctttggttgttttgctgcttcctgagcattatgccatcttcttttgttttgatatcctattgttgttggttaatctgaaatttatttaggttttgagtgggtagtaaagataaagatcatgcctggtaaaatagcttttttttcccaccctcaaatgatgtggcaggatccctgacccccatagtaagtgctttcttcaaagagactgatcaaaggggtaaaatgtaggatcatatggaaaagatggatagactgttgctggccattccaggtagcctgtgccagcagtggagatggaactgaatcctgtaaatgcattggtctcttgatacacatattggtcagctgatattgcagcgggggccatcaccattaatttagttgttaggtgtcctcctttgtatggagtccagttgagggtgttgtaccattccttgatctggtgtgtttgatgagttctgggacctgatttgtggactcttccacaaatagacatttgaagggataactggtatctcatttagataatagtagataaagtagtttcctaagcagtttaataagcatcgttatagtatagttcattaagactataacaaccaggaagtaactaaagaatatctataaaactgtacaatttgaaatcacactttgctctctgttttgtgagtttctgctggaaaattcatcttttaaatatgatatttttatacaagccttcctccgaagtaaacagatatctcttggtgcaactactttttccagggtcatagcattaggtcagctagtggaaacattgtctatgtgctgttcaaggctatgagtgacttcttagtagtatgtggaaaacaatattaaggaacacctatggggtaaaagttcttagtagaaaatgtgattacatgatagtgtttatgctagtcctagccttttcagtactttacctttaaatgttttatgtgttatgtgttatgttttatcttcaaaataatgtttggtattgatagattctgtttagttgccctactatttattgatactatacaaaactttagagtgatccaccagctttgagttgaagtacacagataacaaccaacagaaagattggtttctactgcagaatttcagcctcttaaattagttttcttcccttcctctggaaagcaccaatctcaaggcctatatttctccttttccaggtttaagtcattggaggttcttgctagaaagcacagacaaagcacatggagccagtgcccccaagtttttcagaccatctggaactacctgtggctgcttcacagtctaaaacttcagatggtgttatgatctgttggcagatggctacattgggatccttgtgtcagggttttcatttatctttccttttattctaaaatagaaggaaaaatgaaatggaagaaggatacattgaaagttgtgatattttctgtgaactgagaaatgaaacgtctcagaatatgtagatagatgatagatagcgttcctgctttggattgactagttttgtgttgtttttgtttggttgatttttgttctttcagattcacatttctttacctggaattagctaagaacaattggcatttataagagttgatggtataatagatctgattctctgtctctttctttctgcctctctctggctgtctccccctcccctgcctctctctctctttggtggcctggaacttgttatgtagatcaggttagcttcatacagatatccacctgcctctgtctgcatcatgctggaaaaggtatgaactatcatatctagccttcatagataggattttattgctggtgccttcagcaatacggcttaaaataattagaaaggtgtcactactttatgtttcaggaagagtgttgcaaagcttttaattcagtatttgttgacccaaagtgtctgacacattaaaataaagtcttgggatctaatgaaaagagaaaaataaccctaaatacacactgtgttgcttgctgcctcatttaattgaattcaaggtgatttctcaacttaatatattaagttttaatgcttcgctatatgtgtagggcatatctggctggctatgtaagtacatttatcttaaaatatctcaatatagttaggcttatttacataggtgtctgatagaatgttagctatattaaatatttagttgtttggcaagcaatttgacttttgtgcatatttatgtgcatattcatacataaacacactgacagagacagacagacagacacacacccctaaccagaagccagaggagtaacatgagaatatgtttcagatatatctgtaatgaagaatttgcttctggtttttgtgtaatattgcatttttaccttttgctacatgttttaatttttggtcattttcctgagaagttgttacttccactttcaacgtcttaaaaaaataaattttacagaggaatatgaaatgtatttaaagcttttggtttttttccttgtattactctctaagtcagcccagatggtggccattatggatagtaatagcaaggaagaaagctgttaataccacagtgtctagcatatgtctcccttttatgagtttgtgaactagtgtcaaaggtgtgctacaacatgtattttatgcagactagcttttagaacgttcctaaagccttccatctacatcaaccaatcagaatagattagacaatagttatctcttgtgcttttatccatggcaggtaactgcattttttttgaaggaagctttgatcttctcatctagccaggttttcacttgaaatttcctaactatgttgtgtggtcttaactgttacttttcaaaagctaaggtcttagggctgtagatgtagttcagtggtagatagcttgcttagcatatacagggccctgggtttgaccccaagcacagccagaaagcctctaaaacaaatactaaggtcctctagcatttgatagcatttagagcccacatacagtagagtgggcaattgtgttttttgcatatatgccttttttttctgtagttgggatttctgttctttttatatattcagtgtggaaggtattccgaaagtgatctaaagcaaccttggccttaaagatgtaacttgttctacaatgctatactttcttttacagtcttttaaaggttgtatttctagactttttaagtgtttccctgtgtgttgacaaggacattgaccttagctttgaaaatattaatgggggcagggttgtgactaaatggtaagagcacttgtttggtgtacacagcatgggaggaaaaggtaatagacatgagagggaaatgtgtaacagcacctgcgttaaagacatggacagtgagatctgaatgaaatacattttaatattactgaaatttcagttatatttttatcttggattgcttcactcttcttgagatcagagggagctatgattcgtactattatcataaaaacagatgattatatttagtcagcagtcaactgtgttggttctgtctggctaaaccaaaagcagtagagacaactagactttgatccttttatgccctctctatcctaggtcattatttctttgctgtaaaatcagaataatgaacttggtacattgctacatgggacagtatagctatgttcttcaaatggacttgagacctaaaaaaggtggtgttgagtgtatccaaaagggtagcaaattattatattaggtatgaataaattataaactatagatttaattaataatttacgcattcatagtatattaggattcagggtttttaaaaaaatgcacattattgtgtgtggatgccagtgtatgtgtgtgtgtgtgtgtgtgtgtgtgtgtgtgtgtgtgtgtgtatgtgtgtgtgtatgaagctcagaggaaagcttttaggactctatcttctactttcatgtggtttatgggggttgaattcatgtcatgcctgactggcaagcagtctacctatttagagctccttttaaaaatactcatttcgtacatgttctttatgtcagctgtataagtcagctttcctaatattcttatctctggggaatgaacaagtgattttttttttcaaaatgtgattgatccgaagttgaagagttagatgatttaattagatcagaattatttaatatggacagcttaacatatttttctgcattctaaggtctagaatttgtttttgaatccctgagatctagagttgagaagaaactgaagttcatccaagcaggttttaaagcactgagttagaagtcaacagtaatcgtagagtttgagacccttgagggtctcaactggcatattctgtttattggcagagaatctcttggtcaattagctatgcttgaagtggacatatgttaacatgagaatgataaatatctagtgatctgactaaatccattatgactttttaaaagtacctgatagagccttttttttttttacagattctgttttgctgggcatattaggaaaaagtatgaacaatatcatagtaagttacaggattttctatatatcaggagttaaactttcctgtctggtacagaaaatctgaataacagcctaagtaaatttgtgtccattttcccccacaaaataacagttccaaagtatattccatggctgacatgttacatctaagatactattagggacacggctccttctagccttcctttcaactctccttattatatacttaaggtcacagaatagtcttcaagtctctattcatcatgtttgtggtggaagcaagttgaaaggacagtacaagatggttcctgccagctgagtgagccatcttgaataagtttttccataaaacaaaagaaacacaatttccttttatctcactgactggatgatatcatgaaactatctcatttactaaaaagttgggaaatgtattttactggagtacattagaaactaacaccattgggcttctgatagtatgaaatagggggagaatatatattgaatagatgaataataatctttgctacagaataactctctggctatctaatccttatactttctgtacagaaaactgcccaccctttctgtgatgaaaaaaaatctctgcattgttgtctttaattcctcagtgtctttatgatgtacagccttctccattaggacaaggtaaagaatttgaggaagcaaagatacattttggctcagattcagaggtcttggtgcataattcttgtcttcattgcttctagttctgtgatggtgggagctttgtcagaggtgactgttttcgtagaactacaggaagctgggacagagcaggatcaaatacaacctccaaggaccagctggcagtggcctacttcctctaattacattctgccttccaaagtttccagaaccactcttatgtaacactaccagttagggaccaagtcttttatggggagactttatactcgaatcaaaccataataggtagaaaaagaataggttaactagtaaaactttctgccctgaaaagaagaaatataagttatcattcctatcggtcaaggaaagtggactccttaccctggcttcttggatgatctatgtcagcagaacctattcctgggtagctgctctctacggtgtgactttctttgccaggaaagtaaatttgtaaggaggagtttcagaggcctgtgttctgtcagaaatttctatggaatccactgttactgattgggaagcctaagcaaaaggcaggcaattagggtaggtataattactgaaatggatagcagagtcagccaagcaaatagactgatctgtggtgccaaaaggtgttttctttacccaccaagaaacccagggctgtactttagaaactctaaatcacccttcctcgctcgtttaccccatcgagtgctagaagttaaccatactttcctgggggctttgtagcttctcaaccaataccctgttgctggccatttaggaccataaattattttacaattccaataggtatttttggtttgctacaggacaattttggagtcttcatgattatatttaccacaaaagatgtataggagtttatttacctttcttatattagtatgctgcatgggagagaacccatatctttctaaagaaaaagccttaaggggctagagatgtagctcacttgataggatgcttgcttaacatgaatgaagtcatgtgttccatccctaactataaaactgggtatggtgacacatttctgtaatcctagcacttggaaatggaaggaagaagatcagaatttcatgtcatcctttgtgacatggagagttcattctccaccttattattttgagtcaagttttcttactgaacctggagttaggctggcagcaagcaaagccccagaaattctcctgtctccacccaccacagcattgagatttcaggagtgtggccactcccagctttttacatgggtgcttgaaagtcaaacttgattctttgtgcttgtgcagcaagcatgtttacccactgagccaccagtttttaagactagttttcctttaagtctttcatttgcctcaatctaggggataataggcagtttaatatatatttacttagactcaaaaactgaaagaaattagaactagggaaaatgatttttccaaggacaacgtttagagaggacatggaaataatatgagagggaaactatatagacacaattgctaagaagggaattaattgtatcttgggtattccgagcttctgggctaatatccacttatcagtgagtgcataccatgtgtgttcttttgtgattgggttacctcactcaggatgatatcctccagatccatccatttgcctaagaattttatgaattcattgtttttaatagctgagtaatactccattgtgtaaatgtaccacattttctgtatccattcctctgttgaggggcatctgggttctttccagcttctggcaattataagtaaggctgctatgaacatagtggagcatgtgtccttcttaccggttgggacatcttctggatatatgcccaggagaggtattgcgggatcctccagtcgaactatgtccgattttctgatttccagatgtccagatgatttctgatgtccaaactgatttccagagtggttgtaccagcttgcaatcccaccagcaatggaggagtgtattcattgtgtgtggggggagataaatgatcaataaaaaatgggcaaagtagtctttctgtgatcctattgagaccaaatgataccatgctatttaaactaggtgatatacttcacccagactattcactcctgtttacagtgaagggaaccatggaaaaagtaaacccattgctagtagtttctgtttacaaatattagagccaggattagttactttccttttgctgtaacaaagtaaccacaaaaaaagcttaagcaagggaaggtttattaaagaattatttaactttatgtatatcattgttttgcttgtatgtatgtatgtacatcatgtgcatccatggtgcatccatggtgcccacaaaaggtcagaagagggtatggactcctctgtaactgaagttaacagatccaccagttaacagaaccatcatatgggtagggtactgagaattgaacctgggacctctgcaagggtaacgggtgttcataactgctgagctctctctccagccccagtaaaggtgtattttggctcccagtttcagagacatttcagtctagcagatctccttttgcggcagtggaaggacatggcaggtttttttttttttttctcatcatagccaaccaggaaatgcagcccactaactggaaccagggatgtaaccttgaaagcctgcctttaataaccttccttcagacagactttacttcctaaggagatccataacccaagagagcagcactattttatgggtaaaaatataaatccttaggaagccattagactaaaatagtgccacaaactggggactaagcatttagaacatgagctagtgaaggaaactttagattaaaaatacaacaggagctattgtataatcacttctttcttgaaatgaaaagtaaattcttttgctttcagtagtagttatcttgcatattcttttaaaatatttctgtttattctttgacaattgcatacatgtatacagtgtatcttgattatacctacccctctaggttccccatcctacttcctctgaacccctctcaacacatgccccctctcacttttgtgtgcattttgtgtgtgtgtgtgtgtgtgtaactcatccagtttatttaatactgcctgaatgtgtgtaggtatggagccatcccccagaaagagcatgaacaacatagtagcagctatatacttctagcaaaaattgactgcctctttcctaactaccatcaattgtcaatagcttgtcagctactgataatgtcttgtaagtcactcctttatctgtgtgggaatgctgatgctttgcatgtcttgagtgggtaactatagctgctgtgaatttttgagaacaacatccatgttatacacagaagacagcatttcacacagacagcatttcacattctagctctttttttctgctccctctaatgatgttgtctgagccttggattagaaggttattgatacagatatcccattgatatagatgcccattaccttgcatgtttttaagtttacctttataaaaatatgtttgatcaatttcattaagacgtagacattttaaacactcctttttgtagcatgctggactaagaagtaatcttgaaggacaagttctaatggagaactttcatgctatttaacttgaaaggttttagttttataaatttactttgctagttttcctgaactagatcccccaaattggtatataaagactgagtagcatgcggcctttactagaatctcattttcttttctttttcttttttaagagttgctatttttccacaatttatttatttatttattcactttacatcccaatattaccccttcctccccacacttccccctccccttctcctctgggaatggggaatcccccctgggtattaccccaccctgtcacatcaaattactgcaagactaggtacatcctctcccgttgaggacaggcatggtggtccagttaggggaatgggatccacaggtaggcaacaggttcagagacaaccctgctccagttgttgggggatctgcatggagaccaaacagtgcatctgctacatattgtgagagttattgtgtggattatgtccagtccatgcttgctctttggttgatggtttagtctcttgagagcctccaagtgtccaggttagttgattctgtggtcttcctgtagggtccctattctctttgggtacctcaatccttccctgattcttccgcaagactccctaagctccatctaatgtttggctgtggatttccacatcaatttccattggctgctggatggagcctctcagaggacagttatgctaggctcttgccatacatgtcctttagggaggacatgcaacctttacttgaatatcagtttctttaaaaaaaatctcaaatacttttacatcttttaagacattaaggaaagaatcatcattcttgtgtaccagttatcaggtatttttaaaaatattttaataacatgtattatacaaaataatgaatttcacttttatatgcagaatgtatttagatcatccacaataatgtatttagatcttacacacacatacacacaaattactctctcttgtccctttcctattccctctgattctcttctttgctaccttaatgactttcttggtgatccattaagcttcattagagttgattacaagaatatgggagtatgggtaagtctgttttcaggaccatgtgtaccttttgagcagcgattcctctgaagaaaagtgtctttctctctcccctgtcaaccattagcttgcctcagtctcagagaggaatttggagccctgtgaatccatacctcctcagcaacaggttattgataggctcagtcttgtacagaaaccacagctgatgtgtgttaaggagtataacagccattgtatgcctagaagttggtgttccatactagcactccactcttgcctctcctccagctcttgcattctttcttccccttctgtggtgtctctgggcctagtagggatcccatgcgtagctgagcattcaccaggcacctcgtctcagcactttgaacagttacaactctctgcaggtaacactgacctctgcagaaagaagcgtctcagccgaagcagtgcttagttattttattagatagcagggcttaatactggtaaataaataggagctgttttattgaggatttcttaaatactaggcatagcaggaaatagtttacattctttaatcctcaaaacaattcccaaaggtagaaaatattatcctgtgttagttttctggcataataatgtatacttgagataatcaacttgtaatgagaagcgatgtatttgcctcatggatttttgagcatgatcaattgtacctattgtgttgctctgtaacaaggcaacacatcatgacaggagttcatagtggagggcaacttcttacctcatgactgggtgactaatgagagaaagatgtttggagccctactctacctttcaggggtacatctgcaatgatctcaagattgcccattatgccccagtatttaaaagttacacaacctcccaaaatgcagtgctaaggaacacaatctaactcaggaatctgtctctctactctgcaattattcccatgtatgtgtggaagccagaggtcgacactattcgtcttcctcaatcactctccactggattttttgagacacagtctttcactaaacctagagcacactcatttagctagactagttgtctaacagacctcccagatctttcctgttgctgccttcccagcactaggtttgcaggcacatgccacctgttttgtgtttgtttgtttttatttttttatgtggctggttgggcatctaaacaaagatcctcatacttgcttgacaagtgctttaccaactgagccatttctccagcacaggatttaatatctgaaacatttcctttctttatagagatttgtaaactgaggctcaaagagctgtaagcaataaagctgggagtctaagttaatttgattctaaagtctgtactctctaaaattatgcatggcccctgccatttgggaattcattttaacagggggaagtaaatagaaaaagtaaatgttcttagttttgacatagttgctatgtgccttgcagtgtctaaaaattatatgcaaaagatctttggaatgcttagtgaattaaaatggaatatcaactccacatggcatagagcttttgggaagtattaattcaacaaaatttattgagcagttatgttctgggttcttttggccttgaggatataacactgactaatacaagagattctgtttctgtcatagaaattgcaattcagagagagaaacagatgttaaataatcccataaacagttgtttaaaagtcattgatgttgaatactatgaaggaatggcacataggttctatgagagtaattgaaaaggaaattaagcctattccagaaatgagaaataatggaatagtctgttttctgagaagagatctctcaatttccacaacctaatattttatgactcttgattcattattatttctgcaagtatgctacagacttgtactttgtgtcacttgggaagaatgaatttaacttggtttgaagctaatcttaggaagatgattgtgagtggtatagctagatgcggtgcaggtctagattgtattgagagatgagtcaggaaaggtaggcagaagagaaaaatatttatgtgatcaaatctggttttctattaaccttcttcccatcacttcagtgaatccaagaaatatgaaattttatttttccctctttctaattgcattttaaaaataaactatgtcaatattgactaaagtagtttggataatgagatgtcttacagttctaaaaatatctgtaatgcagtaataatgattggaatcacattcccaaagtgtaatggtttgaatgacaatgtctcccataggctcagatatttgaacacttgctctccagttggtggagctgtttgggagaggtttaggacgtggagcctatctggagggatatgtcactgggagccaccgtctctgcttcatgagtggtttaagatgtaagctctcagcttcctcctccttccatcatgcctgactgttgccatgcttgtctgacatggtgaattcttatccttctcaaaccataagagaaggtaaactgttttcttccgcatgttgctttggtcatgttgtcacagcagcaaaaagtaactaatacaaaagtagtaaaatgctggaagggcttatagctaagctgagggcttaggttttataagaagatacagttaactttccatgactgagtcccacatttgtagattcaactaaccacagattaaaaataacaaatctctactaacattgtgcgtgtttttctgtatattgtaacctagtatgaaaactacttaatagtatttgcattatatttgcataattgagaatctaaagaatgtaggtggatctgtcttagttgtatgtaaaaatatcccatatcctatttaatatagggagttagagtaggaaccattatccacagatgctgtactattcatcatttatataaggtcaagttgtcctgaaaagaaaggtggtggttttgtttatttacccccaccccacacttctctcccttccccctccctctcttgcttcatcccctttgttattcctggggcaggagggtggctatgtgtgtgagcacctgtgtgagtgccccccatctgtctgtgtaatgatagggatgggacccagactcttaacccatgctgaacaagagttctaccactgagctacaaactcagtcccaaagaataaacattgttttatttatttatttatttatttagtgctggggattgaacctcagttcttatgtgtaccaagccaagtgctatcccactgacttttatccataacccctggagagaaattggaattatatattacatatttcattttatgtatatttgtgtgtttatcacatacatgaaggccaaaagatctctagaactgaagttttacaggtgattgcaaggtgtgtgagatgggttatgggaactgaacctggatccttttcaaaagtagctcgtgtttttaaccactgggctatctgatctagtccctgaagagaaagtttttaaccttggtgctccaagtattttctgttgatgaggcaacacgaattttgttaatgatcctagagggaagtaagagctcaagtaagagaaaatggacagtaggagcagcacagggagtgtgctacagagcaccaagaactgcctaggactccatgctctgcatcggagctgggcactgccagtgtttggcactgactactgagcattctggaatatgaatcaggatttcacttttcaaagctcactcctaagactgaaccatgatgtaaagtacagcaaaaaaatcaaaagtatatacagctagtaaggttttatgaactagaatcctagtaaagaaattagaacattaccaaaagccctgtctcatattacttttggttatgtcattttattagaaaatggaggaaataatctttttcactttttaggagtaccaagaaacagcacaaagtgtaagaaaaaaaccagcccccctaatatcataaaggcataggtcagttttccaagaagagcatatttgcagcattacgaataaaccaattaaatttgaagtaattatggaaatatcttggagaattgccaagcaaagggtgaaatagttgtcagtctaaaaccaattattcaagagtcagcaagatggttctgtgggtagacatttgcagttaggccccaggaccacctgagtgatccttccacacagtggaaggagagagctgactcctagtgtctccttgagttcatctgcttgctggtttactatctcctctgtcagactttgggactctccctgcatcatctctcttttatcttactattttctcttttatcttactattttcctgccagggtcctacctcctatgtcctgcctcagctcattggccatcagcttttttattgacaggtgatgtttataagagatttttttttttaacagtaaacccctcctcactgggaaaattactttccatactgcagcagactgttttctggcaacaaaagcttattactgaaattaaatctcttcactaaaaagtacttatatgaaatgttttgatccaatattacatttttagtacatttttagtttatttattgtgtatgtgtattcatatgtatgtaggtgtgcataagctacagcacacacatgtagatcagagaacaacgtcaggagtcagttctcttcttctaccatgtaggtcctggggatggaactctggtcatcaggcttggcaaacaatgattttgcccactgagccccagaaattaccttttggacacaagtttattgaatgcagtatattgcgcgcgtgtgtgtttgtgtgtgtatttgtatagtaatagatatatatttcttcataaaagtgtaatggtgtacctattcatgctgagctttttataagtttagtcataaatgtacccttttgtacaaaataaatcaagtgtgtttattagatgatgaaaaaaaaaacaatgaagatgtggggaacactattcctgccatctcgtacagaactgataaaagtttggaaacatttataatttataacttacatcccatagtttactaatttttctgatataactagagggaacatttcaagttacatgggatatataattatattttatatcaaatttccaaaatttagtgcttgtagaagttaactaaatgctgttctatttagcatagactcagctatccctgttgccttcagattagcaggaaacctacataccaaatcttcataatctcttcaacaaaaagatttctccctaaatcggaggggagaatgtcagttttaaaaattacttgttttttggattaggagtagcatgtattttgtctgtctttaatttgttaaaatctcatcctttaaaaaaaattgagtccatgtaataaagacattcaacatcagaatgtgttttgctttttatagtaaatggtcaaagaaaaataatttatcagaaatgagacttttactttggagggtctttatgttgtaatacattttttcttcattaaaaatcagttatgtagttagttgatatcagttcttttactaacactgtatttgatctgttctgagtttttaatgagagagaaataaaaatgtttaaaatatgagtaactattttaaaagacaataaatatgcacaatttcaataaaatgaaatttaaaaccagtaaatgtagtagaattctcaggattcttcctattccactttacaatggagaataatattggtaaatgttcttggagttgccaaggttttgttaaaaattacattttaaaggacaacttaaaaatataaaagtgagccgggcgtggtggcacaggcctttaatcccagcactgggaaggcagaggcaggaggatttttgagttcgaggacagcctggtctacaaagtgaattccaggacagtcagggctacacagagaaaccctgtcttgaaagaatatatatatcaatttttttttacttatcaatcataagtaaaggcacttatggccaaagcccattgatctctaggacctacacagtgaatggagagaactgactcccacaggttgtcctttgacctctacatacgtgcaatgatgtatacacacatacatgtgcacacacatacatacaaataagtgaaataatttttaattacatgaaaagtcaaacttgaattttgttgtttatttatcaatatgacaaccagagcgccagtcatcctgcatttttatattcatgttgctagggtgcaaatagtggcctttatattttgttggttatcagcagctctctaattgaacttaagaactgctcaacaggagggaattcatgctggccaactacatatggctagtgaggtcatggacttcagaggagactctactttcctaaaccagtataattcccagctacattttaaatacttatccttatatccacagataaacacagctctcactttcatcaaagaagcttctttttgtagcagatggagactattacaaaaaacccacaactgataaaaatacaggaaacaactgaccatggggtacccaatccccagttgatagatctaatacaacctttaccctaaggttcagggaatatcacataagtgggtatagaaagagtttaagaggcagaggaccaggatgtctgctgtgagatagtcaactacacttaagaaatcttaactatgtggttgcctaaacaaggccttcgtgatagcaacaccagttggtatacaatgtgaataggggaaatctcataaggccccatccctagattaaaagctatagacaattaatggctgctaagagaaggagaacagtcttctggaatgaattccctgattggttatctgacaccaagtgcatatgaacaacactaaatggatttagcaagaagtgtgtatttgtgtgtgtgcaaaacagtaattaaagaagagatcatggatttgaggagtagagaaacatgggagaagagaggtgtggaaatgatggaaatatatttgtgtgttaaattttcaaaaaaaaaattatagagctagggaaatggctcaacaattacagcatttgccattgcaagcattaaggcccgagtttagatccccagaacccatgcaaatgccaggtgggttgggtggctcacctgtagtttctgctttggatggtggagcaagctggttagcgagactagtaatattggagagctccggccttattaagagaccctgtctcagtgagtaggtggaagagcaattgagaatgattcctgagacatacctcagactttcacaggtatacacttgctcagacacttgcacatatgcaaacgtgcatacacacacttaacacagaccagacactgtcaagtttaaaagaaagcagaaaaaaaaaaataacatttacaggttaaataagaatccaaatagagattgaaacgatttccactttaatcaaataaaattgttgtgatttctggaagtgatcctaaaataatactcattaagtgttcctatgacatatttatagggaccatgagtactaggttttcactctttttctaaagccctggtgtatcagataaatcttgcactcttgagccagtgtggacatttagaaggaaaagaaatagagtggtatgatgtcaatgaaaactgttaatactctgtctctgttcttagtgccttgtgggagctagtgatcatctcttgcattttgtagccatagagtcattgacaaatcaaagggtttggccaaatgatgccttggattcatctccacacatgactttattttattctagatatatctctagtaaaactttgttgccagatgcagctcttgaccttagatatctcagacctcagaaacatgatcaaatgaatctgttataaattacccagtttgtggtaattttatggtagcacaaaatggaataagacattgtagttaatcagataaatcagatactcatgccgatcaatcacttaattctcagaataattctgaattaattatacttagtagtagtttctttagccctgttttacagatgagcaaactgaggtacagggaagttaaataacttggcaatagctctccaatatttttaactaattcaatcaaatttcaaattttaaaattctaagtgtactgtcaaaaactttcttaattactatgctattcctgcttcatacctatattggacttgcactaaaattacataatctttatctcttttattagaagtaaaaactactctgttacaaatatcagagaattccagccactagagtatatccctagcagtggcctgcagtgctatctccatgttcaacagcaaccagcacatcagaaagccaatattataaccttttaaaggaagcattattatgccttcatgattaccatgcttcatttaaaatacattcttgtttcccttgtagtcatatctaccaactttcttccattgtcatactgttaacacagtgccttctaatatcttgttaactttagagtcagagagcttaatcaattacatatgttggtaccagggatgagggtcagatgtccctccagcagtgcttctaatgattagaaaagtagcatagctgttctatccaagctgttctgtatgacgatttagaggtggaaaaaggccaaaaggctttacaagtacaataaagaagctaagtcccagaaccttcagctaagaagaccacaatgtctagtttggtggtaaagaagactcagaaactttaagacttcaaaagttattagtatgtacttttcaaatattcattgtcttggatcagttccactccaatcaaagatacaaacacagactttcactctttagaaagcacattattgagactattctcttgcaaagtaatgactttttggttcagggcaggactctctcccaagattttagataaagccataaagagcgatttgctctaacggctttagcatcatatgctgtgttgatagtttatttaatttttaaagcattaaacattcaaatcaagtactaatccaaattagtaagcatctgttactatccatgcttgtctctgttctgtggagaactatcatggcaaggcaaggaggaaggagctgcgacctagatagaccttgccaatactgctgaccacaatcatattttctctttatcatgaaacattttattatgacaattaatgttgcagctgagtggtctccttaaaatgactaatttttatgaatagtatattacctgtatatgagatttctactataatttgatttgcttacctatacctagtctcgagattcattttatttgtataataaatgaaagcagcagatgtatagcactttggcttatttgtaatacagatcagataagtgtttgtgggaaacgagaggcataaaacaagctttaaaaaatgcagtctgttatatggaagttacaaactacagtttcattaaggatagtaactctgaatttgtgcactgtgaggaacaagaatttttataagtgaaatagtaatggcttttttgatgtgttccctggaaagaatggtgagtcataatttttcaattgattaaactctaattcagtgtttctagtactttttactaataatattacaaccaaaataaaataagtgcgcagtagaactcatttcttctgttgtggctctctaaaagaggtctgagcaaaccctaattgtcctcatcctgcagtgaattgtacaacagatgcagttttaaagttttggttcttggcgtgaatttttcaccttttattccagtattagccttttgtttgaagcacctaatgttaagtggcatcagtgtgtatttctaaaagacataattagagtctctcttttttactcctaaaggaaaaaagcaaggtcagcattgactttttgcagctccttctccgggtgttctttgaatgcaactgggcttggttaggtcaaagtcaacagtatttgtttctttttctttttggctgaaatttaatattaataatataattaaatattttggattaaaaagcccttgtgagaacatctttcaggtagtactcaagtgattccttccatattcttgatagttgtagtgctgataaacaaaaaacacttttctgtaagcttttcatttaatttatatttaaccatgaagaaggtgcttataatgtggacaccaaaagaaatagggagcaaatgcatggtctcagttgatgtattagaaatcttttgatggctttctatcattacttatgtcaaaacacctgagatcattaacttctaaagggaccagtttcatttggctcagtttcagtttgtgattaggcagatctgtcactttcagcctctggtgactagtagtggcaggaaacatgccacaaagcaaacctcttactttgtggtcagaattcacaagagaactaggaagatgccaatcgaatccattcaggtgcctaaagaaagagtccctgtcccttaggcctcacctccgaaagattccaccacctttcaattatgctattctggggaccaagcttccaacacctggacttctaggggataggaatttaaatcatgaaacatcttctagaggagtaattttacattagttttgcaaggtgattttaactatcaaaaccaagataggtaaaaacagccacagccaggagaaacctaaggagatacgatggcatgtggtataccttggtgtagatgagatactgatacagaaaaaaaaaggatatttaagtaaaaattaaggaaatcgaactaaataatagacatgatttagtacccatttatccctgtaggttcatttattgtaacagatgtgccattttaacttcatcaaggaacgaagtacatgctatgttgaaacctgtacgttgttttatgtatggctttcatcctcctgaaaacctaaaattatttgaaaaaaaaaaaaagacatgatatgattggatgtgccttgagatctgcacttcagcgatcctgcattatgcttgatcaagcataattcaaacatgattccatattttaaagaaaactgacaatccgagttcacttgtagcagagctgaagaagtggtgaagataatcgtatctcatcgtctgaaacttcaatccaaatgtattctaaaagtgaaagcaacactgtttggggtataggcaacctatttctgtaaagtacctgatagtaaacagtttattctttgcagtccatatggtttttcattgacaaccactcaactgctattgaagcaaaaaagcacacataatacataaggcaatgaatgttgctgaatttaaaaagtcatatttattgaaacaggtgagtctggttttcacctgcatcttgtagcttgctgactctggagctaaaagctcatactgctccgtaggtaacatattaactcctttaagaattcataaaggagtacagtcagaacaagttagaatagtattgctttgcttcagttggcagggcgtatagaaatggcagcggtggagagatgaatgtacatggtttatttgcacataagctcatttgccatacttgtgagggactatcttgattaggttaattgaggcgggaaaccccatcctgaaagaagagccttttgccttgtggataagactgatcagctgcctcaaccccctaggtttgcctggaggctggcctccaggatgattccagaccctgtcaaattgacaacactaaccatcacagcatttagggtcaaagcctgggccctaaatgccctcacaatctaggctgagcactcaccatttataagccagtttaaaagacaagtagcagcaaagcaaagaaaggattagtgtgagtacattgggaaaggaacaagtagaggccaagtacccaccctccccagtctctagtgtcttgacatgaagattaggcttaagtaaagaacaagaggtagacatacagttctggtcatgatgtgggagtgacccatcattggcatacatagcattgcctaggcttctggctactagctggcctgcatttgtcagtattatgtaatatctctttctggaagcatcatcccctctccagatggaatccagaccccagtgtttttttctgtaacataaaatcctgaggtaattttaattccttgaaatccattgtctcaatagttgatagtcaaagaggaagagtgtttccctttagggcagtgcttctcaactttcctaatgctgtgatccacaactcagagttgtttttgttgctatttcattaactataattttcctactgttatgagtcataatgtaaatatctgtgttttccagtgctattagatgacatcacccctgtgaagggtctttccacccccaaagggatctcaactcacaggttgaggactgttgctttagagtattttctctcttgctgggatagttctattcttactgctccttgcactattagaaactatacccttctctccaatgccacccctccccccaacaaaagagactgaagagttttagggaaagtaggctattcagtacgtgtctcatatgacttggtggtacttctgatatgatgacagggagatcttttttctctggatgtagtgtgaccatcttaacagcataaaacattgtgtaggaatttctttaaaacacctggataaattactttatttttcctgtttattggattttaagttttagttatttgggagaaatcgcccagcatatggtttaagaagtaaaatcttgctagtgtatgcaatggtgtcatcgtttggatgctgattatggggtggatccctggatatggcagtctctagatggtccatcctttcgtctcagctccaaactttgtctctgtaactccttccatgggtattttgttcccaattctaagaagggacaaagtgaccacacttcggtcttcctttttcttgagttccatgtgttttgcaacttgtatcttgggtattctaagtttctgggctaatatccacttatcagtgagtacataccatgtgggttacctcacacaggatgataccctccaggtccatccatttgcctaggaatttcataaattcattctttttaatagctaagtactatgtatcagaagatggcctagtcggccatcagttgggaagagaggccccttggtcttggaaactttatatgcctcagtacaggggaatgccagggccaagaagtgggaatgggtgggtaggggagtgagggagagggtatgggggacttttgggatagcatttgaaatgtaaatgaagaaaatacccaattaaaaaaaaagaagtaaaatcatagctgggtgtggtggtgcatgcctttaatcccagcacttgggaggctgaggcaggcggatttctgagtttgaggccagcctggtctacaaagtgagttccaggacagccagggctacacagagaaaccctgtctcgaaaaaacccaccccccaaaaaaaaaaaccgaaaaaaaaaacccaaccaccctcccaaaaaaaaccaaaaaaaaaaaaaaaggtaaaatcataaacatttccaactagacaaaggtaatgagacaggaaaacacagtattgcccagagattaagaacacctaagattttatgaacattaggacagtaaaatcaaagagaaccattagaaaccaaagcaaggaagaatggctagcaatgagggatggtgtgtagctgttgaaaatggctcagtgttggctttccaatccagtctgaaaactctgtgtgtatgtgtgtgtgtatccaagttttattttatgcctcaataggaaagttggcccaggctatctatttaactattattgaaaagaaagcactccctggttatttcttggttcttactcttagtgaaataacaccttgtagtatgagagataacatattttaggggagaggtagttaagaggtacttacaagattacccctagctgtcctatcttgtgtgtatgtgctaggtatgcctgctatcttctgtgttccttgtgactttccgaagtatcttccatctctgtttcacagttcaaataagctcgttcctaagatattaaataactactcatatcatcgtaattaataataatgacacccaggacccaactcctgttcttctaaactcgtagctacttactttataatggacttgattcaaagaagaaaaagttgaagtctgtcaagaatggcttttttaaagaagacattttttttttctaattaaaaattattttgaactggagtgcttggactcctaggtttcttcggcatgacaaaaggaagctgtaaattcattgtgaatgttaatgcttggctagtataaatgaatttgtttctttcgttcaatggtcagtcaatgagagtacctaaaaaccctcacatgttgaggttatggagatggctcagtgagtaagagagctttctatataagtatgaagacctgagttcataatccccagtaccaacataagaagcctagagtggctgtgctctttcaggtagagttggaagaacagttgggacatgctggttgctactgccagtctagtcaaaatggtgagttctaggttcagtgagagaccctgcctctggcatataaggtagaaagttggacatttagcatcctcctctagcttctacaactgtacacctatatgtcactcccaaaagaaaccttgcatttaaaacatgctccttttgatgattacttaatttattttgtgtctatactagatagctttaatgcattatcctatattttttcctactagttggctcaagggttaagacatgacaattgcttatgtgttcattttaaatgaactgatgagtgaagtggttatggctaaactgttcctctttttcttttttctgtctgttccatggctatctatcagttcaaacttatgcttagcattaatttggaaccataacctttttaaaaagtcattgtctgcctgtacaaaaggagttatatggataattagttttttctacttagtatttcttctgttaaaactattagaagcacatatataatagtataaactgaattatttttagtgaactattgaaacatgcaacaaattactgtcattcctttttataaaattttaggatggaaaactttctgagctttcaaagagctacaaggttctattttgggaaacatctcaactttacaaggcctgttttcagtcattagaataaggaagtatttaagtacaagctgcccctggtgaccttcctcaaatgagacttcttctctttataaagtttccacaacttcccaaagtatcagtagcagctgaggaacaaatgttcaaaacatgaaccaacagggaccgttttagacctaagccacagcatctcccttataaatacagccaactggcctagaaatggggtcatgtaaaagcagtaagtgctttctggatattagaataaaaaaaaacggagagagcagttaggaacattagaatttaaataaaaataacaagcactaattagctcactagattttttaaaaaccttccacttgctcctagactgagcatcagaaaatctatgacacatgtcatcagtaaacatagaaaacaaaaatcccttaagcccactttccctgacaagaagaccaggaaataggaatcccaacaggtcttacacatctctgctgctccacactggacccccccgccatgtgggcaatattatctacccactggaacggaaatatccagcccctctaagcccttataccacaattggactctagcaggtagtctgacctgacagccactacaatacctggtcatttcttcctctcaatacctggtcatttcttcctctgtgccacaattctggttggtccctgtagtctgaaatgacagcagcaaaacaaaggttatacctacttcttacttctaccaacaaaggataggctgtgtaggttgcaatcatttgttttccttcccttcaccccatatcttaaggagaccaagacccaatagcttgtgagctctttccctcagaactgcccagagataattagcacatggtcctgggaaacaacttttgtccctacaggtgatatctcaatagaggttgaattggagcctgtcttagtttctttttttgttgctttgacaaaatgtgctcacccaagtagcttaagggagaaaggatttattctgacctatagtttaatagttatcatggtgaggaaattcagggtgacagaaacttaaaggagctgctcacatcacatctagtcaggaagcagaaagtgctgaaagctgtctctccacctgtgtagtccaggatttgagctagggaacaacagtgtcattcacagagggtgggtcttccaacctgaattaaatcaatcaaggtacttttcataaacatgtccagagtcccatcttccaggtgattttagattctgtgaagttgacaatgaatactagccatcgcagagcccttgaagaataggccagagtagccttgtgagtgttgagaaaattacacagccattggaaacaaggcctaaaaaagcagtccatagtttatgtactaaacctaaataaggtgactacctgctaagataaaaggtcctatagtccctagtccctaaataatatgcatactatcctggatacacaagtgccaggtaaaacaacttaaatgagaatagccatccaattgactccaaggctgaaatgaagcagatactagaatgaactgatgaagaaaatttttgttggtgtcctaaagttgctccaacaatcagctgaatgaaaaggtttgcaaagtgcagtaggagcactaactaattaattacagttagaatgtcaaagaaactggtcaagaatggcaccagaacttcttgctaagctattaggagttctcttcaactgtaaaagggaaaggggaaaagagaacactcaggagttcacttgctcttgctttgagggatatggttggctgttcttgtcttgttctccacgctgttttgtaccttacttgttactaggaagtcatgtaaacgatgagagcttgttctgctctttagacggcttgcacaggagctttactaacgagggtacactattgccactcagggacgttggtttcttacctaacttaagtttttttctaaatgttttgatattttactatcttgcttaaacaattatatccactgtactcttattttcagatttctttccccaaagcaattattttccagatcatctactttacttctttagacctagaaactgattactacaattataattcaaaacctattttctgctgccctgcacccgagctgggtaattgagtgtaaatggttatttcctttgcatgctttgttgttgtgttaagtgttttttggttaaaagaccagaggttgcctgctgaatatgcgtatattaacaattgtaaaagaaagtaaattactttggggagtattaatgaatagacatttaaattacatagctaaatcttttgaatccattattaagcaaacaattggattaacacccccaaagttatttaatcaacagtttataagccatatttgaatatttgttacagaaaatgatatttgaatggccattaaaacattacaacataataatgcatgttgttattctaaatattaagattcaagttatctctctatatatgtgactttgacaaagaacaaatttaatccttaaaagaaagatccatatcattgtagtatcagtttttttccagagaacaccaatgagtagtaatttttacatgcgtggcagggattgataggctcagcaaggtaggggtgcttattcccaaccacaagaccggatcactaataagtcacaggatagaaggtgggtaggtcttcatgtgatagtccacaatctgacttgacttagaagatttcattctttaaaaaactctgtatgataccaattcagaaaacctcaatttagagtgttagctaattatgtttttttgttttaatattaatattactaccttaagcagctaaaatgaaaagtaggtaagtagatattactggcctcaagatttcttttactaacttaatttaaactagatacattaattttatataatttacgactaggtttaactagggatctttaaaacatgattctgaaaagaaagagatttataatactccacagaggtatattgaaaagcagactgttagctgtagcttctgagcctgagtagtaatcccacctcattcttaggtacagttgtgataatggcttccaaaaatactattgtatgacgatatgccatcttgaatacaatctgttagtgaattgcaacaaaaacacattactttgaagctgtgatttacaatgcaatttcacactctcggacttcaataattattagtttcagtttataagaattggattatgtacagaaaatttgacaattgtgataatgctagcactaattataggtaattttgttgaacactagtagaaaattaattaaaaagagaaaaagtaatcccagcactcgggaggcagaggcagaggcagaggcagaggcagaggcagaggcagaggcagaggcagaggcagaggcagaggcagaggcagaggcagaggcagaggcagaggcagaggcaggaggatttctgagttcgaggccagcctggtgtgcagagtgagttccaggacagccagggctacacagagaaactctgtctcgaaaaaataataataataaaataatttatacaatatattctgatcatatttcctctctatccccaactccttctaggaacccccacttcccctcacacacatataaccctccaaacaagcaacaagacaagatatgccaacacatgtacacacacacatatatacacacacaggcacgcacgcacaaactatggaatttgtattgtgtcagccaactactcatgggtgtgggacctgctctgcaatttggttgatagatccaatgtcactccattggagaaaactgattttccctttgccagtggatatcaattataaatagtttctttgttaggggtggtagcccaagtccacattcccttcacagtgctgggacccaatctggcttgcagctgtataggtcctgtgtgtgttggcacaatcttcgtgagttcatatgtgcatcagtcttgctgtggctgagattgtttcctttgagacatccatcacctctggctcttacagtctttctgccttcacttccacatagatgcctgagcgttgaggggagaattttgataaagacatcctatttagaactgagtgctgcaaagtttctcagtctatgtatattctctagttgttcatctcttaattcccatctactgcagatagaagcttctgtgatgcagttgagtgatgcactgatctatgggtatagcaatatatcattaggagtcattttattgctacgttccagaacgtacgttagcagaattgtattaggctttcacctaagtccatagcctatctagtatcaggttcttagcaataagggtctcatcttatggagtgggctttaaactcaaccaaaatgtagttgtctagtcccataacatttgtcctactattgcactagtatattttgtaaacccatcactgttgcaggtaacagggtttatagttggctgattgcctttctcctccagtagtacacagagtacttccctcaccatgaaaactattcgtgctgctgcttcttgtatggtaccagcacaactttcctcatgtatttgatgacatacgtaagtgttgtcttctgcagtagggccttatcattaggttgtaccaaacaaccaattgcctggcaatagcttgtgatgtttgggagtgttccatggtacccctttactcagtagctcaacaagatataacctttttctgataatggagttttcacttactggtataagatatctagttggggcattctctcccctattatttagattactttcagatatgtaatattttagaattctacagtaataagtttccatatggtttttcaaaagatcttttacattggttaactttttcttttttcttattagatatcttgtagtctttcaataatggtgctttttcttctccttcgctctccccaccttcctctccaccttcccttttatctgcccaatcatcagctctcctttattttacaaattaaggtgggaagcaggtttacaggaaatcacctgagtgacccccccccaaccactcacaggagaacagaattaatatcaaatataattagccccaaggctatccacaacagacgccagacaattattttttaaaagccttttttgttgttgtttttgtttcctacaatttctgggtttttttcatagttattttcagtgcttctcttgtttggtctgtttgctctagattacactttctgttagcactggccactgttttagactctccttcagaagtcttgggagccatggctctctggccatgattagaaatcaagcattgttcttacttggaggcagtattacctcccaacttctaggatatttggaaacacttggagatatttttgattatcaaagcctggggcgggggggggcactgctacaagtcttcagtgagaacagttcatattgctttcctatacaagaaaaaaaaatcagttcaaaatggcaatagtgctaacttgagaaaccccacagcagaagacttaaaagcttcctgggaaaccaaaagtctctctggaaggggatttaattaattcagggcatcttaacctttctccaatcatgacccttttcacctgagaaacttatacaacttcaggtaaaataagcatacaaatgaaacattttctttacaattcataaagatttttatttaaaaacaattagtttgtacatatatatgtatgtatgtatatagttttatttaccatttgttaaggaggaaaacaaatttgcatactaatcaagaggattgcttatttttacatgaattaaatcttggttgaatgtttgataccaaagagcatagagcatattaaatatttttcagacttgattgatactaattttgcaattgtcaatgctgagaacattgttttacataaatacacaatagaaaaatgttagaaatgtgtttaggatcattttagaaatttttagaaattctgtcctgataccaatccaaaatgcatttaatgattttttttcaatcaaactcaaatcagaaacttaacaccaattttaaaagtcaatcactctaacccaatgcactaaaaaggtgtatgctaatttactatatgctcaggagtcatagtaggaaaatattaaaagtctgattttcataatcaaaacattgttttcataagagcagaaaactttctatgtacactaaatacactgtggttcataacatattagtctcaaatgtgagttaaggtggtctaggaaggagtcatccgtgttgagtggcatgtgcagtgcaaagtgggcatactgctgtgtatttaaagtcaaagctctgacacagtgccagtgagtgctgccataaatttgattttggattgttgttgttgattgttgttgggcatgagaaaccttggcattttgtgtgtgtgtgtgtgtgtgtgtgtatgtgacacatttagatttgtggatccatggggttacatcccatgttgtaagaagctgatatatagttgaatgatgtggggtaacctcattttatcttggaaaaggactgagactgtcaataacacacacacacacacacacacacacacacacaaaacaacctcatgctcctttgctttctatccctttctcaatgaccttctctggtcttgataatgtattgctgtctctaaagtatgaatccttgttaggatgagaaaggagcagttacccatggtataagatagagacataactgcttctttaaaatctttcttcttgattctatgccccagtacaggggaatgccagggccaggaagtgggagtgggtgggttggggagcagggcagggggagggtataggggactttcgggatagcatttcagatgtaaatgaagaaaatatttaattaaaacttttcttcttctagttccagattcatgagattgttctgtaacataaatgggtttggttttaaataatcttccttgctttctcctgcatcagttaacattattgtgtctgtgtacactctttatccctcaaatttgattatttcatctctcttgttctcccagttatttctttaagctccttttaatagatttgggaaataagttaggtgcactatgctcaatttatcttggttttctggaaaccaggcataatttatagcatagtttcatgtaattatagtctttttaaaaaatatatttagctcttatatgggaattatctattacctacatttaacttttcctataaagggaaagtaaaggagagtattctgtgtctgcatagggcagctatggtctttctagaattctagaagatattctaacaatacagattttttgttatttctttatctgtctttggtattagagtagtactggcttcataaaaagaatttgtaaacattgctttcatttccattctatggaataatcttcatagtatcaagtgttagttcttttaagatgtattagaattctgcagtgaatctatctgcctctgagatgtttttagttgggcagcttttttttttttttttttttactgtttcagtcttgttgctggagatgtatacatacatatatgtttaaatttttatttcatcttggttgcattttagtgggtcatatacactggaaaattcatctatttcttctagcgtttcaaagttaagggaatataggtttataaggtatgtcttcatgatttttctggacttcattggtatctgttacaacatcttacttctgatatctaattttatcgatgtaggtcttctcctctttatcttttggttaaattggcaaagaattttccagtcttgcttatcagagaaacaactctttgtttaattgattctttgtattatatttgtttctagttcattaatttctgctctgatcctagtttttttgtgtgtgacaaggtctcactgtgtaaacttgactggcctagaacttcctgtatataacaggctggcctcatactcacagaaatctgcttgcctcctctcttctatgattctaggagtgtgctcccaagccctcattctctccctgtctagtgttttcaagtttggtttgttcttgactttccaagactttaggtgcaccattcagttatttatttgagatttttcagatggcagcaaacttgtgtgactaagcaaaatttccactagcaggtatgggatacctccacagaagtttatcagcgaagccccagatgtcccccccaaaacaggttctgcagtacttttagttattcatcactagatgatatgacccttttgcagaagatgccctagttataagatagagagaaagtaagctgaaactgagctggaatcttcttctctgctggctactctcatagtactagaatgtgctactctacatgctgctggaagagaaaatgtattattggccttacccatctgtgtaccctaaaaaacaggaaaaaaaaaactatcctgaaaagatgtgtctacctatgcaatagtggcataattgtgagaacagctgccatctgataagatttgaggcttgttcccaagagtgaaactcatagctagtaagcccacttaacagtctatgcctagggaagttgtaggtccaactggagtaactagatttatacatcatcaaactgccttctaaatacgtatatttatacccattgacataggttgttctcagtcataatgagagaagcctttctttgcaataatcagcaatgaatacaaagactagatagactcgtagcaccctaagattctaagaatgggtgatggttgaaggctcagtcctaaacagacatttatattcctccctttaagctcagagaacactgggagaggcatttaggaagtatgcaaaagccagaagataaggagaaagcctgtggatgccatttcctgaactcaatagaaccatcacagtcatgaactcagcaagtgcacttaccctcagtggtccacatacaagacaggtcatgttaaaagggaaggggctcgtacaacttcctattgcactgttggctattgatggtttttgggaacaggggaataattattatatacactgccaagcccaccagagcctgacagatagctgcaaacccacagtcatttatacagccctggttcacacagtaggtcacaaagaaaaacaaatagacacatatgagaaagaattctaggaaagaggaggggtgtgtgtgtctgcgtgcctgtgtgtgggtctgtgtgtgtgtgtgtgtaggagtagtagtgagatgagagagttgaaactgagagtggttagtgtgcattatgcatttatattaagttgtcaaatagtaaagttaactaaaaattttaaaagtcatagaataaataaataaataaataaattctttttcatccggcaatatttaatcaaatctcaaatatcaccagttgttactctattttggtcaataccctagtagagaaagataatgtatcattttcttccacatcaatagtcaagagttggctatatggtacattaaataaattttaggtaaaaacttccaagaatcaagaaggggttgacaagcaaaacagaaatctgttcttcctgacttttatttcccctaaactatcagctaaatataagtaatgactataatatggttctatgttaatgctgcttattacttttcattttcataaaagaccaacccaaattcttttagtagtatctgctgagttttaagttgtgaatgaaatcataagcaacctcagactgttttgatgtctttaaggttattacatgggtctcagctcaccttcgttagcttcctgcttgttagtaaggaaaagcctttactctgctttacttaggacttgtgttcaggtcttgaagaattcataaatacattccttttaaaattctattaaataagcttaataaaccagtggatttaatttttattcatatttttaaaaatattttgagactatagttacattatttctgccttccctttattcccaccaagttctctcatgcactgctcctctctctttgggatttgtgtccttttctttttaattgttggtattttgtatgtatgtgtgtgtgcctatccttaaaaggtggttcattgtctcattgctttttctctcctttctccaaagctatcttaatttaattctcatacaatggtagcaggagaagcttatgctttcttctttgcctatatttaagcaattgcctggattggccacaaacaaccctacagacagaactcagaaattttacaaaatgatgcagtgagttgaatgatactacacaatatatatatagagagaacatgtggtcaaaacctgattatgttaaatgtttcctgaaattgtatgctattgtcagacgaaataatcacaagtaagactaggttaaaagtggaagcatttgtaagagtcctgcctcacttctttgtgttgtcattgaggaagatctagtggttttcagtgactgtggaaaaggttttctttctgtagatttgtgatctgaacgttaacattatcaacactttcctttccaggctcgctttgctctttgtgaaaagatttgaagctaggtggaattgatgtttgtgaagatggcattcaattgatcacggatccataattaagtataggttagattaaatttatttgctagtcccttaactgaaaaaaggaaaaacagtattacaaatcaaaggaatactcaaacacacacacacacacacacacacacacacacacacacgagtgccctctaaaagccagtgagagcgtcctttgtgtattcttccaccagtcgggattggaaaaaaatgtatacatgcacatatgctcctatatttaatgggtgaatcatagttgaagtgctagtttcacacaacaaatctgtccttgggtatcttaaattcttgagttctgatatttatttgatgactgctcaggatccaagtattgacattttatttccctctgcatatccaattgtgcaacatgtattgagtcactgatgaagattgcagggaggcgtaggtaagcaagtcactagaccagtacaatgacttttactgataaggcagttcattatttatggcagtttaaaatagttctgatttgaaattttagaatgatgaaggatttctgtaatttttttttttttttagtcagactagagaggttcctggacaccaaatcatgcagggatttttccttgagaactccctgcctaagactgtaatccagattttgttgaggattatcttttccttattttatgtagtattgcttatatgttttgtattttggttcttgattaggggtgtgtgtgtgtgtgtgtaaaactttttctctgggattttaagtgagaccatataagattttaattttttcaataatttttattagatattttctttatttacattccaaatgatatcctctttcctgatttcccctccaaaaaccccctctcctctaccctctccccgtgctcctcaacccacccactcccattcctggccctggcattcccctatactgagacatagaaccttcacaggaccaagggcctctcatcctattgatgaccgactaggccatcctctgctacatatgcagctagagccattagtcccaccatgtgttttctttgattggtggtttagcccaaggagctctggggatactggttagttcatattgttcctcctatggggctgcaaccccttcagctccttgggtcctttctctagctccttcattgggaaccctgtgctcagtcaaatagttggctgtgagcatccacttctgtacttgtcaggcactggtagagcctctcaggaaaacagctatatcaggctcctgtcagcaagcttttgttggcatctgcaatagtgtctgggtttggtaattgtatatgggatgaatccccaagtggggcagtcgctggatggcctttccttcagtgtctgcttcaaactttgtttctgtaactcctcccatgggtattttgttcccccttctaagaaggattgaagtatccatactttggtcttccttcttcttgagtttcatgtgttttgcgaattgtatgttgggtattccgagcttctgggctaatatccacttatcagtgagtgcgtatcatgtgtgttcttttgtgattgggttacttcactatgtacaagatatcctccagtacaagaatgaatgagaaaccttttttcagtagttactacaaaacatttggagcttaaagttaagagtttatgatgtgccaagaagtgatggagataaactcagtaggatatggaaataaagattaggtttgtggcaaagtaagagggagatgttgatttaacttttggcttcaaaaagagtatgtcttatacgtttgcagcagcagttgatgaaaaaaggggccatgaatttgaaggaaatcagggaagagttcatggaaaagttcggagggaggaaagggaagggagagttgttgcaattaaaatacaatatcatattaaacaaaaagtgtgtctgtatacaaccacttctacaaacttcccattgtatcagatgttggtaattatttgcaattactacatttgttttttgtcctgactataaggatagtatttagaattttatatatataccatatataagaatttttatatattttatatatatatgaaaacctatttatttggcctccatttttggtataacaatatcttaaactgatgaattacctttgaattagacaatagtactcaaaattgcattgcttaaattttattgtgaagctctctatagtttgtagtgaataaagaaacacagtaagatgttgatcaaaaagaggaaattaatgtcagtgaattaaaattgacttttttgttttttaggggtcccttcagtgttgtacggcgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaacccatttatcaacctaacctcatctgggggtggggaagcaggggatatgatatagtggggaagtgggtggagacagtgtgaactccagttgaaatagttgctcagaaatctaaaagatagcatttgaaatatggaatcattaagtcatatgggatctttatgagcttatgctttttttttttttttactagaaagagagtgaaatagggacatactttttaaggtataatttgagtcctgttctgtgaggtgtaggaagggaaggaaaggaaataactataagaatgttaattgaagatttagaagcagccaaggtcctttaagtataatttttggcctttgggattactatctcctataactagatgattgatattttgattcacatttggctaatcacatactgtatttgtaaaagttgaaaggtcagtagtattagaatttgtgggacttagatttttttaaaatatatatatgtgtatatatataaatatatatatatatatatatatatataaatatatatatatacacacacacacatttgagttacttattatttttaaattttaccatgattcacattaaagtaacaaaactgattattatattgactctcctaattatcctatttactagctttagactttcgccacctagtaaaagatgtattcttccttagtattttgtttttgaatcttaaaggctgtgcaattgaagaaaatacaaagtgaagtaccctatttgtgttttacccaattatctagttttgcaaagtagaatctcacacagtgtgagctccaatctattcctatagatttttattcaggacaattatttctaaacacgttgtgactctttaaattattattatcaatataatgtttatagaagattgttaaaaattattgctaagaggctgaagacatggctcagtgattaagagccctagctgctctcccgaaggacttgggtttgattctaccaccacaaaaaaggactcaaaaaccatctctatcccaggcccaggggatcgcttgccctcttctggcccccatcagcaccagcccatgcccttggtatacagacatgtaggcaggcaaaacccccatacaaatacaatgaaaataaatacatcttttaacaaacatttttaagttacttctaagaaaacctcccttgctgatttgtttttagtgctttaatctttactggatgcctacaaggggccttctcagtcaaagtgtatgcatgcatttagattaaataaacgtgaccacagtactgagggaaaaatcttgtagtaaaatttaggtgtttcatagttcatgatttcattgtcagaactggacattaactgcttttaaatatacattattttatatgcttagcaaaatggaaaatttgccatttgatgggccttacagttatttttcctttgaactgttttgtttggatgtattgttggctttgtagtgctggggatcaaacccaggtcctcaggcaaactaagcaaatactgtttttcttaacttttaaatacttttaaagttctctatgcctcagtagtctataagggcactgaggaaactttgtgcaaacctgattattaaacaagtagatgttttgctaaatgctgaaaaaaagttctgatattgtttataaacagatctaatttgttgattggtacagatctaatttaaaattacaaatgttaaatcaattatccaattatctatattaaattagaataatggaattgaaatatcttacataatattgcaaataactaaaataaatacttataggttatttcttagccccaaattactaatatcaaagttttgatttgtcctatcattatacctaattttctgtctttccagatatgtttctaaatttccaaagatatttttaaaggaaacaactactttttcatttgtctatagtaaattattgttagatttctttagttagatctctggaactagagacttagaatgtgaggaggaatctcttttactacttacgtaaagaaggttatggtgatttacacattcagtcccagaatttaggaggcaggcgcagagataggtggatctctgtgagttcaaggtcatcctgctatacataaaaagttaaaggctagcctgtatatattgagactgtctcaaaacaaacaagcaaacaacaataaaacaaaacaaaacaaaacagaacccatttcgccagagggttaaactccaaaccatttttttttgtcattctaataatttttttattctttaatctttttttacagtccagactttatccccctcccagtccatcctccaactgttccacatcccacacctcttccccccatcccctgtctccaggaggaggtccccactccccacccccaccctaccagacttccccactccctggggtcccaagtctctgcaggattaagtgcattttctctaactgtatctagaccccacagtcctctgctgtatatgcgttgtggtcatcataccagctactgtgtgctgcctggttggtagctcagtgtctgagagatctcaggggtccgagttagttgagactgcttgttttcttatagggtcagcctcctcctcagcttcttccagctttcctctaattcaaccacaggggtccccgacttcagtccaatggttgggtgtaagtatctgcctctgtctcagtcagctgcttgttgggcctctcagagggcagccatgctagactcctgtctataagcatatcatagcatcagtaatagtgtcaggccttgaaccctcaccttgagatggatcccaatttgggcaggtcactggacctcctttccttcagtctcttctccatttttgtccctgcagttctttttttttttaattgggtatttatttcatttacatttccaatgctatcccaaaagtcccccacacgctcccccacccacccactcccacttcttggccctgtcgttcccctgtactgaggcatataaagtttgcatgactaataggcctctctttccactgatggccgactaggccattttctgattcctatgcagctagaaacatgagctccaggggggttctggttagttcatattgttgttccacctatagggttgcagatccctttagctccttgggtactttctctagctcctccattgggagccctgtgactcatccaatagctgaccgtgagcatccacttctgtgtttgctaggccccggcatagtctcacaagagacagctacatctgggtcctttcgataaaatcttgctggtgtatgcagtggtgtcagcgtttggaagctgattatgggagggatccctggatatggcagtctctagatggtccatccttttgtcacagctccaaactttgtctctgtaactccttccatgggtgttttgttcccaattctaagaaggggcaaagtgtccacactttggtcttcgttcttcttgagtttcatgcgtttagtaaattgtatcttatatcttgggtatcctaagtttctgcccctttagacctttctgcccaacttcttttcatctcttttctagttactacgggcaaaaaccgtctgattccgtcagctcttctattccatttataaattgttggggtccaaaaataacccgttttaaggcaaagcatgcaaaacatactgtatcaagaagaaacaaattttgaaggggaatatagcatagtaaagaagagtccataagttcaagtaagattatctagaaatatcttttaattctagctatttaagacaactttttttcttattttttgttaattcctttttcttcaaattttttattagatattttcttcatttacatttcaaatgctatcctgaaagttccctataccctcccccctccctgctcccctacacacacactcccctggtgttcccctgtactggggcatataaagtttacaataccacggggcctctcttcccaatgattaagcaacaaatcatttaaaatccatcctgtgccttattctttgcttactcatatcttttctccccttggcttatagtttctttgacccttatcattgcccattttttcctgttaccatatctgtttcaaaatatattatgggctagatgtaatcatttattttcaaaatatattttaagctagatatggttgagcaggactgtaatctaaagattatgtggaggccagaagatcagaagttgcaggtcatcatggactccatagttcaagcccatgaattcaaagccaatctgtgctacatgaaaccctgcctcaagaaagaaaataataaccaatatgaatgcatgtgtctaatgaggatcactgtggagcctaccatacatcacttatttagataggtcattgtttataatatgattttattagaaacatctgtagtaaattctgtataagtaacatacaaatttaattttgaaataaaatgtttattaattgaaaatttctatattagtcaataaattttaagtttatattgccttagggaagcttccacatgataatttatttttctttattttttgctgctaatattctaatttttgttcagtagggtttttcaagttgcacaaaatccaatagtcccttgaaaataaatatattttgtcatgtgttcatttttcattgtttttacaagattctgaaacagacatatcactcctaagtattttataatttcttcctctatatgtatatagaagtaaaattgcttatgagtatgagataagtgaaaagtttctactaaatgaaagctaaatgattttatattaaaatatttctgatatggggccagtgaaataggtcaacaggtaaagcacttgtcatcaaacaggacagtgttagtttgatcccaggaatcaacaaggtaggacttacttgactcctggaagtcatgttctgagctgcatatacacacaaactcacagaatcagtaagtaaatgtaataaaacattttaaggttttattatttatatgtgtatgcttgtgtgaatatatgtgtgcgtttctgtagaaaccagaagaaggtatcaaatcctctgagtctggagttacacaagactgttagccacctgatacagttgctaggaaccaaacttgggtcctgtgaaagagcaggaagtatatttaactgtgagtcatttctcccgcctctcattagaaggtattttcatacacatatatagaaacaaagacatacaggtacatcccattagtgaaattcttagattcttatctttgaacgtttttttctgaaaaaaataaatttttactgtttttattattactaattaattattttttagtttataccccaaatgttgacctctcctagcccctccctgtctcctctgagaaggtgcccccccccccagcattcccagtttctgaggcatcaagtctctacaggattaggcacatcctctcccactgagaccatacaaggcaaccctctgttacatatgtgccgagaggcctcagaccagcctatatatacagcatatgtgctggggtccacagtccagcccatgctgtacactctttggttggtggcttaatctttaggagctcccaggggtccaggttagttggtactgttggtcttcctatggggttgccattcccttcagttccttctgtccttcccctaactgttccataggggtccctgacttcaacccaatagtttcaacccaatagttgggtgtaagtatctgcatctgtctcagtcagctgctggtagagcctctcagaggacagccatgctagactactgtctgcaagcacaacatggcatcagtaatagtgtcagggagtgctgcttgcccatggatggatcccaagttggggaacaaaataatcatgggagacagagggagggaagcacctgggtgaaagaggggaaggggaggggaaaaggggttcagtgtcaggtatagggagagacaggagagaagcccagaggacccagagaatgaatggaaatatgcagctacctggggtggtgggaggaacctctagaaaatcccagagatctaggatgggagaagctcccaggacttaatgcgggtgaccttagccaaaatgcccaatggtggagatatgaaacatgcaaaccacctccagtagttagacaggaccccagtggagggatggagacaccaacctaccttgaaaaatattgactcaagattgttcctgtccaaaagaaatacagggataaaaatggagcagtcactgaatgaatgaatggccaaccagtgactggcccaacttgggatccatctttggatttttaattaatacactttttgtcttttattctgctgtgccactaataaggttttatttttaaaatatgaaaatgtattcaagcaaacaaagaaattaaaagatagtaagatagatagaattagaaactgaatatccagagttccaagttacttttaattttacttacttattttggtgctagggtttgaacccaaagccttgattttgctacgtctacaatctaccagtgaactctactcccagtccataaccacagtttgaataaagattgtatagtgaaagatctcttttattggttattttatttatttacatttcatatgttatcccccttctcaatttcccctccacaagctcccatccccttctccctccccctacttctatgagggtgctcccccacctgcccacccacccacccacttctgtctcagcaacctagtgttctcctatcctgggtcagcaagcctccacaggaccaaggggctcccttcccagtgctgctggataaggcaattctctgctacatatccagctggagtcatgggttccccctgtgtactctttggttggtggttttgtccctgggagctttgagggttctggttggttgatattgttgttcttcctataaggttgcaaaccccttcagctccttacagtccttgccctaacttccccattggggtccccacacttagtccaatgtttggttgtgtgtatccgcatctgtattggtcaggctctggcagagcctctcgggagacagctatacctggctcctgtcagcaagcacttcttggcatcagcaatagtgtctgggtttggtatcagtagatgggatggctccctaggtggggcagtctctggatagccggcttttccttcagtttctactccattctttgtccctgtatttccttttgacaggaggaattctggattaatatttttgaggtgggtgggtggccccacccttcaactggggaccgtgtctatcctctggatatagtctctacaggttctatctccctaaattcctccagttggatcctgggaaccccctgggtctctggcatgtgggactttctagtggctacccccagttccccctctcccactgctacacacctactttcaaattcctgaccctctgtatttcaacccccttctcctcccatatctgacctggttcttccccttcccctcctctccttttgtgtaggtatttcctacaagttcaaacattccctcctagaggaaagacagaggtttataggatcagtgaaactcgcaaggcacaggaagttataagattctcttcccaaggttctataggaagccagcaatttctggggagagaagactggtaaactgcttccagagtccctaagtaaaaccttaatgtactaggagtgttgagaggagagggaaaagaaagagaaagaatgtgtgaaggaatgcttaaggaactgatggcacagaattctcgtaagttctacatagataaaccaaaaggatatatcataattaagctgtcaaaaattgacaaggaaagtaaactccagaagaaagcaagaaggaatgaattcatcatagagaagggatctgcattagctaccagcagatttttcatcagaaatcatgatactagtggcaatggaataggatccaacatgctgaaagaaaatattatcaagaatcctttatacagaaaaagcatacttcaaaaaatgaagtataaattattttcagataaacaaaacaaatctggctgcctggttattgggactaataaacttgctctacaagaaattctcaaggtagatttttacagtctgaacaggaagtatttgttaatattttgaagccatatagaaataaaaaaatactcttaacatcacatataaaaatgtgacagccagtatagacatactttttgcaacatggtctcaatatgtaacattgatatgttgatctgaaactgattaggcagaccaggctgatcttgaattcagaggtctgcctgcctctgcctccccagtcagattaaaggcttgtgctactactacccctggctataaatacatttttattacacctgtgtttctcttaactgacttaaaaaataactgcataaagtagcattataaaactatgttaatgagaccattatgtaagagtgtcaccccaaattaaccaataaaagtacttaatagctatagtagacatagacaatatggcaagatgatataaatggtgtagtagatactatctatacaatgtcaaagaagtaactggtagaggaatataggcacatagcaaagtttctaatataaataatatcttattggtaataccattaaacataaatgaattaaaactaattataaggcagagagaggcacaatgactaaaaacatgccctattatatattatctacagtaggaacattttatttttattatattggtttttttttgtgtgtaggtatgtgtgcatatatgtgcatgtacatactccacaatatgtatttggtgatcagagggtaactgtctttctatctatcataatgaaacttagttcagcattctgggcagctagcacctctacctgttgagccattgttctagtcagagtcacattttagactcaaaaggcatttaagttgaagtggtaggaaaagatgtatcttttcaaactgtaaccaaaagaaatctaaaatacctgtacaaaaaacccccagaaatttgtatttcagtgatacttttctatttcagagctgaggagacagctcagcctgtggacttcagttccatccttagaacccatgttaaaatgtcaggcatgatggcttctgcttgtaatttctgcaccaggtacagggtgtaaaagaaacataataatttgatctttaatgtagaaaatcattatataaattgaaatgtgtatatatagacttaataagagttacatacaggaaacttgaaacttacgacagtttttttaatctaaataaatggggagcctttctcatatttgtgattcggaagatagtactgtgaaggttatttcctcgcaagttaatctgtagattcattgcattccaaattgtgatcccaaccaactactttttggatattgacaaagtgattctaaagttctataaaaaggcaaactatccagaatacctaccatcttattacagaaaagcaaagttgcaagactactactcaacaccagtacttacttaagaggtgcagggcatattgattgttttgtttgggacactacaatgttagggtaaaaaaaatcatgaaatatgatcagtgtgattttaaaggaataatagcattgggctcgttgtggagtatcttcttcgtggcacacatctattttccattttgttggcgacaagaattttcatataatgataaaattgagtaattatacatataatgccttagtacatggaaacctgtgaaaccaaacggatatctattgtttgtagcagtgttagtttcctgcatttgatattgtactgtggttgtgtaagatgttgccaagggaagaaaggactaggttaatgatatacaaagaccctttgtattatttttgcacatttctgttaatgtataattactctagaataaaagatgttctttaaaagttgttttgtggtttctacaatcttctacaaagtaataattatgcttcaaatattcaggagtatgaaaaagcacaattttaactaacggttttggtttctaatcgctcaaattggtatgttcaggcaaatcgtgattgatgtaactgagagcatcatcaaacagttacttgctttccctaggaaacatgaatatttaataatcctcatttacataatgaatttgcattcattttgtaggataattactggtctagctaattaatctatatcctctcctgtgtgcagaaagcatgtgaaaatattttatttgctgtgatattttcttagtgttattccttttctgctgtggcatgtgtggcatataacagtgaatttcaagacattaagggttatactttaattttgtcatgtgcagtttctgaacactttcatcatgaattttgaagtcctggtcacagatttaatgactcaaattgtaatttgtgaattcagcatttgaaatgaaaacacccattctttcagatgttactgaattatcttgtatgtgcctcatcctgtgcatgtgagacaaatagattttattgtggagctatgacataatcacttttagcattggtattattaaacatgaatagaatcatgaaataattaaatgtagccaatattttgaatcactttatttttttgatattagttttatggagaaaacaagggatttttgtattatgaaatatttgagcaaagctagttggagaccagcttccagccagttgtataattttccacagaatgtctatttttaccatttctgaccgtatttcccatttaattattgcattgggtcactggctagtatattctaaaagaggattttcgtgttagatttttttctatactgttgaagcataaaaaacttcgatgatagaagtactattttttagcaaattacattaatggtacatcattggctatttttcttgagatgcagagagagaggaggggagcagtcagtttatctgtctgtctgtctgcctgcctgcctgccttcctgtctctttgccttccttacctgtctgtctatattgaactctgttgagaaaaaaaagtcagcttttaaacaaatgtatccattttaaaaatatttgtggtagtctagattacctgttcgtagaagtatatatgggcgtttgttcacaaaaatgactcagactcactaggtaataattctagatgtgaacatttaatatgttgactatattcctggtgccattattataaatgtctcttaatctagatttctcatctcacatattagatgtgttgatgaagaggctgtcgtgttttataataatgctctcaaagctccgtggtttatatattcaatttaatcttaatatcatcttaatgtcatattcaagaactataacagtatgacacactgtaaaatgagaacctctgctcaatatttattctgaaataatatagtattttaaggttatctcacccctaccacatgcggattttttaaaaagttccctattccactttctttatacaaataactatctattcttacaaatctttatttcattgttatttactttatgtgatttagagaatttctctggaaactataaagatagacagtgatagatattttagtaggttgatggatgcataaaccctgctagatggagataggaaaaaaatctataaaatgagtatgagaatttgattgtaatatttaagtctgaagcaactgagaggtagttcttttattttgagttggtgttgttaatggctgaatacgcatttgaaataagctaagaaatcatattttgttattaaggttgttatccttcagtagttcacattatgtagttcaatgtatattcaaaaaagcaaatgctaacttaggaacgaaaacatctatttaaaaggagtattacacaaaaagagaaaggagctattgaaatgtattatggatgagaatttttcttagtcccacccagaatcttattgtggtctactgaaatatgtacagaaatcttccagatgtcaaacaaagggagtagaatttgttttagcagataaatctgtgttcatggaaggtttatatacttctcaaatatcagccagaacagcatttttcttacatgggaggagtaaacaaagctagaaagaccttggagagagagaagggggcttaaccaaattttgttcttgttcatttattcatttttaactggtatattgttcttattgattatgtagttgggctaatcagttataaggcaaggaatggtaactcagagtgtctgagtttggccttatcatagataagtaaaggagctcatgaatcttatgtaagtcataaaggaaaggttttgtttttgttgttagaagctgttttttaaaacataaaagttggtaaatttattaacattttatatttttccacaatcaaggtgtttaaataaaatttaacaaatgttcaattgtaaagactttgaaaggttattaatattcactgcatcatttttatattcctaatttatacaagaatatattattagtcctgattttctttggcaaagaaaaattgtcagcaattttttatgtatacagttcaacctcattattcatgggctctagatcagtaggttcatccaaatacagattggaaatattttgcaaaagaaaaagttatcgtactaaataagtacaaactcttacctaataatgaattgggattggaaagtattgactaccctttaacattaccccattctcagtaatgtgaagaacatacaaagaaacataagcaatctgtcctattgtaatttgcaacattttagagatagtgtagaagttgtaaattttaagtggtaatagtattacttgcatctgtatttgtcaggctctggcagagcctctcaggagacagctataacaggctcctgtcagcatgctctttttggcatccacaatagtgcctggttttggtagctatagatgggatggatccccaggtgggacagactctggacggcctttccttaagtctctgctctgaactttgtcacctgctcgaacacatttcctcctgtgagtattttgttccctcttctatgaagcactgaagtatccacactttggtcttccttcttcttgaccttcatatggtctgtgaattgtatcttggttattctgaacttttgggctaatatccacttatcggtgagtacataccatgtgtgttcctttatgactgggttatcccactcaggatgatattttcaagttccatccatttgcctaagaatttcatgaatttattgtttttaatagctgagtagtagtactccactgtgtaaatgtaccacattttctgtatccattcctctattgagagacatcttggttgtttcaagctcctggctattagaagtaaggctgctatgaacatagtgtagcatgtgtccttattacaagttggaacatcttctgtgtatatgcccaggagaggtgttgctggatcttccagtagtactatgtccagttttctgagaaaccaccaaattgatttccagagtggttgtaccagcttgcgatcccaccagcaatggaggagtgttcctctttctccatatacttgccagcatctgctgtcacctgagttttttattttagccattctgactggtgtgaggtggaatctcagggttgttttgatttgcatttccctgatgactaaggatgtagaacatttctttagatgctttttggccatttgctattcctcggtagagaattcttcgtttagctgttccccattttttaatagatttatttggttctctggagtctaacttcctgagttctttgtatatattggatattaactctctattggatgtaagattggtaaatatcttttccccaatctgttggttgccttttgtcctattgacagtgtgctttgccttatggaagctttgcaattttatgaagtcccatttgtaaattcttgatctgagagcataagccattggtgttctgttcaggaaaatttcccctgtgcccaagtgttcaagactcttaccctctttttcttctattagtttcagtgtatctggttttatgtggaggtccttgatccacttggacttgagctttgtacaaggagataagaatggatcaatgtgcattcttctatgtgctgacctccagttgaaccagcaccatttgttgaaaatgctgtcttctttccactgggtggttttagtgaaaattaagtgaccataggtgtgtaggtttatttctgggtcttcatttttattccattgatctacctgcctgtcactgtaccaataccatgcagttttttatcatgattgttctgttgtacagtttgaggtcagggatggtgatttccccagaagttcttttattattgagaagagtattcgctgtcctaggttttttgttattccaaatgaatttgcaaattgttctttctaactttatgaagaattgagttggaattttgatgggaattgcattgaacctgtagattgctttttggcaagatggccatttttactatattaatcctgccaatccatgagcatgggagatctttccatcttctgaggtctccttcaatttctttcttcagggaattgaagttcttgttgtacagatctttcacttgtttggttagagccacatcaagatattttgcattgtttgtgactattgtgaatggtgtcatttccttaatttctttctcagcccatttatatagggaggctactgatttgtttgagttaatttaatatccagccactttgctgaagttgtttattaggtctaggagttctctggtggaatttttggggtgacttaaataaactatcatatcatctgcaaatattattttgacttcttcctttccaatgtgtatccctttgacctccttttgttgtctaattcctcgagctagaacttcgagtactatattgtatagatagggggagagtaggcagccttgtctagtctctgagtttagtgagattgcttcaagtttctctcgatttagtttgatgttgcctacttgtcttagtcagggtttctattcctgtacaaacatcatgaccaagaaacaagttggggaggaaagggtttattcagcttacacttccatactgctgttcatcaccaagaaagtcaggactggaactcaagcaggtcaggaagcaggagctgatgcagaggccatggagggatgttctttactggcttgcttgctctggcttgctcagcctgctctcttatagaacccaagactaccagcccagagatggcaccacccacaaggggcctttcccccttgatcactaattgagaaaatgccttacagctggatctcatggaggcatttcctcaactgaagctcctttctctgtgctgactccagctgtgtcaagttgacacacaactagccagtacactactgtgtattgcttttactatgtttaggtatgggtcttgaattcctgatctttccaagacttttatgatgaatgggtgttggattttgccaaatgctttttcagcatctaatgagatgatcatagagttttttttccttttgagtttgtttacatagtggattatgtcgatggattttggtatattgaaccatccctgcatccctgggatgaagcctacttgatcatgatggatgatcgttttcatgtgtccttggattcagtttgtgagaattttattgagtatttttgcatctgatattcataagggaaattggttcaaagttctctctctctctttctttctttctcttttttcttttttaactgtgatttgatttattatgtcaaaatagctcctggaacaaatatggttatttcgataattggtttcatattgatttctctttatttttttcctcatttattttctttcatttcaccactcttttgtttttttattagatattttcttcatttacttttcaaatgctatccccttttctagtttcctctctgaaagtcccctataccaccaccaccacccccccgccctgctccctaacccacccactcgctcttcctggccctggcattcccctgtattggggcatataatcttagcaagaccagggcctctctgcccatgggtggccaactatcctctgctacatatgcagctagagacacaagctcttggagggggggggtactggttagttcatattgttgttccacctatagggttgcagacccctttagctccttgggtactttctctagctccttcattgggggcccaaagttctctttctttgttgggtctttgtgtggtttaggtatcagagtaattgtggcttcatagaacgaattgggtagattcttctgtttctattttgtggaatggtttgtggagtattggtactaggtcttcattgaaggtgtgatctgatagaactctgcactaaacttatctggtcctgggctttttttggatgggagacttttaacaactgcttctatttctttgggtgttataggactgttctgattcaactttggtatttgtaatctgtttagaaaattgtccatttcatccagttttttcatttttgttgagtataggcttttttagtaggatctgataattttttaaaatttcctctgtttctgttatgtctcccttttcatttctgattttgataatttggatactgtctctgccctctggttagtctggctaagggtttaatctagttgattttctcaaagaaccagctcctagttttgtagattctttgtatagttctttttgtttctacttggttgatttcaatactgagcttgattatttccttctgcctactcttcttgggactatttgcttccttttgttctagagctttcaggtgtattgtagtgtgtgatctttccagttcctttttggaggtactgagagctatgagttttcctcttagcactgctttcattgtgtcccataagtttgggtatgttgtggcttcattttcattccattctaaaaagtctttgatttctttttttatttctgccttgaccaagttatcattgaatagggcattgttcagtgtccatgtgtatgtgggctttcttttgtttttgttgttattgaagaccagctttagtctatgattttctgataggatgcatggaattatttcagtctttttgtatctgttgaggcctattttgtaaacaattatatggtcaatttaggagaagatagcatgaggtgctgagaagaaggcatattctttcattttaggatgaaatgttctatagatagctgttaaatctatttggtccataacttctgttagtttcactgcatctctgtttagtttctgtttcaatgatctgtccattgttgagagtgggtattgaagtcttccactattgtgtgaggttcaatgtatgctttgagctttagtaaagtttcttttatgaatgtaggtgctcttcatttgaacatagatgttcacaattgagagttcctctaggtagatttttcctttgatgagtatgaagtttccttccttatcttttttgataacttttggttgaaagtcgattttattcgatattagaatgactagtccagcttgtttcttgggacaatttgcttggaaaattgttttttagccctttattctgaggcagtgtctgtctttgacactgaggtgtctttcctatatgcagcaaaatgctgggtcctgttaataaatctaatttttaaaatggggcaaaggccagatacatgataaaggttcttgcatgataacttgagtttagtattctgagcatacatggtggtggaggagaatggactcctgccagttgtcatccgacttccacaatgaactgtgccacatacacactcacacacttatatacaagcatgtgttggcattcctgtatgtacatacacaaaatgaaaaaaaagtactgttatttaaatagacaaatgaagggctggggacataggttgttagtgatagagtacttatgaacaaggtccagggtcttatccataactccatggtgaaaaataaactatatcttcttgggataatggtgcatacctttaatcccaggattccggaccctgagagaagaagattgcagcatctgaatcaacctgaagtatataatgagttcaagacaaaacaaaagataatcagtgggtataaatagatacttattgaaagaagaaataaaataacccacatatacttggaaaaatgctcaatttctatagttacacaggaaatgttattaataattacagttaagggctagagagatagatggcttagttgttataagcattggatgttcttccagagacctggcttcaaattctgatacccacatggcaactcatagctgtctgtaactccaagatctggcaccttcacacagacatacacgcaagcagtacagcaatgtacataaaataaaaacaactgaaaaaattacaatgagttacctatcatcttaccccagtggaaatggctattaaaaatactgtcatgtatatatgtgtgtgtgtgtgtattatgtatattatatatatatatatatatatatatatatatatatatatatatacacgtgtgtgtaaattaataaaattatagagcagtatggagcatcctccaaaaatagacctatgatataatccagttttcctacttctgggtatatgtccaaaagaaatgaagtcagcatgcaagcatgcaagtatgcaaacaagatatctgtatgccaatgttcatagttatactatctacagtggctgatagaaccagcctaggtacacacagacaggttgattgattaagaaaatacattatatgtgtacagtatattgtttagttatatagaagaatcagatcctgttatttgtagcaaacttgttggaatcgaaggatattttgtttaatgaaatatgtcagctagagaaagtcaaatattgtatgtcctttcttgtatgtcctttctttaaaaacaaaaatgtcaagctaaaaacataatagtattagtggagttagggaaggataagctacaggtttggggtagttagaagcagggagagaagaggctaaatttgattagtttttggtattaacatgtattataataccacactcagcctcaatgataagaacttaatgtatgttaatcaattataaaatactaaaaatatcttattcatatgtaatttacatatcataaaattctttgcctgtatattttcagtggttttcactgccacaactcttatatgtagaacattcttatcaaccctgaaagaaatttttagctttctgaagacctatgatccttgacccacaaacctgtgaccaacctatcatctttgattctaatttgtctctatggatttacacattttgaacattaatggagtcatacaataggagacccttaaaactgttttctttcacttaaaatgtttcaaaaatgcatctatacatggtatctctggtcagtttttaaaataaattattttatgtatttacatatcagtcatttccccctctcttggtccctctcccgtagttcctcctcccattcctcctcccccttgcctctgagagggtgctcctacctcctccagacctccccctttcctcaggcctcaagtctctcaaagattaagtgtatcttctcccactgaggccagaccaggcagacctctgcttatatttgtgccaggggtcttggaccagttcatgtatgctcctggttgatggctcagtgtctgggagctccctgagggctgagttagttgagactgctggtcttcctatgaggtcactctccccttcagcttcttctatacttcctctattcaacaataggggttccttgacaacagtccaatggttggatgtaagttcctgcttctgtctcagtcagctgctggtagggactcttggaggacagccatgctgggctcctgtctgtaagtacatcatagcatctgtaatagtgtcaggccttggatctccccacccccaacccacacgcacaccatgagatggatcccaagttgggtcactggacctcctttccttcagtttcttctccatttttgtccctgcagttttttatagacaggaacaattctgggtcagaaatattgactgtgggttagtaacctagtcccaccatttgaggccttgtctatttcctggatgtagactttggctattatatagatatattatattgtatactaatatatggatgtatatccattcactaactgaggattggtattggaccaccttattagctgccatatgtaatgctgctgttaatattagctagcaatcagtctccattcatgttttttgtactttatacattcatctattcagcaatgtttctttgtaactctcaaactaatacttgtggcatttttgtggtcacccacagacctacaaagcagtgaaaatttgaattgcttaacacttgggttcctagttaaggttaaacagtgtagctcttctcttattttagctctcattctgtaaatgagtgctctttttaaggtctatttaattccacacttcacttttttgtgctttttgctattgatttagctgcttcaaagtagccaccaagtgtactgccaaagtgttgcctagcattccttcaatgtaagaatgctattacaaatgctttacaacggaagtgctcaatttggatatgaatcacagagctcttggcagtgagttcagttaacaaattaatatatgttaacaaatgtatctttacacaaacatatagaggatatatactgatcagttgaccagaaatacatgaccagaaatgtacaggaacctgatgctctatttcttctgtagagcaatggttcagtgtttatcccatgtatgagctaactagaaaataataactatgaaaaattagttgcatattatttttcatagatacatatgtttgagttttcttgagtgtatgtttaagagtaccattgcagagtgggcatatagcttagttgttttgcctagtgtctgtgaggctgtaggttccattcccagtagagacaaaatagaaaaaaaaacggggggggggcagcattgttaggctataacatagcatcttgtctttgtgagcaaggtttctcaccctttatacatataaagatgagaatacaattcaaatttgagttgaacatcgttatattcagccaggcatgagaaaatggcttcattgttgggcaggtattagaattgccctggcttagacacccatagcacataagaatcattatcttttatatgtcaatatgcatagctttcaggatcctctaaagagatatctctaatttaaaggaacatttacagttttcctaatgtggactccatactttgttcattgtatcagatttttatcacctgcctcagttctattttgtccaattcccttgtggtcaatttatgacattgcatctagagtgcttaagtcttatgtaggaagatgttaagcctagaaatgagttaagacagtgtttttaagttgacaaatttacatgaactcaacccttctagtagcatgaaaattgagtatgtaattgaaatattttaatgacaagtataaaaacgagcagtgtctataaagagaataatttgtgcttctgttgtagtaaagattgtatctggacccaagtgaataagcacattttaatgacacatgcccacttcagactgttctcccctactttatatcacagtgttgagataatcttggctttacataccccatacttcaaaaccatctagaatactgcccagcacaaaatagacacttgctgaatatttcataatgtattgaggattccagggatactacagcaaagcaatggtgtgggattttgactggttggtgaaggttgttacacctgtaaaagttcacatggttttattacatttttatggccaatattccaaagttgaactataaaaacaaacaattctaatgttatttatccctcttaacctgaccaactctctgggttatctagactactttcttatgcaagcttattctgcagctgtatatgaggttatataatcagttatggcagtagttggtgacttttctcatactataagaagtcaagtctagttatcttcaaagtaaaccttgcaaaggtcccaaacgcagatcaggaatgggcaaaatcttgaaaaatatttcaggattcaaaaagaaagtcactccatggccagtaaatgatacatagctcagtcatcagagaaatccagattaaaccacaaactgatagcactgtgttactaacagtgacaataacaattctacgtgtcactggagatgtaaaactaccaagagctcttttagtacaagaataaatttgtaaactggaaatctctaccaaagcatgcatacctaatatccttatgagtagcattttcattccttaggtgtacactaaatagaaataatttaacatgtatgcaccaaaaaataaaaatgtgcaagtgtggttttaatagaattctttatgatagtctaaattagaaacatcccaagttccaaaaagaacacagaaaattatagtgtccttatatagtgaaatagtaaaaagaaaatagatgtatatttgttacatacaaaatatagatgactctcacagcatagtacgtaaaagaaaccaggcatatgggctggggagatggctcagcagaaaaaagagccaagctgcacaagcctgatgacctgagctcaatcgcctgaacccatataagaaagcaaatgtagcactctttttttttggtattttcctcgtttacattttcaatgctaccccaaaagtcccccatacccaccccccaattctctacccacccactccccctttttggccttggggttcccctgtactggggcatataaagattgcaagtccaatgggcctctctttgcagtgatggccgactagggtaatcccagtgctcctactgtatgtaggacaggaggctgaggcagaacacttgcctggaagctcacataccagctggctcagggtattcagcccagcagcagaaacaggagagatcctgcatcaataagctggaaggcaagaaacagttcctccaagttctcctccaactctcacatgtgtgcaagttgatactagtaatggctcaggtgtgtacacacatgcctcaacactcgcacataatacacatacaataaagcactattctctatctggccacatttatttaaaatacaaaagtactgtgagtaatgttatgtttgaactcaaactgagaggagatactggctggtagtagacagcagggctactaaggtactggttgtacacttttttgtttttttattagagagttcactgaccattcagcaggccgcactcttgtaagttatttacagtgaaggggtgagcacagttccaagggcaagagactggaacagttttaatatgttattttgtccattgatgtggtaaagatggactctttagatatttacattttaaataaagaaattttatttgttcttaaaaggctttcttctagttttgtgcttattagataaccattctgagggatactagtaatggctcaggtgtgtacagataggtacacagcatagagaaatgtgtgataatccagatagaagattgtcatctcagtagtaaatataaagaaaaaattactcaggacactaggaaatctgatttgttatcttcattggatacttagaaaatgatgacaagtcacttgatttaattattataaaaatttttatctaaaatgataacatagtatcatttctgaaatgtttagaaaataattttcctagtctatttaaactggccttgtattttctgtgctattagcctttatcttgacttgcttaaatttattccccaacaatgtgtggtaaattgtttctgttccatgttatacttcagaaatgactgccagcatatttaacattactatttgagaaatgattgccaaattactcattattgaatataaagctagtaagcagtgttggcttttgaagaagctctgccagtttgtctctatagtaatgtgttcatatttttaacactttggatatgtaaataaaggtgttacaaagtatctgcaatcttcaccataattgtctgcttactcaatcctggtgtttaagctttagaaactgtttattgtttctaaaaatagttttaaagatttcatccatgagtacttgtgtttacatcatttctaccctaccttctccacctccaaccccgatgtcttcccacttctttttaagttcatgaccttcgtgtgtgggacatacacatacatgagagagagagagagagagagagagagagagagagagagagagagagagagagagacctgcacagtccatttcattttaatgtgatcatcttgcccactgattcactgatatttgaaaattcttttcttattcatggagattaagtaaatgacatttctgtcctgttgagttcttattaaattcaaggaaaagtttaaggttgttaagttctaaggggattatagctaaaaggctttagttttccttcttggtccaggaaaaacctgagaagagctgaagtcagacattccaaatttgtctgtacagcatgacctcagcttttatgaggatgatgatactgtcttcacagagctggcactaagattaagaataaacccaagccaatgcttggcacaaatgagacatttccaacaggagtctgtctgaaaaaaagagcccaaagagcatccggtggttttggaagcaggaagctttctattgggtccactttctccttacatagaccatggtggagaacctggaaggttgaacttggtgccttcagcatcctgctctgggacacactgagaaggaagatccctcctccgaggatcagagtactcagagtactacatccacatagcgctgtctcaatcttcagaacctttatggttttccttttatcttattgagttggggatggtggggctagaggcagacatgctttccctaaggacccattcaatggatccttaaatgagcctcctatgccctcaatatgtgtttccaagtagggtgaggggcacctaggttgatgggaaatgaaaataatcattacaagaacttagcaggatttctgataatcattcaagttataatcatttaacaaattaatatgtatgcacacatgattaaagtattgatggcagaaaaaaagaataaggatgtttgaagttcttcatcttactgcatatcatatagtatagataatgtataatttcctgccctttgtttcaactgtgtatcatcaattaattttggagttaccttaatcttagcaacatcaatctcatctctataatttctgtttgcttattttaagtactgttttctttcttcccaagtaaacaatgagtttttatgaacaatgagaagataaaaaaattgttctaatactgttaacaaaatgtctaaaaatattttaaataaaaaaattcaaagatgctcatggatattaatgtttccttccaaatgctctgtcagcagaaccggtaataacattaattttctgttttccaagtgtgacatattaaagacagctgacttaggagaaggggcttgaatccactacaagtatatgagtacttgtgactcttcccacatttatagttgaattctaatccccaaggattaggaggtgggcctccacaaataggattagtgttctttttaaggaggctccaaactcagtgtcttcacttgtcaaatgaagatgatacaagaatgtggttatgcagaataactgggatgtaacatatatttatataaggtaatgacattaataagaagacaaactacacactaaataccaagctctttgctaagagaatgctttatcgttatctccttagttctcccagcaactgggcttcttgtgtccagttgacaaagaggaaagtggagctttcaaatggaaataacttacctagctataagtccagaatgggaacacagtttaatgtgagatgccactcaaaaactcgctagtcttaattaaatcatcatgctatagaatacaaaattaggatatagatggcaaaaataaaaaacaaatattcaaataattataatatgtaattttctgtaaggcaatacaaatttaaaatttattgaatcatctaatgtttttcaattacataaaatcggtacttatgagcatgagatgagtaaaagatttctaccaaatgaaaactaagtgggtttatattaaaatatttctgacatggggccagtgagatagctccacaggtaaaggcacttgtcaccaagcataatgattaaaataataataattaccgttatttaataacattagtactattatttagaaaaatgatataatctattttaatgtaaagacatattttgagtgaaaatgcaactattagacaatccatacacataaatgtgacatttcaaaactaaaagtccaagtggtgtggtaaataataagaaaaatgatccacaagcagtttcttttccagtcttcatttgtctaaaaagtcggaaatttttggtattgaagaaaatatacagatcccatctttgcatgggaaagataaaaatctctggctgtctttatcctgccataccaagtacatctaaaaaaatttttatatatattattatgtgcattggtgttttgttttgttttgcctttgtgaatgtgtgtgagggtgtcagatcctctgaaactgtagctatatatagttgtgagctgccatttgggtactgggaattgaacctaggtcctccggtagagccgctagtgctcttaactgctgagccatctctccagcccataccaaatacatttttaaactcaagactgttagtttaatgtttgagtgaggtcttggttcttactccatcccaaagcagtaagtagcagatgttctcaattgaagaagataaatatgacaacagtgaagaatttgtctccgaatcagagactaaaataaggatatattgtgctctgcaattagacactaaaatccagtctagcactgttcattaaaatggaatttttaatagttttgtaatcaaaagataatttattttaggcagattgttttcatatgccttttagcatggtttttaagaatattataaggaaacagatgatgattgccttttgaactgtaaaacacttctcagttttggtaaatggtttaggttcaccaaaaaacctgtaaggacacatcttcagtggtagactagcattgaagacaacatgacattcttctgtaagaaactagttagatctgagtacaaagctagtttggtgtgatcaaaatagacacaatagatttcaacatacatctgttatatgttagatcacaacatacatctgctgtatgtggttagctgagaaaaatcaggaaagaaagtgtacttgcagttgttgctttcataatatatttttaaatgtttgatcttgaaacaaggaaaaattctaaggccattctctttctgtttgtaaccactttaatatctatagtttcaggaattcaaagaatttgctgaatactttttatcattttaattagttacccccaaggtgcatagtcccttctagagatagaggctaaacagcaagtatttgaacaggcaaagtttaatattatgaattattgccctctgtagtatgggctagtaagaattctagaactctgacaaataaatataggacttgcaagcataaggactagccactattctcagggctgaagtggaagcctcaggcagacgtttggccaatctcccagtaccactgaaattcaagccttgttggagacagcatgtggtagctaactggaccacaggtttgctgagatatcctgctggtagaaaacaatgggaatctgccttccagagtttaacagccaccatccttagggattaggtcacctctgaatgtgcagaaaacggactaaagatgtgcctgaggaagctggtcgcagacagagtactctactggctgtactctgctgcaaagccacctcaagagggttctcagaagttgcttatggacaggtgccacatgctgagcactgaaaataaattatacacataggggatccttaagagaaaagcactggaaccagagagcaaaatgcctctgctttagtgttcctccaatgccctctgttggcaaaccttaatgttgggtcagctgtaaaagcattgagttcagcttcagtagtgcagagcagtaaataacctgcagaagtgcagagcctggattcatgagtagtgtaggggcaggaagcttttctggatatagtggtggttttgttgtattgtgtttttttgatacaaaatctcattctgaagctcaggttggccttaaactcacttccaccttgccctccagagtgtgggggttacaggtatatgcaaccatgcttagctgaatatagtgagggtttttattattagcttctaagatagcatacaaattactgggtttcattatgatgctttcttgtataatttgttattcactccctctttgctgccctaccctatccccttgcctccctctcgatagtctcctctcccaggagacttttcttcttaacatttggtcccattaccttacttttttctggttttgcctccccccttaagattttttcccctgtgagccctttctagtttcatgacctgcacccacacagatgggatagcttaatgccatattgtatcttagctaccccatctgtaatacttggcagtgttttcattttattttgctttcttttccttatttcccttaaatgattaataactaaatagcatagcatatccacattagaattgttagtattgatgattatcaatctgggaaaattcagtttttgaagtaaaattttaccaaaaacattatgcatataaataaaataaacccatgatttgattcagaatattgtgttagtccatattgtgcatttagacttgttatagtagggtttcataaatattgcctagagagtttctgtaaaataatataaatgaccaggtgagtttggatgaaaattctattggcctatatattaaagtaaaagccataatttctttctgaaaaaaaaaaaggactttaaagaagagtatgaagaattaggtatgatccaatggattcctttaatagtgtgtcacataaatgccaaccaacatattgcagagtagtaaactaataatgtgtcctggagagcagtttattctttctgtaataacaggaggcttattcctttgctgtctttctccattccctcttatcaacacctaagttggaacgttaagtttacccattgctggaccattgcagaactctttctataggctgttctccagtcacaacccacctctaatttttttctaccaattacctacaattttttctttcttaattactactttcttcatttccccaagtcttcagaacatgtcattaatagtggatttctctgtattactctattgctttgagattgaattaaaacactgatattaaattatctgatgtttgcatttccaggacattcatgttttatgtcatttccccacaggaatgctttgctagattgacttaatagatctttatttttttcttcttatgttagataaattcaacctaccataaaggaagccataaggcagcaaaggtagattcatctagaatcaaaattttacacaattattgttacagtgtgtgaagggtaagtgatgttcactaacccctaaaagatgttcatatccaaatcctacaattcaagattatgccatattaccttatatggcaaaatgaagttgtaaatgtggttaaagatcttgagatgggagattatcctggattatttgtgtgggctcaaactaatgacaatggtttgataaaaaggcaggttgagtaagatttaacttacaggagaagatagtgtgacaaattagagattgggatgctccagctggtatctcaagaatgttggcagcctgtacaagtctaaagagacaagaaacaagattctctcctccttagaccctcccaaggaaccaaccttgccaacaccttgatcttagtttactaggactcattggagatgcttacctctaaaactattacataattatgttatgttgtttaaagccatagagtttgaagtgacttactgccaatgcaacaggaaactattgcattttaataggcacttgctcaactgtagcatagaagggaaagtgagaacttctcttaaaagagtcagtgaattaataaatggacttgttgggggtaggtcactgaaggtgggagaaaggatgtatagaggtgcagagtggtgaattagttgacttagtgtgcaagtagttggtgctattggagagatggtagctagcttatgaatgctgtgtctgtgatgctaagaagtttgagtttattttttatcactgaggaaacattggtagacttaaagcagggaagtcgcacaattgggtctatatttaagaccaattagacagtgttacaaagagagttatttaaagagagagccagcaagcaaggaaggtgcagtggccctcatgagaaataggagactttggatggaggaaaggagttgcacacgacgtctcaagcagtgcgatgtggtacctttcaagagacaatcctgagaaatgctcatttgtttgcttcataggattagttgcatagtgataacatctttttacagtacacatgatcaaaggatgagctgggaaaaataaatgagttttgttaaacattttactcctggtgaacttctaaaataaaaatgtgtttattttgatctaaaagttaggaccaagttctgcgcaaaagatgaaataaagaaacaatggagtggggataccagggtcctgaggaaaacctccatttataaagggcggagcagagacagacttacccaaagacacttggagagttatcttctgagaatgccgtcattaatgctgagagagaaaaatcatttctctgctgtcagaaatggcttagagaccagttgatagaataactgtgatgtcagtggactttggcagtgtggaaatcagtgggaacctcagcaagatcatgttcagtcctggggtaaagctagcatattgcggtagtctgaggaaggaatacgcagacaggaaatgaatacagtgtcgcgtccgctctcgaccagcaagaacgacacgaccaccagtccttctaacagaagtttattcagcaaacttcagtcttcgtctctctctcttcatctttttcctcatctctcccgaacccgggcctctcactcttatatactctcagtccccatccactcacagcaggccacgtcacctcaccaggcacgcagcttcagccaatcagggcggcagggacgtgtctccaccaaatatggacttgtttaaaccgccagcatcatggtgcaccttgtgcagctctcatgatggtcaatggtcgtggcttattttcaggtgtatgaggaagtcaggtgcaagtcataagacttagctgcagtccctggcaccttcttgggactgctgccacacccgctcctcacaatacaggatactttttttttggttttgtttttgttttttggatttttcgagacagggtttctctgtgtatccctggctgtcctggaactcacgctgtagaccaggttggcctcaaactcagaaatccccttgcctctgcctcccaagtgctgggattaaaggcatgtgccaccatgcccagtcaggatactttttgagagaaaaaaaaattgctctggaaatattccagagattttctagagtgggaagacaagagacatgtgtaacaagagtgttccatcctggcttaagatatgggtagcaatgccatatgacatcctataacagaatatgggggctgtaaaaatttggcaacaggaaacagtttctgaacatgcaataaacaaaacttgattcaaaagcaagtgcatgctgaatttgaaattcctagcagcatgcacctgtgttacatcatgtggcgtcactgctgccttgcttctgagcccacagtgcacgcacactttccacctcatattctgtcacatgatctaacaccaacaaacactgccagaaacacctgagctctcattcctgactattgtatgctacagcctagtgttttgttgtacacaaaaagggtttggcttttatagaaatagaataatggtttaattattttaaaaaggccatattaccctaccattgttccttagcatataaatatcaaatatcattaaattgtgtttatatgtttgactcttttttttacattattgtttgagtttctgactttggttttattttctagaaatcattaaatgaatttggatttcaattagaacagaatttccagcaatttctgaaatagtcctacatatacttctgccattttgtagtacatatttatgcaaagaggcattctctgcatcgacaattataaagtcaaaatattgattaactctgaaaagcaaagattctctatgtcctgcagtatcaaatatccagccagaatttaattctttgcaaataaacaagcacatctctctcattaccatgcaaatttgctttaatctttaatcaatagtaaaattatatgagtgcagaagagttattttatagcttctttatgatttgtttatcagtaaatacttgatttttatatacctctacacccaagtttgaatacaaatttcctgggcaaaaggggattgcaaatagaaaatatttagaagctcgatctaagaagaggaacagtgtgtgggggaggggtagagattaaggccgggtgtggttcagcatcagtactgcttggaggtggaagctactaggaaagagtaagaaagcatgactggtgggagtgggttttgatagcaaacagggggtgtcccttgacatatatcagaagctgtcctggttagctttaactgttaattggacacagcctagcacagtggctctcaaccttcctaatgcagaaactttaacacagttccttatgttctggtaccctagccataaaattattttgttgctactttaacactgtaaattttctacttttatgaatcataatgtacatgtctgatatgtaggatatctgatatgtgaaccctgtgcctaaaggagtcacaactcacatttcactctgacttagagtaacctgagaaggacatttcagtttagagattgcacgatcagattgttccatcagcatgtctttggagtattatctggatttctagttgatgtaaagggccccacccatcagtgagcagtgctgtttccttagtaggtagtccttggctgtataagaaagctagctaagtatccacctgaacaagccagcaagcagcctttcctccattcaagtttctgctgagttcctgccctcacttcccatcaatagtggagtgtaaccagtaaactgaaataaaccctttcctcctccagttggtattggtcatcttgtatatcacagtaacaaaaagaaagtagaacagaagctgaaggaggaggacccacagtgatgttgttggtaaagtgggaagcatggtggtgataggagagataggaacggtcttaacaacacttaggaaaatgcaatggaggtaagaggggagattgctaggcctcctcaaggggacagttaatacagacttcttgtcctttggtcattaagaaaccatcagatggtttcccatagtggttgtactgttttactttactaccaatgataataccaataacatgtgagaattacagctactctatatcactgccagggcttgagattgtctttttttttttcttcaatcttagccattctagtggtgtgtcatggaagtccatgtggctttttaatttgtatttacctgatgactacatatgtttctgcttaaggactattgtgttctgttgttgtagtactagtaatagtagtgcacactacagtactactagtgtgtgtgtaaaggggggagttatatctccattgtattaagttacagtaacatattctccatacttacttgttgtttgtcaggtatacatattacaacttttgtctcacaccttgtgacattcaatcttatatatttctaatttgggaaaaattcaatttgatttttttcttttatggttctgtatcttaaaaaacattactaccatcaggtttatataaattttttattgtattttctactgtaattctagttttaaccattactctagattctgaaatcctttgatagtttcttttttcagtgtgagattagagttgaggttcatgaatagctacttactctggtggtgtttattgtaaaagttacctttgtctatcacagcattttggcacttttatcaaaactaatatgttgttctctttctatactttctcttctgtcctatcctaatgccaggcctatgcagtctgggttactctataactaacacttaagttgcactaacttacattctattattacttccaaacattcttggtctattctaagttctttacatttttgtaaaaagtttctgagataatgtcatttgttttgttttgtttttgaagcatgaggttttgattcagatttattttaaatctgcaaacaaatttgggaagaatggtgtactggctagttttgtgtcaacttgacacagctgcagttatcacagagaaaggagcttcagttgaggaaatgcctccatgagatacaactgtaaggcattttctcaattagtgatcaagggggaaaggccccttgtgggtggtgccatctctgggctggtagtcttgggttctataagagagcaggctgagcaagccagagcaagcaagccagtaaggaacatccatccctccatggcctctgcatcagctcctgcttcctgacctgcttgagttccagtcctgacttccttggtgatgaacagcagtatggaagtgtaagctgaataaaccctttcctccccaacttgcttcttggtcatgatgtttgtgcaggaatagaaaccctgactaagacaaatgagataaattaaagttactgttaaggcctccaatacatgagcattttttatttatgtaggccaactttgtgtgagtaaatattttgaagagtagagagcacatgcatatttgatttaatttatttttaggactttctgtgatttctccagtttagacatatttttgtctttctaaagtaaattttcttgcatttcacttttacccatatctttccaacatttgttggttttcattattgtttccttaatgacagccattttgtctggaatgagaagtaatctcagtgtagcttttacattttcccaattactaaagatgctgaaatcattttcatttatttgttggctacttgtgtttcttccttaaaaatattttttgttgttgttgttcagttattgatacatttgtttgttattttgatgtttaattttttgagttcatttatattctggatactaattccttgttaaataaacagctggcaatagctgcctctaattctgtaaattgtctttttactcttttgattgtatacattcatgcaattccatttctcagttcttcctattatttgatgaaccaccagagatctatttggaaagtcattggctatgcctgaatcattttatctcaaagtgttaataattctcttcttagttatagttctagctttttgcttttatttctttgtaatgttttaaggaaaatgtattatttcataactaaatagatatgatatactaaaaattatttttatttttgagattaatataattacatctttctccttcccctttcctcccctgaatgcacatatatatatatgtctttgagttctttccaatgcatagccctttaaaactaattggtgttacatgcatttgtgtgtgttcctaaatatagcctgcttactctatacaaagttacttgtatgtatgttttcagggctgattatttggtgttggctgatgaattgctgtgctcctctctaatgaagagtagttctccctgtcttactcagggtttctattcctgcacaaacatcatgaccaagaagcagttggggaggaaagggtttattcggcttacactaacatgctgctgttcatcaccaaggaagtcaggactggaactcaagcaggtcaagaagcaggagctgatgcagaggccatggagggatggatgttccttactggcttgcttgctctggcttgctcagcctgctctcttatagaacccaagactaccagcccagagatggtctcacacacaaggggcctttcccccttgatcactaattgagaaaatgccttacagttgtatctcatggaggcatttcctcaactgaagctcctttttctgtcataacttcagctgtgtcaagttgacacaaaactagctggtacaattgaacccttgtcaacttgacacacaagtgcatcactagtaagcctcaacccttagttcttattcatccccaagatcttaaataactttaaaagtcccacagtctttacatattaaaagttcagtcctttaaaaatatccaatatcttttaaaatcaaaagtctttttacaattaaaagtctcttaactgtgggatccactaaaatattttcttccttcaagagggaaaatatcagggcacagtcacaatcaaaagcaataattaaactccaactgtccaatgtatgggatccaaatcatgatcttctgggctcctccaagggcttgggtcacttctccagccatgccctttgtagcacacatcttgtcttctaggctccagctgcctgtactccactgctgctgctgttcttggtggtcatctcatggtactggcatctccaaaacaatgcatgaccccttcagtcctgggccatcaacttcaactgaggctgcaccttcaccaatggccttccatggcctctcacagtgccaagcctcagctgctctgcgtgaccccttcatgccttcaaaaccagtaccacctgggtgactcttacacattaccaagtcctactgcatcacaaggtacaaccttggctatctctggcacacagcctctgtgctctcagaaaacacttcccagaagatgtcaccttgatgatgctggtctcttcttaataaccgctaatttcttagctccagctaaccaccatcaatagtcccaggaatgcaaagtttttgctttagtatcttgttaatcacagctgattcttcagccccagctaaccagaactacagaatcttcacaatccaaaatagtaatggccctgaaaagagtctttaattttccctctgaaattttacaagccaggcctccatcttctgcactgttctcaacattatcttccaagctcctatacaacatctcacagagctctgaacaccgaatgaaacttctggcccaaagttccaaagtccttccacagtcctccccaaaacatggtcaagttgtaacaggaataccccattcctggtaccaatgtgtcttagtcagggtttctattcctgctcgaacatcatgaccaagaaacaagttggggaggaaagggtttattcggcttacacttccatactgctgttcatcaccaaggaagtcaggactggaactcaagcaggtcaggaagcaggagctgatgcagaggccatggaggggtggatgttccttactggcttgcttgctctggcttgctctggcttgctcagcctgctctcttattacccaagattaccagcccagagattgtcccacacacaaggggcctttcccccttgatcactaattgagaaaatgccttaaagttgggtctcatggaggcatttcctcaactgaagctcctttctctgtgataatgccagcctgtgtcaagttgacacaaaactagccagtacactcccactcccagcacttcttacttgcctgtagttttttgtgcatagggttgagtgacgccttgtgctctttcccccatctactttggcatgtctatcggtgtcatccttgttcaactcatatttagtcatccatgtcagtgaggctttatgggtatagcttctgatgttactagaagatacaacctcacagcaagcatcttgttcctatgtctcttacaatctgtgtctcttccgccatgctccctaagccttaggtgcaggaacattgtgtagctgtacccttaactctgcattttaattgactgtggttttctacaatggtctctgttacaaaaagaagtttccttggtgagggagtgtacttatttgtgggcataaggacaaatatttagagtgtagtagggattgtgctggtttagtaaagtagtaagcataggttctcctctaagagtcttgattttactagctctgggtagttggctaggtttccatttcctcctatgatttctcttttgttgaatggccttaagttcaattagaaagctgttgcttattgtcaagctatgtgggccactatggaaccattaggtctattgtgccatgctgatcactgttgtggtttatcctagactagtttcaaatttggtgtcttagagtaagagactcctttattttattcttttttttttttttttatgtttttgagacaggttctaactgtataagtctggctgacctggaactcattttgcagaccaaactagcctgaacttgcaaggatccacctgcttctcccttctaagtactaggattaaaggcatatgccactctgcctacccttacattaagatctttgatctattttgagttgattttagattgaacaagttttagattccgttttctagtgtgaatatactgttttctcaacatgacttgttaaagaatcttttcctccaaaatatagttttgctacctttgccaaaaatcagagctgaaacttcttgggcttgcttcctgattttttactctattctattggtgtacatgtcgtgcacgtgcgtgcgtgtgtgtgtgtgtgtgtgtgtgtgtgtgtgtgtgtgtgtgtgtgtttgtgtgattttaatattgccatactggtggtgggttgtttttttttttttttgcctgtttctgagaaaggttgtttaagatactgtaatacctccagcattgctccttttgcttaatactgctttggttatttagggtttttatgtttccacataattttttgggacaggttctctctgtgtatccctggctgtcctggtactccctgagtagaccaggctggcctcagactcacagagattatactgtgccttcccccctagtgctgagattaaagacgttaccaccacacctggcatccatgtggatttgaagatgccagttttactttttagtctctgtatgccttttatgaggatttcattgaatattggcagtattaatccagtccataaatatatcttcgatttcttcggtgttttggagtttttattgtagatttttaaatacctttggttaaaataataaataggcagttttaaagctattgtggtgtttccctgagttctttttcagaacaacatctcttattgttgtatagagaagctactgacttttgtatcttgctactttttaaaaattcttcttcgcatatcctgactgcagtttcccctctctctatccctcctattcccttccccagctcccttccccctgatccaccatttcttcatttcctttcagaaaagaacagacctccaagggatatcaactgaacatggcatataaagttacaataaggctaggcatatacccgcatatcaatcaagactagatggggcaaccaagtaggaaaagggtcccaagagcaggcaaaagatttagagacaccctccagttccactgttaggtgtcccattagattactaagcaatacagcaacaatgttagaggacctagctcagacctatacaaggtccatgattgccatttcagtctctttgagccccctatggaaccctgcttagttgattctgtgggccctgttctcttggtatcctcaacccctctagctcctgcagtctttcctctcccttttctacagggttctcctggttccacctagtgtttgactgtgggtctctgcatctgctcccatcagtagctggatggtgcccctctatgacaaatgagttaggcaccaatctattggtatagcagaatatcattaggaatcatttcattgtttttttttttttttttggagtgtgtttagctctatctatcctgggtctctggactgtccagcctctggtttctggaaaccaaggcagtgctatttgtgtgttccctcttttggtgtgggcttcaacttggaccagtccttgcttggccactctcttaaattctgcctcaccattgccccagcatgtctggtaggacaggtcaaaggttttgtggctaggttaatggtccagttccactgttgggtggctagcctggttatagaagatggatggtttgggcttatctttcattactagggtcattctcagagattccagggagtttccactgcagtaagtttctcatctcacccaaatgccccccaattcctcttttctctcccagtactctctccatccctcccacccctaaccctggctcctaaacccttctgtttccaaccccaacccctccccccagcctacattcaaattcttttcaattttcccttcccagagagaaccatttattgtcatccttctcaacccctttgagctctccttattccttagcctctctgagtttgtggattattctttacttaccagctaatgtctgcttataagtactagggtactatgtttgtctttctgtgtcttgattacctcactcaggataatgactttttttctactttcattcatttgcctgcaaatttcatgctgtcgttttagcataaatatatcaacaattcctgtattcttcagttgagggacatctaggttgtttccagtttctggctactatgaaaaaagctgctatgaatatagttgaataagtgtccttgtggtaggatggcaaattctccaggagtggtatagctggatcttcaggtagatatttcccattttctgagcaatagctgtactgatttccagagtggttgtacatgttttcactcttaccagcaatgaaggagtgttccccttgctccacatcctagccaccatgagctattacttgttttgttgatcttagccattctcacaaacgcaagatggaatctcaaagtagttttgatttgcatttccctgttggctaaggatgttgaacatttctttaagtatttctcagccatttcagtttcattctcctcaaaagaactctgtttagatctgaattgattattttaaattggattatttggtttgtcgatatctagtttcttgagttctttatatattttatatatcagccctctctcagatgtggggtttatgaagatcttttcccaatctgtagactgttgttttgtcctaatgactctcctttgctttagaaaagtttttcagtttcatgagctctcctttattaattgttgatcttagtggctgagctattggtgtactgttcagtgagttgtctcctgtgccaatgcattcaagactactccccactttctcttctttatatatatattttattaggtattttcctcttttacatttgcaatgctatcccataagtcccccatatcctccccccaaatcccctacccacccactccccctttttggccctggcgttcccctgtactgaggcatataacgtttgcctgaccaatgggcctctctttccactgatggccgactaggccatcttctgatacatatgcagctagagataagagctccggggtactggttagttcataatgttgttgcacctacagggttgcagatctctttagctctttggatactttctctagctcctccattgggggccctgtgatccatccaatagctgactgtgaggatccacttatgtgtttgctaggcccggcatagtctcacaagagacagctatatctgggtcctttcagcaaaatcttgctagtgtatgcaatggtgtcagcgtttggaagctgattatgggatggatccccggatatggcaatctctagatggtccatcctttcatcacagctccaaactttgtctctgtaactccttccatgggtgttttgttcccaattctaagaaggggcaaagtgtccacactttggtcttcgttcttcttgaggttcatgcgtttagcaaattgtctcttatatctcgggtatactaagtttctgggctaatatccacttatcagtgagtacatatcatttgagttcttttgtgattgtgttacctcactcaggatgatgccctccaggtccaaccatttggctaggaatttcataaattcattccttttaatagctgagtagtactccattgtgtaaatgtaccacattttttgcatccattcctctgttgaggggcatctgggttctttccagcttctggctattataaataaggctgctatgaacatagtggagcatgtgtccttcttaccggttggaccatcttctggatatatgcccagaagaggtattccgggatcctccggtagtactatgtccatttttctgaggaaccatcagactgatttccagagttctcttctatcagattcagtgtgtctggttttatggtgagaagcttaacagtcttctagtgtagttttttgagtcttctcaatatagggttttattatctgcaaacagggataattttacttcttttgttgtttatatctttttatatcagtctcttgccttattgctttcactaagatttcagaaattattttgaataagaatggtaatatggaacatcttttcttttgttaattttagaggaaatggttttagttttctcataaattttatttttaatattaatagatgattgcattttgatgattgttggaattatttatattgtttcaaatctttcacatcatttgtaaactttagttattacatttgattctattattattttttaatcctagtgtccagtttttgtattagaatatatgcatgccattgatttttgatattttagttttgttgtctcctgcagacttgctaagttcagtctttgtggcgttttatgatagattatctctgaatttcgccatggaagactgattatgtgttaactatgtcatctcaaatatacatcttttctactctgtggggtgtttatttctgtactacactagctaaaactttactcccatattacaagactagtcttgagatcaaatgtctcatcctcatcttagaaagcatttggtctcttaccagtatatataatatcaactgcatggggtttttgtgaatggcctttgtcagatcaaataaacttctttctattcctactttgcacaagattttgttttgttttaaagaatggatgttttattttgtcaatttctctttctacattaattaaaatgattatgtattttacttttaagtttattgacagtcacctgtttttatttctgtaatgataaaccactgctgaaaaattcagatagctctatagttttcttgtaatgtctctagctggctttgataacaaggttatgctgatttatataacaaattaagatgcattcatatttttttattttgaaaataggtttgtataaagttgacatatttgatagaattagttaatgatgccatgtgagtctagaattttcattgaggggtggtttaattttaaaaaaataaaagtgcttctgaagtatttttattactccagaactaaaatagcttttcttctttgcacctgttttagtccccgtatttaatgtgaatcgtcttttgcattaagtgaggtttctctgtcatatttggttatagctccaagtgtcaccctgctctcttcacttagcttttggagatttgagctgtgtgtacccagattcctaggaaggtgaggagccactgtgttgtttgacgttctttcctgtgccttctctttcttctagtgctgtgcccagactatctcctctcccccattctcctcagaagtaatctgccttctcagcccagaaacactcttctgctctgcgttatctcctctcctgattaggaaactgggcatcacttccagaattagctcagtatctgaaaatatttgtttcatacatttttttccagttttctagctcaatgggaaaagaaagttcttttccaattaaactttcattctttagaaaaagtcctcatcatgacttttaatgtgcttttaatgtgatttcaataaatcttagttctaatgactttcagaaagggagatagtgttatcaaattctgacaaatataatcaaccttatcttatttccattgatgctgtggttggaaaattatcactacacttccaatgtggttaaaaatagaattttgttagagtgaagagggataaatatgatgttacagtaaagagagttaataatacaaaaaaaattaacacatagcatttacttagcattttagttgtgtgaagtgctttgctaaaaggtagctccttttcctcattactagtctgttatatagtctctatattatgacagttttgcaaggggaagaactgaaacttggcagaggttaagtggcttgttcagactgagaaaaccatcaagtaagtgtcctagattctaactaagtattgacaaagttcaagtcaacattgtcaatctccaaggtccccttcataatcaccatgctgacttttaagtgggcaggcagctctggcagctaagggatccccttcagaacttgaagtgtgggatccactgctttgggtggagtcagggcagcagttccaggtttcctacggaagtctttctttgggtgccttttcagtgctttttctgctttatgagagaaagtcagcaagcttttaagcacaacttacacagagattctgatgccgtcttttcttttctctatgtgtgattggaaatctaagtggacctagtgggagaccttaaaattggctttcatttttattctgtgttaagacattttttggtaatgatgaagtggcatggaagcagagagtactgaaaacatggttactgtgttcatagtttcaaagtatctagtaattttgttaagtctgaaattatatcaaagtaaaaggtgttttagatacaatgtttacttaaacattgtatctatcttcatggtttagccactgactggctgtattattaacttggttcactctaattttattcctggctctttattcctgtaccttctatttaatgtttttaaattagagaaaacagttagatggttctgaaagtaaactaactgtgaaataaggtacattcacataaatatgttttctattcttgtttccttcacatttaatcatttccaatagtgtttattctaaatctttaagattatataaaagttatggttcataattacagcataattgcagtattataagtattgtattgtaaacatacacaaacacattcctctttcttgattgagaagtgtcatgtttcatacagcactttgcatctttcgttttgaagaaaaatagatattctatgattcatttcctagcaggatatgtaggtcctccttattctatttgtagctctggattgccattcttcaaaatcttatttggtgaacatgtactgtctgctatgtgcccatctattggatagattctatcagatgtagtgtatggccttgtatgataaatacatatatcttatctgcattcaagttatggagtttcaaaaatttttaatacattgctttctccaatatacagtagctgattcatcagtatttatttttattagcctcctccttccttaaaacttagaacagcttatgtcatttttgtttctgttgtacataatattgttcagatattatttgtaaacctactaatgagtatatcgcaatgtttaaaatatttagatagctggttgtaaaatgtaagcaaatagtatgataacaaagaccagtaaattggcctgacaaacaaactacctgtcatgcgagactaagtacttaagtttgaaatgcagaatccacataaaggaaaagagatattcaactgcacaaaggtgtcctctaacacaagacacacaaacacacacacacaatttataaaagatgttcgccaatggattgattatacttttttgagatgcttttctatccctataaattcagaatgtctgccttcctttatgtatgctgtcctttcgaaagctcaacatccatttattggctgtattactcctagcattttctttttgcttcttaggtctttgagttttgagacatagactcactgtgtattttgggctggcctttgtatcttatggccttgaatccagcttcagccctccaggtgctggtgctgctactacaggattaaaggcttagactaccacacctggcactcttgcttttgttttgttttctgatatcacttctctccacattttgcagtatttattattttttattaagccccaccttataaaaatctgagcttttcctcaaagtcctatgtagtaggtccgtggggatgtagtccagaattacaaatacctataaccatttgtcaaataactgggcagatatggtggacattgtttttctatttctgtgttaggtctgacacagtctcttcacactacttcaggatcctaactctggtttttcatttttaactttgccacctcttctttatcttggtcatatcttggtttccttttctttgttctccaaacttggctgtaaaggctgtctgtggctttgtttgcctcctcctggccctcctggccaggacctgttatgataatcactcttgagctgtgcatatgattccctcttttccttccacctatacctttcttgacatgctctcttggtttcctgctctcttttctctcaagagtaactttggtcacaaaatatagtgtcccaccttcctaaggaaggacatttaataaggtctctatatgccgcctcagacgtcataaattacagcatggttaaatagctagaaacaaaagatgaacacagtttgagattgtgttcattgcatcgacaatccagcacttaacacactactcaaagcatatcctacagggaaagcttctaagaaaataaatactatatgagatgtagcttcacaaagctctttaaaaaaaaattcaggaaattgattccatgtgcatgaagtcagcgttttctctcagcaggcactgcaactaatgacattaatgagacccatgccatattaaaaagagagaaagagaataaaacagacaaaactgataatttaagaggaaattatttccagtggtctgtttgaacattgtaattaaccaagaaataaaatgagaaaaaggacctttttaattgtggtttttagcactccattaagaatggctcaaactctacgtgaattgggacaatataaaatgagtacttatgtttaagtgggagagccatccgtactcaatatagaggtgtggatttatttcagaatatcttagacttaagtgagtattggcattgtttttggtaatgcttttaaaatctctagtattttgacaagaggttttaaataaatgttatacaggaaaacaaacacaaaacttttctaacatagcttccacaataaataaaaataaataagtaaaaaaaaatttgtttttacacctttttagccccattatagtatatcagtttgctaaccttgaaaacaaagctttataatttgtaacatataaaataatattcccctaagcaggcagttttatccaagattcctggtattacattactaaatgtagtgagtgaaatacttcttaggtaggttcattcacagctgtgctctccttttctatcctttatgcctcctctggtttacttttatgttgctacgtgataaaatattctgaccaaaagcaacttggggaggaaagggtttatttcaattttctctgagaaaagaactatacccacatccctccacatagattataatatcaactcacactacctcagcaatgacacaaaaggaatttctgtcgtagttcattccccctcagcactccgttattggagacaacctctttaagcattatcactgttccttttgtacctaacaccatatactatctcttgactttataattctaaatatcaattatcaccacactgcttcatacgttgcctctcttttccttcttgcttctccttattttcctttgttgatttatttctctttaatttatacttatctttttccccttcatcccatcttcctacaacctgatccttccctgtccccacctgcccgcagtccatgccatatatttttctatgtccccatttctaattattaatacttgggttgttgctataatgtgattttatataattatttattactcctgttgtaaatgcttggcttagttcatgttgggatgtttgtgtcttttttatttatccataggctggcccttgaactgtgtgacttctctcagtacgtacattatttttcatgatagcagagggatccttggttgctgtatcttgcttttcttgattgtcattaaaggaattctcattttcttatgtgctagtgtccctattttctaggtttcctgtatttcttatttttcattttgttttgtttttacttagtagactctctagtaacttcctgagaaaagatattttttggttttttgtttgtttgtttgttttaaactttacatatgtaaacatgtatttatttaattctatgctttgaacagtaatgtagctaggtatatgattcttggtcagatgtaatctctcagggttttgaaaaaatatagaaggtatataaaagtttatgcattgcaattagcttctttatatcaaacctaccagttgtgtgacatgtgtatatcatataacatctctgcctgtttcttcatctaaaaatcaggtatagcattttaccattctgtagaattgctgagaggatttaatgagagatatatctcactaggacaatacctgctcccttgctctcctttgaaagctttagtgatattctgtttgctccagtaacccttcagatttttttcagtgatatgttgtattatgggctcttataaaaatcatgcttggaactctttttatatctagaaacccattgtctttggttccgagcagaaaattcttagataactacatatctctaatttctctgttctgcctttctggtttctgctatttaaataacatggcatatataattagccaccatcgctaaccttttgcctccctgatcctatctcttgttactttgtcctagctttactttttcaacttggccttctaacccttctgtttggatctttgctcaaatttatcatttccagaggtggtattcactgactgttttgtttaagttagtattgtacagtttcctagcatttttacctactgtgttaggtaaaatcgctctgacaacgtatctgaggggaaaactggaaagcaagaatgccaaagggtttagctcatcatggcaggcagggtgtcagtaatttacattattattgtaggaggcagacacaagtgactgcttatactacagagctttcccccattccttctttgctctacttaggagtctaacctataggaggaggatcctttctccatagttaattcctggaaatacctgaggaggaataactagaaatatgctttactaatctaaatgcttttcagaccaaccaagctaactatcaaaatcaataatcacaagtctactctcaacaaccaggcacccaaatatgtctccttaagctataatattttaccctttccccttccttccctcttccccaaacctcatatctaattcatattgcaaaatgcacgtattctatcttccagagtcctctaagtcttaacagacaaaacctgttcagaaatccaatttccaaatctgagacaatgcaaacacttagctgtgagcctctaggaaatcaagaagacattagctattcccaagctcccacaattcttgtattctgcattcttgaaaacacggaatcccatgaactatgccaaagtgtaccacagttctaataggaaccaggatcctttgggctatggctgcagtggcctcagaatgcctgaattactgagtaaaggcaagaggcagattctctgtcagctgtatgtaagcagagagatctaacctttattagattactcattattttaaaaaagaaactttccacttttgaggctccaatggtggcctaattcttgagattctttcaagagatctttcctgttgttccaagtcaaagtgtttggcttcctcttaataaccctgatctcttcagcgctccaagtttccttggcaccaactttacacatttatttcttttctgagcaaactgcaagtttttcagacatttttgttcctctttttgttcactgtttcattatgaacttggctaaaagcagtcagcagtgtccattcttcatctgaatgctggattgcccagagacttcctccaccacattagtctaccgcttttataatcagcttcagaccagatatctaggcaggttttggtcagactgtaattccatggcctctagtaatgtccctacagagtcctcatttccacgtaaaactttatgaagtctttactctctatactcctaacagcattctcagctcagctcccactacaaccactaagttctgtttatagaattctggagtttctagagcccacatctccagacttccatattccttccatggcccagttccaaagacttctaaaccacatagtcagatgggtacaataatagcactacttttctggtaccagtcttctatattaagtacttgttcaatgggcatgacacaataatcttagcaaaacagcagagggaaagaaagatttgttttggctttgtatttcaaaggttccatccattattgtggctaggaaacaatgcatgtggtcactggccaccttatttttcattgttaattccatctagtcctctataggattgtgcatgctatgttcaggaatagtctccttcttgtagttaaccccatatggaaatacccacacaggcacacgttcacaaacacacctagatgtgctttattaatcttctatgcttctcaacccaatgaagttaatcaagattgaccattacatatatcatgttgtatttgacattcccctggtttggcttttataagaaatagcctcctgctcagaattttttttctgtttctttttacattgttttcttttgagaggctttcctcttatatctggtgatctttagcttttctttctgcctgcctgtctctctctctctctctctctctctctctctctctctctctctctctctctctctccctccctccctccctccctccctccctccctccctccctccctccctcccttcctcccttccttccttcctttcgaggggagtattcaacacttgcctagaaaatgtaggtataagagtaacttaactataagtgatcagaaaagaactgagccatatttgacagccccataagttgtctatctgtagggtttgggttttttgtttgtttgttgttttattcttaatacagtcagtttgataaggaagagtcttgtgtgcctgtcttgagttagagatatatctgctgatacgatgagacacacatctaagcctaattacatgagtttcactagacaacattaactaaatgaggctgaagttgttttgtttggcacatgaaatttctaagtgattatcctgtttaaatacagcacttcatttgacctgagctatgtatctggggtccaaggtctccagaaagtaaattacttgaccacagactgggtttgtgcaaggtcatctggtactcttgttttctactctaccagcactactactctgaaaatacctaatgcctcctatttgtgaactttcttcagtagtttgataagcatagtcagcttgtttttcacagtcttcccttgttggaggtatgttagttcaggttctacaaagaagcagttattgggaaatgattaggtatataagacatttattgggaggtgaccaatgagtggaatgggtgggtaaggacccttaggagactgagaaagcccttacaggttatgtatatttgaatcctttagaagagggaaagaaaaaataaatgaagaacagaatgggaaattcttagacagttttaagagtgcttggacctctatagcatacttggattccttaagccaaggttgaccatcttcccatatttcacaaggataaacttgctttagtattatctcatccctttatcagtagctgattatagccttagtaagcatagtcttagaatgcaatgatggactctgttgcatgacttttactgggaaaacatgaacaaaccactatttactctatctggggcactaacaacaggtgaaagaaaccatttatcttactcaaatccagcttatggaagtgatgaatttataggagtgtagatggcatgctacttgcaggagcatgagtatcttaaaggcatcactgaaaagctaaccccagcatagatggaaattaatggaagctgtgtctgtggtgctccctggaggctgatcaaagagtaccctctccccagaagttgttatggcttagataaccttgcaaaggagtgtgtaaatcttcggactttcagaagtttcatagctttttaagttttagtttacttcctagatcgttcctgtttcctttacttcttggtcttgtatgagcctccctcctctccaggacagtgtttctgttgagaggaagtagcatataataaagtccttgtgctatacctatattatcagtcctttacactccagtctaccatcctagattgaggtggcacatcataatgctaaccctaattaaacttcaactttctttgatccactgaccatttactttctcctatctgaaatttgttttacttatccatataatctgcctcctaactcattattttaagcttttaatttataatttgtttattaaattattagctagccttcaaggggtagtagagattggggaaaactggaggatggatttgattgaaacatcttaaattctcatacaataaagcaaaactatgaagaactttcagaaattgtagaggaatatgtgtttaaccattgtttaaatggaaatactggttcacttataaagttcaaacatgatctattaaactatatacattctattttgttgtgttatgtgctctttggtcacctcctcctataatgcagtcctgtgtgggcatgcagacccagtagtgactaaccttagttaatttgaataatgccaagaaattggtaactcacatctcattggccattccatgcagattctccttattggtagtaacaggggctttatattgtagggaagagtatagtctgacttgatgccctcttggttctctatcaaaatcaaattgtatagatatcccatggccagagagcatgacatctaccagtattcaccagatggtgtctgtacttagactagaccttttatactaggaagctgcagaagatggaagttatcagtcctgctaccaaaccacccctgaagctctctcctagttcagaaagaggtgactacaccctgtcatcttctcctaaaccttcagagtttacctggaaatgaagtgaggagaacgctggaagtgaaggtggaggaccagctgctccattggctttttcacctgttccctttaggccttcctcagtatgatatctggagaaggtggttgcctattctaccctgaaaggtacttttaccttaaggagcagatctgaaatccagctgctgaaccccctaaaacagttctttttgctaaacactggggaagtaagtaccccgaccccctgtacattggctctccattgtggaggctcctcattgttctttcacagattctgtagattgtattgaataaatgcttctcagtttgttgtaagccttttgatctgtctccagatgcttttttcttggttctaaccagctaaatacagtaagacctctgtaccttcaggatctgcatccagagacccacccaatcgtgaactgaaagtatttggacctacagctccaaagacctacaatagtcataacacttttcatagctgtaacacttctggctagtatcccaaagctaccaagagttcacatatattgttctttttaatgacttttattttcttacagtctagtcattacccccttcttatccaccctcccacagttcctcattccattcttccttcctcaatctccaagaggatgcccccccacacacacaggcttccccactccctggggttagttgcatcttctcccactgaggccagaccaagcagtcctctgctgtatgtgtgtcaggggcctcatatcagctggtgtgtgctgcctggttggtggctcagtgtctgagagatctctggggtccaggttagttgagactgctagtcttcctatggggtcaccctcctcctcagcttcttccagccttttcctaattcaaccacagggattcctgacttcagttcagttcagttcagtgtaagtatctgcctctgtagggcctctcagaggacaatcatgctaggctcctgtctctaagcacaccatagcatcagtaatactgtcagggcttgaagcctcctcttgagatggatcccactttgaaccagtcactggactgcctttccttcagtctcttttccatttttgtccctgcagttcttttagacaggaacaattctgggttagagtttttgactgtggggtggcaaccccatccctccacttgatgccctgtctttctactggaggtgggctctatgagttccctctcacctcccaggtcactggtactttctagagattcccctccccacccctccagcctccctccagtcccacaaagaccagtttttccagtttaaaattggttaatctcatttaaggctgttaatcctgtgataataaagtacctctcctgtgtacacacttggctgcctgcccacctcattcttggaaagggcaagataagaacctagttggcaacaagagggtcttcaccaatcacctcaatatatatatatatatatatatatatatattcacacacacacatacatacatacacacacacacatacagacacacatagatcttagtgatactgtgcttccttgcaaagtatatgtgattttgagttccctctagtggaggaaggtcagatgtgctctttttaaaaactcagctcctgactagttaaccaatagtaaacagatacacatataaatcccttaaattgataaattttcccgggacctttgttcttaagtgtttttttttccaagaaaaaccttagagctatatgatactattaaatagtacaatatatgaactactcaaaggcatagaaatgccaagcatacattactttgcctaaagttggtgcattctgtggtggcagtaccctgaattttccatttgcagtcatggtaacaaaatgtggagggtaatattcacacccttttgttgcatatagattgtatgttttaaccactctgaaaagtctagtcagtgtgagtatgctactgagaagagattgcctcaaagtttggatgattttagcatcatcttccatagaaagtatgtgatatcagagtgctggatggattgggaatcaaaaacctgtgctcatctttcacttgggttataaattagccatgagaatttgagcatgtctcttgtctaccaagcctcattttctttctgagtaaaatgtgaacataaagaagagtgttacaatgatggcttacagtaatgtccatttttagaattctcagaacttttatgtgacaatagacatgggtgctgccttccagcaagattggcagaatcaccagcagcaagcaaagttggtaaatgctgagatcttaaggcatgggggtgcaaatgttaggagtgcagtgttgctatgtcatcacagcagcatatgcctacctctgctgaagactgttaaaaacagctgtggggctgagtgtcaatgggatttaggtgaatgagtaacattcatcggggtaaagaagcgtgtgaaatgttaaatggggaaggaacatttattgtgatgcatttcataaagatatttttactcaagtacatcatgtacttgaccatattcatcctcctatcccttccagtttttctaccaatccatcccactagtcccttccttttttatgattttattttttttatcaattttttttatcaatttggatgtttcaaaaaaggtgcagttttaggttccctgaccccgcttttaggcatctcgactaaggacacttccattgactcccggagcctcccccaacccaggtctctctgggacttactagagatgcaccccaagcccacccccccacccccaccagctgcagatttccattcattctcctgggcttctggacctctgactttccccacacctgatcctatcctcccatttccaccctcctcctatctcccacccaggtccctcccttcctctgtctcccatgactattatgtcccccgttctaagtgagattcaagcttcctcatttgggccttccttcttgtttaacttctttgtgtctgtgggatgtgtcatgggtattctgtatagtatccacttgtcagtgagtacataccatgcatgtcctttggggtttgggttacctccctaaggatgatattttctagttctataatgatgtcctaattagctgaataatattccactctaaacgaaccacattttctgtatccattctttggttgaggaacatcaggattgcttccagtttctggctattacaaataaaactgttatgaacatagtagaacacatgtccttgtgatacggtaaaacaccttttgtatatatgcccaggagagatatagctgagtcttcagatagaactatttccaattttctgaggaagtaccaaactggttttcagagtggttgtaccagtttgcaatcccaccagcaatggaggagtgttcctctttctccacatcctcaacagcatgtgctatcccttgcgtttttgatcttagccattctgattggtgtaaggtaaaatctctgggtcatactcatttgcattccttgatgactaaggatgcaggagccccagtggaggtataagatcagcaacccacccacaaaacttttgaccaaactttgtcatgtctaaaagaaatgtagggattaaaatggagcagagaccaaaggaatggccaaccaataaccagcccaacttgagacccatctcatgggcaagcactagtctctgacactattaatgatatttagttatgttgagacaggagcctagcataactgtcttctgagaggtttcatccagatgctgactgaaacagatgcagagaaccacagccaaacattagactcaggtcagagacccctatggaagagttggggggggggagatcgaaagccctgaagggagtgagaaccccacaggaagaccaacagtgtcaactaacctggacccctgggagcttccagactctaagccaccaaccaaagagcatggactagactgaggcttccagcacatttgtatcagagaactgcttttcctggcctcagagggagaggatgtacctaatcctccagagacttaatcaggaggatacccagggggccccatcctctcagaggtgaatggggtggaaggcggtagagggattctgtgagaatgggaccaggagggggcagcatttcggatgtaaattaaataattttaaaaataaataaaaaattgaaaaggtgcattttaaagcacataagcatgggtcagaagctgaagggaaagcagctgaaatgtagatatgtggaaattttttagtagaatgaaaaaaagcccttagattccagttgtgctgctaaatatgtctgtggacttagttaagtggttggaggtaaaaatcaaagccatcctgaaggagtataacattttaatgcatggaagagaacacagtggaggggtttggagtatatgataatagctgctttaaattcctataacactttaatgagtagaatgaaaagaggaaactgaaggtaaaggagcacattagataattactgctgtggtccaaactagagttggtgaagactgaaactgggctaatagcaggaagggaaattgacaggtgatgcagaaagacaatggacaggtgatgcagctgtaaagaggaggagaaacagcggtttgtctgaggataattccaagaagtgaatgatttcccgaaaagttatagatgaaaatttacggtgttaaagttggatcgaactatataacagtatggcttagtgatggggtattcacattgccatctttttatctttaaacttggttcaaatgattttggtaaagataagaaagaataatttttgtcaaaaatggtcaaagacaaagaaccatgttcatgttatgtactagacatagtgctttcctgtgcattatgaactctgtaggcttctccataatcctgagtagaagttgttctcttactcttcccattttacagatgaggaatataaggctccaagggtggcacaactaccggttgttgggaacaagacttttaaatggacctttgactacaagtctgttatgctatcagcacaagtaccttcctgcagaaagtgtcagtgctttaaagggtacatggcagatctatgggataatgtgagtgatgtgcctgatgtgctgtgaccaagggtaacttcccaagacacaggacctacagtgctgtggccaggaaagtcctaagtgaaaccaaaaaagctttatatgaaatataaaactttacatgaaatgagccattatgtagaatgatctaaataatgggcccattgtaactgtttaatgtaatgctgtgtcatgagccagggcttttgttatgactaagtgaccactgattcttaaaatgaagaggaggtgaggccggcctatgtgcctcacatcagaccgttttcactagcccagaggattccactcagctatgtgtgaatcagatgcgagaggcctctgcctctcaaattccattgttaaggcaactgttgttttattcatccccagtttgatgaactggcgaaagagctattcagaggagaaaaatgaggaaagacgattgattgtaaatgtatgttctttacagagtaagaaaatgcacgttctggcattctgcctacaaaagctagagaagagcttcagtgtcattatttggcagacactctaaaatatatttatttcattcttgtaaacatttatacactaattagtacataatttatattattttgatatcaagatgggaaacagcaaattggactgcatagaatgtccccaagggaacttcttataatttttttcaaagaatagaggaacgcagttaatggtggttttatacattgcacatagcacagtgctgagtttggcagcaaacagctgaaatgttatgagagttttactctttgaaacctcaacagttattctcaaaactgctcattgctggagtgcatgacactgcctgagttccccatgtcataacagccaggaggtacggtagacaattacctgtctcaatcctgaccttactcatagcttttgtgcttcccttaaatgtcaccgaagagtctttggaggcagaccacctactatttcaacagactttctgaaatgagttctggctcctaagaagttttaaattgtgtgtctagatagctactatattttgagagctaaataagacacttcgttatttttatgaacaatgaaatgaaaagtttgttatgagaacaagacagtataatacacctaaaatttattaaaacactgggaaaatagagccctttcagaagactcttcccttataccagagttttactatatataaaacatctttttgccactttgcggcaattgctgggtgattctcctttgaactaaaaattttctagtatttttcaagctttgtgactagtttaaaaacttaagactaaatggctatttacctacacctattcatatgcttctcttgataatacactttgttagtagaccatcaaaataaattacacaaataacttggtggttgtatatatgaatttgtaagtatatcactatccctgattttacagtgcttaatacaacaactaccttattcttttcattggtgttttccacagttaatgccaaaattgatacttttaatatagacttgtttcatacttatttttgagagagttccactctgtagcccatgccttgcatccttctgctttggactcacaattgcagggatgccaggtgctaactgtggtacacagcttttgtactattctatgatactttgttgacaaaagcattttatgactagatgaggaatgctgtgtaattaaaaccattggtaataatttcactgtactgtagacatccttggtcttagttatttacttatttatatattaaactagatcataagttgttttctgaggaaatttttggcctcacttgcagtgccttcataatggagaaaggcttagtagagaaaagtaaatggtaagaaaatctatcctggtatgtatattttgggggatccccaatacatttatttatcaataaatgaaaataggaagtaaatcttgttaacatatcaggaactattatgcactagatatatgagtgtttgctactttgacaaattagttgaacttctgctttattattataacttttttgctatttaaacttaattggataaaatttatgtacaataaaataaacccacctaagtctgtagttcaatgagctgtgtaacaaatgactgtatttcattttcttacaaagtatcctcatctattaatatatatatgatgctttttaagacttaatattgagacgtaattgaagcattaagtagggtttctccaatttcctcttataaagtgaaaaatacaatgttgaaataggtgtctggtttttgtcatcctaaaatgccctgattttcctttccttggtttacacctcctcaaatgaaaagcaagccgaactgtacctattagagacactaggaacattgtatttagttattatcatgcataaaatatagtctcaatagtcattcatatgtttgagaaaatgaagcactgaacttgatttgctctgaatatcagttacctctgccttactccttttagctgtttgattaacatgttttattagtcggatcccccaaagacttccaccattttcatggttgagtaactccttgcacagaatactgaaggctatattttctgaaacaaataagttggtttctttttaatctaatgttgattcttacccacaaatggcttttaagcagatgcttttctttaaagacactttaacataccagaagataaatattaataaagagatttgaatttgtcacctggaacatttattaatatccaagtagaaagatcaataaattttttgatataactcacagcagggtctttattctatttgagctagcttgccctgcctccaacacaccaccatcacataggatggttttggtggtgggagagccccaaatgtctactggggcaagggtttatagtaagcaacaagtagggagtacatgtgcaaccatctaattgaaaagctactgtggcctttaacataattggctgatgctgggagtcagatcatgaacttaatttctgctcccctctgcattggtggtctttaggcaaggggtgggcttgtaacctggggtgcaggtttgttgggggaataacctggagacactggtcttgttgggggtataacctggagatgctggtcttgttggggattagcctagagactggagctaggttcaggttttgttagtgggcaacttggaaattaatgctaggtactaaccagatagtttacctgagttcaaacgtaggtcaggttctctaaaatggagtctaaattttaaagatttggcatctcacagggcattcatgccctgtcttaggttgatccacctatgagtgaatcttaccacctttgactaccagcctctgcagtggggtatgtaacctattcggctacagttttgggccacatatactggagatctgcatggatgttcaaaaagaaatggaaggcacacttaaccacaaggggcaacatgtataatcctttaaccactggagtacccaaggcaagaattaggaaggccagggagtacaagaagaccagagaggcatgttcttcctcaatttctcttgcagcattgaatttcaggggtttagcatcttttagacaaaccattaggtctgctcaaaactttttaaaattttattcaacacatgtaagcctctatctgaataccaaggtttttaaatattaactggaagcaaaacaaatgaacattgataacatgccataacagaaattccttgtacaatgccagatatacaattaatcaaattaccatcatagaaagttacattaaagctggacccatacagttactgacagtgcaattgtcacaagttacattaaacaaatatccagacatagaaacattcatttgcccaatcatcaatacatgaggcaaggatacaaaagttgttataaaacctgacaagagacacggggttattttcgtagtgtaccatggttgggtggtgggttcctttttgacccagcattccagcctgtagagtgggacgacaaatgccatatctctcttctgtatctgctttctctgacattaggatactgcaaaggatctcaggaaggctgaaatgctagtcaaaggctgggcaatagggcatttatcaaaatcatctgattagctgatccacatgaaagatagggagcaatcccattgactgaactggttatcattagctttcagcaagtccagagttcagcagctccacaggtgatacctcagctccacaagtgatacctggatagagtctgtcaagcaggcgaaaatctgctttctctctggaacccagttgagtcaccgcatgaaggaaaacaccacacaaacttggtttagaataagcagataacataatcactgggcacaacaactagcatcttaatttgtaagcttttcttttttttttcttttctttcttttttttttttttttttttttttttttggtgttttgagacagggtttctctgtgtagctctggctgtcctggaactcactttgtagaccaggctggcctcgaactcagaaatctgcctgcctctgcctcccgagtgctgggattaaaggcgtgcgccaccacgcccggcaatttgtaagctattttaagttatacatcctccggtagcaaatcccagtggatctgccacctgaatacctgaaccaagtggggtcttccgctacctacattttggcctccatgctctctccctgtcccaaaagccaagatgagtgatttttagtacttaaatatacattaggaatgttctgacagttttataacttaaaaccaaagtaaagaaataatattcttaggcagctatttaaccacttatcctaatgaaaaagaatgacaagcagctatcacaataagctttattttatagatgattggtattggtacatatagtattggatttagtttgaatttaatattaaactgggcagtgtgcgtgctttaatgtatttgttacattgaaccagaacccaaaactttgagaaatatattaccaaactctcattcattctgaaatactcagtgcaattaagagtaatttctaatcaatttacatttctctagttgaaaacaacaacaaaacttgttagtcagatatcctcagtcctcagtttcctttcttcttcaaaagacaaatgagagtttagcttatagaaataaaaggtgggtgagaacacaaagaagttagaaaatgcacagaactctgtgtgtggaaagaaataataaaaattgtagaggtaggattaaaatgtgtaaaagagcaaagaaataacttgtgaggatctttctgggcctcatatcattactagttgagaaagtatttcttgatttatagaaaaagcgttattaaagcaaatccgaactgtactttagccttcatattggttattatatgaaggtagaactcagcagcagcaaatgactttactaatgtaatttctccaaggttctgcttagattcctttcttaaaatattatatggttattaattttatgacaacaggaaaaatgttatcaatactgatttcatttacttattttgttcttaacacttgttttaataaacacattactactggccctgattatttctaggacaacattaggatactcggtgtgagtttagagctggggtgagcttttagtgaattgtaactgtcgagcttatgatgcaacttcgacattatttacaagtggataagagtatttctgtgctttgtcaggaagtccatggcaggcttctggccgtcagtggtgacagtgcaacaggaagaagctggagtgtataacagttttgctagctgcacagccgagcatgcattatcgggttagcattgttccccattagatcttgggacatatgtaaatgacacagtcccgggtgtcatagtggagtcatgtcaagagcactgagcttttgttattagtcttacactttatttagaaattatgtgatttttttcagcaacttacatcattgaactaggacctcattttcttttctctgtaaaatgagaccacacacaaacacacacacacacatacttacatgggtgatcacaattatttagtaagtacttgaagtgggtgcttgaaaatcacaaatgaaaatctcaaatattttattgcatattctagagttagaatctataaaacaattcatttcattaagttttaaagcacacagctatattcagtgtatacaactatataccatcttatttggtaaattaagcaaaataaaattagtttaaaatgacagaacaaataaatgatttagattaacaatagtggaaaaacttcagatttagttattaattgataaattatagttattaagataagccattaagttttcttgacatccttgaactacacataattgaatgtagattcttttttaaattattaactgcaaatgtctgcccaaaaatggcacaagaaagcttggggcgtgtaagttatgggtagaatgcttacctggaagtttgggggtatgaatttgatgggggagggagtcatagaaaaaataagaattaatgtaaattgggctggtgagatggctcaacagatcaagtcccttgccatcaagcccaatgacctgagaacattcgtggaatacatggtggaacaagagaactgacttccagaagttgtcctctgacatttacatgtaactgtcacacatgtgcacatgaacacacagacaaataaataaaggtaatacaaaaacaagtctatttatctagagctgtaccacttgtagctgctactcacatgttgctgctaagcatttaaattgtgactagactatttttatataggctaagtataagacacacacactggttctcaaagagcacaaaagtaacattttattaattttaagtacatgttcaaataatatttttcatacatttgcttgaatatgatataattaaaatagctgatctaatcttcattgaaggttcctgggcaactgaactcttctttttattctttttttttaattaggtatttctttatatacatttccaatgctatcccaaaagtcccctatacaccccccgcccgccctgctcccctacccacccactcccacttcttggccctggcgttcccctgtactggggcatataaagtttgtaagaccaagggcctctcttcccagtgggtaagtgaactcttatgtgtaggctttttaaagtacagatactgagattgagattgctattccaaagctaaaccttgaaattgctccttcaatcatatttataaatatcaaacctagttgttacccattgtcaaatgagcttgctgcagaattacagcactaaatggcaccaaatttttataaactctaataagtggttgtaaaatgaataataaattttttcaggaaaatcgtattttaaacttattactgaagtagattctctagctttcccttatttaagagtactatttattagtaccgtgcagtggcactcacgatattattgctattggtcagcccaaacttcttaggaaattaatagtagttttaagtttgtatagtatgctgatttaatttaaatatgttactgacttgagctataaaattaagtatcattagtgcctcttttaaaaggaaatgagttgattaaatatagttacatagttaaatgtgaaggcactaaatatagaaatcgaggattgaaagtctctttcaaaaatttcctaaggaagagggagaagagaaggggggagggaggaaggtgaaggctgccagtgactaaccaagcagtcactccaagcagagatggccccactaagccacgttcctcacaggtgggtttcatggtagcatctgtaagcattcacacagtcatgccaaagtattaccatctgctttccagctcttccatccctgcctcatgagtcaccatgtaggcaaacagtagttttaccccactatgttatcatggacttaacagcactcaacaggtgcatgttctcttactcacactttcaaatggccatttgagtttccttcttctggactctaaagttaaaatgcatatacaatatattcatgcttttttgagatctttgatttaattttcattttgatacttgttttttaaaaggatggtttttatttgcactatttacttgatacttgaattatggaaaacaattgtgctttttttttttttttacattgctgtccctatcatctcaaatttattttcatattgtcagttttgtgctatcctgtcagcattttggctacaaaatgtcagattcaccgacatttatgtcacactgttattggaaagcaggggccccagaaattttgcctttgtttggagagtggtaggtattaaactaagagctttttcagcccttcgccatgcggagcgcagggcagcgtttggcagatctgtttctactaaaagctttcagtgtaacaaagctgtcatgtagcagagtgggaactgaagcatggtgtagttgcatgaaagggacaaaatggaaaagaaactgcagagtggaaaagagaccaggcttgattgtggcaaacactcaatgtgtttgcttcatgagtgtcagagcagagttaaaactgccttgcatcagaacagaaacgaaggagtcactaatgtgaaagggtgacctctgataaaacgagactctagagagaagataaaacgttttccctggagctgggaagcagaccattcttgagaagagagagccatacaggtatctgatgtcattaggctcagtctggccctccagcacacttgttaaagaccttcctcatggttagttagcagctccctacacaagccctgcaactgcttgaccctctcctcctgcagggccttcccaactggttttgaacataaaggcatttttcctcagcctcagtcttttccttttttttccccctttttcgaggtgaacacacacacacacacacacacacacacaccttttggcctcttcccccacatgctgtgttctacatgatcctctcccacatggctacttgttgtgatcttagcactgccctttgaaaccaattagtagactctgaaggtaccacatgacctctcaccattcccatttcgttgactaaaagcaagtcatttgtagaagtcggtacttggtatgcaggtggaagagacaaagacaggattcacaccatttctgactccagattctgtgcacttcttatcagtgcagggccactgaatgcctcaaacagtgttgccttcacaaccacagggagcaaataagcagaagttgctttggcccagccatttcttctactagtttttcttccttccagattctttatctgggatcacacccacatccataacactgcataatgtaaagcttgttgactttggagtcagggttcaaagctcactcctgtaatagctgtcgagctgtgtgatcttgaacaggtttccaatcctgagggagtttcctcatcagcaatgtacctacctcacagaatggttggaattttcagctcagtgagagaaatgataaattttaatctaacattaaacaatggtctcttgtataccaagttcagccctgacctgccacatccttccatagcctgggttccaagaccctgcctaggagtgatgagggaagaaaaacggacagatacaagaaaagatgggatcaagtggtctgtgttctaggatggagaagctgtagtactcccccaacccccaagctcagcataattataatctacagctgaatcaaagaggcagggcttatggtatacagctaaatcaagcaggcatgcttagcaatcataacagcaactgtgtctgaacagaaacagtcctcaagctgtaaacattgtgtggaggagagagaaagctactgtgtgcattttctgcatacactttcacatgcacacttgaaccaggagggaaagctttgccatttccttgagcctaagccaagagaagtgtttccatttcccacgggtctaaggcattggagtccttgccatgtatgcccttgtcaaccacacacattcactcgggacttcatttgctccctacatatccaccttctttatttcttagatgttcaacattcccacttggaccccaggaaggctttgccatccctctgagcctcacttggggaaggctgtgccactcccgtgggtctggaacttttgggtcctagacacagctgtgcacatgccaatagcacacgttcactcaggacttccctagttcctgacactgactgacctctccttggaactttaccagctcagaatgttcatggctttttctcagattccaacctttatatacctttattttctctatgtgcttgactttattaacattgtattattgatctttccgtttctcatggtacctattctgtactgccttcttttctttatgttgcctgtatgtgagtaggttttgtaaggttttatctgcaaccattactcttgatgacaggactaagtttgaattaataaacaaaaaaagagttcatgttgtctattgcattgtgcagtgtggacttggtactctcttgtctccccttctactttcagatataacaacaccacattgtattttatgcatcagcaaacaggtttagcactattagtagtggaagactttagttatatataaaacaagtgatgtccctgcccaacattaatgtgaggatgttgatattaattttgttttccaaataggattattttgttgttgttttgtagttgttattgttataagatattgtctcatgtagcccaggtttgccttaaactcaccatctaggtataggtagccttgaactcctgatcctcctacctccaccttccaagtgctaggattacaaagagatgctaccatgcccagctgcaaacagtactttcatcttatacatggtagtgctacctgcattatctgtttgttcttttaaagatcctgagttagtcaacatgttttgtagataatattttaaaattccccaggctagagctgtaatttaacaacagaccaaatatttataatacagaagaccctgaaatccttttccatcactgcaaaacctaatcagttgattcatcctaactttagctgtgggaacagtgcctttttgtgtaaaccatactatttcttattatattccacataaattctgtgaaatgtctctaagtgctatattttattcttatctggcttaaggaaaagtaagataaaggtaaaattcaaaacaataaattgagttacttatcagcagatcaaggagaagttatcaatttggaggctgaaacttgactggaagagtttgtgggaatatacatgcacttattttactttgggacaagctgattctgtgcacaaaggaatgagaacctttattagtaaaagcttcctcccatatctggatggaagctgacaaagatggaatgttgtattgccatagatgtgaaagggtgagaagataagcttagtttaaatgggggatttcatctttttagacagagaagtcttcatgttaccatagatcacatccatccattcattcatccttcactctaattgtctcttgttcctacctaatgaagtgtgctgtgtgtttgttttgcagatctaaagcgggaagccagtatctgtcatatgctgaagcatccacacattgtagagctgttggagacatatagctcagatgggatgctttacatggtttttgaattgtgagtggacattttatttctcgagtaaagttttaagtgatattggttgcagaaaatcttaacacctttttcttcaagtttagcaacagttgtggactcatctgattcaagagacctggagtcacaggtaaaaaacaaggactttctcatttaaggacaaatggcaaaggcaacaaaagctggccataccaagtacgcttacattgtcagtactcttcagagaagaggctctaaaatgacctagagtctcccaaaatcttgagtttggatcttagtgaagaagaggaagatgaaagtagaggattccacatagaaagtctctctggcaactcaaaatgtataataacacacataactttctctttttatgtaatcatattgccataaaaggaaacttctccactaacagtgtcttgatttcaatatgctacttcactttgacagtcacataagtttgtttaagatggagcagtgtgagccaagcacaactaaataatctatagatgcttggataaatgttcaaagagattatgtaaagctttatgggatatcattattcaatattttgtctttaatctctttctatttaaaattaacccatgactttgattaggaaaatagaaaaaggaagataaccagcttcactattcaagatatcaaaataagatgatgtattcatgtattcattgtctattgcttcataatacattactctaaactttagtgacttttaagcaatatccatgtattacctcactctctgagcatcaggaatgaagttcaacttagataagtcttctggctctagatcactcacaagatgctaagttaagggccagagcatcttaagactctactgagggtggatgtgcttccaatttcattcacatggctgctagcaatcatgtaatgagtgaggacctcagttcccaagagccattggccagaggcattcctttgtcccttgtcattggacctcttcataaattaggatggctactagctttgacagagcaagcaacaaaaatagacatcaaccttagaacctaattccaaaagttgcacaacatctcttctggcatattgtattatctagaaatgagtcattggatcaagctcacataccaagacctacatagcaagaagtgggaacctcagggaggcattttacaagttgcaccctatagaaggctcactaatactttacctatctatgtagaagtttgaatctaaagaactgaaacaaagaaactcaaattgaagaaaagttcagctacataagtgactttttactgggaaagatgtaaatgttttgattagttgtttgcaatagcttagaaatcctaaatagaatcttaggccacattaattagaaagtatatagaattcaaaacaaagccacactcccacccttacacactactttttcaccctggagtattcatggttagcaatacaccgcagtgtttatagaaaaggatcaccagaacaaaaacacgcggaaagtccattagggtagagtcaccgtcttctagcatgctagaattttgagctgggtctgctataagttgatatataaaaacttctattatggagctagagagatgacttagaggttaaaagcactggctgctcttggagaggacctgggttagattcctggcacccacgtggcagctcacaactatttgtaactccaattgcaagagatcccttgccctcttctggcctctgtaggcaccagacatgtatgtggtacatagacatatatacaagaaaaatacctatgtataaaataaaatctaaaataaaaattaaatcttttattgtaagaaaatttctttcaacactttgaatgttcttttagctatatttccttcacatttaaggaagtatgtactatgtgatctacctagcaaaggaaatcctatgtcatagagccagtcagacttgatttctgtcaaagaaaaaagtctaactttttttaaaataaaattaaaacattaatagacatcccaatgacattcgtctaagtgttgattttaaattctaaaatagtccaagctctcttatgaacacattatctagctatgaggtgcgagctcctttcattcctcagggctaggctttgcttctaggctacttctaggggctttgcattccctgactgtctgtgaagataggcagactttagaggataggggagagaacttgctcttttgagaaggcagactgtaaatccagaaatatgaaaggaaaagtaacaccatagaatttgttttcaggcagactaggttatggtaagggaggaaatggaaattaattgctttaaaacatcctagttctggagcccagcaggatggcttcactgggtaaaagctctggccgtgctgcccagttctgatgacctgagttaaatccccaccacataatagcctggcagctgtcaagcaagctagcctgaagtagagtatatcagaaacaagggagaccctgcctccacaaagtagaaagtgagaagcaactcttggaagttgtcctctgacttccacatgcatagtgtggtgctcaggataataataggtaatttttttaaaaaaaaaaatctagttcagatgtcccttggaaaggcttttgagtacttctagacatacttaaatcccaaatgaagtgctgtggcatggaagagctcttaaacacattgaagttgggctgaagagatggctcagaggttaagagcactggctactcttccagaggtcttgagttcagttctcagcaaccccacctacagtgtattcatataaatacaaataaatacaccttaaaaatatcattggaatcatagatgcccataaatgtattgattttcatattctaagatacctatatagggaaaacataatcagtatctgcagttatttgaaaaactgtgatctgtaagaatatgtgcttgttcactgtggcattagaggccaccactagaatcaacaagagacaaatttcacctttaagtaagaaaggttctctaatgataagatttagtccaggaatgaagccactgtcaatttttaaattcacattacatcccaattgcagccccctcccacctctcctccctgtcctgctcttacaaatccttcaccccatcaacccctcccttcacagggcacacacttgcctccttgcactcaaaaggatctgtagccatccaaaatggctgaaggtagagggccttactttgagactagagaggatctctaacttctcactcaattttaagatgattcttttaaaatcacttttctggtttaattttattcttccctcaagaactctgtttctatccatatttttattctgagggaactaaaagcagatttaatcatatatcttaaaatgacaagcaaagaaagcaacatgttaaaatttacctaaattttgatccccattctgcttgtatcagggccctaaaataacactagtagagagaagatggtctttgttgtcataaaatctaggatttgggcttcttagtattgatgcagtccttatgagatttttgtggctgattttatatactgttgtgattaaaacaatccaatgactgaagatgacatctcattaaagattaacatttatcaatagcctaatcctaatcttagcctaaattaatagaatgtagctattctctttttttcaccttctgttttgggaattttcaaatgaaagggagactaatataacgaaagtcagcactgagctctagcagttatgaaaacatttgtcattctctgttcaaactatcctttcctgttatcatttgccactgtagattgctacagcagtttcatttcaccagaaacactcctgttttaaatgataacactattatcatgcctaacaaaatcaccaataatttctcaatatcatatcttattaacttgacattcagtttttcctaattgaacatgaatcttaaatgacagctatctaaatttagaacttttttatgagctctagggatctgaaagtagattataaattcacagctaaattaacagtgatttcttcttaaaaggccagaaccaaaatagaaatatcaaactcttcttctctaccattattttataaatctatcttcacagctatctttgctcagtttctctacctcttgatcttttggattcaaaggatcaaaccagaaagaggttactctaaaactactctaaactgtgatcctatgtatggctcacagagcaatgctggtacacttgtgtatgcctccacctactggcccagaaagagaatgcatctacagctgcagtgtggattaagctattccagaatccggtccatatttctggcaatagatgtaagctcccctggcattcaagggctcattgctcaagttacgagggatctggatcatttgcacagttttataatgttacatcaatacataatagatagggaaagaggaaagaaatcaaattaggcccattgattttcttgtttcatggctttctggaagctcttatgaaggaaaaagctagactgaagaacatatttggattaccagcatgtttttatatttggtatccatatctgtcttttcctccgtctatgtgtgtccaatactccttctaatttgcactcatgaacttatatggcataattatgttgttggatattagaaaatcctaggaaatagttgatatatgcatgactagaaatagtgtgcttagaattgagaacaaaacacccatggaaggagttacagagacagagtttggagctgagacaaaaggatggaccatctagagactgccatacccagggatccatcccataatcagcctccaaatgctgacaccattgcatacactagcaagattttgctgaaaggacccagatagagctgtctcttgtgaggctatgccggggcctagcaaacacagaagtggatgctcacagtcagctattggatggagcacagggcccccaatggaggagctagagaaagtacccaaggagctaaagggatctgcaaccctataggtggaacaacaatatgaactaaccagtacaccccagagctcgtgtctctagctgcatatgtatcaaaagatggcctagtcggccatcactgggaagagaggcccattggacttgcaaactttatatgcctcagtgcaggggaacgccagggccaagaagtgggagtgggtgggtagggggttggggggagggtatgggggacttttgggatagcatttgaaatttgaaatgtatataaagaaaatatctaataaaaaaagaaaaaaaaagaaatagtgtgtaaatataaggcatacttaaatatagactcatagaaccagaattgtagaactggaaaggatttagagcagtagatttccaaacttagaatgcctagttcaagctggtcttagtggcacttacctttaatcccagaatttgagaggcagaggcaggtggatttctgagttggtggctagaatgagttccagaactccccaaagctacacaaaaaaactctatcttgggaaggaagaagggaggagggagggagacagaaaggcagaaaataaatcctgtgtagagtatcttaggcaagcatgtatctaggtcccatacctgagttcaatttgaacagatgcagtcttcatggcaccaggtgagagacgtgacctttaaagcaggagtaatgcttagagagtatattgttaatcccctagcactcacaggaagacagttgacaagtgtgtgtgctggcactatatccattgctttgggattattcttaaatatgaacctgtttgtagtgatttgccaaacttattttaaaatatagattcagatttgaagatagggctgagttgtgtttccccctccaaaaaaaatttaaatatttgtttctcagtagcacattcaggcttgtttttagtagtgtctggtacttgagttaagctgtaaatcctaaattggctggctaaggaattttaattaccttattatagtgtgattacatataccacagggagaattttacagtaattaaatatggattttaaacacgtctgacatgaaaacaatagtttttttatcttttaaaataacattctcagtttgtatttttgaagcttacaaaggagataataggctggaactgctctttttgactttaatttttttgtctgatatgaattcatggggaagagaatgtgtgtgaaattcattaactaagtggaactaattattacttaccagcgaagttgccacttaagcaaaaatgtctctgtctcctatcatacaatgaaaatctggactgtagcatcttaatttatttaaatgtatacatctcaaatagccttctctagtctgtttgatatttttatgtatgatgatgcagattactatttttgtgaagcacagtgacatttttcttgattcttggtcaaaatttttcatcgatttttttttgttgttgttgttgttgttctgaataccatttcagggtccccaagactactcttgggttgatgcttcacttaaaagattaaaaggatgcaatgttactgtatccatggatgatttattgcaacaaaaggaaatggtgcataagatccagggaacaagcttcccatggtcttttccagcaattcaattgtgacctgctgccaaccagagaatctcatttgagacgtaatgcccagagtctttattcaggggtggctgcataggtaccctatacctggcatgtacccagactccccaaacccaactagattttcagcataaacaaaactcctgtttgcagtttagatgcaggcagtcattcctttcagttagtgagataagaacttcctgaggttcaagccctcagatgcctgcctatcagggccaacattggaagtgggcatgtcagaactttcacaagatctgctatggtaatcctatgtaaactaaaacagagaaataggagatggattttttaattggttaactcgctccacaaaccaaatgtaattgcttatgaagataattataagctttgggtttggagttgtttttaacttttaagtgtaattatggtatcattttaacacgtagtagaaaaaaattaggtggccagatcactgaagcaaatcattagttgagattttataatgtagcagggattttaagcttctaagttatatttgaaaacaaagaatactctgatactattattagaaaaatacatttgaaattgtcgctctagtaatttttgttcagcatattaaatctgatcttcaatcaaataaaataattttaattaatgatatgccgataccataggattaattcagttgattttttttctggaatttaaaagtacaattaatcttaaaaaattataaataattttaagtatataaaattggtacaatatacctactttgtaccaattgacaaatggttaaaaattataatgtcacaaaaaaatgtcactcacaaaccttcatcagtggcgtgtttaggattatttttttctacttaatagccttatacatttttgtgacattgattttttgagaatagtgttttatgactgcagtaagatacctagaggtgcatataccacatttaatttgataatctccttattagaaatgatgctgtatttaatattctttttaatataatattttaatatattaatatttaatatattatatataaatatttaataagtgttcattattttattgttgtatatgtctgagtatttggcctgagtgtatatctgcataccatgtacatgtctggtacctatagaggccatcagatcccttaacagacagttgtgagatgctatttcagtgctgagactcatcccagtcctctagaagagcagccagtgctcttaactactaagccatctagagagagagagagagattgattcatccttgataattcaataacccactaagtacagtttgtgctgaccttatactcatgagtgtaaggccatccacaggagcatggtccacctaccaggggccacacctttaaagaaaattgactgtctctcgcccagcaggtgtcaactggcaataactgttactcagctaggggtaggtacttgtaagcctcttcctcctccatgctcgaatgaattctatacagatcatctgcgggcagccacaactgcttcagtcttgttatgtccagaagacaactgtttagctcaggttccccctgacctctaccttttacaatctctctgccctcccatccacaacagtaccagagccttgaaggtggggctctgaaataaatgtcccatttatgactgagcataccacagatacttgacaattaatattacaattacttaaacagaattactaggtaatcagaatatgactattaacaaacataatattcatagatttaagttaatacatataccatatttagaataatacatgcacataaatacagactagggaattattctaaaaggaacatccacatagctacaaccacatcaagaaataaaaataattgccaacatttctgtagccttaattctaagtctttgtgaccatagcccctttttctgtacgacagctttaatatgcatgtcatttttatgcttatccagctgtctcatccaaataagcagcatgcataatgtaattcactgccccttgtttttctatgaagtcacacagtgtatattttagatctataagactcatccaagttgctttgtgcatctattccttttcatcactatacagcaagcattgcaatgaacagactttcagtatttattcattttaaagttaatgaatatcagggaaagccctagctttccttgaactgccgtcatttcagcatgttgttggtcattactaatagcgccttctccttacactcattatctatcctgtactgtatagccctcctgatacttagtgatgccagatttttttttttaattttgctaattgggatgaagtttttcctcattgccctttctgattgccacttgtaatcctctatcttcattcttttagttttgttttgtttaataaaagagactttggtagttttaatctaatgtaatcgtcacttgttttgctttttgttagcatttttgtgtctgaagaatcatttaccaagcctgagaaaatggatattttctcttgtattttatcatccatctggaattgatttgagatacactgtaaaatagcagtccaatttcatgtctttccatacggagattcaattgtcccagcagttattaaaaaacctgctctgtggtatagcctttaccataaatcaaacaccatatatgaatgattgtttccaggcacagttcgagcccattggcttgcttgcatgcctggcattgtgccaagactctgttgtcttatgagttctggaaccttgtagagtcagtccttccagctacattcctttacaggcatgcttggaggacatacttggctctgaattctctaaaaatgttttagaatatggccatgagtttccaccaaaaaaaaaaaaaaaaatagaactattggcagttttgacattaatgtttatatttaatctttataacaatttgagaataattgacctgcttgcagtattaatattgaatcttctaattcgttaacgtcatatgtagcttcccatttagctctttgacttctttcaatgaatttgtatgctttctttataaagactgtgtacatctatattagatgtggctttgatcaatacatgttagataatgataacagcttcgttaagtaagttttattagtttggttcttaggtactagctatccatttccattcatcaggctttaattctggtaattagtacagtcatttggattttctgaatacatgatcgtattgtttgcgtatgatgatgtttcattccatacaagttcttttttaaattacattcattcatttattcattcattcgtttgtttgtttgtttgtttgtttgtttgttgcgagcacatggaagtcagtggacaacttatggtagttggttctcctcactatatgggtttcagggattgacctcagctagtcaggcttctgagcaattgcctttactcactgagccatcttgccagcccataattctgttgtgtttctttttcattttattgcctttattgtgatagataaagcatctagaaaataacattgtgtataataagtgtgaataggaagtgaatttcatcaaatgctttttttctgcgtgtcttgaaatggtcagatgctagcagcctttaatctattgatgccctgaattgcgttgattcttgtgttgacccaattaaattgttatgtataaataagctttataatccttcttatatgtgctggattttgtttacatttatgcttatgggataattttgttataattttcttgttctatccataccatgttttcatatctagattacattataaaatagttgaagctcctttctttatctgggttttcttttccttccttatatagttcataaaactcacataaacaaaagtttcttataagaagcgtttctgtttctggtttaattctttaaatgtttgcagaaatattaagaagttctggccattagtatgccatgtttaccaattgcattttactagggaaaagggtcaattttatgtggattctaaacagttttggcataaacctgttctttgggctctgcagccgtaacttttctatttagtttgtgtgtttgtgtgtttgtgtgtgtgtgtgtgtgtgtgtgtgtgtgtgtgagagagagagagagagagagagagagagagagagagatttggaggagttgattctctcactgtctggctcctgggggttaaactcaggttatcagggttggcagcaaatactttagccttcttgcctctctacttcatacctcttgatttacatgtgtcatcttcttgtgtgctttcttttcttcttgtggttgtttgttttatttgaattacatttatttttattatcttttatttttgaggttataaatacattgtactctacttgcagtacccgttagcatttttctttccctttattttatttagatcaatttaaaatcttttgtcattatagcttccttttatcttttttaaggtttatttattttatgtataaataaaatacataagacagtttcagctgtcttcagacacaccagaagaatgcaccagatcccataatagatggttgtgagctttttcttaattagggagtttaaatgctacttactgagtagcccagaaattccaatatacttcctaacctagtacattcaaatatttataagcaattatagtcctgaaaagtacaaattctgtagaatgcattaattccattgaatatcacctttgacttatatcccatgttttatttaacgattttttattaataaattatgaggtacatatattcatatcatttccagcttcttttatttaacttagtcatttagatttaccccacacttacctatctttgttctttattctttgagcatagctatgattttatcttagtttgttccccttgtgtcagtctcctcagtacaaacttctatttttgttagtttcctttttttcttgcagtccctttagtttgaaggctgtccactgtatggagaggtctagattggcctattagacatcattcactcttttccagcttccattgatgttgaaattttagctagcaatctgacatttatctaaaagtagtagtattatttttcaagctattaaatttttccttcatctttggctttctaaagttttctctgtgctatatctcaagaattgtgtctgtgtattttaaccttgacgtgagttctgtaagtgtctgaaatcagtgtgttgatattatttgtagttatggaaacttctctgccattatctcttcaaatacttcctttgtccctttcatttttggaacccatttaaatatatttaagagataataagccttataatattctatgtgtagactacattctttcttggaatttgcatccttatctcttgccttttctgacctgtcttccaggtctgtttttctcttcagcattgctaaattgctgtcagtctgctttctagatttttaattacactttttagtttatagtttcatagtttctacttatttttaaatatttactgcattacatttgtcatttttttacaaaatttttgcaaaaaattaaagatggagttttatattcagtaaagatagtaagcttcattacttaataatcttgtgttcaagaactccacttgattttgtttttaatctgttctctattctggctctttgtcaagctctctgattccatcgagtgcccaattcgttttgactttctgctagatatcatgttgacacttactcgcctaagaatgatgctttcttcctcaagggaggattttttttgccccttctgctagttaccatcaggctctagcaacttgaaactgtcaaagtctaagacttagacttttggggatacctagatattgagtcagggatcagatctggtgattggctaattacttacaacacacagcaagatctctatgtaggctcacattactttccataaatatttacgtttgtatccacattaatgagagatgagcagatccgtatttaccttgtgcgtgtgtacggtagtatgaatggaggccagaggtcgatgtccaatgtcttgcataggtgctctctactatatttttgagacaaggagttttaatgtcactcgagcctgctgattgggtagactagctggcatataaaccccagggatttgcctatctctgtccagtcagttctagtattgtaggcacataccactgtgcctgggttttaagtagatgctgggaaaagaaactcaggtccaaatttgacaagtactttatgaacagctcccttgtgcacattttgatgtcaagtgatgttatgggttaattgccatttattttgccattagtgctataaaatgcttttaaagcatgtttactagtttctcttccattcagtttctttagggtttttgggagtttttttgggttttggttttttgtttgtttgtttgttgtttgtttgtttgttttagttttttgccaatttaaagaattcctaattggttttgtttttatttttttattaaatttacttgttttatatgtagatgttttttcttcatgtgtgtatgttgtcacatgcatgtttgatgcttttagagatcaaaagacatcagatcccacagaactggagttactggtgtttgtgagataacatgtgggtgctgggaattgaacctgggtcctctgcaagagcaacaggtgctcctaaccaaggagccatcgttccaaacctaaagaattatttcttttctaagcatgcttgcctttttcgtgtatttgcaaatgtttctccaaaaagtgcttgtttaattttgtttatagtgtttgattattttacttgttgatttaaaagaagaagaagatgagctaggatctgaaagattaccgggtggccaaacctagagcagttggaacagccaactaaagtaatattggattataacaccaagtgtaccagaatatgtgactacacatagcttacaaaggacaatgaaggaaagaagcagagctctcaggaatgctgagcactctgtaagcacactccccctcttcacatgagcaccctccaatatgtgataagaaaggcatttcacctctgatacacttctctccacccctaaaacaataaaggaacataatccttacatacagaagacaaaacgatcggacagtacccaagttgaggaacattataaaatccttcaccagggttttaaaattatctatgaaaaaaaataaggaactgtcacccaagatgtaaattctgaggaaaattgatgaggtatgcacaatttctcatatttgcaacttatatataaatataaaataaaaccttatgtttcatggtgctccttgaagaaattgtcacttaatttctgtgcttccacagcactgtgtgcatggcacttggcaccataatttttttaaagttgtctttagttaaacctaaaaataaaataaaaccacgagtttacgctattagaagctaagattttcttttttctttttttaaaaaagatttatttattttatatatctgaatacactgtcacagtctttagacacaccagaggagggcatcagatcccattataaggtggttgtgagccaccatgtggttgctgggaattgaactcaggacctctggaagagcagtcagtgctcttaactgctgagccatctctcccacctagaagttaagattttcaatcattagataatacacttattatataataaggttattagacaacaagttattagttctttttattttttaaagatttgttttatatatgtgaatacactgtagctgtcttcagacacaccagaagagggcatcagatcccattacagatggttgtgagccaccatgtggttgctgggaattgaactcaggacctctggaagagcagccagtgctcttaaccgctgagccatctctccagccccaagttattagttctaatatgtaattttgctgctgtgattattttaccaaatgagttctttctgtctggaaataaatagtgaaatatttatatattatattttactgatatccgagatttgtctcagaatcaaccaagtagcagtccaagtcatctctgtctaatatgatctgattaatcattatcttggcctctcaaattagaccattcaaaaatgctggtcccaagaaggaactgctgttgtttagatactcctactatagaaacccaccctgatcttaaattttaagatattcaccaacaatacctgttgttcctgtaatccaaggttacattaaagaaaacctcaagagacttatgaagtagggaaaataatgaggtcagtgactgggccccccttcaagacctttgggaatggggctatagatgggccccatctcaagactataggtaaaacaaaatttggtagtgtgctacattttttacagaagggttcatatttttaatatttgaaattttctgtagttatgttttttagtaaatgaaattacacaatgttttaacttttacattatcttatccctaaatcatatctctaaagcatttttggttctttaccacattaacacacttatttgcttcatctcactagtttagctatatagcataagtgtaagtgtgaaaagcaggcttgtctttcattgcatttagtttctcctttgcttatatacttactcaggtacaaaatcaaaaggctaagttctaaagtaatttgaaatagctcccctttctggttataccacagactgatgtggatcaattagatttatttgggattttgtttgttgcatcactgcagtgttttgagacaatgtcttactacatagttctggttgtcctggaagtctgtatgttggccaggctggcctcatactcatacagatctgcccgactcctacgtgctgagatttaggacatgtgtccccacacccacccagttgtttagttaaaaattttattgacataatatgtagtttcacatgtagctgtaaaaagtaaggtagatggctaaaattctgcaaaagttgtataatgttacagcaagactactgataattgatacaatctaggaatcttatttagatgtctgtatccatttgtttgtaattaaagggattatctctttttttttctgttgtttttagtttattaaaatgtttacacggctacacagtcaaatttaggattagggcttcagaaagatttagttttcatcccatcagccccttacttccttgccctcatggaaactttttaagatttattttgtttttctgttatgtttaatatgtgtatacatatatatgaaaataactgttttctagtccacccctacacgttgtcgcatactttcttccatctaaaccttgagttttgtatttttaagaatgtggaaagcagctgggcgtggtggcgcacgcctttgatcccagcactcgggaggcagaggcaggcggatttctgagttcgaggccagcctggtctacaaagtgagttccaggacagccagggctatacagagaaaccctgtctcgaaaaaccaaataaaataaaataaaataaaataaaaaataaaaaagaacgtggaaagcactgaaggattccatagtagtagctagacattttccttcctatttatatctgcttagctgcttagtaccccatttataatacaaactagtcatcaaacatttcctctgttggtagatatttggattgtttccaattttattctattatataaataacattatgcaggcttcatttcatactgctgcaaatgtcaaatattaacctactagcattctatgaaaatgtaagctttgattttacattgtgatgaaagtcctgagctgaacctcagtcatattagctcatttccctcattataaaacagttgtacttatgtgtatatatctggagaaggatggttatagataaattattatgtattttattgaccttatccatatctgtgggattgactaacatgttgttaattacagtgggtttcttatcaccatatgattgctgaatccaagaaaaatgtaatgcttgccgttggatactttaaatgttcacagtatcattggatcttagtaaaagtatgtgtgtgcgtgcttgcatgtacacacacacacacacacacacatgcacacacacacacatgcacacacacagccaaactctttaaaagtactgcttgtcctgagtctcaagcataccattcgggcaacaagagaatgaatcacaagatcttgatgggtcttttaatgtatagcaaggagtcaggattttattctaaagatgtgattctatcacaaggtgtttattctcaaacagtcatttaatgatttgtttgtctgttttattaattaagttatttatttactttacatgtcattttaaaaagactttttaaaaaacaatgtgtcatgaggaacgtatttggatttagggagaattatgaaataatccaagtagttaagtatgtatattacaatgataatcaaggtagatgaatgtcaacagacagcaaaagaagcaaatacagtttaaaagtacttagaaattagaaaaagcagggcttgatgattggataaaggtagttaggaatgaggaggaaccaaagttgagtctccatccctgacttgagcacttgatatgagataacgcctttgaatagcttaggcagtcctagaagtaagtgataaaatacaatttgaatatgttgacctgtctatgagacacccaaatggcagtgctaaccacatggattaggaaggtagagatcttgggtagaaacagatttacaagtggccattatagaagcaataatactgagacttggaaggatgggtaaccaggagtttgctgggtggtagcagcagggatgaagtctacaaacttaagcaaaattataaaaatatggcaatctcatgaaatttggagaagatacacagaatgaggctaggtctgatgcatattggggacagggaagatcacagaatccaaagttaatactcccttctgggaagtggagaggggcatctttctattaactttgctttagaaagatcaaccttgcctgtttacataaaagggcttgtacttgcctctcaagcaggttccctagtttccagctctcatgatcttgaatcataaatacctttaagtatctctttagattccaaatacagagagaaaatactaatagctttatatgattgtctcacgtcccacctcttttttctttcctaccatgtagtgccctaagctatgtacctggcctactatggatagactgctttgaatccagaatattttctttgttaatccagagcaaatcaaagcccactgttgtttccatagtgggatggatggataaatttaatagactgtgggtggcagattgatcacatttgtgggaaaggagataagcattacagccaggatagcaaacatgcagaatggccagaaatgtgaggcagggtatgtgcctgaggcatttctaataatgctaggtcttgctttgaagtaaaatataagatgagagcatgactggtgataagtttgaacatgtaataataaaaccatcagtaatgtgtacattacttcatgctgcactttctattttattgccttttaaggcttcttaataattgactaactttaacggcagtgtccattttgtagttaaaaacaacctgaaacataaagttgcagcttgctcaagtttacaacactatgtgctgcagccagacttctaatttaagcagtttgattgtagggttccactcagaattactctgctaagtctatgtcttttgattccatattactaaggtctttaacccatatattcatcaagtacttatagaatgcatgcagtgtaccaggcactgttctaagtgctacagatttagcagtgagccagtctaagttcataaacacatggacttagtattctagtggaagagactaataggtatatattactaaaaataagtactgaatgtgccattacaagggacaccaggtgagaaatagggaatgctgagcgttagagagtactgcttcagataggacattcatgaaagccctgtctcaggaagctacctttaatcagatgtaaagctccactgcagaggtgatagagcacattagaataattttaccaaagtaataatataaccagatttatacatgagagagagagagagagagacctctaaattcagtatgaaaatcagtagtagacacttgaaacaagtcagtgagtaaccccgtgcaaaatacaatttggagctcagcttcttcactgagagggccgaaaagctcatgcaggggagaggaaaccagagtcaagcccatgaatgaagttaagacaggtggcgatcctgagcctgctctaatggctgagaaagactctgaccatcagatgtgaaggagtaattcaaagggtcagaaggagaaaacaaaatctctgcttagtattcaaattaaaacattaaaagttccatggcaaagccaacatcataaaactctctgcatggaaaatgtgaatatatatatattagaaaaaggaattctgaagtcttcaaacatttgagctcaagaaaataaagataatataaaaggggactttgaaggaataacaaccacagaacaagaggctgttctatttggtaaatgttgaaaaagccttaggagtgtgtgtggtatgtgtgcacacatgtgtgcgtctgtctctgtctttggaactcaatatgagccagttgaaaggtagcattgaataaccaatagagaacaaagaacagttagctagaaatcttaaattaagtataaaagagaaactgagaaccatgaaggccaattggagaatatctgacatgctttaggaacagtaattctgtaaggagagcatagaggaatgatgaaagggaaagaaaggccttattaaaggaacaatagccaaaaatggtcccaacttaaagaaacactagctttacagaataaactttgggaatagatattacttgtagacttgggtcttttgcatttgcgctgattatagaacacagagctctatattattgtatattatatataatttattattttattctatattattacatatataatattatacatactgttgtccattacaagccaccttatgagcctgtctcccatcacaggtagaatatataggagtcactcactaccattgacacagggtatcttctatacattggcacctcagtttctactttgcctggtcataaaatgaagtgaaatagatgagtagtccaatcagtgagctaaatattgtcttcattgtcatagtcataaatgctatttagtatagagccacaggattagagattaagatctcagaatcccagagcccattgcttacattcaatttcttactgtactactttgtagctatgtgaccttgaacaagttacataacatttgtatgtacacatggtgggactcatggctctagctgcgtatgtagcagaggatggcttagtcagtcatcagtgggaggagaggcccttggtcctgtgaaggttctatgccccagtatagggaatgccaggaccaggaatgggagtgagtgggttggggagcaggggaaggtggggggaagggataggggaacatttgaaacatttgaaatgtaaataaatgtaaacaaagaaaatatctaataaaaattttttttaaattttaaaaagcttcaatttgttcacctgcaaaataatatctgtctctagtatgtttatggggattaaattaatacttacaaacgatttaaaatggtgcttgccatgtagttaaatgctcagtaaatctttggtattagctattaacatagctgcttttaacaggaacatatagtattttaatcctgaaggagtaactaatataaaaatcatagtatataaggataataaacttaggtttctgcgtgttcctgtaatacacaaaggatcagtttagttaactgctggattttatttgtccatgtaaacagttttgtcactgtttgaaaattggccttgatactatttgaacattcaagggttcatattttttctttataatgtctgaaatctgaaactttgaaataatttacaagcatataaaatgtcctcctcaggaaaaagcagtggttgttttgttcttgcttaattaagacagttaagttttaagcacataccaatgtttgcacctgtttttgtttatatttgtatacctataggtttataactaccagccattaacatttcattttagctaggaaatgcctagaagtaagaattaaaccagctggtttgattttaatatgcaaattacagtcaaacaaaaacagaaaaccaataattaactgcatgattattttgtaatctttgttacatttgttcaaggtgagatcattttccaaattggcctactctcctcatctgcaggggcacatcaaagcctagcatgattgttttcagtcctttaaatgtttataaaacagattgacagaagacatcccaaaagtagaaactgtcagagaaaggtgctaaatccttaattctacaaatactgtgaggaacctgtgtgctttccattactttttctatccaggagctttgtgtttagtgttggcaataccaagagggaaaccctatttctatggttaaacgggcaagaggatttatagatatttaatattacacacatgtactcacctacaaaagctgtaagaattgaggggtctggggagatagtgtctgctttaaacataatgtgaaaaagtcggtgcggttgcacatatctgtaagcagaggtggggacaagtggatctttttaactctctggccagccagtgtagctgaatctatgagctccagattgaatgcagaccctgtctcaaaaaacaaggtagaaagacatcaggaaaaagacattgaacattgttctctggcctccatacatgtgcacgcagtctctctgtctctctctctctctctttctctctctctctctctctctctctctctctctcttgaatggcagaccgtgtctcacacacgtacgcatgtatgcatgttctcacttccacatgaacacagactttagatgagattggaagcaatcaggtgcattgattgtgatcagtttgatgtggcaggggtttttcccaagctctcacaagggtgtgcaggactagaacggactccttaagaaatttgaaatccgtttaaactagatgagctagtatacacaatggatgaagaattgtgtgttacagtatttatgcaattttatcttagaaataatgatggtaaaaaaaaatagaggctttctagaaaggagagactaaaagaccttggactttagacactgttgtgtgcatgtgtaagtgttctggttaaaatctaaagatagattggaaataatggtagcttggaaacttgacttacctagtgagttccaggcccgcctggacttgtgagaccttgtctcaaaaacaagttctttggttgactatttgtcattgatacctagaggttggggacataggtattcaactgtggggattagtgagatcactaagtgaacagccaagttactatgtatgtatgaacaggactgtagctcccgtctgtcttactttttgactaggaagttcgcagaactttagagaggtatgggaacagctaatacttcggaggtctgctgctaatattttaagatgctctacagtcccttgaaagaattttgaatttggcttggtttttgttttttatccactaggaggcaccattatcaaacagttctaatgaggcgatgtgaggaatacaagaattccaagtctctttaaaactctgtttgcaatttgtcaaggcatgtagaacttagtgtctgtctctctctctctctctgtctctctctgtctctctctgtctctgtctctctctctctctttctctctgtctctctctctctccagtgttgccctatgtggcctttgtctcttgagttccagatttggagttgtataccaccacactcagccttgtagaatatgtttagcaatttgtaagtttaatggatgtgttcaatatccccagtccaaaaaaatccaaaataccccaaaatcataaaattttttgagtggcaaagtggcaaaggcaaagtaaaagcataggtggaaaaatgtacaccttatcatgtaatagatgacagtaagatgtaaatattacatgtaactatttagaaaactgccttcagtttatatatatgtgtgtgtatatatatatgtgtgtgtgtgtgtgtatatatatatattccatccttttaatataacacataaataaatgtatgtcctcccctgtttcccttcagacagggatgccagttgaacatgacataacaagttaaaataagactaggaacaaaccttcatattacggctggacaaagcaacccagtaaaaggagaaaatggttcccaaagcaggcaagagtcagagacagccctgactcccactgttaagacttccataagaacaccaagctacacaaccataacataaattcacaggacataacataaattcagacacatgtaggtttcctgatagctgcttcagtctctgtgacctcctatgaatcttagttacgtctgtggaccatgatcttgtgatgtccttgacccttctggctcctacaatccttcctctccttcttttgaagctctgcctaatgtttagctgtgggtctctctgatgacaattatgctaggctccctgtacaagtatagcagaatatcattaagaatccgttttattggctctttgttttttgtttgtttgtgccagccatgtttggatctgccctagttctctggtgtctgctcctccaggcagggtcaggcatgggctccctctcgtggcacgggctaggagtcttcactagggtcatcctcttcgattctagggaggttctattgccttacatgtctacattaccccctaaagtgccccccaatttaagtcatctctcagtactttctccctccactcctgacctgatccctcatattcccaaccccagttcatcctcgaaatcgattctatttccccttcccagagagagccatgcgttcgcccttgagccttccttgttacttaacctctgcaaatctgggttgtagcatggtcatcctttgctttacagctaatatgtacttatgagtgagtgcataccatgtttgtctttctgagtcagggttacctcaatcaggatgattttcttttctagttccatccttttgccggcgaattttatgatgttatttttttaacagctgagttgtgtaaataaaccacattttctttttccattatttgtttgcaggatgtttctgactatggtgtgtcctctcagtatatacccaggagtagtagatcaatccccaattttctttttttcttttggttttttttttttgttgtttgtttgtttggttggttggtttttttgtttgttttttttttgttttgttttgttttgtttttttgttttgttttgtttttttgagacagggtttctctatagccctggctgtcctggaactcactctgtaggccaggctggcctcgaactcagaaatctgcctgcctctgcctcctgattgctgggattaaaggcatgtgccaccacggccaattttctgagaaatggctgtctgtattgctttccaaagtggctgtacacgttttcacccccagccgcaatggtggagtgttcccctttgctccgcagcagcaggagctgccacttgtgcttttaacataagccattctggcagatgcaagatggaatctcaaagtcgttttgatttgtatttccttgaatggctaaagatgttgagcatttcgatttaaaatgggatgaggaactgtgggaaggcgaactgggatgggggtaaatgactggactataaaaaataaaacaaaatcttaagaaaaaccatctatccagctgttttgtaagggctactgtagtactgtcctgaaggagtcttttcacatttttaaatgattagacctgatttcatgtgataaatgcctgtttgtttatgaaaaaggaaaataaagcaaagtgtttcaaaaaccatcttatttatcaactgtttaatactcttactatccagcaacttctgcatctctgcaaacagatatagatatctgttgctgtgtcttcttaaattatgaacatctctttatgtcaataaatatatagcatcatttaatattctccactatgagtttgccacaattcatatgcacactcttctattactgacatttaagttgcttccaacttcctattataaataattataataaacccttagcattaaaactgggagatagccctaatttttcctttagaataaaattcaataagtcccaagcaacatgtgtatattttaaagcatttgacaagcactataaagttgtccttcagaaaggttatattgattattgatgtgtttttccatgaacaatgagtttgataactaaagaaaagtttccccaatgccaagttgtatatatgtgtatgtgtctgagtgtctatgtgtgtgtatgtgtgtctttgtatgtctgttacatggattgccatcttcttacactggaagattaaactatgtcccagcatattcaaatgtagttctacaatatactatgtataccaggttggcctatgactaggggcaatctatctgcatctgcttcttgaattttggaattaaaggtgtatactaccacacccatgttgatccctcaattttatacaagttttgacacttatttttttatttttaatgttagaaatattttctaattatcattgtgagttttttcttgattgataagttactgagtatacattcttcaattaacaagttttagaaagactttgttaatgcttcattaatttacatctaacacaatttatgatcaggaaacataccctgaatgcttgcttttgctgaaatttctaggtttatctttatgtacataattaataataataagcttttagtggtttcctgtgctacaagcatgttacacaagaaagtactctatacccagttttcaaaatgcagctgtttcgtgctaacaaggggtatttcttcaggacctttggcagactcttcagacatctaccaagcaagagttcagtctctcctcttagatctccctggtggaaaagcatcaggactgtgccatttcatagttccacaatagtgtcctcccacagctgcctcctttgtatagctcgctgtctgcatgcctcctcccccaccaaggcagaagcagctcttcttgttctctcttgtctttgagctctcatcatccatcccctgttctcaagagattgtttcccactctctgtgctgcttgttctttgaaaatgtaaactattatttttctaatttctaataggttgtatagttgttttgttatctttagaaaaaatgctggtcagagaaatttgtctgtcctttataacagtgttcctcaaagaatcatttgcatacaaatgccaatataccatctgttacatgttggtctgctgtgagatagatacagaaactgagtgtagacatgtagaaaattgctgttgcaatttgacattatgacagaatcatgatatatgatgctgtgctttcagctcagagtcatccttaggccagattggcagaattgggtgtggcatattctcatccctttcaacatgcacacaatcagaccttgtagtttcatacctataacctattttgtttgtttaatacatgtattttggctcatttttctaattcttgattcataaaggatttctactccctcacacttcactttctcagagtagagacaactaagagaataggagaatacaagatgtgctttttgaagattcctgacaactgaataaacacccaaagatggaaaaccaaagagaagagcagcaaattaggccttctcactgttttttacaagtattgaattttcaaatgatctatcgagggacataaatcaattttgtgtaaaatgttcaaggttattatataaggattgtatatatcatgaatatgtataaattaaatttttgttgaatgaaatttgcataaataacaatagttttagtttttaattctgtacctaataaaatttaaaattagtgcattgcttttagttaataccaattaatgttataaataatcaaatggctttaacagtagaaaggtactttcatggtcattattctttcagagtaatccttcctaaaacatgctacatattttaaaagttacacctgtggttttttcagtgctcctggttataaatccctgaatttaaaaagatagaatgttcaacatacctcatttttaataagtaaaacaccagagctagggatggagtttggtagtagagtgcttgcctagcatgtgtaaggccttgggttctctcctcagcactacagtcaaaaagaaaggaaggaaggaaggaaggaaggaaggaaggaaggaaggaaggaagaaaaaggtaactatttatatagagatataatacctatgcataaaactgaatcagtctttggaatcagtatagaaaaaacttaaaactgtaatttagagatgtgaaaagaagtaaaagatacgtcattcagagatttaaaaatattagaaaatattaaattctagaagttaatatataactaattccatcttagctaaaatataaagatactttacattacacaaaattgttttaatgttcaactggagtaaaatgttcttaatgatactatgaaattttttatttttaagttattttatttatttatattctagttgttactcccctcagtcccccctcccacagttcttcaatccattcctccttccctttgcctctgaaagggtgctccccactatcagaagccttccctttccctggggcctcaagtctcttgataattaagtatatcttctcccactgaggcctgaccaggcagacctttgctatatatgtgctaggggcctcagaccagcctgtgtgtgctcctggttgatggcttagtctctgggagctccctgagggcctgggttagctgagtcttctgatcttcctttagggctgctttccccttcagcttcttcaatccttccccttattcaaccataggggtccccgacttcagtctaatggttggatgtaagtgcctctgtctcattcagctgctggtagggcctctcagaggacagccatgctaggctcctgtctgtaaacacatcattgagtcagtaatagtgtcaggccttggtgtcccaccatgagatggatcacaagttgggctggtcactggaccacttttccttcagtttcttctccatttttgtccctgcaattttttaaaattaggtatttatttcatttacatttccaatgctatcccaaaagtcccccacacgctcccccacccactcccccaaccacccactcccactgcaattcttttagacaggaacaattctgggtcaggaattttgactattggttggtaaccctgtccctccacttgaggcccttttatctactggaggtggactcttccagttacttctccccaatgttgagcattttatctaaggtcccctccctttgagtcctgagagtctctaatttccctggtacattctagaagattccctaacccccatgccctgaggctgcttacttcccttcattctcttgtccctctggatttccctcctgtcccccaccccatatctgatcctgttcccccttacccctctccttctactctcccacccaggttcctctctccctctgcctctcatgattattttcttcccccttctaagtggggttgaagaattctcacttgagccttctgcttgataaactttttacagtctgtgagttgtactctgtaattttaggctgatatccatctatcagtgagtacatacatgcatgtccttttgggtctgggttacctcacttaggatgatattttctagttccatccacttgcctacaaaattcatgttgtctttgtttttcatagctgaatagtattccattgtgtaaatgaacctcattttctgtattcattcttcagttgagggacatcagggttgcttccagttaccggctaatacgaataaggctgccatgaacatggtggagtgcgtgtccttgtggtacaatggggcatcttttggttatatgcctaggagttatggtgtagctgtgtcttcaggtagaaaattgtataatactagatacaagaatagaccagtcagtggaagggagcagaaaccaaaggggggaagtatctatatgctgtatgagcatgtgtacagattgccattggagatactagtatttcagatatgtccagaaagaaacagatttatccgttccaataactatagttatgtcagaacatggtcccctacttacactttgaccttgttattactttgccatatcccctccaccatctcctttcccctctcttgccctggatccatctcataagttttcctttagatctcaagacagattcaaatttttattactgtattatgcaacctatttggctttctcctccacccaattttttgagtagtacttatccttaaatttcagtaaaaagggaaaatacctaaatagaagaaatccctcactatgagatttttatttttattttttagtcctcatacatcaacctacttaaaactgtagccagttttaaaagtagcattttcattccaccataaaaagaaataaagagaatactcagcttttctagtaatcaaggaaatataaattaaagcaagcataaatgactcttttcctcctttctggcaaagatgaaaagaggagtcattgtgagggcacgggagaggaaagggcacattcacacacagcaacgtcagtacgattggtaagatgtgtctggcaatatggattgcaaaagcattattgcaagtaacttgacctagaaacttccactccagaatgctcctctagcacatgatcagaattgttcacacaccatgtgagccttgaatacatcggggaattaaaaaaaaaaaaactcaacagtattttcataatgaacattttgaagaatttgatttcacactgaaaaaatgtccaagaagtatggcatgtaaaagccttatataaatatggaaatgcttcatttgcataaagccacactgagaaccaaatgatacaggtaaaagttctgtgtgctaggcattctgcagagtattgaattagactgtgttgaaagtataaactgatttttaggactttatactcttgggttgttataggatgtgatggtgtacacgtgctctttgcataccatatatttatatatgtgtaatccttcgggaaagcaataaacacaaccagatagatttaaagcagtggacacagccaggtagatttgagtccccatcactttatgcaataactagatttacttgagaatcaaaaatgttgactttatggagtgcttagctgtaagtatgaaaagagacctgacagactgcttctcatggaatctcataatatcatgtgtaggtcccttgaatttgcattttgggagtttttgtgttacctgcaataattatttgaaaactaacctaagtgaatttcaaaatatcttataagccttaaagcattatgaaaatgtttactgctaatatttgaatgaaattttaatgaaagtaatcttatatgactgtcatatatctgcatatttgtgtgtgcttaggttgcataaagcctaaatgttacaatgcaaactgtagcttgttagcagttaaaaactgttaaggactgagggagttttctttatagatgggaatggaagggaattttgaattaatgcaggcttaaatatgaaacgtggtatatacagaagcatatgcctggtaaagataaagaaaatggcacattaagaaagtactaacagaaaggaggcccgctcttttctgaaaaggaaatggagggggagtggacctacagagatggtaggggcagagtggctaggaggagtggagggagggagtggaaacttgttgggatgtattgtatgaaagaagaatctattttcaataaaaaataaagaaagcaataagatcagtctatgtacagtttgattttcttaaaaatgtcattggatagattaggtcaaagtgatctgacctgccagataagaaattagaaataacttacattctatggcaatgtagtaacaggttattaccaacacattagtgtaagaatatgtctgcagtaattggaaggtaaaataaataaattctgtgctggcttatttttttttcctttcatagcatgtaacttaaatttcccacttattggtaataactgttgcaaaatattataaaaagctttgtattcttaaaatacattatttgacgtggagaatttggagatttaattcaaagcttatccccttcacctttagagttgctcccacgtgagacttattactgtgttttttgtgttacttggtacgtccgttggcttatctctcttaaagattcctttttctgtaaatattcaacagctggtttacactgaaagaagggagctttaaataatgtagtcagtagtcagctcccaacaatggtatgttcacttgaagtattgtcttggaaggttttctttgctaatattctttttcacatttctctacagtatggatggagcagatctgtgttttgaaatcgtaaagcgagctgatgctggttttgtatacagtgaagctgtagccaggtatgtaactgcatctaatccccagaagtaaagtgggaagtaaaagaaggaaatgaccaagaaatcacaggaagtagccagctcttctgtctgcaagcacacacactgctagcatctctgcaaatgacatagatgcttcagtatgtgtggtagcagctggacaatggatggaagtgtgtaatcaatggcaaacattggatctattaacattttgcatacaaatgcttctattttactgattcctggtgcctttctacaaagaggggtctgtcagcccaggaattaagcttgagggttttatatgaagctcagcctcatcagattgtgccttattagttctttgctttgcttctttgagatatcagattattatgtgaccagttaatctaagaaaagcacaaaagagtaagaggagcaaaaataaaagcaccattttcctgttgaatatattgcttcaggccactatgtggtctctcaaccaagccatgactattttactaagtggggcagtaaacataaaaactgaatgactccaaagaaaagtaaatatggaaaattatggtagccatgaatgcattacaccactaacttacagacatgaagcaatgcagctttctgctttgggttgtattcagtcacagcgtaattatgcactggcaggttaccgatttgatacgtgagatggagcatcccttcctttctccctccatcagtcactgaccacagtatggtgaagggcttacactcacaaacctacaatgatcgataaaatgttttgtcagttgaaaaacagtcacatcgagtgattataacgtccctgtcattccttttataactataccaccctgggacatagttggaaacaaccaggcaactaccttaatacattttttagccccatgtagattggctgaggatcaaaggctctggtgtcaaggatgaagtggatgtaactgtcgcacagaataaaaatatcctcagtgtgggatagtcgcttttttagatatcctcttggatctgggagaaagaagcaaaggaaagcgtaatatgttcactgcactacttgcttgtatcactgccatatggcagaatgaaagccaagcatcttctttacttgtatatcatgctttctgaagcatgtttttaggttccacttctctattttgagcttatatcacaatttttaaattgtcattcttgattgtgcttccaaagtaaaaagcatgctctaaaactccaaactgtcagtattatctggattttctgtggcattgttgtgagacacctcctcaaagtaaattgaattcagacttttgcatacacacacatttcttacttctgtaagaagaaacttctgtacgttttcttaccatcaaacaccgacctggacctagaacctctcacatgcccatcaggtgctcctatcccctttttcatacagttattataaataatagaaagtaagaaaaatccaaatttcagaattttcattcttcaaacttccttaatgaggggaagtgatttgttgtcgatatttttttttcctttttgaaaaacattagcactggaacaactggcatacatggtggccaccacgtttcctcacatttccagtttgtggtgacttttctgagttttcctttaacttccttcctagctctacagttggcctggatctcagcatagacatgaccaggtgatgtcatgcagtaattgccatctgggctctctcatcttgagacttaccaaaaaggttaatgtttgtgtatatatcaggatgaaagcttattgattttttttttaaagactcacttagatttgctgttaaaatggttttatgaaaggaattcatcagaatggagtgggaccagtaagtgacattattcagagagcggtttgaacatgctttattgaagtctttccttcctaacaatgaaaatggaagcagggagactcaggtaccattcattattatctgtgttccctcttacaccagatcaataactcttagtggtggggagtgtgtggccaggtaacttcgaatttttccttttttctctccggttctatgattttctgttaggaaattcagcttgtgtgggtattctactgagtgcaactgcaagacttagagactcaatcaaatggctaaagctgtttttatttcaagaagaatagcaaaacatggcacaaagcacagatatgtataatgcttatttaatacagaataacacagcccagctaatgatagtccctgttcttcctttgtggaataagttaacataaggtcatcaactccaacttttaaaatcagagttatatcttccctagtagcaagctttcctaatgatgtgaagtttgaagacaaccagaaggcccatctgaagccctgaactaacaagggctccccatatcacttcttcccacattaactaactagcaatacacctgatccagaacaaattctctacttagggcaagtgggattccacgaatttcagggagcatttcaattatgaaacattgttttatactgagactgttggttggcttacatttctattctccctgaagctggccatgtctgcttctatttaccatagataatatttagctgggaacatttcagcaaatatttagaggggttttaacccatttttgaccacaggaggaagctgagtcatctctctttgtcatcaaaaacatctcctagagaaagtaaatggactattggacagttgtttctttgtatagaattatcatttttcctgattcttttttttcatttctttttttaattagatattgtctttatttacatgtcaaatgttatcccctttcctagtttcccctccaaaaaccacctgtcctttaacccctccccctgctccccaacccacccactcccattcctggtcctggcattcccctatactgaggcatagaaccttcacaggaccaagggcctcccctcccattgatgaccgtctaggccatcctctgctacatatgcagctagagacacgagtctcaccatgtgttttctttgattggtggtttagacccagggagctctggggttactggttagttcatattattcctcctatggggctgcaaaccccttcagctccttaggtactttctctagcttcttcattggggacactgtgctccgtccagtggatggctatgagcatccactttttatttgtcaggcactggcagagcctctcaggagacagctatatcaggctcttgtcagcaagctcttgttgacatctgcaatagtgtttgagtttggttgtttatgggatggatggaagtaaatatatacattgctgaggttctctgaaaaaattaactgtgattattcatgaaatgacttatatgacataaagattctgctgtgtttgcatatttgaatcaaataataaagtaccccattttctagtggctgagaattaaatctacagctttttgcttattaaataaatcttctgtcactgagcttcattcagccaaataatgaaatacaatgatattcacactttaaaatgcccagccacggagttttctttggatttttaagactagaaaatgggaattttcttttcgctgaagataatttaggtgactagctcagtactatgtatccaaaatagtctgttatgtaggtacatgtccactttgcttaatttaaaccctccattttgacatctcgattgacatttgagactttgactgagcttaataataatgttataataatggtgacttcagtacaggtttcaaaccatcatgatacttgttattagccatttcaggtgatcacagttcctccaagatctactttgaatgaccaaaagtccccaatgctaggttaaatctaccctgatttaaacaaaacttaattatagtctacactggcacagacaaagcccttacatgtccattctcaatggatcatcacactaagaactgcttagggcccaggtatgaggagatgatctatgtagaaaaaagggttgctttgctttaagtttggaggatattctcctctacctcttatttttaagggaaacttgtaatccattataatacataaaataatctatatcttgactagatggatgtttgtatgagcatgttagacagtagtgtaccaaagaggaaccttgatagaaatctttcagttaatttgtcgaaagttataaatacattggtaaggtcttctatgagtactctattttaaactgtaagtttaaattagtgtaagaaatatactgtctgaaagtacaaccaagttcaataaaatggtgaaatagagcatttctatactatggctgcttgagatgaaaagagaggacatccatgtcttgccttagtttgacttacaagttttatactttgtgatggcattaaaaagatgtgcagtcagtagacactacacttccaagttttgctgggctattaatgtgtacacactatgatgtagctaatgttagtgttttgagaatgcttaaagcaaaatgcaaactaagcttagactctcatattcagtaacatgttaggggtgtgtttgatgcactttcaccttgccatattttcagcttcagatgtgttcatccagatataaacccataataacagaagaacatttatattcctgttataatctgttgctagttgaccctgtcagaacttttaaaaaacattaattccttctttgttcttttcttgtacccagtggaaaactctgcagtccccagctgtcaaacaataactttgctttattcaagagtgccctcaaataaagcctgattatgttgcaaaaagaaaccacatttgattaggttctgtaggttcctctcatggtcaaatggaaaccaagcagagagctggtttgagtggcagacaaaaggctacaactcctttggtcagaataattccaatagctccaagcggtttctttcatagaaatatagtttagctaaatagaggtagccaaggtttcggttttgttttgtttttttaaaatattttaggcttgctcctttagtgtgtatagcaatgttgtttattaaattatgtggaattcttttttgacttggctcagaagaacattctgtttcttaaagaagcatataagtttggcaaaatttttattaagtctcactgacttatctactcaaatgaaagctatttgtggctagctaatataaagataggagttataaagcagagaagctgtgtattaatttttgacaatggaagttctttacagttttaaatttctcttgtattttacagccactacatgagacagatactggaagctctgcgctactgtcatgataataacataattcacagggacgtgaaggtaagtattttttctcactaactttaatgtttctgaaagggaactagataataataatgacaacaacaacaaccaggaattttctttaatatagagagcatcttaaactttatttgaaaataaaaaataatttatctgctttatattgagtcattgtactaatttttaacaggaacactgtgatttcagtttccttacttttccctaaaagatgtgtgcaaactaatgtttttcctcttttgccatcagaggaaaagaatcacaaagccagtaaaaaagggaaacaaaactatttttttaattaaccaaatgcttaaatttatcacttatttttctataacttttcttcaaccagatttctgtctttcaagtaaagctgaaggattgtaaactgaaagaaataagagacgagaatagtgccaaagtaacagacacccctaatcaaaagcatttatcacacaagtgagaaagttgctttagaatcagaatcattttcatggtctttgctgactcaccactactttacagcatcattgctatttgctaagtagtaaaacacagtgtcacaaaagataggaattatgaaagaagccagttcattccagtaagttaccttccaacttcttacacgcatacctatcagcataaaataattaaaaatgatgcctaagactagaagaaacttagtgtaggttatgaatcaaattaaagagaatagaaccagtagggttaaaaaaaatcctctcactaaaagtcgttacgaaaataagaatattttaaaatgaaaatagaatcaaaactctagtagtacaaactagcctgaatagtttgataaatgggggattcagttaactgtcactgtactttgacaagtggatgccattttaacatttcatgttaaagtggcacatggatgtaactgcataaaggacaactgctatattttgataggactcaactagttaccttatatccaagaaataaaatatagtttactttaataactgtctgcatatgcacagactctgtaatccaagcctgtggtggtttgctgcacagtccttaacagttatttttaatgctttgctgtaaagctttgaccctatggtgttcatagcactctaattgccctccagtatgcaccttattctctgagcactaagttgttagattatgagaatcgaaggtaactaaaccacccatgaactacagtgatattaaaatagatagtattgttctggttaggtctttctttgtttgaaatgcattgtaaagtcttaaatagaggaattcctatagccagatttctgtaaccttcaaagattttcccattaatcacaatgctggtgtcatcactaccttcccttttctgttcacctagttgtggaagaaattggcaataataagaattctcatttggcctactattaaaatgatagcaaactctttctgatatcattttcaacttgcatttctgaggatggtttcatccagtctgctcagtaaacatacctcaggagcaagattttcttgtaatggcagatccctcatgaaagcttattatgtcctctttggagaagatatactctttatcctcaagagtcttttaatgccagcagtaaaaaggctggtatccttggaataccacagtcaagggtagtctgtgagccaggactgaaagctctgggtctgtggcattagggacttgagcccaaggaggaagtgaatgataaaggaagtgctatcagtaagcacttgttggcatccacaacagtgtctgggtttggtgactgtatatgggatggatccgcaggtggggcagtctctggatggtcattccttcagtctctgctctacagtttgtttctgtgactcttttcatgggtattttgttcccccttctaagaaggattgaagtatccacactttattcttccttcttcttgagtttcatatggtttgtgagttgtatcttgggtattccaagcttctgggcttctggactaatatccacttatcagtgagtgtatatcatgtgtgttcttttgtgatttggttacttcacacaggatgatatactccagatccatccatttgtctaagaatttcatgaattcatgagagcatcccactactcttccctctccactcctgctgctgcccaagcccacccctcccccttctccttggtgctgtcatacagctatttttttaatatagcagggaatcatgattccaaatacaatccactttgtactcttagaatatcagtgagattgttattctttcttccttttccatccttttattgaattagtgcgaattctcagtccctgttcattgttgtcaaaaaatacagaaacaggccatgcaggagcggtgggatttcccactcaggcctagcaccttccaaggtgtttaactaccagagagtctctgaagtctgtagccgtgggatgttttcatagttagctgtgttagccctggtctatcaaaccttcagcatgcagaggtggtatttcttccttctaggcatatttttaaaggccttactctttggtatactttaaattgttaaggaaattaggtagaggttagtagtggaaattattgtagctaaaagctgagaactttcatgagcatttccaaaactgtctaattaattgtaataatagcaaatgaaaatcattgtaaaatgaacaaaaatttccattactgcaaattagttgtacaatatcttattgttcattcttttcaaatgcaggtctgatgttggtactctcataaaaacttgacactaaacaatccaatagacacataatacttttatttttaaaaatctttagttatgcatagagagtaaaaattgtacaaagctgtcttaatattctattactctggtgaatcactatgagtaaaggaactcataagagaaagcacttaattgaagacttgtttacagtttcaaaagattagtcatgagtatcatagttggaaacagtcagattctgagagtttttgcagtagctgagagctttgcatcctgattcttaggcagcaggcagagaaagagaaactgggacaggcatgggcttttgaaacctcaaagtccacccccagtgacatacttcctccaacaaggccacacttcctaatccttcccaaatagttgaccagctggtgaccaagcattcaagcatagagcagcagggtgtgtttctaggagggtggtctcacttgaaccatcataagagggaatagagggaaaagaatcaatagagttttaaaatgtatgcttctttgcatcattctgaatgaatataagtgaatatatatggagtaaaattttctccatatatacatataggacaaatattctataaaatacatccacgagctggggcctagcaaacacagaagtggatgctcagtcagctattggatggattacagggcccccaatggaggagctggaggaagtacccaaggagctgaagaggtctgcaaccctataggtgcaacaacaatatgaacaaaccagtaccccggagctcatgtctctagctgcatatgcatcaaaagatggcctagtcagccatcattgggaagagaggcccctaggtcttgcaaactttatatgccccagtacaggggaacaccagggccaagaagtgggagtgggtgggtaggggagtgggggggaggtatgggggacttttggggatagcattggaaatgtaaatgaggagaatacctaataaaaaatttttaaaaatacatccaggaaaaaatgataatctgaaagcttaaaatttgtaaaatagatcactagtttatgtaatgcaattgtgtttaaaacagtttgctcagcagttttattttgtgtgaattctgctcttcacaaaaattttgtcaatattataagaacaaaatatgactatatataataagtaattatagtaatatatttagattctgattggccatggtatttgatataatggcaagcccaaccaaataatacacaaaagtggttatatttggcttcatcttctactttagcatctgtttatatagtctacaaatatttggttgcctacttcacccagagtgtgagctctaaaagtatcaggaaagagactaagtaacatttttatcacatactgttggagtctgaccatttgtcaacactaagtgactttaaacaacagctggcatcatttgctccctattgtacagtttagttagagccatggaggaactgctcacctctgttacccagactgttggccaggatcatgggaccagctgcccaccagctcaagtaacagaaactagagagctgctaagctttttccctctgtcataattgacacctcccccactctttttatgtggccccatgtccaaaagtacagtggctcaggtcttcacagaaatggaagttagcagatgcgtaggtgcctaggtctcagttctcgtttcatgttggaccttttgcatttgattggttgtatcagattttaaaagtggaattagtctgagttccagtgaaagaaacagagctgtctttttcgggatctttttttgtttgtttgtttttcttggtttttggtttggcttgggggattcatttttgttttctaagacagggtgtgatgtttgccccagctggtcttgaactttctgtatagctgaggttgacctcctaactctaccaacccaagtgctgatattatagaaatgtgactcccaccccaccatgtctggtcagctgcaacatttttttaaagtgctacaagtatacaagggtaaaataagttgttgggtatgatctttatagacagacaaacaaattgctatagagagtggtgctaagtatcagtaaaagacagaatctaagggtttcctgaaggaaatcttgaatgagggggtaattgtatgaggacagggagatatttcacatagaagaaacagtgtgtgcaaggacctaaaagtagttttattttgggttgtgttaaattagtttctttttccgaaggacataccatgtaatttttaggaagcacttagaaacctgctgaagaaggaaatagagaagtaattctcagactgcaaatcaagaaagcactaggcaaaagcaccatactccagctgtcagtgagactcaacagagggcttacattaatgttgataccctttataccatttcaggtaccattatgttgaaggtacctgaaatatggacgttttgcatgattgaattcaatgttccacttatttaattggcgttgttgaattgggtatatttctctaaaatattcatccaaaagatatttttcaagtgcctactatgtggtagaaactgtcctaggatctggagctacaccagtgaacaagacaatcacagccctagtagagctgacagggagacagctagaagtcaatgtgcaaaaagaagtaaactggcagtttagaaactgagagaggcacttgggaggcagaggcaggtggatctctgagtccaaagttagcctggtctacagtgagttccaggttagccagggctacacagagaaaccctgtctcagagagaggggggagagagtggggagagagactgagagagggtggagaggaagagggagaggagaggagaaaggaaaagaaaagaacagttagattgtagctgtatttagaaggttgtggcaacagaatttcttaataggactttagtaacttacctaaatttagtgtgattccggtgtttattctagtgggtaatcctgcttgccagtcattgtaaaaccttcatagctgttaggtctcaggacatccatatatatccagaaatcccccaacttcacccctcacatataataccaatatatttcacatgactaattatttaaaatgtcacttgttttgttatgttaatctttgtttacttccttttaattagttaagaaaatagaaggccatgacaatactccactttcatgagggaatcttcagtttaatttgtctcgtctagctaacaattatatgtttgcattctctctctctccccctctctttcctttccctcttcctttcttctccccttcccctttcctgccttaccagattacctaaaagcagatttttatgttgattaattacatttttcttctgcttggtatctgtttccttttgaaatcataataatgaagttgaacgaggtgttttggttagatttgagtacatagtaccacgaagccacagtggaaactgctggcattggagaagcaatttctcaagaaattgcactttttaaaatggtgagtctttgcagtttagggagccgtgtcatgatgatgtaggatctcgcagcagtctactattgagattggggtttgacacttagttttgggaagctgtctaagatgttttaatatgcctaaacagtaccctgacctttgcccagtaaatgccagtataatatctccaaccctccaagttgtggcaaccaaaaacgtctcctgaggcataaaactgccctcagataacacccattgttgtaatattatattgcggtttacctccttgtagacattaattgaggtatgtatattctttttttcatccatcttcttccctttctttatcttgtaaaaagttggggaaatttccattatgatgaagtgatccccctttgtcctctcacccctgactccagagaactttggatagaatcagaccattgacaaggtcagtacagcttctagctccttggctgactcttgactctcagctcccctgaaccccaaagcatcgcctgggtttgcagagacacagcacacttcagccctctgtttctctctcactctggtacaactttagtaattgaagacaaagtaaagcagtttggcgtacagactgctggccaaacacaattactttccattctgagtggggcctggcccaggaggtttgagagctcagtatttagttctcaaaactgctagcctcaggtgcatatacactccatctaaggcctcctacctcaaggtttctgggtgtgcttcctcaatggtttcctttgtagcctttgtcatcacgcctgactgctctttggaccctttctggtctcagttctcctttcacctgctaagtgcctgactttcttataaatgtgcattctccacagttacagtaaacaatggtggccgcagcagtgtggatctcatgtagtgttccttcctcttgtgctccctcactggcatttcttttataccaactaccacaattccaaaagtccctgtgttatagttttaaagaattacttctcatcaaaaccaactcacatttaattcttttttaattgaaaatatttttcatcacaatatattctgattatggtttttcctccccatactcccagttctttcccatctcctctcccatccagacccattcctttctgtctttattataaacagctcactgataattagtacttgagaatgactttaaggtccttgagcatcttacccacattttatctgattataggctcttaatcattggactctaaaaaatttctcacaaatttttaaaggatgaatatttcttttgcttattggaaatagttccttccaatactcctcacctgagcccaggggagcatgtgtcatataaccagataggttttccatcagttataaaatgtttctgtctctagtaacttttgaaatgatatcaaagggggtaggggggaccagatggcaatccccagctttaggccacactactgaaatgctcagcaattccctttgtgtgcctgctggctttcctttcacctacttatctatcatagctcccatcctgacaggctgtaaggaagtcctcatcaaatcagaaccaagggccatcttcctctcctacccagggaagacagagttgcttcagattaaatggtgcatcttaaattttgtttgcccagtcttaatggtttaaattcctggtttataatttcacaattgccttaaggaaagagtgcatgaggaaggaagaaaagggaatcattcctgttttctatagttaaaatattatttgagatttctaaaatacaaactttaaaattaggatagatttaggaagttatactttataaaatatttttctataatatcaaataaccaactctttaatactttgaaaaattcaacatgatttatagaaatcatacaaagacaaatatattaaataagctcaatgtataatttaatatagcttccatttcctgccagaatgagcaatctgaagagaaactgcatacctctttgcatatcaccttttaaatattagtaattctagtttgccaatatcatttatctttaacatggtaaatagaactgtaaagcaattttcaaaaaacagaaaaccaacagcaacaacaacaaaaagataatatctcaactgctgttcacgtggaacccttctccacttaggccttcaaagttctcaactgctgttcacatagataagctctcatcctgcagccctagctggcctgaaactcgaagatctgcctgcctcttcgtcccaggtgctgggattaacggctcaccaccacacctgcccttaaaggggatgtttttaaattattttattattttatgtgtatgggtattttgcttacacgtatgtctgtgtccttggagggcattagattttctggaactaacgttacagacagttatgaaccacagtacgagtgttgggaatcaaacccaggtcctctgaagagcagcagtaaagatgagccatttctccagccctgtaaagtgatttttaaaataacactttttaaaagtttatatatattttaaactcagtgcagtgagttaatatgatacaatttccataaaagttctgatcatttcagttcctcttagtctaatcagtttggggtttaaaacttttttaaaaagatttatttatttattacatatgagtacactgtagctgtcttcagacacaccagaagagggcatcagatctcattacaggtggttataagccaccagatggttgctgggatttgaactcaggaacgctggaagagcagtcagcgctcttaaccactgagccatctctccagccccgggactagaaactgatttaaggataagtggttgtaactttggagaactctgggcatttcagacagtctcctactggagttatatggagttattctgtgctttgcaggtttgcaaagtcactatattagacatctcagttttcagcctgtacaggtcaccgggaatttccagttatcctttgtctctgcatgttactgagccaaaaacttaattggtcctatgaaaaaaatgggtactcagactgggaagataggtacagactggagagaagtacttgagttcaattcccagcacccaagtaaaaaggtagtcttagtgacatgtacttgtagtcacagtgctggggagaccggcatatccccagcacttactggccgttcagccttgcttgtacaatctgcgagccccatgtcccactgaaagactctttctctctgtcaaaatcaacatggatgactcctgaagataagaactaaagttaaattctagtctctaaacccaagtgcatgttccaacacatgagcccacacacgtttgcacgtatgtatgcaaacatacacagaagaatagatatacactgtaagtatctgaaggcagaatgtgttcctactttggatattttcatctctcagttaaagaatgagttaaaaaggtcaagtatttactaggtatgtttcagttttggattttgatgagaactacataaaatgtctactaattttgagcacatggctctagagaatctgttctgtgaattgcttctacagttcttgttcaggaacaaaacctgctatgagactgtagactcacatgaacttaatgtaaacctctctttgaataccaaagtgatcaccatgtggaagagaggaaagtgagcctttgagcagctcctaacagcgtgccgagttgtgctcaatggttgattttactcagctgtttcatttggttccattcacgaagagaatgcaagtgccatggaagtagaaaaggaagatgcggcttatgatcatttgaagaacactttttttattttttaatcataatgtatacaatacagaatataatcactcttttcgttactggcaagattacatgaaagaaattatcactaagaaatgattgcttcttaaatatacttaaatactggaggaattgggataaccacttcacttcatatctgggttttttcatcagtaagtacattaacatgctttgtggttgtgatgattaaaattataatcatgaaacatatacacagagggcctagcacatagcaagtgctggtagctcacagtaggaacagtatctgatttaataatagtgatatgaatcaggtcatattttctgttccacgattaaagaaactattatgtaaagagagtaagtagtttgcccaaaattctccatctaaataagagatggagacagtataatacccagacagtttgaatccagaggccagccttttatccaacatggttacaattctttatacttcatttgtttagtttacaaaaattaattaaatagatggcaggtactatcattgatagcaccattatttatattggaaatatataaaatagcatatagatggacatataattttatatttttttattttgacaagtgtaatccaaatgtgtgtaagtaaaatctatgtattaaatattagaatcattgaatattgcctttcccagtaaaatgagccaaataataccaaattgacttcacactgcattattcatgcagttagatgggatttaaataaaaacatttcttactgctcgacttttccagtacttacattttaaaattattttttaaagttaccaacaatataaaatctgaccatagatgggtacttgcattaggttagaaagcaggcaaacccataagcctttttggttcttcatcctatagtcataaaatattgtgttttgaacagaatatccacaactgactgaaaacaaaacaaaacaaaacaaaaagtctgacttcacacacagtagaatccctttggtatgcttgacttgtctctgaaagtctctgccatctggtctttcaatataagtagaactgtaagtccaattttatgcatatatctttttttaaaaaaaccatagaggttttcttggtgcccgttaatgtcactaagagtcacatgcattttttttcctattttgtggtgttttctatccaaaagtcaaccatatgttagaatgtgcagtgaattaagattttgtaaggagaccatatagtgtcttcttgaatgttttatctaataaaagaaatataatggggtctgtactacttctggctgatgcaagacaagtgaggatgttttttgcttctattaaataattcagctgctgacagtctccttctctctggtgcagaacataaaaaatgggtttaaaaatactatatggaagaaagcaaactactaggaggacctggatgatcaaaaggtgtcttttcacagatctgtaggtcaaatctttctcggtaatggaggtacaggtccttactcttcgcagatggctgacaagagaatagtatgatgtcactactactaaaaaggagaatccaataaatgtggttccaatgagacccgcaatctgagaaggtctggctcccagttccatctgccgattgtagcactggctctgtccttcttctgtagcctcgactactgagtagtatagggtaactggaataattatgacaagcacaactccccatatgtaaatacacattgttctggcaaagttgggctggcgaaatcttttcagtacgtgaccataaaacattctctcgtagcatgaggtggcctcttgcttggactcctttttcattaaggtagcatagcggcttatggcaatccagcttaaaattaagaggctgacaaacatacttacatgcatagaaagagttcccaaaaaattgaccagtctgcattgtacagattgatatttccaataaaaacctctcaagaaatatatacccatgaaaggcatagcagtgcacacaagtaagtttgcagtcacaagatttgccaagtagatatgtgttgatgttttcttacctatttttgttaaaaatacccactgagcaagtgagtttccaaagagaccaataataaacaaaaagatgtaagtgaccggtaaagctgtggtagaaatcacggatggttgaatgcatgtcgagttattagtcatttatattagattttcttgatttttgtcacaggagctagaatggaattatatatacttaatattaaaactaacaacaacaggcatttttggttttgatggagtgagaaaatccaggttggttcttaccttttctcgttgtcacagtggtctgcttaaagtaaaagcaacagtacttaaagcgatggataagtccttcgtctaaaaaaaaaaacaacaaaatttggtagaaatagttaattaaatgcctgagatttatcattcgtaggttagagaaatttatacttcttagattataaagcaatatgtaaatgattatagattttgcctagaaatctagaagcacaataaaaggacagtggtacaaatgtgggcacattaacagaccagtaaaacacatcactttataaggtgatttaagaattaataatttttattagaaagtttttatatttaagcttttattttttaaactaataagtaaaagctagtttttaattccaacattgattatatccagaaatccagaagtaaaccccattccagatgaacaaaatactcagacaagatcctgaataaagataaactccagaacctatggtcattacaaggtcatcagtaatctcccattccaaataatgctaaactctcacacttcaataaattacattatgtgtcaaaattatacttggtatgcttgatggctagagtaccctaacgtgtcctctaatatctgtggttttccagggtttgtttatttgatataggtttccaacccagcataaatgcaggcgtgggttttactttcttaaaaatgtatttttattttatgtgcctgagtgttttgcttgcatgtatgcccatgcattgtgtgcatcaatgcctgcagacttcagaagagagtatcagcttccttgggactagagttacagacagttgtgaattcctgaatggctgctgagattcacttaaccttggcttctctgaaagaccaaccagggctcttaactacctaggcacctctccagctctggtgtttccttttaagtcttccctgtgaataagtgagaaatcccagtcaagctctcttctttttcaccttacttactttttttcaggtgagaataacagaaaagttactaggttctggtcaaacaacaatcctgatttctatcttccaaagttgcagttataattaccaacttaataaattatatttattgatttttaaaggcacatgatttctctattttcaccattgacttttggggcaccatattttgcacacttttatgatttataggagagtttcttaatcttttgttaaccatcttctctcttttgatgatgaacataaaaaggtttttccacagagcatcttctgatctctgccctttcaggattgtattctctaccccacttcagcatcttggtcttattattttctgcatcttgaattgctttaaaattacattggattttattaaaaatgaggatcatttcataatacattatcattctgaaacaacttttaagccaatctcttacctaaatacttaaaaattttctgcattcaagtactgagaccctttatcaaggtctgccactatcttcactttatttctttacaatttttattcagaaactgcatcatatgtttcagagtgcctttatggataggagttgtagatactcttaatatcaaaccttaatctgtaaccttgctgatttcaaaattaggcaaataacaattgaaatgaaccagttcacttattaagaaaaatccccagccgggatgtggtggtgcaccctttaatcccagcactcgggaggcagaggcaggcggatttctgagttcaaggccagcctggtctacagtgtgagttccaaaacagccagagctacacagagaaaccctgcctcaaagaaagaaagaaagaaagaaagaaagaaagaaagaaagaaagaaagaaagaaagaaagaaagaaagaaagaaagaaagaaagaaaggaaggaaggaaggaaggaaggaaggaaggaaaagaggaggggaggggaggaaaggaaaggaaaggaaaggaaaggaaaggaaaggaaaggaaaggaaaggaaaggaaaggaaaggacaggacaggacaggacaggacaggacaggaagaaagaaaggtccccttctgttcaaaagaaatgttggttttactgaagggccaaagctttttttaagagatgaagcttcttttatgcaaagcttccagtagcctctgcctcatagagataatgcattccatgctgaaagcagcagaggttcctctatgaatatcagtagcaactattccctaatgaaagaagagcagaatactattacttagatgttaggtgatggtgagtctctataaaacaaataacaactcactccccatcttcagcttcccaaattcatgccccattcagtaacagcctttgattcaaaagctactagaaatttagttttaaaaatttgtaaaatgcaattaaacttgagaaggcaaataaaagtgagtcttacagaattgcttccaaggatatctctccaagtgtacattctcctcagcagaatgtctgtgtacacactgtgctaatttgacaaatgagaaaacttgtacaactctagcagttacttgtggctatttaaacacttcttgagctgactaccttatttaatgatcagatttcacaattcaaatagtttagtccttttagacacttacaaagttaacctttaagctaaaactgagcccccccccaaaaatcatccttacctgtctgagtagcttatgctcattgactgtttcacactcacagttctctgatcttcactcttccagtatccttaatcagtatgagtagagtcttgcatgacaccaagtacagtggggagaaaaagggaaattagattgttgaagaaagtcaacagttacagtaaatataaccagtacctccttaaaaaaaaaaaaacaaacacaaccctcatttctctatttctttagtgggaggaagttagtgggtaatacatatatttagtataaatatgtactgtataaataaatatatatgtagtatacttatgatgatttcatgaagtagttagctttattgttgtgattggctgaagttgcatttctaaggtttaatcacacatagctaattatttttctgtgagcatagtaaaaggaacttctttccagtaactcaataaaataccaacataaatttgtctctaaacttcactacaaaatcatttgtgaacagcttctttgcaatccatcttttctaagagtagaacaaaacaaaacttgaagttttcttatttataccggcttgctcaaatcaaatatcactaggctggattaaaattcatgctcatcagtggtctctgctgttttaagattgaaaaaaactgatgcccagagatgcttgctctctgtgtgctcagagtatatatagggactagaacccagtttggttactaataaacaacttttctctacttctaattggcatgttctacctccatttggagttgtaataatgagtacatgagttagaacattttatgatggattttggaggtagcaaatgtgtttcaaaacaaattaatagttatagcatgtagtctgaactgaccataaccgaaggctaaatgtgcatttagcactgaccactgagcaacctgcatccccagcccagttctgccaattcttgtttccaaacccaagtccacctcatttgcttaccactcgtctagtacgtagatgatgagaagttgggcttactcaaagattgatcctgagaagctggagagggcaaccatcagcaaagctctgtcttggagaattgggttataagaagggtaggaaagcctgggttatacagtcgaacgatgggcaggaggctctgtgcccattcccctgcccgcctctggctagaactgtaatcaaccttgaccttctgaaaatagctacaaacacattagttatctacaagttaacctccacagcaatttgtatgctttgtgttaactgatgcaggggattaaaagaacaaggagagctgcacattcagatgttatcagaaagtcaccaggagttggaggtgggggtgccaataaatccacaaattgtttggcaattaacatttttgtcatttaggtgagctcttctttagcacaaaggtaacttctggagaaggaaaggggaaggcacataatttctccctactgtcccactgtgtgttcattgtggcccatctccaggatgtttgcatagccggcaagccctttcctagacctgagttccccaagatggacaattccttaaaatggtggccattgctccattctcagaccattttggatttcactatcatacattttccttaaacagtacagttcactcaaatatttattggagtttctactacatttctagtagcacatggaggtcccagaagtataatgctaaccacaaactagagtgtcttcaaatccaaggaagatgtagatgtgatgtgtctgagaaataaaaacttagtgagttggtaaatcacaatggttcattaaaagaactgaaagggaagaacagagaatgtgtgatagatggtggtggaaaatgaggctcggggaagaaacgactcaagtgagacgactaggtaaatactataaaagattttctaagacagtaaacaatactctccagtagtagaaaaaagtaatggcaggaaatactaagctaacaaaaatattccttgtcatggagctatttcaagaatatcaaaccaagttgcaagttctctaggacatagtgtgcccctttggacttcgggatcacaaattttctctggctctttgtgttctcatctttctcctcttcagagtgcggtttcctttgtccacatgtaaatctccttatctgattacttctcagatcatctgcccaagcactctccagtacatactcttctgatccttctgatctgcctcaggtgatggttttaaatctggcccctggaattcctttggagtattttagtaagagtgatccaaaaggaaagctcattcagttttgcagcccatggtgagctgttgttactacctctatcaactttgaggggtgggtttgagggtcacttaccagtttccctcaaaaccaaaagcaggaggacatgagataccttagacttatctgaacttgtgtgtttcaaatgggaacttactttttggctctccaagctaatatctaaattggctacaactggacagtttaaaatttgtccatctgaccaatcagtagctcagggcattgagagggaagctattgtgcaagacaagaacacgtgtctaaatgtgtgcatattagaacaccattcttaatttccctcaaaggggaccacagtaagccttgttcatcagttcaatgcttacacaagccagttagctttagatgtgcagtgcagtcctgttactcaaagctgtggtttgttcaagttcagtgaaccttctgttctctttaggatgtggtatctggccatagccttgtttccagtgctactgctctcaggtcctcacattctactacaagaatctgtagtcgtggaagacccaagtgtaactagagttttaggataaaagcgctttctccagcaaccctaacaggctggccttggccacccatcttaatatgccaactcaagaagcaaatgacaaatcgtgaaaatcagagacaggagaggtaatcatgtgcacatcaaaaagaggaacagtgtctggtgaccccaaatccctctcagggtactgatatcagctgtagattagaggacaaattgaggcaaggaggcaagagttgtgcataattatacagccttagtcaaggtgtagccagtagtttgtgtgactcactgatcattgtctcagttatggttcagcaaaggtagtctgtaggctttcttattgttcaagggaacagggtggtccccaggagatgattgctcacactctagtcctcactggttaaatttcatcatctaggtgatagaatccaagggagtcctggtttaggataataactggatatctttaggcaccttttaggcatccggaacagaacatggtaaaaagctgacactaagatgccccctttagtcctgtctctgtgtccttggcctcaaaggacaatggaataagtgataatttgatagacactccttgagtgattcatattgaaagaagtagacaaagctaatgagccagattaaaagagatagatgcaaaatgaaggcagacacaccaggcttacactgtgcttttaggtccctgggggcctgaatgagaagtcagtggtttttaggactatcagggggcttttcccctctttttatggatgtgtacgtgtgttcatgtgtgtgcagttgcatgctcatatcatgtttcagaaccaaccattcttccctgtgggtactttgaaagccaaaggtaaagatgtaaatgagccagcaattcttgtgttactgcctgccgtgcctgtgctacctttgaagtgtacaaagaaacttattttctttccttaaaagcaggcattttagaaaataaggcatttgacaagagtctgggagaaatgtgacctatcacgaattaccacaagtaaacacatgcccatatcacaacacagcaactgggaatgcaaagagattacgatcatgtatcagtgcccagaattctccatgtttctttccaagaacaaggtcatcttatttctagccacttctttttaatttctcgataaaattgttttaagattaagactgtgtttgtgtccctttttgtctttactcaaggaggaggttatatcaatggccagggaaagagaattgggcacgaggtgttctttcctgtacctgttagtgtttgaattcaattgctcatattgagaacccccaaaattgaagtactgcagtttatgtgaactgctagaacaattgataacagccaggcatggcagcacaggtctttaatcccaacactctggaggcagaacagatggatctctctgactttgaggccagcctggtctacacagtttcaggtcaaacaagtctatataatgagaccttgtctcagaaagcaagcaagcgagggagggagggagggagagagagagggagggggaaagggagagagagaggagaggagaggagaggagaggagaggagaggagaggagaggagaggagaggagaggagaggagaggagagagtttgggtgatggtggcacacccctttaatcccaaggagatctctgtgagtttgaggccagcctgttctgctacacaaaaaaaccctgtctcaaaaaataccaaaatttgataataaatgacaaccacttaactatattttatatttatgtacatatatacatacatacatacatagaaggtttaagatatatcggagataaatgcttttatttcttcaacaggacaagcatatcatgtgttgtaacacaactagggcttgaattgatcccaagtgttaaaggttgtttatcctgactcacattagataagatagcactcatagaatctgttattttttattttattttaaaaggcatttcatataatatatttgtatcatatcctttcccatcctccaaatcctccctacccaaattcacattctctctccctccttcccctccctctcaactttgtctctttctgtctctctcaaaaaaagaaaagaaaactaaaacaaacaaaaactaagtaaataagataagtaacaacaaaaagacaaggtacccgtacaaaaagctgtttgggcgttgatgcttctgataaggtgaccaagtatctcatatctcctttgaccaaaaatagcttttacttatgtcaactttttatgtaatctgaagcttatattttgagatcctaaatttaatgttacccttttacacagtggattttagcagtcactgataattcctattaaattaggagtctcatccattggcacttgcatcttgatgcaaccttttgatatgtggaaataatttagagttgaaatcagtcactctagacaagtatacatacctggctgtttctaatattttcttgttgcctttattttaggaaaaaccaacctgaaatacctagtagaaaacaattggaaagaaaagctttgttacattttaacatggaacagctctgtaaagtgcttgcttctttagagctctggccagcagagggcagtatatcaccgcaacacagttctttttttttttttttttttttaaataatttgcttagtttccagctggaaatgactgcagtacaggctaggggaaatttttttttttaatattgagggttttgtccttttaagctctaagaaatctataaatttactttttctagtgcatgaaaaccactttaaaagtgataaagtgaaaataattttaaaacaacaaattctctcaagatgaaagcccagtgccactcatcagccatgaataggataaatcatttaaggcttggctttgtcttattttgttttaatgattatcatgagtcacgtttgtgaaatattcatgactctaattatcctggaggttaaaagaaagtctggcaagctgagtgtggtggggcacacctttattccctgcactcgggagacagatggatctatgtgaagctagcctggcttctaggacaacccaagccacatagtgagatcctacacccactgaaatgagaaaaaggaaaaagaaaaaaaaaacagtctaacattttagcatgggacaattttgtggtcaccttgtgggatttaacttctaaaataaaattatagcagctaatggatacagtttgaaaagtcaagtaatgctaaagggcttataatgaaaatagttaacaaatgtattttatagtacattttatcctctgaagaaagtactagaagcgatgccctttctcctccactgtcctcccttcttccagtagcaggccaactatgccgatacttcctcctcgaagtgcctcgcagcttagctctctacatcaggggcacatccagggttttatccccgagaacgtgtgctttgtcactaaagcttcagtcaccaccttccatcctgcatggatctctcacatgagtacacaactccctcatccctcctcacaaacaaaagagctggcaagaacatactgttttcattttcatctaccacatttctttgaatatgctttcacttttgatgacctgactaggcttttatatttttttccctttagtgcagtaaaatggctctctccctagggattaataaggtatgtgtagcttagagtccactgtttcctcagcaacattcctcaaaggaaagagaattatgctttgcaaagagacctcacatgtccaagtgctggaagtgtggaactgctttggttccttctcataccaaatgtatcacaaagctggccctttgtaattttcatctatgaatatctctttctgtgcttctagaacagcaatctagcttggcaagaaagctagaagaaaagcctaatcctgctagctctagaagtttatttgctccttagagctaggtattgtcactaacatctatagtaccacagcctgaaaggatgtagaaaaatggtcctttcagaaggttaagggagcagcccccacgcctctaggctgtacccatcactcaaggtttcactattatgagggtcataaatatccaatcattggatcaggagactcacttgctacttgactatcttctcttcctagttgccacacatacttggaaccatgtaatctttacccacaagatctgaccccatgtgtcctgtgtttttcaagccttgctggccacaaaggggaagtgaatataagcatgcatgcaaacctgtcagttccctttgcagccagctcaatgtcttcgcttaaaaatatagaggaaacggtgtttttcttctgagtacagactgaatttccccatacagatgagcatttctgcttctgacagatggagagggggtgtggaaaagaagagcgcatgcagttatgagaaaagggtcttaaaagagaaagtagggacacagagacaaaactgaactggggaagagaaaggtgctactgagtacaggaaagaaaaacagcaggagggagtgtccggggtgctaagaacatctcatttggaggacagcagtaagaggcaggaaggaaacagagaaaggaactgctattaaatgactctttgtaaagtctatgccagcaggattagcagaaggcatgaagaactttgatctagaaacttgcagttggccaatatttgaaaatagggtagactggccatgatggtattcacttagaatccctgaacttggaagactccgtcactagaatagcatgttgaacaccagcctgggctatgtaaagagttcctgcctccaaaagaacaaaagcaaaaataacacagcagagggcagaactctagggaagtgaccttgttgctattttccattgcaatatgaagactagttcagcgatccagattatacagaaaagtcaaggctcagatacatattaatgtatcttttggcatctgcccagataccctcacagtctttgcttgctgagccttagagtatggcctggctagcataaagcagaatctatctgctacatctccagaagctaggattcagttcgctttgtgagtttcttctagagttggcccacagtcactttcattgtatacctctctagatctcatgtttaccctcagcttccagctgtgtatttctgcctttcccctggtatttggctatttggataacttaccaaatattttctgattgctgggtacctcaggatcattcagccctcttaacaactctgagtgaggtccagcaattactcatgtttttctctgtaagagaaagaacgtgtccgaggcaacttataaatgatggagcaaatatttgaactcaggcagtcttttagcctgtctattttgctagctctctgttcattctttactgaagtgttattaagctctaagttgcatttggcctcaccaggcttcttcccatggtcatatcaataagtcacatattgtactccatatccattggccaaactaacccactggactgttggactaggcaatactgacattcccccacacagcttccccttaattttctttccttttctagagaaccactaattctttcccgtgacatgtttagtatttaatcaggacatctgatcaagacattgtgcttcttaaaagtatttttatgtaattatacacaagtgcttaggttttgtagttttaactctcagaaaacatttctatttttatgttctcaggggtccccacatttaatacctcagtactatttgtaagtaaaatgctaagatatcaaaaatatgatctgatctatgaatttgagagtccttgaggaatgtatattaagactagtgactagctagatttagtttttagttacttagttcctgactacagtttcccctccctcctttcttcctggtcccccactaccacctcccctctccacccacccatccactcatcctctatttctcttcagaaaggggcagccctctcatgggtatcaactagctacagtatatcaagttgcagtaagactagacaccttctctcctattaaggctagagaagtcaaccctgtagaaggaaagggtcccaaaggcaggcagcagagtcagagacagcccctgttcctactgttaggagtcccacaagaaaaccaaggtacacaactgtatcagatgtgcagagggcctaggtcagacccatgcaggctccctagttgttagtgggtccctatgaccccaggttagttgattctgtggattttcttgtagcattcttgatacctctgactcccacaatccttattcccccattaatgcaagattccacaagctccacctaatgtttgtctgtggtctctctgcatctgtttctatcagttgctaggtgaagcccctctgatgacaattgagctagacaccaacctatgcgtataacagaatatcattaggagtgtttcattgcttggttttttgtcagtcatgtttggttctgtcgtaggtctctaggttatctagcctcttgttcctggccctgcaggcagtatcaggggtggattccctctcatgctggatcagtcattggttggccactcccatactttctgtgccacctttaccccatgtaggtaggacaaattgtaggtcaaagttttgtggctgggttggtgtcccagtccctccactagaagtgttgactggttacaggagatgaccaattcaggctccatatcctctcttgctaggagtcttatgggctctatttattgataaagggtgttttttatttctttttattttgtccttgctattgttgcctggtagaaggagcctctgaactaagtataagtatatacaagttgaagttatttgtgacccatttcaacaagaaatgattgaggcccagaatatataaagaagcacttcaacaataaagaaagaaagttaagcaactgaggaggagggggaagtgaagctatgaacagaccattcacctaagagaaagcctacatgcaggaagtattacaaatgacactccattgccctagtgatcaggaaagtgcacactgaagccacaaggagatattatcttacacctatctgattgacaaaaagtagtgtgtgatgaaaccaagtgttagcgaggatgtgggcagctaggagctcatttctgcccacttgtgagactgggtgtataagtagtaaaattgctttggaaaattatcagaactgggatatgctgaaggccttcagtcttacagccaggcattgttgcttgaggggtcaactctaagggacctccatgcaaggacctttggcaagcagaagactgctcctactaacagaaaaactggaaaccacctatatgtccgttggtgggggaaatggagaaatgaactcatgttgttttgtgtcctataacacttcatctatgaaaagaaataaagcctttgtgctagacatagataagcataattacagtgggaaagagctatgaggtgataaaatagtagttacaccacatgtaaactttttttttttttaaaaagaaagtgtaagccaggcagtgcatgcctttaatcccagcacttgggaggcagaggcaggcggatttctgagttcaaggccagcctggtctacagagtgaattccaggacagccagggctatgcagagaaaccctgtctcaaaaaaaaaaaaaaaaaaaaaggaaggaaggaaggaaagtgtatcttgttatacacatgtgttataaaagtacaaaaaataaaccctccttacccaaggttaataatgcacacgtgtaaaaccccagtatgaccaaacagtaagataacaagttcaaggtcagcctatactacatatcatttttctgtttcaagaaaaaaaaacatagtttatatacatataaagtaaacttacacgtgaaattaccaaataagataagtaatggctaactgttgctcctgaactaatttcactgggtgaccaaagctaaaagtgacatatccaaactgcaactgaaaatctttttcagaactcattctgtgatgattctttacgtgttttatgaacttgaaaaaaattaaattagataaaatgtaccaatttatctttttttttaaaaagtatgctccgtgtgtctgggattgcagtgaattagctttcaagagtcaagtagagtttgtaaggtatacaaatgtaagacagccagaaagccagtcttgcaggtttggggatttgggcaccatacaattttgataaatgctaaaagtttttgcattaattgcatattaatattactaagttttgaggtggctggggttgtttgtttttagtaactatcatcttggaggcttagggaagtagatcagttgataaattgcttgctacacaaacagtaagacctggctctaatccccagcctggatataagtacacatttacttggattcctattttgttgcttgtaagcataaaggaagaaaataagaggcaaaatggaatttaggacaaacctgtttccataactagaaccattgctcccaccaccaagtcttcatctggaaacccaaactgagctaagacattacagcagccattcatccaagcataacctagacatttctctataaggattgctatcattgcattaatagaaaactatttcccatcctcagatgatttagccatctatgttttttttttaacaactaacttctttatttacaactaacttttaattccatttaaatttcctttggtgtggtacaaggtgaggatataatttggctttttattttaaatttgcacaacactatttattaaaccatctcttccttcttgaagctctttgcagtggttcctttatttgcaatgattttctctcagggaaagggatgtgtaagagttaccttagaagcttttcaaaactatgcgcaccataagtaacaaagctttaggttttcctctgattagttcctacccacttctgagtgtcagtcacatgccaatactctcctcacatcaccaagggtctgcttcaggtgtatattccattcccctcgtaagtttctctgcatttactcccttgtttgtttgttttttaaatcgaaggttacaaatgtatttaatacaaataaagtaagtttctatcatcagattaagtatcccttatccgaaatgtttaggactataagtgtttccgttttcggagttattctgatctaggaatatcttcacagactttactggttgaacattcctaccctaaaattccagtatgtaaaatttttaaatatttcagattttggagcattttaactttcaggttttgaaattcggcattctgagtatgtactttagaaacctaaaaaataataattctgcagcattcatattgtctcttgaaattttcctacttttgtgttttctgggtaactttaaataggctttggttgaaattgttgtaatttgattagttctatttttgtataagcaggataaccaaagcttatatagaattgttttttctaagatggtggagacagacaccatctagcctggctctgtgcataatactttccaaaaactaacagcagtgcttagtactgagatgtcactcagggagccaggcagttcatgttgcccttatatggcattgtacatgtgagatagtatttggaagcttattctgtctgaagatcttttgtaaggtgaagatatgcatgtacttctgaatttccttttctgtgtatatgtagaactaagccttgtgttggcagttggaaagtcagtatttcctaagtacatacaccaatgatcactaagacattatatgtgataaatatctctaaatttagtgagtcggtagcatgctttttattaaattctagaactctccagattcaggctaatttaaaggatgtttaaaaatgaaatttctatcagtaaaaaaaaattacaggattactataatcaaattttactttattacagttaacataagttaattcagtaaaacattttcaaatattttatagagatcatcgtttaatatagatagtaagatcacttctagagctatgagtattttattttaatgttcctgaacattatattaactgatgataatatagtttgtgtgtgatacatgcatgtgtacgggcatgtgtctgtgtgtgtggtgtgtatggttgtacatgcacatgtgttctgatgtgtgcagaggccagaggagaacagtaggtgccctgctctatgtatctgccaagtcacctggccatcaagttcccaggatatgttccaccccatgtgctttggttacagctgtgacccactgtcttagatacagttaccattgctgtgatgaaacatcatgaccaaaagcaacttggggagggaagggtttatctggattatgagcttccacatcacttcatttttgaaggaagtcagggcagaaactcaagcaaaacaggaacctggagcctggagccaaagcagagaccatggaggttgatgcttatggcatcctcagcctgtttcttatagaacctaggactacctgcccaggggtatccccacccacaatgggctggacctgcccccatcagtcactaattaagaaaatgcctataggttatcctacagctcgatctttttctcaagacattttctcaattgaggctccctcatctctgatgactagtttatgtcaaaaagacataaactagcaagtacactgagccatctgtacagctcttgataacatttaaactgtgtttcttaatgtgacattaaaaggtagggaatgcttaccactgataggatccaagttttcattatttaagattacacaaacagttactaaatttaatttagatattatctgataccattgtcaggacaccaactaaaattgttttaacactttttataagcctctaatagtttttatcgacaaatgttatttgtatttccagatatacttctgcttgacctattcttttttgtttggttggtttttggttttttggttttatggagacagggtttcttctctgtgtagccctggctgtcctggaactcactctgtagaccaggctggcctcaaactcagaaatccgcctgcctctacctcccaagtgctgggattaaaggcatgcgccaccacgccaggcttaacctattctttattcaacctgtttatgcactttctgaaatatagtgccaaatgaaactgagtgctacaactatatacaagcaaatctcattgagatcaggcccaaccaaaaatctgcatgcttttttctcatccaagttattttttgcagtttttaaaaattatatcatttctccctccctctcttccaactaacccatcctatatccccacctcactccctcttattcatttcattattattcttacatatatgtgtaaatatgtaattttgtaaatacagcatactgtttaatgttgcttgtgttgtatatattttcaaggttaagcacttggtattggataaccaattagaggcacctccctgaggacaactagtttttttctctcttggcaatcactgttacctttacttcttcatctaagggtttggccttatgacatttccctcatccacattgacaaatcaactggtgttgtagttattaaatcttgcttaagcaaccatattgttgagacttcttaggtatatcttctgtgtcctatctagaagcaaatattctgatcttctggttcttaaatttttcactttcctcttctacaatgttccttgagccttatgtgtatgggttttgttgtagatttatcagttggggctaggcagcccatgatcagttgatgtctgcattttgacaagatggtgcttttggtaatagtctctgtctgatacaaaagaagcttctttgaggggcaagagccacttatctgtatatataaggagtatttagaatgccactggatctgacctgaaagctttatccttgaggattagttttcatagtactggaaagtacattacaagctgccttgagaggaatacaaccaatagtcctacccagctatgacacctattagccacaacaatgaccagcatagcaacatatctctaaaggtgcaatagtggcacatattttggtagtaaccaacagctttctaattgggcttaaggcagcagggaaactatgcctgatactgtaaacttagagctaacaagatcataggtcttagagaagaacctgctactgccactttccttaaaccagtataattcataactgcattctaaatttttagtgctttatgacattgttttccagccactggcttaacttgagttttaagacatattctaggctggacatgacatatacctttaaccccaacacttgggaggcaaaggcatgtgatgtgatctctgtaacttcaaggccagtttggtctacatagtgagttccaggccagccagggctccatagtaagactcctcaaaaaagaaggaggaagaagaagaggaagaggaggagttgtcgttgtcatctatgtgtaaaactaactatgttggaagagtgttaagagtaccaaagcattctgatttttaaataaaattccatattctgtgatagaaacttaatcaaagattcatggagtttgttacagcggtcttttatatattcagacaatggcattctggttctgtgtttagcaagatcaaaacctacacaaacactggccaaattttttttcagtttctctaaggacacctcctgtctggattgcaatgtataatgtttcttcagctctatccagaataatgactggaaaagctaattagcctattttttcttttacatcttttcctccccatcttatttgttcatctatcttttcttcctttgttcactcaactactcggaaaatattgcttctgacttgccaaactacactgacctaggagtcagtgatgagtcccttctttttactctgtgttcttgaacatacatgaagttttctgtttgcgccttttaatgtcaaactccaggttttctgtattgtcaggaaatgtttcactcagaaatttatcagactagcacttatgtacctgggtttaatatacattaagcttttaccatgtttgtgccaaagtcttcacatgtgaccattaagtttaaattggtctgtatgatatatatgttatcattcatgctttgatttttttatttatatggacgtaaagaaaatgataatgttttaatattttacataaatgatttcatatagtccatacctttttactcttgggtatggttttctttcctgttcaatactattttttattcgatactatttttttaatgtgtatggatgtttacattgccccaggatgccagaagagaatccactgaaactggagttacaaatggttgtgagctaccatgtatgtgctgggaatcaaacccaagtcttccgaagaataccagggcttcaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagctacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacatttttccctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcagaggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccaaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtggaattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcccaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaagatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaaaaaaaagaataccagggctttacatttctccagcccattcaatacgatttttgctatgttcccatgtctgatgtgtatgtgttgaattgaagtgttaaaggtatttcatgtggtaaaccacagtttatttctttctgcttttacttgtacatccttaagtgttctgagtgatgagtatcattgtatatatgctcgtatgtatgtatctgcatgctcctgtaagagatgtacctgcagtgaacttgctggtcatatcatcacgtgtacagtctgtgtctcactgtatcaaagtgtgaagtggatggataatttatgaatgtgcattaagtcattccttttgccaggctatcatgttcttagcttgactgtttgctatttaaattcttcacatttttttttctaagcagcaatagtgcgcagtctcacttttattagaattttattattttcatctgttagcagagatttagacataaatgaatatagcatcaagtgatgtaagattttgaagtaatactcatgttcactgacatttcaactcagtccccagattactttatttttagacatatttaaaattagtattaagtgcctaactttagtaactctttagtgacttggaaaaaaaaaacaatgacatttcatctgttttgttgttaaatccatgaacttcacttaacattgtaaccgttgttaaaagtgttagcttaacaatgtattctgtgaaaattctacatacagttctaaaatctagggattaatgtaagcttttctttgctttgaactactttgcaattaagcaagtgaaagatcacttctaaagatctgagttttgggcatattaggactttgttcgataattttaccaacctcaagaaatgaagagactgttttatatcattcattttagtacatttgcctcaattacccttagtgctgtactggggcattttgactgtcacggacagatcatgcaaggaatgtcctggcttaaattctgaagtgctttcacttctgcttgcttcactttgaaaccttctaaaaagaagttgacacatgattttgcgaatattactggacatcaggaaatacatgacaggatccaggcaactgttgaaagaggagaaaaccagcatgatctcgttagttttgtgaatgatttccttccaataacaagaggacacatttagctgtgaagaaatgtaaatgaaccgaaaggcatggtaaggcacaaagcatatagtaaaaatgatcagtacaataaaggagttccgggctgttgtagcatatttgccagagtttggaaattttgacctccgtttagaaatcctcagtagattcttgccaatcttaatatatgagaggattatcagtaggaaaataagccagaacattactacaagaacaaagttaaaaattgcttctccctttgcattatgtctgtctctgtaatggaaacacattgtggaattatgacctcccttcttcagtgtcaaaatgatcatagttagaaatccagcaagagcaaccgtccatactatacagcaaacataaatactttgcttggtggttattgcccttctttgttgtatagaccgattgatttttatatagcgatccaaactgataaacccaagcaaaataatgctaatgtacatgttcatgtaaaatagtgtccccacaactttacaaagaatcacacctagtgtccacttgttttggttgatgtgatacattatgcggaaagggaggcagaagatgagtagaaggtctgcaacagccacattaagtagataaatttgaatggaatttcttttacggtgaatgcccagaaatacatagagggcaatgatgtttccaaccagtcccacgaggaatataacagagtagaaggttgttaacacagtagatagtaatttttcatccattggacagctagtgacatttggcactcctgagaaattttgtgaggcttggtcactataattagttataaagtgcattccatgagaggagcaaagccagctgtcaactgaagtagtagtcattgttacagtgtgacttctcaacgtcttctgtaactatcaggaggagagctaaatgacatgctctttgtacttctttgtgtcttcagattttcctacaacagaaagccaaacattgagtcatttgctgtgataatgacagctactttaacataaagcatagataaggatttcgtttcagacctaaattctacttggttctattttgctatctacacatgcattattgcatcacaaaacagcagtaaatatggtaggatctctctaaccttttctgttgctgtggcatgctcatttcatttattatattaaagtaaataattgaaagaaaaaataaataattgaaacatatgataatattttcttagagatactgttttaggactagaaatagtcaaaagaaacagcagctcctattttttaaggatgaatctcaatgtcccataaaggtgcttctagccatgagtgagctgggtcccttcctgatcctgcttgactttaggaatgcttcctgttctgcccagtcccctcatagctggcatccattcattttgatatatgttgtcgtggtagtgatgtaccttttcacagtaagagtaagaaaggggaccctaaatttccttcttcacctaagaccaagataggagtattaaaattacttatctatagaaatatgcagttccaaaacagaccaaggtggcacctgcctcctttcagagattcttgtagcacttcaccagagaccatactggtcaaataaaaccagatcagatagcagatagctgacagtaaacctctgccagcctagaagcataggacagtaatatagatgggaaactaactaaacattaattttaccctgggttatatcatttgagattgtcaccagaaccttcttaagtatgtcaattttacttgttcccagtgctacttgctattgaacaattcttaggcatttgacttttgggacctacaatatatgtaaggagaattcaagaaggtctcctcacattcttttcttagagcaactgccctgtttatctgtaaatcccttccgtgggtgtaagatagagtacagatgagacagctcagaagagttaaggaacgttgtgccaagcttaactacctgaaactgatctccagacagaagaagagaactgtccccacaagttgttctctgacttccagatgtatgtagtagcacatacttgtcacaaacaaacaaacaaaaagtaaatacttcaaagcaggactttcgaaattatatttaacttcataatcaaagataaatgatcattactaagcctattttctcatatgttaaaaatgcaaagttttgccgggcgtgatggcgcacgcctttagtcctagcactcaggaggcagaggcaagcagatttctgagttcgaggccagccagggctatacagagaaaccttgtctcgaaaaaacaaacaaacaaacaaacaaacaaacaaacaaatgaaaagtttttatgtgaaacacttaaccccgatgcatagtaagtactcaaaatagttgtctttaggcctgggtcttgtagctcagtgatagaacacttgcctagtatgtgtgcaatcctggtttaggtctcagcactgaaaaaaaaaaaaaaaacctaactttaaaaaactaggtacctaatgatcaatctaaacattatatatttgtttaaatactgcttggctattacgaccaatattaacaatattgcatattaacaatattaagacagagaccctgttctcagtaatcagttttagaggactgtatgttgaaaccctaaatgcagtataataaagtgtagatttttttgactcagggtttctttatgtagctctggctgtcttggaacttactttgtacatcaggctgactgtaaacatccgcatttctgtatctcctgaatgctgggattaaaggaatgcaccaccatccagctataaagggtagatcttaattatgataattaatttttcatgttgtcattgttttatggtactgaggattgaacccaaaaccttgcacatagtaggcaaacattctaccactgaatcacatctcagcacaatggatttttcagttttttcttccttttaaaattaagcagttttagtatacaaaatgtatttcactaaatatggcattttatacatttgttttattgtgcttccactctcctctgcccattgtctgcttccctcccccagattgtacctctgtgctgtgatgtcatatggatggataggtatttaactgtataatcctcatgaaagaaaacattcagtctttgtgtttcttcaccttcattatttctccttgttctacctcccttagatccattcctctcccacaacctccttctgttatatttttatatctagattctatatatgaccatgtaacatttgtctttgcataatcaatttcttgattggatgttatatagagagaaaatatttggaaaaatgtagcctctcttaaaactatattttggtcaagtacaggcttttagtagaaagtagcgttcagctttgaatgtttacagactgaaggcaggtcttggtttcaaggaagaggaagtggctggtgaggaggaagttctgttaagccatcttgagaaaggtctccacaatttaggactatggaaggagaaagagagaagggcactgggaggaagggagaaaggaatgaaggaagagctggggctgtgttgcagatgcaggaagacagatttcacaatgcttgtagaaacatccaggcctgtttcttgtgatctgaaacttaaaaggaagaaacaatctaggaaaggtagcaggctgctgatacttcaaagtacattgtcagtaatgggaagagaaacctgtgctgtgtggttgcacaggaagcactcagaggctcagatagaaacatccataggtgaaaggatactgagattcaagtgataagactcaagaaggtgaattgacttggaataggcatctgtaagtagtttttcttcctcataaagtttaaaccctattaggattaagaaccaagttcgttttgtttgcctctctgtgtaccaggtatttagcacaataaatattactgaatgaaagaaggagtttggaaaagtagatgtaaagtgttaaaagtacaagtactggaagcttcaactgtattcacaataacacaattccctgtcctctatcagcaatgtaatataaccattacaaaaactaaccccatctttggtttaactcaaacttctgtggtattttaaataaaaattgttactgctgacctgaattctgtctcaagctaatagtctcccctaaaatatctttttttattaatcatccccagtggtatacttaagaaagaccatgcaccaaacaagaagtagaattcagatattgtagatataagttgaaggaaataggcacattaacctatagatgaaaatgttttgcaaggccatgaagagggtctccccttcttattcatgtgtgcagagatccaagcaaggacaagtactggaaaagtgcagagacaggtattgtctccttgtgaggtaatgcttttgcagaatgaagcagtctagctcagaaagtactaagtcttcaagctagagacccaaagctgcagcgctctataggagggattctcagtggtactctagtctgtagatgagcatgtctttgaagataccaatgtctagcttcttcccagataccctgatacagttgttctggaatgggtttgatacgctggtttaaaaattcatgagaggtagccagtgtgtactcaaaattgaacacttgagctaaatggtcaaatgatcaattagtcattatttagcacttactgtgatccagatactatttaaacacatgatataatttcttttatatagtcttttttttaaaaagaacttctatttagtttatgtatgtgagtacactgcagttgtcttcagacatcccagaagagggcatcagatcccattacagagggttgtgagccaccatgtgagaattgaactcaggacctctggaagagcagttagtgctcttaaccactgagccacctctctggctctatatagtatttataatagtgtgtaagataaggaaagagtcataggtactgtggtctcagagctcttaagtggtagtacccaagttggggctcaactctgactctcaaagaccctgaaccgccttggtaaacttcacttctatcataactgatcaccgtttccttactaatgttaaattctatcaactaaagtagtttaagaggattcctttaccactatctactttagttgttttatgaagaggttgtactgtctagctttgctcctctggaagttattaatctttccatttgctaggtccataacaatatgcaagtaaacctagatttcatggaatcaaatcattaatcagaatttcttatttctgggccaaagagcaataatcaaaatgtttctaggaagatatcagtgcagagaacatatcccgagaccatttcttcaactctagtattcaagtaaaattaagtgatcaataataatagttggacaaaagcacgattagtgatgctgctagtgtcaagttggagaataaagcaaaagccgtgttgtttcaacaacaacagaagcatggcatacagtgccagatagtacctggccagcagcaagtgatttatcaatcaattcacaagttacagcctgtctcaaatttggtaactagtgtcacctttaaagtaaattgggagctgggcttggtagttcatgtatgccagcaatcatagttccttttgagtccagggcaggagaatcacaagtttacagcaatgttgtctaacttagtgagaccctgcctcaaaagaacaagttaaaagagggccaggaacatatctaaatggtagagcggttgcctagaagtacaaagcccttggagtttgatatccaatactgcaaaagcaaggaagtaaatgagtcatccataagtcatctggtatgttggtatcattcactcagtgatcatcatcaccaccatcatcagtattataattaatttggggaggtcaagacagagtttctctgtgtagccctgactgtcctggaactcaaactcaaagagcaatctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctcccaagtgctgggattaaaggcatgcaccatcacacctggattcactaattattcttaaggctacttattcatattttacttgttcgctataagaatttgccagtgaagatgagaaataagtgagcatagcctgttggcatggcagagctgacttgtagctcatacagtagtcccactcattctctaatagcaggtagtgtttgttactcagcaagccccattcctgtttgcagccctaagtgagcacttgtaccccaactgccaccatcctacctcccagattttcttcagtggctgtagccaagaaaagatcatgtaacatgttatttgggtgttatttctatcaatatcatgtgctgaaatacatacctatttgacaatggacttataataatgactgaatctattcaggccatacttcagaagctgcaggaactgctgcatacagaacaattgaaagcatgttacttgaaaaataacgatattagtactatatttagttttgttataaacttaactgtttacttttaattgtttgaattaatttttaaaaatatattgtggtttatttttcttttctagagtattctctttatttagttccaaaacatgaaacttaaattgtaactggtctgtaccataagataataaaaatataataaaaatgtttaagatggggaaacagtatagcattgtgaagtcaagagataataaataggaaatctgtagtatattgcaattaaatttactatgtctgaaaataactttagttgattcaaatacaactgcaaataattatgactacgcaatgccaataaacaatgtgaccattgttcttagttattctatccaaaaagaagtctcctttgaaaagcaaaggtgtcgtccaaagcagtttactcagtgactctaaaaaacagagatttgctgaaagcagaatagtgttaccagcatacatcgagcttcactctgaacattcaaataatcaagttttaactaaaacaaaggctgctgtgtgtggcttttaaaaatcagagaatacttacagttgaagctttcctgaagtaaaaggagtaaacccaaaactccctagaccaggttgtgtcagctgggctcttccatccggtggtggtggtgcaattggctagagttctcttcttttttatatccacatgtggtacagttgtttttccccttttctttctcttttcactgtgacagcccttgggtcccgtttggagctaagaaaagataccactcttagcaacagcttcaagttgaagtttaggaaattgcatcttctgtatgagtcccttctagcctaaactaaagagcatttgtcccctaagatgccaacaaactataaaatacaatcagaagtgggcagatgctctctttcctaagaaatgatgagtgatgtcctgtatggattttagaatataacccctgaatttccatttccttccagattcattttagaagttactaccatcatgaagtatatgaactttctgccccaaagtatactagcattgctaatagttggcttttgttttgttttgtttttactctttggttctgctgaagttttatttactctctatattattttagtatcattttgtatcttccttaaagaccatggattcatttcctaaaacatcttaaaatttggagactaggtgggatttgtagcactattttcgcctcagcacaatagtaaactcacccaagtaagccgaagtgctctctcctatttcaaggaaaagatgctgaggctctgcagcttccattctggtcacagtccactgtttaaccaccatcaattcatctgtgttactgctggccctgcactcgagtgtcatttccccttttggttgttgtttggaacatgattgttatcctccagctttgtctaaatctaacattgtaagtatttctggaaatattcttctgaacttcatagtccccagaacttttagtttagttttttgaagaatcataacatgtgagaccataattttacattgttagaataaaagtattttataactcttacttccccctgagaatctctgagcaggaagatggttactgtatctgtccagcagtattttttttcttactgtggtaagcgacacataccactagatttaccacatagccagttttgactctatcatgcagtgctgctcagtgtacatataccatcaggcagcagatcaccataacatttttatgatgcaaaattaaacctctaaaccctctatacacgaattttctctgcccctagtcttaacattggcaaccatgattctgtgacattgagttccattataaaacctttttgtgacttgtttattttacttagcctactatcattgaggttcacctataacgtgtaacctaatttcctttgtttttaaggctgcatatttccaatgtttgcctatacttcgttttctttattatctttcaataagcatgtaaattttctctgctttggggcaattatgaatattgcaatattgctgcaaccaacatgaatatgcaaatatttctaagattctgtcaggattttcatgactaaatgagtcataatgtgctttttatctcctgaaatacaatataaatactagttttgtattgtactattgtcctacacttatgacatcccatttcaaaattgcttttcagcttttagtgttctcatattgtagccacattttctcgctgatgtaaggtttgaatattatgttctagttcctgatcattctgaactttgtcaccattccttcattatgtgaaacccaaccctagtgaagttcagcttgccacctcttccagttctgaacctccccagtgaagatgaggactgctggctacaagcacacagccatacagaatagcctatcttcagattggcaatccaaaaccttaaggggccctgcactgccagaaatccttagtgtgaattctaatgtccttagtcccgtaattctcaaaggatgacttccagaccagtagcaaagtgggatcagggggagggggagggtataggggattttcaaagagaaaactaggaaagggggtagcacttgaaatgtaaatgaaaaaaactctaataaaaaattcttcatatatatatatatgtgtgtgtgtgtgtgtgtgtgtgtgtgtgtgtgtagtcccacatatatatatatctcattcagaagcttgcaactgaagttcatctagacccaagagtctgtgtgattctggagttaaaatgtaagggccattgccctagttaatcctccctcagaaatagcttttcacacctttgaccttctcaaactgccagcaacctcatttccttccccactctcagctaggagttgctttttgtttctctaattaaagagaaacccttagaaaggaacctcctctatatctacaggcacattacaggaaaggtctgtatgtctctatgtatgttatttcttacttttaatatcctacaaagaaggagggaaatattgaagcataatcaaagaaaagaaaaattagacctctgaatataatttgttttgcaattttgagtttggaagtacagacatgttttctgtaattaaaaccccaaactgtacaagtctaattaaactaaatgagcctcattatatgacaaaataaaagcataaccacatgaagaagttattttaggttcctttaaaataggattgggggtcaggacatacttttagacttatgaaaaagctacattatacagcacagtaatcaaaattgggaaatttatattaaaacaataccattatatatttgacaatccttgttacaaatttcatcagctgccctaataatatttttagagcaaaaataaaaagatgacatttatctgtgatacatctttagtttcactgaaatccttgagtccaaagctagttttgaagagcataagcctgctactttctagaatgtctctattattagatctgactgcactgtttgccaaggataccacaacattatttttaagtcctctgttagaggctctgaacttggtaaataagtgaaattttatgattggtttttgaatacttaaacaaagagtaacaaatgaagctaaataaaacaagaatggcagaagggtggttcagctgataaaggtgagtgccaccaagcctggtgactaagtgtgatccccagaacctacacggtggaaagaaagaactgacatgtacaagttgtcctttgacatggcacacaattatgcacacaaggacatacacacaagagtgtaataaaaagctttggagaataagaggatttgttcatacaaggtgataggtatgtggaagtttattcattttcctgcaattgtgttacactgttgaaaaggggtttcttcaattccacatgatcctctcgctgcatcccctgcctccattcctagcacagaaaactttgaaacttatctttacttactgtctccacacccattccctgcagaacctagaccaatggacatttttatgtctatcatgccaccaataccacttttgtcattggtactattgacttccaaactgccaaagctaatcatctgttctcacttctcaatttaaatggctgtagtaacactgatcactactaagcatttcttcttgacaaaaatgtctttccattggcttctgagatgcaaactctgatgctcaccttgtttccctgtctgaccattggtttccatttgctagattcttctgatctttctgccctccatttacccactgagacccaactcccatcgtcttctctaatagtagtcactccctcagaaacttcattcattcattatcttggctgttgatccccaaattcacatctctaatcccagctcctatcctaccctatcttataaaactgaataatagtctgtctttcaaactcttcccctagaattctccatttcagtaagtagtatctttatcttcactccaaggctcattgcaagaacctgcttctcaggcttgacctcctctttcaatgtatccatcagcagctcctgccagctttacctttagaacagaagttcttgccatcgctccatagcaccatcctctcatgtctaagcagctcagggggctcttttttctcattcctgtttctgtagttactggtctgcagagtactcaggatgatcctttctaaaccccaaagtgattacagtgctcactcttcagagtctccgggtagttttccatcatgatcagtgtgaaatccagtgtgaaatccagtgtgaaatccagtgttgaccatggttttaaggatgtgtgatcacattttctaccactctgcctttgcttattctttcctagctatccttcatatgtcttcatatccttgatatgtcttcatacatatcaagcctctgcacatatctagacctttgcagttattaacttctctgcccagagtttgcttccatgtggcttgctttttttttctctcctcaccctagtctctgtttggattttgtcacaataagaagggctcctatgacacccaccaaataaaatagcagttccctaattttacattatatgctttgggcttattctctctccatttgtatctatggatatagttttttttttaacctggagttcaaattttatcactcttgacagataattgaaaatggcagaatccacatagtgatgagaatttcatagattacagtttaacattaacttcagaagacataatcaacagactatgaagagtgtaccatgagcttctgaccctaggaaggtgataagatgcttccaccgatgtgaccaagagaccctatttgggtctaagctataattttccccctgcatcatgcccatgatttctcaggcatgcaggagctaggaaagagctctgcactgagcagcatccacagctcgcatacattcttctcactgctttgtcatgacagtttgttcactattcatctgtataccagcttttccttccttccttccttccttccttccttccttccttccttccttccttccttccttccttcctgttgttctcatatactatgcacacttctattagaggattcatctttctttatgacagactatgtacttttccacagtagatttctgatgttctcattaggaagaataagatccttcccactcccatttatatcaccatcaatatctgtgtgggtacactagctcagttttgttgtacagagtggtgggggcctttgtttcaaggcaactttcttatcacctaaactttaaaatgataccaattcccagcacacatactgggtggcttacaagtacttgtaaatccatcatataaagagagaataaaaagtgtcataacttaaaaggcttgtctttttatatttgagaatcatccaaatgtactgttaggtgtgtcagagaatagagtatgtgagcagacaccaaaggtcactactactacgttcttctctgacaccacctccaacaaacttccatagagaaatagatgaagataagatcccatgggaaagcacattgttaccacaaggtaggaaggaaagcagatccacaggcaatgcccagaaagaaatccctgggaacacagctcaattcaagttagtaaaacccaacatccacaccttccatcccagcacttgggacccagaggcaggcagatcgctgtaagtttgaagccatcctggtctacactacaagttccaggacagccagagttacataatgagaccctgtctcaaacaacaacaacaaaatagccatttgatattcctattactctggggtagaaaacataaagaaaagaaagaagatggggaaggtgagcaaagaaaagaccattggcattccctaagggtcaaagtgtagtgactttaaataaaagcacttatgtagcaggaagaagcatgccatgcatttctgctgaaacaaatataaactttaaatcaaatacagagactattacacacacacacacacacacacacacacacaaagaaagtatatctgcacttgtagaatacccatgctttctgggtgataatcttggaaacaaataattcctaaagtctttagagaaagaatttagaagtgagaaaaggacaaagaacttaagcatataaaataattcaaatgcttttatttattatttattttttttaaatttgggacaaggtttctcagtgtagtcctaggtgtatggaactcatacacctgcttgcctctgccccccttgtgctaggattaaaggtttgcaccaccactgctcagcttcagaaacttttttaaaattgaaatttgtttttataataggtgtcttaatacatgtagtttttattttagggagggttgagaggatcaggaagcaatttgtaggagtctccactttgtgagtcccaagttgtcagacttggtggcaagtacttttaccctctgagccatcttgccaaaccaatttccaagttttgttttgtttttaagtacaactatattgtattatttagttttatgcaaattgaactcttttgcattaaattttatctttgatttgattgttgcttttttttcttttcagccccactgtgttctccttgcctcaaaagaaaactcggcacctgttaaacttgggggctttggggtggccattcagttaggagaatctggacttgttgctggaggtaagaccactttaacatgctcccccttcaaaacctgggtggtatgtatgaagattggaaggaaggatagctgggaaagaacgagcaaaggcagggtggtagaaaatgtgatcagacatccttaaaaccatggtcaacactggatttcacactgatcatgatggaaaactacccggagactctgaagagtgagcactgtaatcatagtgcacaaagagcttaccatttggaaattgaactggacaaataaagtcacctctagtataaatgggtttgccttttaggatcacagcatgcctaagcttaaatttcctaccattttcctttttctatatatcaaagaagcctgctaaagtcatcagcctatgtgtctgtgaagagcaaatggaaaagaataacaaggctggttttctcattaaccaaaacaaaacatgattttaaaatgcctgtgccatagtagaaagtgaaatttttcaccagagtacagaagtggatgctaattcagattccactattgtagagtttttatgaattcttttccagaattcagaccacagcagtgcccagggtttacttctatttcttagttttgcaaattgcagttctccattctgtactgctggtgtaggcagtgctccgaatactaacagcttcacgaggaatcaaaacttcatgaagcatatcctttagcatagagtcttcaagtcaatttgccaaccttcagaaaacctctgttaagccaggtgtggtgatgtacacacagaatctcagcgcttaggagactgaggcaagaagattgctttgagtctaagaccagccttgagaacctagcaagatactatcccataaaagaaaatgaaacaaatgctcatgttaaattcaaatgctttccaaaccctaacttttaaaatagctgtctgtttcacaagatagttcgttcaatttgattgtggctagagcatcaagcagtaataacaatggccatcttctgaaaaatgagcctgaattatacttgtattttaaaaatcactctctgccacactgctctctgagattaaattgtgttaagatctaatcttacatacttttctagctaagtatttcctgtaaacatgggaataagagaaaatgagccacagtccttttatgttatatgctaagatgattttgtgtctgttactctggatctccattctgttcatattcattgtagcatagactatttcacaaatcttgatgggggtagattcactaagtttgcctccatgttcacctcttttcctaaagactataaactcatcctctaatttttattttttcaacaatattgaactcacatgttcattattcaaaaattactatttttatactctaaaaaggttttattttacattgagaaagaattttatatggtccagagtggcctccaagttgttaaagagttgaagatctgaacttgtggtcctcctgactccatgcctgaacagtaggattacagatacaccatcacacccagttgttggcgctgggggtgagactcagggtttggacatgctaggcagggactctgctaagctgcaccctagtcctaaagtactttctggtagttaaaatattgtcatttcttaatgtacctttccatatacctttcaaataactattttaaagattacagtactttaaaaaacacaatgtgaataggtaagagatacatgattttccataggaaaaaaagcttttcttctgtttaaagtacttttgaaattttactaatatttatcaattttggaacagaaagctcttttcctgtagattggaatctttgactacctgggcttccaaagagaaaaagattatcttcctttacatgttctacataccaaaaccatgtaactccattgcatttcccctatctaacattcaactgtttagagaatccacttactctgaatacaatgtagaaaacaattacagtgtagtaaaactggttacccttaaaaagtcctctccattgaaaactaactacatacataggagactgccttcctctgcttttcattaaattgtatagatttgtgtcccctcataatttgcacctcctattccatttgcttagaatgcctattgtcattttatctgtcgcatttaggtgtttgcttgaagactaagctaacaattattgccttttaaaagcaagcctattataactgccctagttatatgacctatcccctcttccatctaaccagaactatctagcttgcttacttcctaacaaaatgtgatcaaacatgtaatagcagcaaaggcaagagtgagtggtaggagagccatggctcatccctccaaatatctgccccagctatcacagtgcctaggtcctggcacgcactctagaaatgtttaaatgaaagactagtggctagccattttccagtcagtagcagattataagcaacaaatcaagacatgccaggacttgagaaagcatggtgagaagaaagaaaaggaaagccaggtgacaaaatgcacagcagccatctgataccacagaggttcatcgttacatacctgtgaagctcctgagagaatctggactgtagcattgttcctttgttgatagccagagtgacaagtgaagtcaccacaaaagggctaaatgctgtgtaacagcctatgaaaaactagtgaggaaattgtaaaaaaacaaaaacaaaaaacctacatatgaagaagataacagtggttgtatgtatgaacattcaaatcctaaagtattaaaaacataaccactcagaataactccctccctgaagtttgaggcaagggttattattttattgaaattagcatttaaatatttatgtacctttctgaggtatttcaaaaagttacatgtttggtttggtaattggtttcctgttcttagaattttgtgatcaaagtcataaaagtcaagtggttaagagaggggagggagagggagagggagagggagagggagagggagagggagagggagagggagaggagaggagaggaagaaaattagtagcaaacacaaggggtttagtgaagtctttcacattctactgatgttcttgacattaaaaagccaccactgttatctgtcaccactgagcaaatttttgaactcaaagtacacatcttcctgaagaaaaagcataaatttcttcatagtgggggcatgcttcaattcatattaatggagaccacattgatggagagagcctctttaggatggctgggcctgactgtggaggtttcgattattcctcacaaggaggccccccacaatgagtcactctgcctgagtaggaagtcgtaggaggtgcgtgtcaaagtaccatctgaacttttcagcaggtaccaaatgggttctggtagctgtacttcaaatggtaccctgagatattcgccctgcttttttttactcctcgtagctcctgccctgtccatcaaaacaatgtttattttcctgggaccctgccttacagaagctgccaatgaagtgggaagttcagttcccaatactataaaatcaattttgctgcttgaagaaacaaaatcagacaatcaaaaaaattttttctctcatcaggtccttatagccaatgctgagttctcattgtacattttgagtgaaggtattttccctgctagaatcctgagcttaatctcttcctttcagaagtgtgagagagacagctctatcagggtcctttcagcaaaatcttgcaggcatatgcaatagtgtctgagtttggtggctaattatgggatggatccctgggtggggcagtctctggatggtccatcctttcatctcagctccaaactttgtctctgtaactccttccatgggtgttttgttccccattctaagctgtctcatgtgaggctatgccagtgcatggcaaatacagaagtggatgctcacaatcagctattggatggaacacagggcccccaatggaggagctagagaaagtacccaaggagctgaagaggtctgcaaccctataggtggaacaacaatatgaacaaaccagtacccccagagctcatgtctctagctgcatatgtatcagaagatggcctagacggccatcattgtaaagagaggccccttggtcttgcaaactttatatgcctcagtacaggggaacaccagggccaagaagtgggagtgagtgggtaggggagcagggcgggggagggtataagggacttttgggatagcatttgaaagtaaatgaagaaaatatctaataaaaaaatagaaaaaaaaaaaagaagtgggagagaacacagagtgacctgcagtagaggcgcacctgtaatccaaattgaggagctaactagcctctccacccctgctgaatttgataaccatcaacaggccttggcagcatgttctctatagatgggttaaacggtctcttaggttctttttaaacacaggaccacagtgagataaagtattttacaatctccaaagtaaaaataatcttggattgagcataagagtcatgcagatggtcaaaaaacagaggaaggaagggcagggctgggcctgcagaatgtagacgagctgccaagttggttaggcagtggcctgtcccaaagtcctttcccggcacagttgaagccttttattcctccacagaggaaaagactacctcaaggctactcagtgaaagatggttatagtgtacatgcagctccaaccacattcctcctagaaaactggtttttgtaagagagggaggaaaatatgaaaacgctttaaagaacatgagagtcaaagaggattgcgtgggcgggagttcctgattttgctttagtgtatgctctcattcccttcaaatgtttacattaggaataagctaagtattcccattccagtagccactgagaattgctgattgacctaggaacttggcagttaaaagtcatctttttgccatcaaactgttgttcacttatgcatgccctcttcctgcccctgcctctccttaggacaggtacagactggccaactcactcttccccttcctctgctctaaataggaacatataaaattcttcaaggagcaagaaatagaagacctactatataacatacagaattcaaaaaagaggaccagagtcctgttctaggcccagtcttttctgacccagtgatcagataaactatttttgctttctatgaattcctttcagaaagggaaaagaagtactagaacattgatattggtaaattttttatccagactgatactgctttttttaattttcagatttcacaaaatcagttttccataatgttgctgttttaaatacaggccgcgttggaacacctcactttatggccccagaagtggtcaagagagagccttacggaaagcctgtggatgtctggggctgtggtgtgatccttttcatcctgctcagtggctgtttgcctttctacggaaccaaggaaagattgtttgaaggcattattaaaggaaaatataaggtaatagactatggccattttattttccatacaaattaaatgatcctgagaaaggtacttgtcttgaagttgttgtctgtctttgctcattaacttactactgcctgaattcctaccccgccagagcaaaggtctgtgttgccatcaggacccagtagccttgtgaagcacagtggggtcttgggaagtttgagtcaccatgagctcaactcaatgagcagcagacttctgtgggccttttttgtatagtttaaagcccttcatttttaaagcttttttcttaattcataacactcaaatggaaatttcactcaggtactttttcagtcatttcttatcttaattttaagtttccaccatcatagccaaaaaagtctttatattgcagagtgaactgacatgtgagctttacaacatgtttcataataacagttcacaggtactttctttaaagaattctttttttattagttttgtgtatatgtctgcatgtaggtaggtacatgtgaatgcaagagtctgcaggagatgttggggaccctggagctagagtacaggcagtagtgatcccacccaacacggataataggaagcaaactcgagttctacggaagagctaagccacctcttcagtcccatcttagggacattttgatatgacttacacattcatattccttagctactatgcatcaaaagcctgaaatattatcactgtcttgtaattactagattactgctttcattattaaaaatcaatgctgtgactgacattatggagagttatatcaaaaaagccctaaggactctcagaaataaataagctgaaggtccattcacagtcccaacccatcttactctaactatgtatcaatacatatatctggtaaggtctagagctgtgatagtgtgtatctggtggcacttaatgctggggaaccccccccccattattactgaagctcatactttctatacaactgaatcattgcttcatttttggccatgcctgataatgtaagaccaaatataaatttatataacactagactcccaaactgtgaagctgctaacatttcttttctatttgtcagtaatgttataatttttaagatttattttatttttaactatgtttgtgtttgcatgtgggtataggcaccagagagaatagttgccagtggaggccagagacatcagatctccctggcgctggagttacattacaggtagttgttagacaagtcatgtgaaagctggcagttaagcacaggatctctgcagcaccagtattcactcttaacagttgagccctctttccagcccatcatatggaaaggtagtttcagagttacagccttatccttttaaactataaataagcacatggaggtgaaaatggcaaatactttagtttaccttgtgcactgtccactcatgagagcaaacggtatctttctgaaacagaagttgtaagtatatgcttttctacttgtcttagagtcagttgaccagaaaataaaagtaatacttttaaagtattgcttattaagcaatggtccccctcctatcctgggagattgtgaatgttaccagtaatacaaagactgggctttctggtcaaatattaccaaatcaaatgaaattacacatgctaatgtattggaagaaactcagttgaaaatgaagggccaggcatggtggtgcatgcctttaaccacagcacttgggaagctgaggcaggagaatctttatgagtttaaggctaatctgggccacatagcaagctccagaccaaccaaagctacacagtgaggctctgtttcaaaaataccataaggaaggaaacaacaaagtcaagcacaggttactaagcatagcagcagacagtacttcatctgcagcaggacctgaactttagctgagcactttagtcagtcttctcagcagctgatggcgtacttaccacatgataaaaatctcccacctgcctttttgagttataagcatttgctaacaatagaattcttcctttgtgtttgttcatttgcttacttcctggtttccaaggcaatgtgcttcgttccaacagcgtctggtatttgattttgtctatttttaaagcattgaatacttattttttatgccttggtaagtaatttcgactgcttgtactgtctaaaaattaagttattttaaaatttcctattcttagcaaataatggcaatattattaggaagcgataaggtagcagccataccatgatttctgtaccaagggtttgcagccttgcatcttagaatttatttcccattttatttagcttttctctcttcttgcttgtcttcatggtttcctttacaaaaggcccaggtcttcagcagcagtttaaagcatggagtccacttctgccacttctatgaacttcatgggccttgactttctgttcttttctttttcttctttcttctttctttcttttttttttttttttgatatagtgtgatatgattctatcagtatgcattgatgcttctttatcatggaaatgatcaaacacacaggatagtggaaagctctcagcttcaatacttaatatattaccaatcttgttatgcatttcacgcacttttatgctattctaaaacatctcaaaaaaatcatttcaacaccatgatggtacttaccaaaagaagcagtaaaatcctgatcttggacatttgtaagaaaagctcaatgaaatcacatgaggcccaggacagggaagaagggtgttttagttaggtttctactgctgtgaacaccatggccaatagcaagttgtgagggaaagggtttatttggcttataggttacagtccataattggggaaagccaagacaggaacttagaggcagggaatgaagcagaggccatggaggaatgttgcttatgggcttgtgctttgccagtctgatttttttaatacaacccaggactaccagatgtagccctcccctcccacatcaatcattaatcaagaaaatcccacagacctacctacaggccaatcagatggaggcattttttcaactgagctttcctcctgaataactctagcttgtgacaagttgggggttgggggacaaggaagcatactatctaggcagtggctaatcagtcaccaccatgcatttcagacattgcaacacatgtaccaaagatgagcatctaaaggtccattgaccacaattccaatagaatgacaatatttaagcagtcttgtgccagttaccgcatgagattcaacaactgaaagtggttgctttagtaattttgcctctaagaaaaggaaactagaacattgtccaactgtaagagctctccctagcatacagatgctttgccctccccatctgtaagttcaaagcctcacctgagccaaagcttggtgtctgttgctagcccttggccaaactggaatgattcctttatgctgtgatgcaagtactgtgatttcatttggctttaaattattatatttattctccatcattttctcttaagaggtggcattgatctctaaatggttaaggtcagcacactgagccagagatgtagttccttggcagagcacttggaccagggttctgtctccaacactgacaaacaatagcaacagttacaaaagctggatactataagaagcccctggtaccaggcaactcccatatggtcattcagtcaggcaacttccccttttgccactaccttcagttcccacttcccttcccagctccaagctctgagcaatttccttgagtgtttttctcatttctggccttagacatgtcctctttcccaggagccttccaatttttccctcaaagatacacatccattatcaatagacttgaaaaacgtgtaattctttttgtttactttcactcagttttaccacatgaattagttgtctcgtctctaaaagaaaggacttcactgagtagtgtacaagtggaattggctattttacagagatatgatgataatatattttttcttatatattgaataccccagtcagaatatccaattaatgatttttttatagcttcacaattaatgttgcccccagttttgttttagagcttgtgtgactgtttctttcttccctttaggaatttttccccagtctaggctgacctcaaactcattattcccttgccttagtatctcagttgctaagattaaactggtgcataccacactcaacacctggtcctaacgttggaagacactggttttcaaatctttagctgggtgtgatggtacagacctgtaatcccagcacttaagaggctaaggtagaagcaactggaggttcaaggtcaacctggactacactgtgagttctagtctatcctgggcttaaggaaaccttgactccaaaaaggaactttctttaagttttttcacttcaaatttatttcagtggaccagtatattctagcctttttagctaaaaatcaaaaactagaaaccagcgtcatgagcagacctttcaaatattgaaaatattataatatagcagcaccaatacaataattgctgatataaataatgaggaacaaaaccacaaagcactgcatgtcttcttccttgggaagcaggtctttttttttcaagacatataaagatgtatttatattatgtatgtgagtaccctgtcaatgtcttcagccacaccagaaagggcacctgatctcattagagatagttgtgagccaccatgtggttgctgggaattgaactcaggacctctggaagaacagtcaagtgctcttaacctctgagccatctctccgggccctttaacagatatactaagtcatgaaaagtgagagaagttgaattgacttaaaattcatttttctcatgatcctcattaataacttatttagctctgaggttaagaagtagaatatgaattactcctcaaagatataatataatttccatagctatatcacaactgttaaatacataatcaatgtttcttatagttgttacacttattttgaaagatgtgtcgcaaacctggcaaaggctcaggcaaaatccctatttgttgttgttgttattttgcttgcctgtgctctcttatttcacctgttgtaactttaagaagttatgattttgattcaatgtgtatattttacatgttttctcaatgtgtctcttgatagtcttgttctaatattcttgcaaatttgtgtacttttttcttttttttatattactgggtatttatttcatttacatttccaatgctatcccaaaattcccctacaccctcccacacccactcccccacccacccactcccacttcttggccctggcattccccagtactgaggcatataaagtttgcaataccaataggcctctcttcccaatgatggccaattaggccatcttctgatacatatgcagctagagacacgatctccgggggggcactggttagttcatattgttgttccacctatagggttgcagatccccccagctccctgggtacttcctccagctcctccattgggggccctgtgatccatccaatagctgactgtgagcatccacttctgtgtttgctaggccccggcatagtctcacaagagacagctatatcagggtcctttcagcaaaatcttgctagtgtatgcaatggtgtcagcgtttggaggcttattatgggatggatctccaggtatagcagcctctacatggtccatcctttcttctcagctccaaactctgtctctgtagctccttccatgggtgccttgctcccaattccaagaaggagcaaagtatccacaccttggtcttcgttcttcccgagcttcatgtgtttcacaaattgtatcttaaatcttgggtattctaagtttctggggaagcaggtcttttaatctctgttatttgccctgagaatgttacaccgaaagagtataatagtaagtgttgacttcttgaagataactgtgtagctttccttgtttcctcctcagatgaatccaaggcagtggagccatatctctgaaagtgccaaagacctagtacgccgcatgctgatgctggatcctgctgaaaggatcactgtttatgaagcactgaatcacccatggcttaaggtaccgttgctcccaggtcaccatccacactgcccttaaagaattctacaacatggaccttttcaccattacttgttcctcagccttaccatcagctttgtccattatgtttgctctcttgcaccttgtccaagacatgtttgatatttagctattggactgggcacaaaatcaaattaaaacaggctattgtccagcaaagatgaaaaggaacatctaaagtaaccatttcatcttacattatctttacattgcatatgactgtatactctgtaggatttcactggttttcagtaggtgtagatttacagttttagaggagagacacatgtagaagttggttttgtatcccatttttctggattaaggaaaatcaaatcttaagacatcagaaagtagtattgtttcattaaagcattgtgccataattccaggaaattcttgcttcataaggaagaatacatcctcagagatgttcagaattttgccataagtcacaaaagtttttactgttagagccaagattttatttagttcagcctaccatacccattatttatgctatatatcctgtccctctcactaacttgatgacattgctccagctacttccctctttcctacattatcagttttctggatcttttggagttaatgtgttgtgattgtttttattgcttacatacacatgcatgcataaacatttgccttctcttgatcctacaaattcctccagcttctgcccctactccttggttctctcaattacaaaacttaaaagaattatctgtacccatttctccaatctttcctatccctttctcttaagctcattcatactagtcgggatctaccaaccccactaaaacaattcgtattggctatgggtatgcttcagtagagtacttgcctgacatgtgcaaggccctgagtttcaacccagaaccgccaaagctcaaaagaaagccaactcttgtctagtcactattgaccttcacatcactaagtctactgctcaaattccagagctacagctgcttaatctgttgacaacatttgacatccatctcgtgaaactttctccccttgactgccctctgtttctcttctactagtctgactgctcctcctccagtcttgcagattttccatcacctccttatatgacatcacatggatgtgccactgactgacctccatcccagctctacatctctttctccatctcactctatatgtgggaggcctcattaagtttgactgtgtttaagtatctgtacatgatgagtcctgaatccaggcctctcacctgaagtattcttccttaacctactgtctaactgggtttcctggtaccttgctgatttaaccatttcctagtctcctgtgactcagtttctgtcattctggcctccttgctgatcctcagaccacagtgttgcctcaacattcctgtagtaatcatgctgtctctctagaatatcctttttctaggtcactttggggatttccctcacatcaaatcaatatttagataccagcttcttctggtgactattatatcatgatgcttcctcagaggttatgtaaggcactaagatatgtaaaaatatcgatcaaaaatgtatcttggtgactacgatgtggaatgatattatagagcaattttgacatttcagtgaatcttgatccttcttgggctgaaggggtccaatgataaagcacccataaatcctagcatgcataaatccctaagtatggtccccagtaacatttaaaagaatattacttttgaaatcttcattcagccttttgatatcttactactagtatttctggttttcctagcaaagaatagattattcagtactttctttcttttagtaagttttagtatgtttttctccctgatatgaaatgaaaatcttagaagattcctattccttccttgcttctctcagctttttctaataagggtcttttgtcatttagaagttactttaaatgccaaataaggacactagcagctgtttaagtcatttttaagatcctttataaaaagtcttagcattatacagttgcagtggcttacattatcaaagcttatcttgtgtaataacgtacttcttcctggaaattcttgtttctaccgatgattatagatagttctcaccctaagtagtctgagctgtatacagaatagatttctggcaccaaaaaatgttttaaaatgtcagtaatataaaaagaaaagtctggaaagctgaactcagagtcacctgctgtgtgtgaactactgcttattcacattgtttatgtgtcatctggagatgatgcagtcaataaggagcttatctagctggagggagcaactttagtttacatttagtccttgttcctgtagatatgtgtcccattacagtgggcgtaagttacgttgatttagaaaggccaaaatgtaagccttcatttaataaaaatgcctttaataactacaaagcaaagaaagggaataatgaaacttatgcaataaagtatccaaagtcaaagtatcattgttttaagtcaaaaataagagcaaaaagaattatttctttggtttaaaaaaaacagatatttttatttattccatgttgaaaaagaatctgagtattaaaccaagtaatatatgaatcccttatagttattgactttcacccttttaatgtctttatcttattaatgaaataatggattaatgaaaacttgctatgaatattcatcctaaccaaagtagaattaagtaaatactgagttcagggtcatagttgtagtgaattttctagtctgaaaggaagcccgcgacagactgtaaatagagttttcgatgttactcatggggagtaaagacagagggttttctcctgcatggatagcttcttctgtgggcatttcctggggctcattttctcagggtttcttgtcctttgacttcccaagctgaatcaaaaaaaaatgaaataaagcaaagtaaatagaataaataaaatcgcagcaatatcagcctaggatctctcctctaaccctcaggcccctaaactgtctaccttcctttctccagctttcagtcttcagccattacatcagggaacctccccagggcctttaatcagcagaagcatgcgatgacatgtgattgcgttgtctcaccactcaccactactcattcctttcagcacgtcatttctgaactgatttccttattgtcagtacctaacagtttggggaaagtgcttatgtattaggtagggaatattgtcacaatcaaccgtaaaccccatttgttgatgtgtatccaaataagacatgcatctttcaagctgcttgtcctagtcttcccagtacaggaggaatcagacttccatttactcatacccaaaattgtggtatatcatggtgtcttcttcctcccattacccatagtccgtcagaacaccctattctacctccagatacatacatagctaaaaactgttatttgagggacactagtaagaggatgagaaacaagctataaactgagaataaatctttctaaattatgtatctgataaaggacagaattcttttttttgtttgtttggttttttttccattttttattaggtatttagctcatttacatttccaatgctatagcaaaagtcccccatacccacccacccccactcccctacacacccactccccctttttggccctggcgttcccctgtactggggcatataaaatttgcgaaggacagaattcttaaaactctataagaaaacattgaatctgatgcaaactttgaaaatacttaagcaaacattttttacaaagatacgcagatggctgataagcatgttcaaagctgctcagcattagtagtcattagggaaatccaaataatgccacagagagagacacctgtacacttgggttagaatggcttaaataacaattgttagggctagacaggtagctcagtggttaaaagcactggcttctcacaacaatctgtaactccagttccagagaatctgtgccatcttctggtcttcaaaggcactgcacacacatggtgcaaatctacaggcaaaatgtgcacattaaataaatccaaacaaagaattaataaatgtgactaatcacacatactgttaacagagatgcagaatatctataactcatgctgttactacgagtgtaaaaggatatgttcagtttgtaaaaacagtttgactgcctcttaaaaagttaaacataactcatttacatggcctaaccattctgtctgttccttagaaattaagtgtatattcatacaaagagtgacttgtgtctgaatgttcataagaaggtttttttttacatttatttacttacttacttactgccatgtgagacacattctcactccttggacctttgtgctaggtactttgctctatttcagttgctctctaggtaaatagtaccccatcatatgttaattgtttgcttactgattgccagtctggctagttgtgacttgtattctccaaggactaatgaggttgaccattttttttcataatgtttattggccatatttatttcatctttggtgatgtatccatttcattagcccagttgttgagttggttgtttcttaggtctcgttagtcctttgtacattccagatattacgtttctgtcagatatttgtctagcaaagatttttctgtataggctgccttttcagtcaattgatagtttctttgttgtacagaagccttttaatatcatgaggtccatttgtgtgttgttgaccttatttcctgagtgaccagggtcctattgagaaagacctttcatgtacctaaatcttcaagtgtttccctatttttttttcctttagcagttttagaatttcaggacttccattaaggtatttgatccatttggagttgacttttgtgcagaataaaagatagggatctagtttgattcttctaaaatagagtttgaaattactctcttggaattctaaagggctgctacaaaggaagttatttctttctgggcaagggcagatgcagaccctgtatggatgaagtggttgaattagatgcccattgaaaagtctgtcctagttggaagactatacatttttttgatgttcagttgttgctgacagtacagaatgctgaatcagtatagacttcatttttaagagctcattttacctgaaagttcataatgaagacaacttcaatacaacatgtgtatgtgtcttcaaaaaaaaagctgtaaagaaagctattattttgcatgctaactaaaaaattaaatagaaaaagataacttcatacttttataattattatgaaaactttgtctaaaaagtagataatctattactttattcttactaagtccttcattcttactagaaaatattatttagccatcaattttaatattcgtagaacctctatcagaatttgtatcagtatatagaataaaatagcctagccagttccctaaaattaaatctcaacgtcaaatcgaagaatatgaccaacacaatttatgttaagcttcttgattttctcagcggttatgtatgatcataatcttcttttataggagcgggatcgttatgcctacaaaatccatcttccagaaacagtagaacaactgaggaaattcaatgcaaggagaaaactaaaggtaaggttttaagaccctaagagctcactagatggagtttgtaatcatgcttctgttaggtttggatcttcataatcacatccttgtgttggccattaattttgctacagctaaattatctctaaaaattgttgctatttcattaaacttttgggtatttaaatcaaataaataagttaatgtttcagtatgaatcaaaacaaatttagcaactagaaggcacatcatattttagatttgttttgttctgctaaacttcatagcaaagacatggctacattatgaatctaagctatgtttttccaaacataaatatctggacaataacatggcacgtgtctgtaatcccaccactaaaaaagctgaagcaggaggtttatgcatttcaggccagcctgggctatatagagacactacttcaaaatgttaaattaacaatgataagactttaaaattgttaaatgtgaccttagttctctggaaactgcagctgagtttacattggctctagggttcaacaaccatcttaaagcaataaataaaaggcacactgccataatgtatgagaaaatgtttgcagatctcctattatcctttattctttctccgtggcttgcttaccactctccctgccctctgtctcaaaaagtaaaggagcacaaggataatggctcctcacagggagccattgtagttcagaactttctgacaaacacccacaattcagtggtggagctccccagctctgggaggaaatgctatggggcagcagaagctcgccacaaagatccagaggaaatgattgatgtttgtttgatctgtgctactgaacgtgttaggtctgttctagaagtagctgattggataatagtctctaatcacaagactcctaccaactacaaaacttctggagtattttcagatgtcttaaattataatactatttatcattctttatgccttgaagattatgaatggttttacacagctggaaattatatgtaaatgttttggggagactctcagggtataatagtaccatagaaggcagaaatgcccacaatggtgtccattagccacatgtaggtgtgtgagtctaagttacttaaaatttaaaaatccaagtgctagttccccattcataccatcatgtttcaagagctttgtggcctagtagttaccttactgaacagcacaaacacaaaccattcctaccctattaaaagattccactggacgtgggatgctgctgaacagcagaacttttcacacatcactgttaatgatgagcatttttagttaagcttttctcctaattcttttgttgccaggagttcgaacgggctcttctctatgttttttgtaaaatccttggcaaaaaatagttattaatgatatgccattgttgagatggtgcccggagaagtttcttaaggcttaacatctttactttgacgtctccctgaactgctataggctgcaaaggaaagaaaagctggtcagagtaaaatttgggcagctctcttgcacttagttgtttgtccaaagaaacaatgtctgagcttctttcttaactcttctctaaatctctttcatccttggctctgctttggcttcacataacattactctatgcaaggtcaaggcttcattgcccaaacagaggtgttccactcaggcttgagctcacccatcacaggagacatgctcttcccttggtgccacagaagcagactggaccaaaaatagccaaactggtgactgagattcgtttggacagagctaaactatcacaacaagcaggggtcatgtggatttaccacatccctttacagggctattaaaagtctcaagacccgccaagctgtgtggaattagaaacatcagcctgatgattgtgggcttgttttcagctaaggctacattcccagagttgtcagctaccaggttagcacgtgcaacaccttccttcctcagggagcttattctccttcttatacttctatgaagttctacaacaaagatggtaatttccctggtttccatcacccaccaccccacagcttatttccacaaataaacagctaggtgcctgctcatctttacccccagacactgatttaaagttcctcaaatggtgcagcaaccaaaattttaagaccactttagaaatgattctaaaattcactgaaaagatgctgaaagccaattactgaattttgattaatagaaaaaaaaaagaggtatagagcaatgcaagaagaagtacctcaaactctgttgagtgggtgaatcctggttctctatgcttcagtcatctttatctgggaagtatacatagtacaaaatgcagctaattcctaggagtagcaggatccaatgagctactgttacagcagttagaagaacaccaggatgtggtaaatgctccaaagatctcttttgctattaactttgtgatttttattaatacattattaagattttaatggtactaccttagatttattaatctataaagactgtaattcccaaataaatattgtatgccattttagagtcttgctagtcattcactttaatattttagaacttttagaaacttttaaccttttattacttcttatttattttgtgcgcctgaaggtcaggaaacagacatgccatgccaggcatgtggaggttggagggcagcttgtacgaggcaggcacctttacccactgaacactcttgccaggcctgaggaacactaaaaaaaaatgtataaaacattgaaaacttttactgaataatccttcttatatttcttccaaagtaattatgcttagacttttctcactacttattatcatttccctctaaattatctacaagaagtttttatacttgtaggattatactcacttccttgtaactattttccacaagtaatatagccatgtaacataccagacccttactaggtgcctgaaaaatttgttttgaattgcatatattctgctgttttataaataaatatgcttctaataaattataataaatcaggcacattaatatttataataattaataataaatgcaataattatagtaatatgttattataaaagtcattaaaacatttaaattattggtgcctagtatattccctgtaatattttcatacaaggaatgattgtaagtaactagaactgaggaaaggcaaaacgagtctatgctcctcatgtggggctcttggaccagcagatcagcaccatctggagcatattagaaataggaattcctaggttataatatattcagataagaaaacacttccatttggaaaaaataacactatctttgtagatgacgcagttccatattatagaaagtcccaagaaattccctagaaataacaagtttataacaagtataggttatgagtcagaacaaaatgattcatatatatatatatatatatatatatatatatatatatatatatatattacatctatatccacacatattgagcaattaatagtcttaagaagaaattaagaaataagtctattcactgcaacataacaatgaaatgttcagaaataaatccagcaaaataaatacaagatatataaactaatattgctgggagaaattaggaatctaactaagtaaagggtgatttatctgggaagactatgttatctaggctgcaaggaagatctgtgccctgaggtacaggctccttaagtggtatattagttacattctcattgccgcaacagaatacctgacaaaaccaactttggctcactgttagagggtatggagacataacagcaagagtatgaaagagtagtcatgttgtgcccacagtcaggaagccagagagatgaatggtggtagccccttctctttactcagtcatagtcctgagcccgaggaatggtgctgcccacaattagggcagctcttcttccctcctcagttaatcctctctaggacactctcctagactcactggcagtggtgatagttttggtgattccaagtgcaggcaagttgacagtagaaatgtaagtatcatgacaaggcacactgtcttctaacctaagcatcagccactaaaggagttataaacaaagggatgtttgttggtatatggccttgtcaatctagcaacaagctcaacagggtatctgctctaaaagttatcccctttgcttcaggaattattttgacccatagaaagcacatttctctataatgaagcaaaatacattatatatgcatgtatgaaattctaaaatagtttaaaatgtttgctaagtttaaaaaaatctttaatcaaaataacatgttttgggataaaatattttcatccccttcactatcattattgatttttgtatacacagaagttatctattataacaattttcatttcattgtttgtatttaaaataatttctattaaactgaaatataatggaacataaatataagatttgacctttaaaggaaaaaatatatctaaatagaagcaatagtctatgtttgagtgaattaactgcaatcaatttaggaagtggtagtttgagccaagcagggtgttgcactcctgtaatcccagcacaagttcaaagctctcctaggatatctagccgtgctgttgcaaaccaccaccaccccatccaaaactagggctacagtgagttgaagccaagcagttcaattaagaggataaagccacttatacttttaatatagaaagcaaggaagaacctcctctcaagaaggctcacatgaactttccccaactgtgatttcctacatagagtctacacaagactgaggccctaaacatttagtcataggtggcagaggggctcatggggcgccaacccactcaaagaagctaatggcagactgagactgctaggggagaagtcatctttctcagtgtagtcactggtaagttacccatgttccagtggatagctcgaacctacatccatgcaggtggctcaggttaagccccatgaagtcacaaagtaaaatcagacagaagacaaaaaggcgtgaaagtaggataagaacttagtgggaggatataggaggttggggtggccaaaaaatattaaatacatggagaaattgtcaaataagaaaatcaatttataaaggaaatgaacacaagggagatttctgagaactctttacaacttcgttgtttttgcaaattgcaaatgtataccttattataagaaaacacagtttaggaatgctattttagttctttaaaagcagaaagttgcaactttatcatagtttttcctaacagattttaaatagtattaacttaaaattatgtttcatccttaaaacatgctaaagtatacctaataaatttgaagagatttgtcaaagttggataaaccagaaaaaaataagagatgtttatttaagcgatcatttatattgctgtacccaataggctcttcactagaagtatactataggagttggcaaacaatgtccagggagtctagtccaccccactaccttgtggaggaatataaagttttattaaaattcagtgtcatatattcatttacattttgtctgttgcttttgtgctttaataacagagttgagtagtagcaaaatatggacccttcaaagcctaaaatatttatgctctggctctttacagagttaaaaaaaagttaactcctagaggaataaaaactcctaaattaggaagactaatcgatggatctcagttctgaccatgggtgattgcatctttaatcataacagagcactaagcctgtctggacctcagttttccctcctatgagatgaatccttttgaatggctcatcaccaagattgggtctcaaactgtaataaaattctgtgaatctgagctgttttgaaactgttttcctgtttcacataattgtcttgcattgggtagtagaaccatatatggtcactgaactgagaaactaaataagccaagcttctaggaacttattgtttcaaagctgtttttctctcaggctcttttaagtaccagtctaagtacttgtttatagatcttcaactacagaagtagttggggaaagcctttagatgtaacactaacatacaaagaaactcagctcaactcacttggaaataaaaaaaaaaaaatctctaaaattctggtttgggtttgtgggaaatatgatttgatacataagaattccattccacctagcttttagggagcatgtataatatgcaaagtgaaataagattcttctgtagaaagaaaattcaaccttcactctattttcctatgtgactgataaagttctgcagaaaagcttccttgttttagccccatactgtgggaaatgtaggcagttgcatcaaatggcaatttcaaaaccacttgtatttttttgtgtgtgtgtgttttccccattttttgtcttttttgttcttgctgctgctatttcaagacatgatcttgctatgtagcccaggctagcctggacctcccaatcttcctgcctcaactgcaggcatgcaacatcttattggttcttcacttcctgtagtccatttttcaagtaatatttatagaaacttaatgtgatcccccaaaattagaccttgtggaaatgctgctaacattgtcatgtatgtaccaacaagtgcctacatgcatggcagatttatctttccttgcagaaaactcatgagcttaatatttaaaatttacatagaaactatgatagacttagaccacttcagtgatttgatatttaaactaagtgaacaattctatgtagagcagtagaagattcactcatgttctgcctctgttttagtgggctcagtaatgatttatacttccagaatgtccaacagttttcaaagcacttttgtttacattaagactttaggcaatgtaaaataaggcacatcccctttcatactctaagtttacagattataagacctagagaggaaatgaggagatcaatagctcagtcagaaaagtacttcctgcacaagcatgagaactgagttccgttcctagcaccacataagaatacacctaaggccagcactgaggcctctgggacaagagagaatacacaaacgtgccctggggcagagacaagaggatccctggggcccgctgaccagcccagcccagcctagtctcatcagcaagtccctgttcccagtgagactctgttgcagaaaacaagtggctgactcctgaggaatgacacctagtgtagacctctggcccttacatgcacatatgcatgcacattcatataaacatgctcaaatacacatatgtacgcatacaccatgcaagaacaggaaaacctagaaagtatgaatgatctactcaagcaatgctgtggagccagaacatgacgaagctagaaagcaagcatagcaactatgagtcttcctattgctaaaacagtaactcacattgctgtcccacacagtagtcctaaagatggcagcactctggatgacaaagcttctctcctatggttcagtgggtcttctctgtggcttctagaacccatctgtaaccaggtatgatgttgcgtgtctgtaataccagaccttgggaagaggtaaagataattggatcaagagtttggggcagcctcacctacatagcaaattcaaggccaacctgtacttcatgatatctagtctcaaaacaaatttacatgtagttgattcagatgtgcagtctgatagagagttgatgtgcgagagtaacatagtcattgttacacaaagaaagcagggagaaaaatgagaaactcataatcctcaatgataccattgttaacatgctgatatatgcttattagtttataattgttaactatttttccaaaaaaagaaatcagaatatgcactgttttgaaaccttttaaaaaatatgatttattacaagaatcttcctatttcattaaataaccttctacagcatcattttatgacagaattttgtaccatttaatatatgtgcaagtccaaaatgtaattagtttatacacttcattctgcatatggaattcatgtcaagtattccgaagttgttttgtgacacccccccccaccctctcttctagccaacgtgacttacaaatgtcactttctgactaatccttaagcttagaataacaattagtaatgccttatgtttgcatgtttgttgtaattgtgtactttttcatcttctcctgcagggtgcagtactagctgctgtgtcaagtcacaaattcaattccttctatggggaccctcctgaagagttgccagatttctccgaagaccctacctcctcaggtaactgggtaatttgctcttcaccagtgggaatcacttgccatctcttttctcttccattctgaatagtctttgtgggactatttagtcaagtcctctgagagattctaaggaagtttgtcacccacaaaatcatacttacatatgtctggttcctctttatttgaataccaaaactgtcctctctgaatgctcccaaaccaacattatgccagtttcttttttacctcaatacttcttcccctttgtacagtccaaactctgaactgcatttccttccctctattgttgtagttagattcactggatctcgatgatcatcttctcccactgcaaaaccttctaatgtcctgctttgtttatttacttagctctcttttgtttatttacttagctcctgactcatatgtcatctggcctcagctttacttctgttagagacgaaaattttatgtggtggaattttcccctctgatttgattttttttctattcttctttaaactggcttctttaatatttgcgtatgagcattagaaacttgactcaggactcgtcctacagcatgagtagtatgtcctacagtcagcagtagaagagtgcttttccctggagggtctggaattgtctgtcagtgcttagcttctgccctcttctcatgcacatacagattcaaaagctcttgccaatcagtatgtacctataccatatgcaaatgaccagactgagtttcctagtccagcaggtgtgtgcttcctccttttgtcttttacaaatcgggatatgactcttcctcttttgagcaaaggtgatttccaaacatattcagaaacttagagaagtgactgggcttcctcttgtgctgtggcatggttgtgactggccacgtcctctggatcacttcatctctgcccttcttttcttcctactatatgttgttcccatcccctggaccatttttagaagttgaacatctccctctggctttcagcatagattacagttggccctatttagggaacatggatccaggcataatttttattttgtatctgtgatgacatgaaagaggcacagctttactatatttagaataaattatctcttcaggatttatggtcaacgactatcactttcatttttgaaatgagcctagaaaacagtatagtccttaatcttgagaatttgcctttaattaatattttcctctgcccactgacaacttaatagcaccttaagtgttcttttcctggaagaattgaaatttttctttacaaaaagaaattatatttgtaaacatgcttgcttatattaaatatattttatcacctggtcctctttagtatattttttaaatgatttgattgaaacagttcctttagtgtaaatctatgtttttaaacaagcaaacaaacagcaacaacaacaacaaaaccttccaccgtcttgtaggctgccttcaggatttcatattaattgtttccaattgaacatttcttcttcgctttcctttcctgcagtctcactttgttacattcttttttcgtctctttaattctgggtacgtcatgatcttctaagcagtatatattttatttattttttttgataactttgggttggaaggcgattttttttatttctttttttaattaggtatttatttcatttacatttccaatgttatcccaaaagtcccccacaagttcccccacccactcccccacccacccactcccacttcttggccctggcgttcccctgtactggggcatataaagtttgcacgaccaatgggcctctctttccactgatggccgactaggccatcttctgctacatatgcagctagagacatgagctctgggggtactggttacttcatattgttgttccacctatagggttgcagatccctttagctccttggttactttctctagctcctccattgggggccctgtgatccatccaatagctgactgtgagcatccacttctgtgtttgctaggccccggcatagtctcacaagagacagctatatctagcagtgtatattttaaatggccatggtaaatatctgtaaaggactttttcagtgatgctatctgggtgctacaagcgaaaagtagaattagaatcaagtgaaaagtaaaattaaaatctaaatggaaatcactaccccaagtaaaggagacatttttatgtggtcagaagtcagaagcaaaggagatttttaaagacaagtgtaatgttttcgtacacatttcacatagctatcagaaatcatacatttccaaaattaatttttaatgctaagcaaattgaggaaggcattctgccctaatcaacagtattaaccgagagccatctgccagcccatggcctttctgcagccaacagtagtgtatcagcttcagaaagctgtttatgtattttatctggactcaaagctttgcacttttgtaaatgaaaatatctacatttgtttttcattatttccatctcatttttggtattttcattgctttctaaacctaaaaaaaaaaatcttccttttatccttatgcttgtttatttcaaattcccaaagtaacccttttcctgtcttgatgtttggatttgtacgggtttgttttacactgaaaaaaaccaggagcactttctgtaattacctgcaagtgcatccaagcctgagatacgagaaagaaatgactgcagagcatacgcttgtagggtgctgactgtatctacctggaccatggagttttaataccaaaatgttccttgaaagcatgacatgaaatttcttaggagaagccacctagctactgacctagtttcctttctagtgctgtgataaagaccatgaccaaaagtaacttagggaggagagggttcaccttaaagtctacagtccatcatcaaaggaggttgggaagggctgggaagatacaagagaacagtgtatttcaccagcttcctattctctaaatgtactgtctttgtgttccacattacaaaataccttttccagtctaatgaaattatagtgggtccattttaaaaaatataagcctaccaaaagtaataattgtccatcccaattttgtcccccaatatttttttcaaaattccttctacaacattctgaagtttggggacagtaactaaaactgcttagccacaaaatgcagcatgttgtttccttaaattaaaattactaacaaataagagtatgcatttgagaaatgtgagtatttaaaatcacattctaaaaagtaatcagcgccacagcctaccatccagagagaagctgaacatgttcaggtgtgtcattgtaatacaaaataatttttttctgaaaaatacttttccattttgattattgaagtttattcattatgcttttactggattaatcttatgataaacagtatcttgttgctttgttacttaattaaaatgaaaatgttctcatatttcaaagcaaagcatttagaatgagatcagagtaatgtctgaaattgggtgggggggtcagcatgggggctgtgcttgtggattatctaaaggacccaactatggcttaatgacctgcttgctctaaaatcataacgtttgtcctttgtccatatgctgccttcctcctaggacttctagcagcagaaagtaggtatccctttgttttcctctaaggtttatctttatgcaaaagtgtttggctctgcatggttcataattggcttgactttttccatggctgcttgtgtttagatgtttaaaagtgaattttaacactgtctgaccataaaataaaaacttgtatatattgattttctggggcattgttatacagctgaatttctcaattctttcaaggggtagggaggaggcagtgttaaaatttcaactatatttaatattatttcacatttgaaattcaaacacgaatatattcattctggggaaaaggtaacattttattttgaagttggctcccaagaaaacttttagggtaagtgagtttttctttcgacaattttgttacacatgaatggtttttattactgatacaaaagtcattctgtttatcattgttgggctgtgaagtaaactctgaaattgtcttttaacaacccccatcatcagatacagtggccgggaaacatacaggtatactgatacagtctcacactcatggaaactgaggcaggaaggtaacaagttagagaccagtcttggctatgtagtgagaccttgttgcagaaaataaataacaagtaagagtaataatagatatcctttaactgcaaagagatataatttgaatatgtaaaaaattaagctgtacaaaatatgcacaaacagaacatacacaaacaacaatgtgtttgggggttttgtgtgtgtgtgtgtgtgtgtgtgtgtgtgtgtgtgtaaaactgaagttgtcccaataaagagggtagattacaacaatattagtatttaaaatgcaattaaaatttaaaatttacctcaaagtaatgctgactaaaggaaagtaatgagacaaagataaattagaaaatgtgggtgctaacaatgaactgagttgccacttttgttgcatttactatttatagctaaaattataatacaaaaatctcaccatatactagtggtttgtggctgagaaaggcagcacctgtggatcacaagtagggtatggctttgctaagtgcctctgcccacctttcagaattttgcagctcacacagtagttaatagaaattttcggtttttattggataatttacttatttacatttcagatgttatcccctttcctggtttcccctccagaaaacccctatcccatcccccacccctgcttctatgggggtgttcccactcccacctccccaccctggcattctcctacactgaggcatcaagtcttcacaagaccaagggcctctcctcccattgatgccagataaggccccttcccttcggctccttcagtccttcccctaactcttccattgggttcccagtgctcagcccaaaggttggctgcgagcatccacatctggattggtcaggctctgacagaggctctcaggagacaactgtatcagactcctgtcagcaagcacttcttggcatcagtaatagtgtctgggtttggtgtctgtatatgggatagattcccaggacgggcagtctctggatggccttcaaagtgtggaatagaaaatttctaatcttcactggctgtgggcttgtcaacaaggctgttcacaacccatcagcttgctgccccaaataaatgactaaggggaaggcaggggttgttcctcattgttcccaagacaaggaacagttttttaaccttgcatcagaagtaacattctctatgctcaggccccatgccaggagaagtagttgtgtgataaacagcaggggactggatcttaggggttcagaggctaatgacatatccatgccggtgactataagaatggaaatcaatcaagcaattaatctattcttcccctccctccttcctctcccctttccctttttctctcttctatccttttttagtcagccacatctatcaccatatttgggaaggaacatcctatcggtcatacctaccagtctgtataaataacaatgcaaatgagcatttaaggctagcagaatattgtcaaaatactttgaaaaatggtgctcaaaaatgttactacttgtgcctagtggtgcacacctttaatcccagaactcaggaggcagagacaggtggatctctacaatttcaagtccaacctggtctacatagtgagttccaggacagacagagatcttgtctagtttattaaaagaaaaaaactaaaaaagaatattactacttggaaacagactattttaataaacataatgtcactagaattgtagcccttgtatgctgacaaaatgtatatgtagaattccttaagaaacttaagctaaatacatttttgaggtgcctgtgccataatctacacaacaagaatctaagacatttactatcatatccaagttttcacaactagaattggatatagtacacctgccagcgctcaaaatgcagtttccactgtgaggttcactgttgcttataacatgattgaaagcctgaatttgctttattttcatgcattggaaataaaagctgttggctaggggatggtggtgagaagaaacagactgcaggttgacaaggggggatattttttgagtgataacactgtacacttaaattggtaagtttaaattaataatgtatacttcagtaaggaaaaaaatgagaccaggtctctcactatgtagccctggctagcctgggattcactgtgtagtagaccaaactggctttcaactcagagatctacctttctctgtctcctgatgctggcattaaaggcatatgccaccacacctggaaagacaaattttttcagcattatattacttggctggggacagggttcccacctataatcacagctcccaaaggtggctgagacaggataatcataacttcaagagcagcctgagctgcataatgagaccctgcctcaggaaaggtatcatgttgcaagggagagtgcatgtgtagtggtgtagtggtgcattagtgagccactcgtgggataggcatagttctacatgtaaacaagaaatgcacgtggatcttccctgaaacaactgccaggtaaatgtgggagcaccaaagcccattaaatggtaaacttaacatgcgtgtactttgctgtatttgaattgtatctgagagaagaattgaaatcttcgctgaagtctctatgaggaagtgactggtgtcagccattctgccacttactgtaacaatgagaaatgtgatgaattgccagatggatagctggtgatacatgtgataaagcatacagtaagctgtggcctatgtggttgtcagactttctgcctgcttggaattgctcagagtttgctctgtgtggggaaaagggtttgagagagagcccacatcagcgctgagaacctcttagtttaaacagtattctgtttatttttctgtcgtccttttgggtttatttttacttggtaaaatttttttgtgagacttttccactcttataatgaaactgctctgtatcccaagctttgattggccttaaaaacatattcctctttaaataaatagacctaaaaaacatttttaaagtagttgatatatttatgctattttgactgttgtttcataatagtaagagaagacttttcagaaaacctttcttagaagtgagattctttggaaaaggataagtgtttaaaattcagttgtatagtttttcaatctgaatttttagaaacaagattgattattgaatgaacagtggaaaatgttaccctaagacaggtataattgcttttagtaaatttgccaatgaaaaagtttgggccaagtctgggccagcagattggtcagtggataacaaatattgctcttacagaggacacaagttctgttcccaggacccacatcgggtgattcataagagaattcataactccagctcatctcgctttcacaggcacatgtacacaggtatatatagccatgcacatactcacataaataataatttttttttaaaaggcaagtagtggtgacacatgcctttaatctcagcactcaggagacagatttctgagttcaaggccagcatgatctacagagtgatttttcaggatacccacggctacacagaaaaaccctgtcttgaaaaacaaatgataaaaataaaagtgtggcccaaatgctaaaaagaacctcatatggtaaatacaaattggaattaagaagaaaatagagttattgcaaagcacagcattactgaacacatgattcaggtgcattgctgaaggtaatctgtggtttgaggtaatagagaagagcactgcaacaggagtcccaggtgggtgctgggattcattcctctgctccctgtctgtttgtggcccttggataggttattgaaccctcataatatgcctctagtttttcaaatacaaaagcacttgcctacatagcaggttattgtaaagtcacataagatagcaaggataaaaacataaattgtcatatgtgtgttattatgaagataatttccattatgatttttttttctgtgcatggtagctcacacctgtaatcccatctcttgggaccacgagacaagaaaatcaggaacttgaggtcatcctgaactatatagtgagactctatgtccaaaaaaatatttttttcctatgggtaaaccatctattctaatccttacctctaaattcttaaaaatttgttcaggaaaaatcaaggaccctttgaagcatccttctcaaccagacattctaaaagtctagcccaaaacacaagagctgatagggtgtctgtggttatgccattagatagctatctcctagagaaagcttgtgaactacttaatggctgatttttgtaaggcagttagaatttactctagggttttatagggaaaacatcatcttcaatcttggaaaagaatgcctggttcctatatgacaatattgatctacagtgaatactagtaactgcttaaacgtgtgtgtctgtgtgtctgtgtgtctgtgtgtctgtgtgtgtctgtgtgtgtgattgccactacaacctgtttttaaaatctgaagcaacagcaatggggaagccctaccaaagtctttgtgtccattcattttttaaatttttttaattaggtattttcctcatttacatttcaaatgatattccaaaagtcccccataccctaccccccccccactcccatacccacctaccttcttggccctggcattcccctgtactgaggcatataaagtttgcaagaccaaagggcctctcttcccagtgatggcagactaggccatcttctgatacatatgcagctagagacacgagctcctgggggtactgattagttcatattgttgttccatctatagggttgcagatccctttagctcctttggtactttctctagctcctccactgggggccctgtgttccatcttatagatgactgtgagcatccacttctgtgtttgccaggcaccagcatagcctcacaagagacagctatatcagggtcctttcagcaaaatcttgctggcgtatgcaatggtgtcagcgtttggaggctgattatgggatggatccccgggtgtggcagtctctagatggtccatcctttcatctcagctccaaactttgtctctgtaacttcttccatgacctgaaaaagtgtccattcatttttattactttttttttcattgaaacatggtaggtcttttagatgggcttggtacatgattagagatacctgttgtacacatttgtcagacctaaaatgtgttttgtggttctgctggtcaaacccaaagaaagaaaaaacaagactgcaggacatggtggtacaagcagaggccggaggatctctcagtataagtcccaggccagccagggccacatagtgagtgactcgctgtctccaaaaggatgagagagagagagagagagagagagagagagagagagagagagagagagagagagagagagagagagaaaagaagaagaagaagaagaagaagaagaagaagaagaagaagaagaagaaggagaaggagaaggagaaggagaaggagaagaagaaggaggaggagaagaagaggaggaggagggagggagggagggagggagggggaggggagaaagccttgggttcaatccccagctctgcaaaaaataacaatagtggccaaaggtgaagaaagattttatgattggacaaaaacattcattcaatttaaaagatggaagggaaataaattaaaacaatagttctcctatataattgcaaaaacttgaagttagggaccttttgcagagctggaaataggtaacttgcatacaactgaagaaatgccccgctttgtccattaaatgaatcctgtttgtgtataagctatgactataataagtcacttcagaagtgacaggtaaggaggtttagtaggccactggagaccatgggaatgcaggctaatagatgtcttcgatgttttcagaaagataaccatccgctggccccatcagcagatacatcccttggttaagatgggggcttcctgctcatccccctccccagtcctatcccaggactattcacttcaaggtgtagtttgcctattgcctacaccaacctgagagtcccttgaggccttgagagcatatttctgttttccttgaagcccttacctagtacctggccaaaggaggaacattcagttcagtaaggaacctggtcattatctgacccagtagggtaaagttgtattggctagtaatagaaactaaagaattgggagttgttgttattgtgaattctcttttgataacctcagtatcattttattccactagccatgatgtggtttggagaaccaaagattcataaggacattggtgactacttttttttctacatgttctctttccaaatctttcaataagggaacaaaattgattttgtgctattttacaagggtttgttgttattattctttggggctcttgtttgttttgcttttgtttgtttgtttgtttgtttgttgctacactgagcaaggtaaaaaatccaaagaggaggattgtgtccttacatctttaggaataccagggacaatgggagctaattcctaccttgtatctttttattccatttgatatctccttaaggttcctggtgaaaaatctcaatagcctgataggcataaattatccaaaatttaaaagtaccaatagttacttcccaacaaataaatgattaaactggcatatctgtgccatggattatacaactaagcaatgaaggagaaactggatgactacagggacgtatgctagggttcaaaaataaagaagagccaatctccaaagatcatatgctatgtgatttcatttagatagcctccctaaaacagcaaaattagagaagtggaaaacaggttgttggttgtcaggaattaggaaagagcagaatgggaggcaaatgaatgggtctaaggcatcatgacaatgccttgtagggatggatgttttgtagcttattgtatatgtcattacatatgtcaccatattgtatattacatatgtcaccatcctgactgtgatatctactaagttctttttcagatggtattttcagagaaacttaaatctttgtgtcattttttacaagtacattacatctataactgtctcaaaataaagacagatttttaaaatagtcacagtagttttcatgtggaatgacacatgatttgtgacttaaacaccaaaatttaatgtaactaaatagcactacaaatataagtagcttatgcagcaatttgtttttgctgttgtagaaaccttggaacatatgagcaaaaaacagggtgaactatgtaagaaaatgataactactgttagacttctgctgtatttagatttattttttccactgtgtgtgtgtctatatgtctgtctgtcttgttttttttactataattagggaaatataagttccatggttttgtgtctacttttctaaattttatattataagaattctcctatgtctttaaatttttttcaaaaacaattttcattcatctatacatgtcattatgtaagcatcctaataatttacgtgatcattgtctattaaatttatctttcatttataagataaacatccttgtacagaatccttctatttttctctttagggtagatttttgcaaatgaaattagcacattgaaacacatagacatttaagggttttggtatatgttgcctggttaccttctggggaaataaccctgatttacattctcaccaataaacacattgtaatattagggtaggaactgagaagaagaagaactagaaacagttcctaaagaatattttatttttgtctgaatcagggtttttcatactgaatactgacattttgggtcaggtgattcttagttgtagggtcctgtcctagatactggagaatattcagtatcacccctcacctctactactacaggccaccctcccttcctgctgttgtcacaacccagagtcgccgcagaaactaagaaatatcccctaggagagcaaaatcaaaccgtcccacacagtcaaggaccactgatccgaagacttagctacaaatgaagcacttattttcagacttccttggtatatacaaatgcgctcaggcctcttgggattcttttcttatggagtgtatatttgcatattatgtgtagtgtaaaacagattggttctttaaggctgtgtaaatgactttaataatattcatgtttatctttcactaatgatacctgcctactgtgcactcccattttctttttcctacaaaagaactttctttaacatatcctgtggtaattggatgtatccactatgcacatgtctgttaacctaccagccctttgtcattgagtctgtataaggatctgagacagtgacagtgactttgcttctcttgactccatatgtaaaatttcaaaaaggaataaatagactgaggtctttgctaactaaaactaaaaaagcctccaagcttatattaagtaccaagagctcttagttgatggtctctgactcttatccatagtttcttatactgtcagtatgtaataaaatgtgtttataatattgcaaagagccttaggatcccaatacctttactgtctagctgatgtataacttgcagcacccagatcatctattatagtagcccagttctgttgacagagtgctttaattttaaaaaaaaatatttattttatgtatgtgagtacactgtcactgtcttcagacacaccaggagagggcatcgaattcccattacagatggttgtgagccaccatgtggttgctgagaattgaactcaggacctctggaagagcagacagtgctcttaactgctgagccatctctccagcccaagtgctttaacttaaacatacaagattaagttcactttaaaagcaaaaggcagaaatactttgttgaggacataaacacaaggtattctgcccttaaatgacatgaagcatttgagcttctccttcataagaacacaagccttctcagttctgatactcattgttattaagtgtaagcttagggttggaaaggttaatgtaacactgactatgcactagcagtttctttcccatttgtccccccaggagccgtctctcaggtgctggacagcctggaagagattcacgcacttacagactgcagtgaaaaggacctagattttctacacagtgttttccaggatcaacatcttcacacactgctggatgtaagtcttgtctttttttatttttcttgtttgaagaacatttagtatttagcagacctcttcatagagattcccagatcttacagcatagtactcccttttcaacttctttgtatctgtgaaaatggggaaaaccatctagtaccggttccaaactaaaataatcatatgcgcagtacaaatgcagtatagcctaaccagccacaacagggaaattgtgtgtacttataatttgtgcacacaagtgatgagcaagattgttagagtgtagcacaaccctaatttaccaaggtaatttttctactataacaaattattaatcttaacagtgatttctctctattgccttaaaacattatttctcaatcatgcatacagaagtgataaaaaactaagaggatactgtgcaatggagtaggtctacacacatacatatttaatatcactgggacaccaacatttgcaaatttggtatcttcaaatataaaagagtgtttcattattaaatttggcagcagattaggacccaaataacaacaaaaaaagcccagaagcataaccagatgtggtggcacatgcctccacactcagcactcagaagatagaggcaggcagatctctgagtttgtgaccatcctggtttacatagaaagttataggacagccaagactacatggtgagaccctgtctcaagaaaagaatagaaacagaaactgaccattcgtgtctgttttcagtatactctcagaaagcatagttgatttctacagtgaaaatcgtgggtggttctgatggtaatagtgcatttcaggtggtgtgcaggaaattctttcccttaagaagagaacataacttctttaggagacctagaactgtttggtgcttcttgattcacccaccgttgatgcagattgcactaaggcacagcaggatgtgctataaaacattctgctaggtaatgcggggcaggaaaggaaaaaggggctttaactgattggttatttgatgactaaataagtgtggggttcaggtgggcattgttaccagtgctaagatgtcctgacgaaaaggaacttttttgacacaggatctctcactaaacctgcagcttttgatttttctgggctgactggccaatgatctctaaggaccaccctacccccagcattgaagttacagacacaatgctgagcccagctctttatgtagattctggggctctgaaatcaagccctattgcttattacctggtgcacacttcactcacagatcatctacccctcccctggtttgttttatatatatataaatcaactcactaactgttataataaacagttctaaattatgggtataggagctggaaagagagcacacctggttatccagaggacccaagttcaattcccaccacccacattagacagctcacaactgcctgtaactataagagatccagtaccctcttttggcttctataggcaattctatatgcatttgcacataattaaaagtagtgtagagttggtaaagtggctcggcatatgaaggtgcttgctgccaagcttgatgacctgagttcaatcactgggtcccacatagtaggagataatcaactcttttttttttttaattgtatttgtaattcattttttacactccatattttattgcccccacccccatccaccctccgactgctccacatcccatatcacctccccaccccacctcatctccatgtagctaaccccacccccacccccaccccacctgacctctaaacttcctggagtctccagtctcttgagggttaagtgcatcatctctgaatgaacacagacccggaagtcctctactgtatgtgtgttgggggcctcatatcagctggtgtatgctgtctgtttggtggctcagtgtttgagtgatctcaggggtccagattgagacttctggtcctcctacaggatcacccttctcctcagcttctttcagccttccctaattcaacaacaggggtcagttgcttctgtccattggttgggtgcaaacagctgcatctgactctttcagctgcttgttgggtctttcagagggcagtcatgataggtccctttttgtgagcactccatagcctcagtaatagtgtcaggccttggggcttccccttgagctggatcccactttgggcctgttgctggaccatcttttcctcaggctcctcccaacctcctatttcctgaggttgcctgtttaaattctttctgctgaccctcagggcttcagtccttttccctcacccaataccagatcaggcttccctctcccccgactccccaccccatctgcttttcctctcaggtccttccctccttccctgcttttgattgttttcttctctctctcaagtaggactgagacatcttcacttggacacttcagcttgttgagctttttgagttctgtgggttttgtcctgggttctgtactttttttggctaatatccacttattagtgagtacataccatgtgtgtcctgagttatctcactcaggatgatatcaactcttatacattgtctttgacctctgactttagaaggtaggggacctagaaaatacaatttagacacaagcatagatttgacatgtaactcagtggtaaaacatttgtttagcacgtacaagatccttggtttgatcctcagcactcacgagactgaggcaggaagaacacaagctagaaaccagcctagtgtgcatagcaacagtgtttcaaaaaagagaatgtatggatgaatagctcttgggaagaaacttttcaaactttgcccatccatttattctccttctactactccacaccccatgcttaatatggatcgttttgtttgacaggggcctcaacagtgacaaccactgacagaactgattggtataagtatagatatatagactgatggaacaaaaatatttagaaataaactcacatttataactaagatgtcacagaagatgtcaaggcaattaaatggcaatgcaatagtctttagatgggaccaccactattgggcctccataaggaaaaatatgaacttggactcttataccacatacaaaaattatctcagaatgaaccataatctcaaagggaattatagattcattttaagagtttaaaattataaattttgttttgtttttgtggtgttgggagcaaacatgagataacatatctgttaggcaagtgctttgccactaaggtacctcactagtggcatggcccctaaaactttgaaaatacacacacgtatgagtaaatcttcattgcatgcaatgggcaaacacaagggaattgggagaaatgttctgaaactggattgagataattatgtaactattatttaaggttttctgcagtaacagaaccaatacaatgagcatatactaccaagggacttacacagtgtagtgcagaaatccaacagtgagtatttacacgctggaaaggctaagtactcagtagctgttcagtccatgaggttgaatacctcagcaattccaatattatactcaaggactggaggaatcctagacagctgctggtcttcactctatgttggaagaagctagattccagtgtcagcaaaatatggccaaagcagtatcggcaacaagatgcatttgccagcaaggaacaaaggcaggcaggcataaaaaacagcactgctttttccgtacactcctttccccctagactgtggggtgctgcctactctaggagaaggtctttcctcttgttcacccatccaggaagtcctttatggacctggccagaagttcatggttctaatttaatgccagatttaattcaagttgacaagcaagataaaccatcacagctatatgtttaccagccatcatcaatctattcacttatagtggccacgccgtgtacttgaacaaagccctcatagatgagagaaagcaatcaggtttttctttaaacttatcttagcatttttgtaacctttcaagataaggtgattttaagaactacaggtgtaatgcttacctagcatgccgaaagccctatattcagtcctcataagtcagatatgactgcctgtacatgcctgtaatccaagcactcaggagactgtggcaaaaggatcgtcccctggtcatcttctgctacagaaggagtagacaccagcctgagggacatgagacaatatctcaaaaaaaaatgaagaaaaggaagcagcagcttgttggaaaacactgagttatacagtattatacatcagtgaggagagcgcagcaggacagtgttcttgtgatcattccatctacattcaagtatgcatttgccacttcccacatttcaaagattttggcagatataatataatataatataatatcaacatttggacattttatggttatgatatgaacttaacatttaaattgaccattgcacattgtttttttttttggttttgattggcattctctaatcaaaccattttttaatgttcatttatgagagaaaattatcttaagattcagaacaaagttaaatcgaggctaatttgtcaaaaaattgtcatgattctgtagattagaatagtttcctatctttttttaaattttctgagatttatttttaattatgtatatgtgagtgcaggtacccacagaggccagaagagagtgtaaaatcccctggagttggagttataatagttgtgggtgacccagtatgcatgctgagccatctcttttttttaactttattattttattagatattttctttatatacatttcaagtgctatcccgaaagttccctataccctcccccccgccctgctcccctacccacccactcctgcttcttggccctggcattcccttgtactggggcatataaagtttgtaagaccaaggggcctctctccccagtgatggccaactaggccatcttctgatacatatgcagctagagacacgagctcttggggtactggttagttcatattgttatagggttgcagacctgggggtcctgtgttccatcttatagatgactgtgagcatccacttctgtatttgccaggcactggcatatacgagacctataacagggtcccttcagcaaaatctttctggcatatgcaatagtgtctgggtttggtgcctgattatgggatggattcccgggtggggtagtctctgggtagtccatcttttcgtcttagctccaaattttgtctctgtaactcctttcatgggtattttgttccctattctaaggaggaatgaagtatccacccattggtcttccctcttcttgattttcttgtgttttgcaaattgtatcttgggtattctaagttcctgggctaatatccacttattagtgagtgcatatctaatgacttcttttgtgattgggttacctcactaagtatgatatcctccagatacatccatttgttcaagaatttcatgaattcattctttttaatagctgaatagtactccattgtgtaaatgtaccacattttctgtatctattcctctgttgagggacatctgggttctttccagcttctggctattataaataaggctgctatgaacatagtggagcatgtgttcttatcaccagttggaacttcttctgggtatatacccaggagaggtattgctggatcttctggtagtattatgtccaattttctgaggaaccaccagactgatttccagagtggttgtacaagcttgcaatcccaccaacaatggaggagcgttcctctttctccacatcctcgccagcatctgctgtcacctgaatttttgatcttagccattctgactggtgtgaggtggaatctcagggttgttttgatttgcatttccctgataattaaggatgttgaacattttttcaggtgtttctccatgctgagtcatctctacagcactattttcagcactgtaaaatatacagttctatagggataagtgcatttacattgctgttcaactactgcaaccttctattttcatctttctcaactgaactaaaacataaaacaataccatcatcctctctcactcttggctcatgacagtcataattctacttactgtctctatcaatgttattattccaagaacatcagtgaatcacaaaaatttatctttttaatgtttttagttatgtgggtgtatgtgtatgggtatgtgtgggtgtgaatgtgtgtgtgtttgtgtgtcctgctacttaggtgcatatatgccatagtatttatgaggatcagaagtcactttttaggagttgactgcctccttccaccatgtgggttctgaagattaatttcaggttatcaggccttgggacaaacaactttacccacttagataccgcagtagtccagtatctgtctttttattactagcctattttatttagcatcatggtccttatggatcatccatgttgtattaaaatttcctctctttttaaggttgaatagtagtctattttgtgtgtgtatattgcatttttttctcccgctctcccactctccatgttatgtggtaaatatgtacaggaaaaaacagcttctcaaaatgccaatcacagagatttctaccttggttcattcatcacataattgcgctttctggatcccaagttggttcctatattctttctcatttttaaaagaatatactatcttctctgagtatgctatggattacaggggtttattgtggctcctgtttttgggggggttggagttttggggggttttggatggatttgcataaaccagagtttgaaattcactttgtaatactaaagtagatcctacaataataaattcaagttcaagctattcagtatgtgctgggccctacccaaggatatgctaaattccagagtaggactctaatcgctgctttactccagtcactagtttctgtggtataacatacttcttcagatgaaatacaaggttggtttaagatttctaaaaggtgctttgtttagtgatgctgttcaaagaaatggaagttcaattttctagtaatgcatggaatggagaatcatctgtatgactaatattttaatgtcttctttttaactactcaaaatagactgggagctagagagttgataaggtgattaagactacttactgttctcctgaggaccagaggtcagttcctagcacctatatcaaatagctcacaaccatctgtaacaccagctccaagggatctcacactatcttctggactctgtggatacctgaacatatgtagaatacattctgtcacatacagaaagaggtgagaaagaaaggagaaaaagggagagaaggaggaagaagagagagagagattttaattaaatagatttgaaaattctgtaatgcataagtttttagggagaaaatggtactgataggatagacaaatatttactccataaaagaaagatcacccagtgggtttttattggggggtatatacctcagcaaaattgaaatttatttttttatttacaatccagtcgttccccaccctaaccccctcagtcccctctcccagagttactcatcccatttcctcctcccccttgcctctgagagggtgctcccccgaccagaccttcccctttcctcaggcctcaagtctctcaaagattaagtgcatcttctcccactgaggccagaccaggcagacctctgcttatatttgtgccaggggcctcggaccagctcgtgtatgctcctggttgatggctcagtctctgggagcttcctgagggtctgggttagttgagactactggtcttctttgggatcacactccctttcagcttcttcaatctttcccctaattcaaccataggggtccctggttgggtgtaagtatctgcatctgtctcactcagctgctggtagggcctttcagaggacagccatgctgggctcctgtctgtaagcacatcatagcatcagtaatagtgtcaggccttggtgccttcccatgggatggatctcaagttaggccagttattatactgactttccttcagtctctcctccatttttgtccctgcagtttttttagacaggaacggttcattatgaattttgcaggcaaatggatggaactagaaaatatcatcctgaggtaactcagacccaaaaggacatgcatggtgtgtcctcactgataagtggatattagccaaaaagtacagaatacctagaatacaacccatagaccataagaagttgtaacaaacagaaaggcccaagtgagtagacttcaatcccacttagaacaggaaaggaaataatcatgagaggcagggggatggagggacctgagtaggagagggaacagggaggggaaagggggaacaggatcaggtatgtgggggaacaggagagaagcccagtgacaagagaatgaatagagataagcagcctcaggggttggggtgggagatgggggaccctctagaatgtacaggagacccacgaggtgagacactcttaagggctcaatgggggtgcccttagccaaaatgcccaacattggggagagggaactcaaagagtctacctccaatagatagacagggtctcaagggggagggacagggttattaacccacagtcaacatttctgacccaaaactcaccatggtggcttttataacattttgtaaattgtggaatcacaatgatgcataatcattcttagatgtgtaaaaaatttttctttcagtttataaatttatagttcctcaatttttctgaaaatgcaattttaagatgtacaatattcctttcagacctgtactatctcatttttaatgtctgaaagggactttcatttttggttttgtttatattaaagagttgggtttccccgggctatccaggaactatgcggtttaaacttcctgggtaggtatctaagctgaaaatctcaagttggtatgttaatttgggcaggaaaatatagtttagatctctgaaacttttctccagtttacaacttcgaaaaatcatcttcaaagtgatagctgcttgtcagttccctaaatattagtattaagtcacctgcctttccctaacattttgatggatttcaaatatataatatgtgaaaaaaaaaagtccttttgcctagcacttctcagttcactaaggcacgatattggaacttggttcctgttccctgagactgtgaagggagtctctgacaggctgtctctcatctcatggctgccatttcatatagtctttctcacactcttactatctgtctcactacagttgcgggcacatttcattattttggagctaaaaatgaacttgaattatcttccaacaaaaagttgcttcagtgtctttaaagtaactggccgctaatgaacttaactgttctttgaagctctagaaggaagctcttcatttattgatctatatttagagtcttgttccaaaagttacaatcttgtctcaagtggtacatattcttgtcctttataaggttttctctgtggaaaaagaaaaggttgatgagctacacaacccagggatagttatttcatagtatcttcccactaactttaattatagaatatttaaaatagatatggaacagatacctaaatgtggaatatgtgagcaattatttctatttgaggactaagaaatcaagagtgaaatgtaatgctgtgttaaaataggagctgcctttaatgctttacaagtaaagtaaaagtgattgacttcatctatctgttggaaagtgcatgcttaggagataggaactgggtattgccactgagtttactctgctttgtttgcaccatctgtagaatacagtttcccaatggagttgcagtgactccaaggcggaggtgaagtgtgtctgtgcagctgtgtgtggtcatatctgacccagtgccaaagactggcagggagcacgtctgtctaggagtgacacagtgtgagacagcctgtttcccttgcagctgttcacatttccttgtttttgccttgattctatgtctgtggtttgtgtgtgtgtgtgtgtgtgtgtgtgtgtgtgtgtgtgtgtagtgctgaacttgggtagctaatttctttagaaaaagaatgcaaacagccagagctcctcatctttgtcttccttctaggaataatctattaacatctttctatcccctctcccactcccttcagcatgccagccttataaatatgctttattatcttcagatttaaggaatgcaaatgacaaaaaaatctattttgatgttaccagtctaccttgaacttataagtctggagcagaagttgcaagttatcaccctcaagccaaatccagccaaccacttatttgatacatattttactgaaacacagtctattcattgttaacagctgcttttatacaacacaacaggctgtaatagtagtgacagagaccagatagcccctaaaacctaaaaagttcccttttggccaggagaagattaaggttacttaacgtgacaaaaccatgcagttacttaacatgacaaaaccagcaactgattaacttccagatcatatgtagtttatttttgccatgatctatgaatagcattttctgcaatttccccccaaaatattactaaaggcaccttcctagcacgagttgttagttgttatctatttctaaattctaacataacccagagaggtctggtgtgatccagaaggccatgctctcatgccctgctgctctgcttgtgtaaccctaagtgcagcatttcacatacctagacattagttttctcctctttgttgaacagctttcagttgctatgacaaaacacctgagataatcaccttaaaaggaagaaaaatattttggctcacggttttagaggtttccatttgttctccctattgctttgggcctatgggaaagcaaaacattatggcagaagaagctacccacttcatgacacacaaaaagcaaagagaagaagtgaatggaatactgccatctatttcaatggcacagtcccactgacctagcttttcctaccagaccccacttcctaaaggttccaccacctgccactagtgccacaagctggcaattatgccttttaatacatgggtgcttgggtgatatttgtccagactataggattctctttaaaatagagaaatagaattgtatttatatctaaggtcttctctatatttaaagaaaaacttgtttagtaagtcagacttgaaagacccacaaaaaaataaatatgtacaaaatgtctttgatttcaggggaaaaaattttagtatgcaagcaggatcaaatagaaattgtatctggttcccaaagaaacaagctaaaataagtattctgctgtgtttatttttgtgctactctattttttttacaaatatgtatttataatcgctacatacaagttcaaatttttattttttgaagaaaacaattatgaaacacacactgtgtcctgttaccttatattggaaaactcaagggtcatggagaagaaaaagaatcccttacacagcatgttctataatcaccaacattagacggccacttcctttttggttgttgatgcccttggtgtagcagacatgccagtgttggtgctgggttgcaaatttgcagccttggcatagttggcacagcgtacagctagcctcagcagcacactcttgtctcctgccccgtgatgttactcatagctcctatttctggttcttcttgctctgttcaggcagttctcttggacaggactccatcagaataaccttgctcaggttacctctcatacatttctttgacttataggaagcatgcattcttactttaagatgtgctgcaagtgtgggctatcccaggtgaggcagaaaaggaagccctcacatactaaaggaacagatacaagtcatttttcgcttaacctaaaataccacatgttgagcctccccaaggattctctgaacaaagctatctttcctagtgcaacagtgtaggactggactataacttgctgcaacttgacaagccctggccagagaccaaggcaagaagctccactctctggaacttccagttctgggacaagattttctggaggactccctacccttcactttttatagggggaagagtaggtccctctcctttccttctcaagaaggggaagggaaaatcaaatatgagctctccctaattctgtgactcctacacatgtcaggcttctgcctccgtaggcagaataaggcttaggctgagtgtggaaggaacactggctgctgtgcagcaagctctacaccagcactgtcagcttcctgttggccttagatgacattctttttttattattaaccaacgtgattttattgctcttgtacacaagagaatttatgccaccagagcagaggttgtggacaactcaatttccaattgggtggaagcacctgcttagtcttttagtgtcaagccaactggtaatttctgctctctatcagaatcaggtggaatttaccatccttatcctttctgttcctctcaagatgcttgtggacagcagctgctttcttaatcaaatggcagagattcttggggagatctgggacaaggccttgggattctcaagattttattaccagtgacacagctcccattcatgatggtggaggtctaatagcaaagacaacgtttatgtgtgtgtctgtctgtgtgtgtatgtacgtatgtacgtgtgcacgtgtgcacgtgtgcatgtgcgactgcagctgtatgtgtgcatgtgtcaggccataccaaaagcacagagttttatctgagcaccttccttacaatataggcatgaaaggtctgagattctaggaacctctatgccactcaggaagtcatcctaaagctagaactttactttaaagctagttctgacttcactgtcgtctgttttccccatctgtaaaatgggaatgacagaggcaccagccttgcaggagaagctgtggttaagtggatgcatttatattaaggtctttgactagtaattagcatctagtaagtgctcagtaaaagcactcatcattgttcctagtgtgcaggttaaatatctctaatctgaaatgcttgagatctgaagggttttatactgaggatttcttttccaacattaaatatttgagtacacataatgatattttggggttaggagcaaagtctaaacataaaattcagttacgttccatatatagcatgtacacacggcctgaaaagaattttatgcaacatttttagtgtgtctggaatttgggtacaacctctcatgtgaggttaaatgtggaattttccacttgagagtcagtatggtattttagaagtttcagatttgggggcatttcagatgttggagcatttctagttttaaagcatttcaaatttgtaattttttctttcattaaaaagtagattttgttcttacataatatatccataaactttcccctccctttaccccatccagtttctccccaccatctctcccatccagatccaacccctttttgttgcttattggaaaacagattcctatgggataatcatagtcagcagaagcagaagagctcaggaaaagacaggaaatattgcgtgagtgtggattttagaagacaacctttgagaattggttctctcctgccacccaggaatcgagttcatgttaacaggcttagctaaaggtgtctttacaaactgagccatctctcaggtctagtgtctttacatattgttttattttgctaagaatacaacatgggggctggagagatggctcaacagttaagagtaccgactgctcttccaaaggtcctgagttcagttcccagcaatgatatggtggctcacaaccatctgtaatggggtctgatgccctcttctggtgtgtctgaagactgctacagtatactcatatacataaaataaacaaatagatcttttaaaaaaaagaatacaacatggtatttactgtcaataaaaatgtaagcctgttatcgacagatgtaatgttataagattttttattcaattcttgtaattgtaatatatttaaatatttataattcagagtgtcttttgttttggattttgtagtagatggcattcacgttgatattttatatatgcagtaattcatttcatagattagtctgggaagctaatcgctacattatttctgtaagctgggcattgtggtataccctttaatcctaatactttagagtcagcacagatctaactctctgaattcaaagacaagtaggtatctacaaattagaggccagcctgttctacacgctaagttccaggccagccagggctacatagtgagtccctgcctatttctataagaaagtacttttttttttcattctaaattttagttagcaaaccactagagatggaaaccttaagaagacagagactatatctatagatagatagatagatagatagatagatagatagatagatagatagattgattctccaaggatttggtcaaaaagcatatcacctgtgccctaaaatgttaataaaatgtttgaatagcattttaccattctgctcaaactatttattcagccttcaattcagtagtactttcttaattaatggccctttctcttggtcgtttttgttacctcattggcctaaatatttacaagtcataaagatttatctcacatctagctataatttgaagaatgtttacagtcagtatttcacctctggaatagcattggtgtacagagggagaaaaaggtagggaacaaaaccatccccaaaatctcaaactgttttagagaagttaggaaatagaagccatcagacaaacagaggtcagttttaacattatacttttcagagcaggccagccactgactgtgagccattccatttgaggtagaactagtgttttaattacacttctagactgcagtgtattttctctgactaattaatgttctttatcaagttgctgtttgattctttcaggttggaggaattgtaaatatattcagatttttttcagtcttctcacactccttgaatttgcaaagccaatagaaaccaagtttctgtccatgactccctgttgaagtctccagcactgattctattaatgaatattcctactaagacgagcacaaacctctgtaagaacattccttcctagaaggagttacatttgccctttcccaagatcaaggcttctatgaaaattctttcagactcttcttggccagaatctgttcttcatttgactccacactcccgttagtgagcattgcttctgtctggaggaaaacactggggttgctgctatattgacaaatgtgaattgctaaggatagagttttggttcctctctttaaaaacatttactttaaaagatgtgcataaaacttatattctgaatgatgaacaattgcaaagaagactcacttatatcatctctctgactttttaggaggacaaatgttgttttctgaaacaataaaccaaaagctataaactgtagcaaaacacgatgtgtattgatcggattttcttctttgctttttagctgtatgacaaaattaacacaaagtcttcgccacaaatcaggaatcctccaagtgatgcagtacagagagccaaagaggtaagtggcatatttttctcaaagtacatagcattgtcacgtttgccacctttactgaagatgtctttgcatgttaagggcacactgtttaggatggcagcttgaagcatactcagattctggttgctaagtttatcattgaacatccatgtgggaaagaaaaagtctcagcaacaagagtccccaggcttctccttctggttctgctgtgcaaatgagcatattgtttggggtgggattgtctttttaaaatattattttactgtacatggaagaaatagacatgcttcaaattttttagttgccttttaaatgtggtactatgtagtggttaattgactttccagaacaattaaatatactgagttcaaagaagtcatttttttatgcatcatcaatatataaaagtatctcccacaagctttttttcatacttgcttatcatagaagcatggcattgcagagagcttggaaaacaaaattcacccagaatcatttgcatatagaatttgatgtattaccaatcgaaatatgttggtttgagcctagaattgtgtaataagcattttacacctttatttggtctttataactatagcacaatgactaattttttcctattactaaaatgatgtagaaattaccattagtaagtgccttattatttttactgtttgttttaaagtttttacgcaaataaacctttctttttaaaaatattttataaagtgtgattagtaaatgtgattactaaatgtactgaagacataattttatccctttcctagcagatattgttctgggttttgttttattaagatagaatctcaccatgtactcagtgttgggatgttaggtgtgtaccaccccatctagcttcttagcagaggttaaacatgacttttgataaaaatatacattgtatatgctcatatactcactgagaaattagaccatattggctgccaggcctgccctcttggtgagtctccggtaaaagaagtctgtcttagtttgctcagcaagcattctttgaaaggaattacactgtcaggcaggaatcatgagtcgctgcccaatcttaacaatacccaaacagacagaagcagagatactctgggcgggggtggggggacaatcctttgtcctaactttacagtggaagaatctcccctagctcaggaggtcagactcaatacttaagatcatgggctatgaaagtatcaagggaaaggagagagtttgtgctttcccctgttgtttcctagaagagaagctgaaaatacaccgaagaaaactatgttaatatcattaagcaatataaattagctgtataacctgcagccattaacagagcatttgaaaaaaaatactagtatgtatgtatatgagagtgtttgttttgttggttggtgtgtggggtgtgtgtgtgtgtgtgtgtgtgtgtgtgtttcattcattcattccttatgtgtgttttgtgtgttcatttatttcttcactcactcactcttccccatgcttaagtagcagagctcattacatgctagaatgctgaaatctgagactcaagcagagtgagagtgagcccctttctgaagtccttgaaggttaaggcaggagagtcctactggttgaggggatgtgtgccccttacaacccatggtgctaaggcaatactagataggctccatgattagaattcagttgagttcagtgtagaggtctctgtgagccatctgcagtaaaaacagtaacaggtgcctactcagagaaactccattcctgggtggaagggagaagtttttaagaactgtttacttgcaagcagcattttcaccaatgcagagaaaatgttaatgcctaattggcaatgaaaagttgctgctgaaggtgtttaaatttttaagtttggtcttttgtttgctggagtttcatcaaaggttcatttggtagaagcatgcttttctctgtgttgaaagataagcattttactcctgccaggctacaaggaaaatcacttacatgtgttcttagttaattatgctagttaattagcagtcttatgtatattgttttcattgaacctgtgtcatcttttaaggaactagcagtgttgttaaattttaaagggcaaattgatttggggagggaatttgtaaggcatattttccttaagctacttaagttacttaaacctgtaataagtatgtgttacaagcttcccattttgcttattagtttttttgttacctttggatcatagttgggtaatgaaggcaaactattattacccaaaacatttcattttattactatcaatattcttatacttcaataacctttgaactcaacaaatgttttgaaagtaattgactttcctgctacaaaaatatattcatggtttttaatttaaaggagttccatgctttgtacagctcattttgcattagtgtgtatcttatttgtttttctaggtattggaagaaatttcatgttaccctgagaataatgatgcgaaggaactaaagcgtattttaacacaacctcatttcatggtaagtaacacatcactagacatacaacaccatttcacaagtcatttttaataaccttcctaaaatattgctactgtcatcaaatgtcataaatatatccttgtacacctgctggtgtgcattttagagaatatgtcattaggcagtttgccattgaaagtacatcacagggtgtccttacaagagcctgggtgatagaggctactagtgtacaccaagctacagtgtgtatggcagagtcctgggaggtgcttagattcccatgcagaaccatatgaaatttaacaagcactagagagtgataaaatcaagagacaccataacacaagcttgtgaggctagtgccaggataacataacatacacttttacaggaaacatgttgtttctttattttcattttgcttttagttttggttttatttttgatgtaagatctcactaggtagctcagagtagcctcaacttcagaatcctgcattgaactcctattaagattataagcatgtgctaccatgataaacttttcctaagtagaaggggcagactgtgaaataatgatttaaggactggagagatggctcagcggttaagagcactgactgcacttccagaggccctgagttcaattcccagcaaccacatggtggctcacaaccatctgtaatggggtctgacaccctcttctggtgcgtctgaagacagcaacagtgtacttgatttataaaataaataaatcttttttaaaaaataatgatttaaaaaagtagtaactacctaagccagcagcatcacagctctcaagtctgatcggccattcataactgcatgcatcatgctctcatctgaactaactgcactagtttctttgcaccagcatcaacaccacaaccaagtaactaggcattgtgcatgaactcactaggccctaggaatattttgctttcgatataatcttgtttatgtagtgtctcattggctcaaatatcattttgtagttcatgactataatatcagactaagattataatcctaggtaataacacattgttttgtttcattattgttgttgcccttgtatcacagttgtaaacgtgccacttgtcaagtgctcatcaaggactatgtagaccccacataatgatctgcttccctgtgttctcacatcactcactgcaactctatgctacctaaaccacaaagagctgaaattgacgacaactttttaaatgaaaagctgtcttcagttttcacattatatttatttacggggcacatgtgccacaatgcatgcatggaggtcagagaacaagctgaaggagtctttcttccaccatgtggcttcaggaattaaactcaaagtgtctttgttttagacagtgcagaactcccatacttttttgttgatttctatgaaaatggaaatagcacttatgtttagccaattattagaagctctaagtcgttaagaaacatttttgtagaaaagaagttcacagatatctacttatctacaattcacaagtagaattacagggctgacaggacagctctgtggtggaaagggtctgctgctcttccaaaggacccaaggtcagtttccatctcccaagtcaggtggcttataactgctataactctagctccaagggagccaacatcttctgacctccaaggtcataaacacacagttgtatagacacagacgcataaatgaaaataggacagatttttttttgaaaaaaaagcacaattataggttaaaatccttgatgaatataatgtggaatatatgcaaagagttaaaaacccagctaacttccctctgggtggaaatgtgattttaaaaccttgttgttcttattacaactatttattttaagtgttagttttaaaatcatagctacaatgaaacatatgtatcatatcaatgcctgtaaggttttaagtatatgctatttctttgtacatgcagtgcttctaaaactttaccattgtccttctaggttattatctatcattttctatttcccttccctaatttttctaagttttagtggccaaactcaagcacatctctggaagtgtctaactctgttttatctgatggtagtgaattagaaatatacttcagtctgagcaagcacacttttacatgatatgtgtcaattcagagctcagttcgaatctcctttgctgtacttggcctggtttctgcctgacatatgcttaatgcctcctcagtgttagctaatgaggattattacctaccgcacagtatgtcatctgcctgtgcacagagcttatattgtaagctctagtaggcgctgagcatatttgacccatttgcaaggaggttcaccttactactcactgctctgtgcactgtgttctccacatttttgaacagactacgaattgctgtatagcctgagctacttcagagaattatataggaacatttcagactagtaaatcttttagatttgatgaagactacataaattagcatatccccaaataaggccttttttatcgggtaaatttttttccaggaaaaaaaatcattaaagctcatgcagaccagtgcctcacagctcaccttccttctaagccttgatctattttttatgtctaaacttagaagtgtgtgtgtgtgtgtgtgtgtgtgtgtgtccctatcaggaaacattttcagaaataattcctcaaattccttgaaaacatagctcagtacttaaaagacatctttattcatataccaaatatctaagtgcctactatgttccaggttctctatgctggccactaaggatctagttatgaataagaaaaacacagtctcaccctcaaagagtttcccatctcagtgaggctgaaggataggggtttctgattagaaatagactgaacacatcagataacacaataatttcatatagttacaataactatgaataagagattgtggtatagaggcagtagtacaagtgtgagctattttatatcctcaggggaaagccctctgaagagttagctaaacttgttctcagaagagctgggcccctgaacatccaagcgggaggaagaggcagaaggaagttgtgtaggtttagggaaccgagctaaagtccattaaagattggatttaggaaaagagaagaaagaggtacagaaatgcttacagagcttggcagaggccagaccaaggaggctcttccagaccatggtaaagagtctagagttttctcctggttaaagtagtgattgtattgagtgattgattgcaatcaagaaaatatgagctaagtcatgctttcatggttgctcctaggcatagttacacattcctgtagccccaacatttgataggctgagatagacgttccacaggtctgattcttttttttttttccgatcctcccatttttattgaacatttgatgtacatttcagccaccatcagggtgtacattgatatatataccccttaagacaaatgttaaaaaagggcataaggtaaatgaaatagaaatactacctccaattcaaaatacactagacataagagcaggcaaaaactaaatacttaaatatcagatgggctaacacacaggtctgattctaacctgaggtatatagtatgtatcaagccagccggtgctacagagcaaagcactgtctcaaaagtgagggggtagaagatgctggagctcacatgctgtgaatggactgtaggagaaagaccagttagaatactgaaaggaatgatggaggcttagagaaaaatggggatggtagcagatgggcaggttgggatttcatattggggatggtaggaagcaacaggacttgcttgtgattgggatgttaagttgtgtgactagccttagaagtagaaattgccctgtgaggtaggaatttgtttaaagtcatccacctagaataaagaaggcttccctaagactcaagccaaatctgactagctcttaaaaagcagactgttcataacacaaatgaatttccctgtaagcctatattaagcttattaataattcttgaacaagcatacatgtggatactgtctcttgaaagaaaattctaaaatatatattaaataggcttttaagtattaaagctcaaccctgctgtctcagaatggtaagacaggaaggttgtaaactctaggccaacctgggtatgttgcaggactgtgtctggaaaccctagtactaattgttcagtcatactctataggctatttaaaagaaaatgttcaaacttcaatttccttatttatatcttatgtattcttttttaaccatattatataagcattctgcacatgttccccttttctgtttgcatgtgaattagagctggggatttagttgtattttgtggcagcaatcactgaaagccgcaaattctggttaatatcaagtgtgaccttatttggcaacataatttaaactttttaaaaattcagcttggcactatttcgtgaatgaaggtttatttttccttataaataatacattaaatgcaagcacctgtttatataactttaaaggatttatagaaatcatctacaaaaagcaatgtaaacattttacccagttcataggacttgaaggctgacatcattcccatgaaaagcttgcctgtgtttagcaatcagacaaagcatcttgagtcataaaagacatctttgaacttagatgatgaacctgatcttaatagatgaacttctctacttggcccattcctgatttggcctctctgctctaaatcttagtttctttggtggctacagttaaaccacaaagaaggccttgcccatatagtccaaccttcatattttgtagccacatctcctggcccttcattgacctctgctttaaacctatatattggcacattgtcagtgccctaaagccaccctcacccaaatctgcagttgagaacagtggcctgggattgaggtagtgctgaccatttcaatcagaaacgagtaaattgattactcggagtacctgttgatgatgactcatcactgtcttccttccttctggttttggttggttggttggtcttggtttttcgagacagggtttctccatgtcgcactggagatcctggaactcactctgtagaccaagctggcctcaaattcagagagatccacttccctgcttcctttctaatttcaacacattattaccttatttttgcctttatgtgtgactttaaagtagctaagtcatggctccgataagccttttacaatatttcagatagcaaaatactatttaatcacatttcattatttgtgcatatctcattaccacacatattacagatgaaaatgagactaaatttagacttagcatatacatacttatctgtataaagttctaaaccgaacaataatcagttgtaaattctctttaactaaaatttctcatgtttattacaaagggtttgtgatgggaacaaagggtatcccttttaaaaaaataaaagagatttattgctgaagtttaccaagatgacatacagatgacaatataaaagaaatcatttttctttgttagtgcattttgcaaaatgaataagtaatcattttcaagttaggagtaggggtgtagctcagttgttaagagtgagcttacttcattcccaacatcacatgaaacaagtatggtggtgtactcctgtgattctggaacttgggaggtagaaacaaagtcatctttccctacatagtgacttcaaggccaatctgcaagacatgagaccctgtctcttaaaaagtaagaataatgatcagatttatgtcaaagccccccaagttaaaaattacaaaacatttcctttttgagatgaaatggctcatcaggtgaaggcacatttcaccaaatctaacaacctgagctccatccctgggactcccaaggtagaaggagagaactactcccacaggttgtcctgtgacctccacatgaacaccatgacacatgtatgtattcatgtgtgtgcacacacacacacaaacagtaaatatgtataaacaaatttaaaagttctaatttgagttctataatgtgtgtgatacttctaaaactttatgtcttaagtatatctatgcagttttcattttatttcttaaatcatgttataaattgtctttatcctttaggctatataaaaattgaaatcactatgtaattgtccattcaattgtaagaacctgaagattatagattctccttgatctatgcttctcccttatttccattacccaatctggtagtacgcaataccaatttcatcttttttattcatatacagaagatgcttattcagtacagtaattattacataatatcttttaaactttatatcagtttaaagccccagtgcaaatttgttggttctttttattattggctatttctgctaaattatttaaaatttcagtctgtcagccttgatttggacatgtgtgttaaatacagatttgtagcctaacaccagattgacaagcccatccattcattcttttgctctgtcacttgttcattctatttttaaaaagaaatccatctatctgccacaaagaaattgaggtctgatagtttggaggtgtacttcatttgtggtctcttcagataaaaaatacttttgagaagtggttatacatgtgtttatgtaacagatttctgctagaatggtaccataatattttccttctttcataaaaatgccaggccttacttcagactcatgatgtagtggcacatgaagtttacagtgatgaagcattaagggtcacacctcccccgacttccccctatttaaacggtgattctccagaaagtgcaaacggagacatggacatggagaatgtgaccagagttcggctggtacagttccaaaagaacacggatgagccaatggtaagtaggaagagcttcgaacttcaccctgtgcagactgctactcaaggagggagggaggatggagggacatggatggtcctaaagaaatcagtttccagccaggcagcggtggtgcccgcctttaatcccagcacttgggaggcagaggcagctgaatttctgagttcgaggccagcctggtctacagagtgagtgccagtacagccaggactacacagagaaaccctgtcccaaaaaaaaaaaaaaaactaaaaataaaaatcagtttccagatcatcaccagttctcctaccttttttgccaagaagtattctgcctaaaatcaggtcttagacatgctgatcatccacctctcctgtaccaattacttttcaactttccaagaacacggtcattactctggaatgttaaaaaaaaaaatctcatataacaaagaaagagggaattaagtaaaagagaaatttcaatactttgcatatcttttgctttcaccaaaaaatggaagaaaagtaattcaggaaatgttcagatctcatccattcacattgaactgtttgtctgttttcccgtgctggagaactgagactgtgtgtgtctgcactcattcttaggagcatcataggttgagatgatcaagaaagggctctggggtggccactgagcagacaagaactgaaaaacatgttagaggcttcaaagcagcaaaaggctgttgaatcattgtaagcatggagccggattgggttttcattttagaacaagcactttggaaactgttacagagtttagggagactagatactaaagcagaccctgccatggtatagggaagagatcatggtactcagaactggtagcatgtacatcaagatagaatgaaagagccagatttggtgaccatgcctgtaaccccagcactggggagacaggagaatcaattcaaggtcatcctcaactgcataacaaattcaatgccaacctgggctagttgatatcctgtctcagaaaggaaggaaggaaggaaagtaaaccagttaggcaaatagtaggttgcaatgagagacacaaaactcaaggatgaccctcaaacttcaagctcaaacaattgaatgcacaaggagatagtgagatggaacactgggcacatttcaagttgaaaaatgggagcacgtttccagggaagaaaacattcaaagatatgcacttatatcctttccttggagttcttaagagaagcgaaatacctacgtaagaaaagtttcaccagttgccttccagataaggaagaaatatagaagaacgggtctatgatcacaatttccagagagtcctcagatctagacactgcggtttgtattcttgttcactgttcttagtaagttgccttaccattatctggcagcacaaaggaggcatgcaaattggctatccattctggtattctcaggggtaagtgtaacacaacaagaatatatatttatactgaattatgttaacaatcatactaaatcttaataatgtaaattctcctattaaaaagcagaggttgacacacctttaattccagcactcaggaaacagatggatctcagagcttgaggctaacctggtccacaaaacgagtttcaggatagccaggactacacagagaaaccttatctggaaacacacaaatacacaaagcgattgtagtggcaaattcacacatgcatgcacatattaaacttgccaaattttacagtttgaaatatcttatgtgggttacaaaataaaacttattttgtggaagaaatataagggatacactaatataaagtatatacctttggtaggaataaaaacctttttaaaaataattagcaatataaaaaaacaaagtaaagtgaaaaataatcataattaaaatattaaaaggtagtagataaactgtattcttgctatttagcgatcaaaataccgacaagtagcatttctgtcatggaacaattttatatgtaaagtcttcattttctatatgttctcttctatttaaaattacctacaataaaaatcacaaatataagatagtgctttcatttaattgtatccttacgaactttgttttctttaacagggaatcactttgaaaatgaatgagctaaatcattgtattgtcgcaagaatcatgcatgggggtatgattcacaggcaaggtgagtcccaccagagactctttctttaccttccttaagtcttcctagacttctgatggaagtaggttttttatcattcacataaaagagctgtttgtcttttcagtttcagttattgtagaccttgttcctgaattccatccccaccaccagaaatgaaataaaacctccaagtactcttttatctgtatcccaccaattttgatatgtaataatttgttatgattcatttgtcattgtcttacatttccattatacttttattggcccaaaagttatttagaaggttggttttttttacagatttatttatttatttatttatttatttatttattttatatatgtgagtacaactgttgctgtcttcagacacaccagaagagggcatcagatcccattacagatggttgtgagccaccatgtggttgctgggaattgaactcaggacccctggaagagcagtcagtgctcttaaccactgagccatctctccagccctagaagtatttttatttaccatttttaaagagatttttttaattaggtattttcttcatttacatttccagtgctatcccaattttttttttagacatctttctgtaattcacttctgacttaatcgcattgtgctcagaaggtgtggtctgtatgacaccattactcacagctttgttaagaccttccctcctggaaagcactttcatcatttttatgcgtatatgtttatgaagagcctttatttttcaattgttgcatacagagttcccaactggcttggtgttgttaatctttctgttcaaatcttttatgtgttgattaattttttgtatgcttgacccacaaatacttcataaaatatccatttatcatagtaaagtatttcagtgtctatttataaatctctctttggacttaaatatttgactatatgaattaggtacatgggcctcaaactcactgtgcagccaagggtaaccttaaacttgtaatcctcctgcctctacctcctgagtgcttagattaaggtcatgcactattgtgaccagttctgattactatttttgatagagtacttcattaatattcaatgtaatgattctactgttttgctttcctggttcattttttggagatttttgttttattagcctctagcttctaatttcagcacctatttctgtgatactagtggttacctacaaattttaagtttccatatattaaagttaaacaatatctttttttttttgtttgttttttttttttctttttggtttttccagacagggtttctctgtgtaaccctggctgtcctggaactcactttgtagaccaggctggcctcgaactcagaaatctgcttgcctctgcctcccaagtgctgggattaaaggcatgcgccaccaccccccccccagcttaaacaatatctttatgtttatttatttctctgtacacacacacatgttctgtacacatgctgcagtgtgcacatagaggtcagggagcaatctgtgggaatcaattctctttctaccatatgggttccaaggattgaacatagattatcagacttgatgaaaaagccttttgcttctggcccagatttcttattttattaatcttatttttcctaggtctgtatagtaatgctttcatcagttcaataaaatattcatccaatcaaacattgccttttcttcattctctttgttctttctgaatttcagttagatgtacattaaacaatcctatgccatagctatttttatatttttttcttgtttcctggtttccctatatctttatttccatgaccttaagtgatcttttgttatatcttccagttcattgacactctcctcagtcatgtctgaattcttactcaatgtatccatttattatcttatgtcgccatttatggttttgtttagatgtagtagtcatttgttttgttttcagttctgtctgctcattcataatagtctcttattgggtggtcaacaagtttctttggccatccatcaaaactgtgctttctgtaagtaaatgtatctatttgaatggttttactacacaaaagtgaagtaattctatagctaaatgcagtcctatctctaaatcactggcttttagatctgtaatttatttttgtattacattgctacctttcccttttcattattctaaaaacagttactttgttcctgtttataattgtgtatgattttcttaggtacacttcatgttggtgatgaaatccgagaaatcaatggcatcagtgtcgctaaccaaacagtggaacagctacagaaaatgcttgtaagccaatggaagtttccccttctctaagattcatttttagttcattagcctagattttgatttttaattatatttatttaatgtgtattttggtgtggctgtggatgcatacacgcccatgtgcggtttggaggacagtttgaaagagttgcgtctctgcttcctccagttgggtcccaggcattgaactcaggtcatcaagcttggcggcaaatgccttcacatgctgagccatctttttttactattatatttttaattaaaatataattatatttccctccttctcctttctctctctaatctcttctatatagcactccgccaggtcagtcgctctagttcatggactctctttctttgtattgttgcatgcgtatagagatgtttatacatgtaaatccaacatgctgagtccattaagtgtcccttgggtgtaaatgctttcagagataaccacttagaatgggatgaccaagtgggaggcccatccctgggaacaactacttctccctctcaaccttccttagttgcctgtagttctttgtctaggggtaggtccccatgagatttccccttccacaacagcatgtcactggtccgctcaccgtataggtcctgttgctgagccatcttgacagctctattaacttattttatacaaaacacacacagaaggtatggaaagatggctcagtgggtagaagtacttgtcagagtacctgagtctggacgccacacccaggtaaaaggcagagcatggtctcacctgcctgtaaccccaactttatgtctggtagagacatgagggtagctggggcttgctagccaccagcctagctcaaggttcactgagagatcctatatcaaggaaagaaggtagagaataatggagcagaatatccaacattctcttctggcctctacaagcacatacacacaggtgctggcacctgtatacacacacgttcatacaccaaacatacatacagcgactgaggtatccccactcatacctaacacacacactaaataaacagatataaagaaaacacatctaatggttcttcaatcctagtcagaatacttcttgtaccatcatttacgtgaagctgaacttgcacactattcattaaaaactgacaactaggaaaatgcagtagctgcagtggactttgaaaccattttgcctgcctttagcagtgggagtctgcacactgttatccttccttggtttcttaccaaccagatatttacagaaaacctccccagtacatagtcgtgtgaactagtgtctcgctgacctcaaaaggttcctgattaaccccattagaaacctctttcctgtttagctgagtcatggccagctatagtgtatctctctacgacacaaagaagaggaaggccattattggctatactcgaaaaaatccatactgaaattagaccttcaataaaaagcattgacatctgctgacagacccccatctatgctgggttgtagcaaacagagggaagcatttgttttatgccttgagtcctccctgctatagtacagcagcttctcgtgcggtaaatacctcttaggcaggaagcaagcatcccgggcttgccgtaatcaaaaggaatgccagaattaataaagtataaaagcaattttatgttgatagcatctgagagtagcatattaaatagggattttatataagtacttattctcttcttcgggtcagtgtatagtcatttttgtaaagcatatcatttcgaccgttttgtattcatgtgtacaaaagataaccatcagagatcttggagaccattcattgctagatacaagatagtcagccttgactttgagggatctttcccagaaaactctaccagtaacctgagtgtttcctgctttataattaggggttttttagggctgagtgctgtcaggtggtgtggactgattacacccacacattttgagtggtttcttctgtgtttttgtgtgcaacatgtgtttgcatgagaactctcctcttttcttctcccagagggaaatgcgagggagtattaccttcaagattgtgccaagctaccgcactcagtcttcgtcctgtgaggtaataagtctaacaagcctctcctacccccaacctcccccatctcctctgagttcttaactaactgtctgctgatggctgaatgtttttgctttctgggaaattgtttctgcctgtgctgttagatcactgcacaccaattttacaacaaagataacggaacagaggaggtcccacccacctcctcagccctacttgcatgtagatatcttcagcctttttgcagcaaaatcaaagccaaatatagaaaagctacaataacataaagcttgataacaaaaagaaagaaatccctgagacaaaaaaaaaaaaaaatacagcagtgtttccaggaagtccattcacttcccttgttaagatatcccacaggtagttcttctttccaagagtcaatttctgttgaggtatcagtgtttaaatgagtgacaggtctcaagatgagaccctgatgaattggtaactgacttcactgaaaggacacaggctcctgtgacctttctgcatatctaaagtgagaaatgatcttttgtagaataatgccccccgtgtttctgaaaacagactgtcctctggcaattagaactctttcaacttacggctttatttttttagttttattttgcttattatagtcaaaaatctattctttctatattgggagacataaattatcataaacagaatcattctttggttgtagcacattcagttcaagtgttacttattaaaccttattttccaatttccctgtggctcttccaggtatgttaatatgaagtgtaagagctgggaatatagcacagcgaatgcttgtttggcatgtgtgagtccctgggttcaatttttatcactgcaaataaatagatatgaagtgtacattttctaaagctaagttttaagggctggtagctgacttactggatctgtgcttaagaaaatttgaaagaaagattatacttttcaagtctatagtggtgctacaaacttcacaagaaaaccaagtacaaggttcaagtagattttaattgtcaattaaagtgtcatattttattgggtcttgagctcctcttggtgacttcctaaggaatgtcaattaatagtatatttcaaaaataagcagcactgctccagcttcaagattcagagcattaagttttgttacttagagtataaacctgtcctggaaagagagaatggcatacatgcatgaagacattgaatagattggattgggggtggtactaaccagaagatattgttagttatgaatacaagtttctccttttttttaagttgttgaactagtttgagggagacaccagtatcatatatataaaatctacacctttaaatatttgaaagaaatgatttcctcctcttaatctgctcatagatacacgacttttttttttttaacccacctgggttggactcttcttagctgggcaaggcttctctaataaaggctctcatccacttcccccagaccctatccctactgatttgaatccctaagggtgacaaatagagatcaatccactgcataatgtttgagaatgttcctctaaaggatctcattctatttcaggctaaccaattccagaagtattctttcaatatcctagagagaaacatatcttttggacagaagtggatacagaactctacacatgaaatgtcttaaaggacttaatttcttcttctgatagttctttttattaaagttgtcttagacactaaggaacagaacctgaaaaggattaggagtgggttgaacagcaaagagtgtgggctcctggcaagtttggccagaaatagagcattgttgcttggagtcactgtcttactcagtctgctaaaatgttacaaagaaagagatttgctttctggtgcaactttctctttttaccccattagtaatatttattctagaaaggtctaagatgattacaatatgtaaagtctttctcttaggctcatttactttcagtggagttatttggtagttcttgacagtggggtacctaagaacaataaactacttctcaaacccattgtttaacctattcaaaactaggcagttgagatcttcagtacaatagcactataatatttattgttgtgtgccctttgataagtttttaatatcactgtcctgagatcccaataaaaaggcaaagattgtagaatttgggatacaggaaaagaataatcaataatcaatgacagcacagccctcactaataatatgggaaccttcaaactgcaaaaaagtatttttatacttctgtgaaatcatataagtaggtcagcatgacaccttttatagcattaacctcagaggaaatagttgtcagactgtggttgggactgttgatgtgaatatctgtttctgtgctagtgctctgtgttaatgaaccttgtgtcttatttcagagagattccccctccacttccagacagtcccctgctaatggtcatagcagcactaacaattctgtttcggtaagaactctagctccacccagccaagtgtgacgattttgttggtgctcacctgccatgagtgtttagttccatgtgttcagtggaa

SEQ ID NO: 675 - DNA, 292147 bp, mus musculus
ggagggttagtccgcgccaggcgggtgctcgggctcgggagcctggcggctgctgaggctgaggggaggagctgaaggcagcggtcgcggctcccgcccgcactgaacgctcatcccgcgaagccccctcccacactcgggagggcggcggcggcgggaggaggaggagaaggaggagggagcgtctctgccgccgcctcctggtccccagcgcggatcagccgccaccacctcccttcgcgacgatcctccctccatggtgctgccgcggccccccctgtagcccgagctgccccgcgccgcgccggagccggtctcgggcagagggagcggtcgcggcctcgcggcccgcgcgggctgacgagcggagagtgcggcgcttcgcggtccccgagggtccgcacgccccggcagcgcggtcgccagccaccgcgcgaggagcagcgggcgggcgggcggcgccgggcccgggccgccctcgctcccacgccccggccccgccgcccgcgccggggcggcagccggcagaggaaaggcgctgcagtctccgggcctcacggccccagtcgagcttcctcagcaccgagggcttgcgggtcctgagtggaggacacgagcccggagccgggcactgagctcttgggcgcccccaacccagttttcagaaccctccacgctgcggccgctgtccccttcggaccatggccgacgacgacgtgctgttcgaggatgtgtacgagctatgcgaggtgatcggcaagtgagtctccacgcgagggagcgggagtgtggaaaaatgcttttcagcgatgcccggggcctcccgcacccgttccgggcctgccccctgccctctctccctcccctctgcctccctcgttctcttcaccctggagaatttttagacgtgtacctgggtttcctgccaggaatgggtctgggggcttcttagtaatgcgtggaggccaccgagccccggtcggccaccccataaggcgtggggcgggctccctgcattttatctgacggttacacagggacgtggcaggaccgattttgtagttgcttcctgggaacagttggggtttttgttacctttcctgtaccatagacctttcacgaaaagagcagcctgcatttcatgagcttgtgtggagagagcgagagagcgcgtccggggtttttaattgtggggtgtgtgtctattgtgccaggatattagacagatgcctttgtgttcaccccatgcccggatttaagagggtcattgaagacggatgcgtccagtttcagcaaattcttcacctgccatagacaaacatagaaagagttgggggcacccaaatttttaatgcctcgttatgcaatgactgtacaatcagtgctcgaggctcccttccactgttgttgggatggtggttagcgtggtagagccgtctgctttgagtcaccgggctggtctagaatatagaactgacagtccaaatgctcatcctttcatctgtgttgtataattacactagggaaaagcagggaatcagattaatcacagtcctgattgagaattaaatctgcagttcctcatctaattgtccagtcctgaaatctgttttgaattgtttccttttcattcttgtcaaacagtattccaagtgcacaatcctgctaatttgcttgtgagggaaatgctggcaatctgaagttgatttcctagttcagcgtgtattctctggctttggaagttgagatcagatttaagagcgatttttgcttatttaatagggctcgttagatggctagtattagaatattttacttcgttttggaagcggtgctttattgtctattttaaggtccgcagttgggaaatgaaaccaagacagcatttggctctagctcttttaagttgtctgcactatactcagtttcaattttttgagtacgggtaactgattttttttcctccatgttgagatattacaatacggctcacatggtgaaattgtgggtagagcttgctacactcttttcttagacccaaatgctccttgccccattgttcagtgaccagcctatctgttaagaggaggatgtccaaatgtgtctggtacagtctttgtggatgtgctcagagcagcgctgttcaaaagctatttaatgagagccacgtgtaatttgtcattttctagtaggcactttagaaagatttcaaacaaaaaggtgcaattttcgtaaaatatttatgtaatacattatatataattagtgatttcagcatgaaaaaattttgccatactgtatatcttttcctactaaaccattgaaatgcaatgtatattttacactaacagaacatctcaattttgacgctaagctaattttttaccagaagtatttgatctgtatttaggtttcataaaatttgcatgtgcaaaaaaaaaaatagattcacatattcaagttgttccaaacgtacataaaagttttccactaactgaatttactatttctaaattttaatcaagtaagcagaatgcaaaatgcctcagttcaattagtcatatttcaagtgcttaatatccacagcctactgccacaattttagagagaaaaaaattcaaaaatctccttcatttcttcattgttgtgaggacacaaaaaagagaaattcgatgtttctcaaaaaccacacaaatggctatgagagtgagggatacttgttgtatcttagttgtagctgttgtgagcctgaagttgataattagaaaatgtgggattaagctgcttgcagatattgtggtgatggaaatagctatcattgaatcaattttggtgattggttctgatttcttcaggtctgaaaggatgacagtgtagatttcaaacgtggtcagcttcatgttagtagtctgtgttgtgctgacttaaaattgagaaaatattttcagaagacacccctagtagaattaagtttatccattctgttctgcagctgcagaaggaggaagagcaagcgaattttgatatgccacctagtcagtggctgcctgcattactgtgaactgtgaaatttcattcctatcctacacaatctgacttggttggtgtcgtctataaaatgccattccttgaaataatgaatccaagatagactcagtcttaaagactgtaatgatggtgcgcctcaccccatgcaaaggttgaagatttctccgggaaatcgtgtcagtatatattgatcctgaaattgaaattcgcttgaggttttttattttagagaccttgacagcatacacttaaacttagaatttgttcaattataagcttaaacagaaaggccttgcaaatcatcgttcatccggaaaaaaatcttttttgatgatttctagccagactccatggaattttgattttcttttgtatcagattggtatcacaaattgtgtttacaccacaatatcttaagagttttaaattttcactaaggctctttaaaataaatttcagttttttaaggcatattggccacccacccacccactcatgcttctgcctattcacctacctacttgctccttttctatgagactctacttcttcagactctacttggtggtgtaaggaaatttcaatttgagtgagggtgggagagagggaggctctcaggaatgcagccctggctggcatggagcttgttatgtagatctggctgctcttgaactcagagatctgcctgtctctgcttttgaaatgctgggattaaaggtgtatgctgtcatgcctggtttaaatttccaatgtaatctaaaccccctttggtgtctttttcttggttaagaacagaacttgaggtaaggagatttggagagagattgctctttgcaatacattttctttgtagctgttgcaaactttactcttattaaatctgtcttcgaaagaatcaggtatcttaattataaagatcaggaaggtgctatttcttttcaaaaaaagtaaggtgacaccctctgggttttctttctgaaagttgcagaaactcttaaatgatttttgtttccataacattttcatatggcatctttcaagttactgaagcaaatacaattatagtcacaaacttccttttttctctttgtttttgagacagttttactatatgatttgtagatcaggctgtcctccactcatagctatacacctgcctctgcttctgcctcctacatgctgagattcattgtatagcaccaccacacccatctagtccccaaactttttaccttaacaaatgtagcaattgctggaaagaaaaggtattatgcaatacaagttaataactaattttgtcataatcacttactgttccttctgcagatttatagttttgtaggtaaatgtaaaattagtaatggtatatgaaataagttttaaaacagttcatttaagttaaaacataaaacccaccatctttctggtgtaagcagtatattttgaagaggatcatacaatgtactatttttatgtatgtaggatgaatattggccctgggttttagagtgttcagtaacctggaacttctgactctctttttctactagaacatagattggaatgatgaagcaatgactcatggacgacatgcaagtttgccaggcatactatatttgcttataccctgagaacacataacatatttaacatatttacagttacttatttatggtctcgctacctagctaataggtagcttcttgaaggcaggaaaatgtgtaacaaacatattttttcattgctaaacacactacctgccttgtaatagtcattcattagctgtgggataaattgagaagttttaataaaatctcattaaaaggcaaaaagtgtatttatcaactttggagtaattattgtccccaaatgctgaattagttgaaagtggtgctgctttccctggctacatattagaactgtcaggggaactttttaaaaaggtctgtgccaagaccctgttacagaacagtgtaaggcagaatcctgagacatgacacaggtaattggtaaaactaaacgaatcatgtatgaagagtcagttttaaaagctagtttctgggactagcttttcagaggattaaatattttccaaagtagaataaatatgttttgtagtgcacttaaactatcagaccaaaacatggatttttatcttctatgcatttatgtctctgaccctgttgtgtaagaatttagcttcagcctgtgtttggctttggtttcctgggccttttatggtttgcattgatttgtgacactcatctaatgctaacatggtgattgtctcatgtttgcagcaacacagaacaaggattgcttcaataactgttgatgatagctttctactacaatgccttaatttaataagaaattcattagtttagtatggattgtttgcacacacactttattaaaagagaatggttaagttacttatgtactttaagttctgtaattgtaactacaatgatgcaatttgccagagaattgagttaaaaccagtcttatgtaaacactggattaataatatataaaatacataattaagcatagaaaaaaattagcttttctgatttgcgctaattactctggctttcccatgtattgattatatcagtgacttggagttctggtaacccaggggaagcattacatgaatcagaagaattgtcctgaaaacttaaatagacactgtacataaaatagtttttaatattaagcttaggaagtggtggggagtgttctggctaagatcacatgggattctatctgcttttaaaggctgttccttttggccacagtttactggtgtttcaggttatgggaaaaaataccatattggatttctttaaaataaggctaattttcatctttaaaatctattattgtaaaagatgattactttccagttacacttctcacctctttggtggactgtactattccttcttaaattacttctttttttctcttgctttatgactttggttctcaacctgtgggttgggacctctttgggatcaaatgaccctttaacaggggtcacatatcagatacactatatatcagatatttacgttatgactcataagggtatcaaacttaacagttatgaagtagcaatggaaataattatggttggaggtcaccatttcatgaggcactactgcattgaagggtcgcagcattaggaaggttgagaaccattggtctaagatgaagtattagcatttgtaatcaaactaattgataaatctatatattctttagcagtggaaataaggactcttgaccatatgtccacagtataattggttttgaaacgttctctatcccttttactcctcaagtgtttgctccccagactaagtattctaagtttctgagtcagaagtagtgaggtttgcatagaggcgtttgttggaggctagggtggatgatttcttatgccctgtgctacatagtgaattgcatttgactttgaaaaccacgtcctaaactgcagcttccgaatctgtctcagctgccagcactgttcactaaagtagtgaaaaaatgctactgttgtacagttgccactgtagagaaagtacctgtcaccagctgccaggttgatgggatgttctgcttttccaatatggagcttatattttacttgccatttataatacagatttctttttcctgtatttgtgttttatagattttgagtactggcttttaagtaaaatagtttgcttttccaaaataatgccatttccattcactagcttgtatttggccatgaagtagatggaagccttttgttgagtgacaaagaaaagattaagtacaatgtttctcctttttatctttttaagttcctagtatttatcacactaatattgtttccttaaattattccattatagagatgttcattctttctggtgtcaaggattctttgtccttggatggtgttagtatgctcctctcctttcctttctcatcctctctctcatcttaaacagcttttctttatggttcctgcctctgctcctgctggctttcctcctccctggcttccctcaatgacagactagtaccgggtcatgtaaaccaaataaacactttcctcctccaagttggttttggtcagtgttttattgcagcaaactaggacatcactgaaccatagatagattttactgcttattaaatgaagaatggtttattctgttccagaggtctctacccttgctatggtgtgcagatagctattatatcactgctagttcatgcatccaattttgtgctttaaggaaacacattttcagcctttctgcttatcttttttttccactgaatatcggattgctttgctttgtggtttgtaaggcatcccctgaagatctgatctggtaacctttgggtacatttttatctatatagaaggaatgatacctgcttcacacgctatttgcatagattagtgatttaaagtgaaggttaagtgttttttacttgtagaatgtctctgccatactcaaatttcttttgacagttttgtatgtaagtttcaacaattttatatgtgatctttctcagtgttaaatacatgctctgttacataaataatatgttgaaatgaatatgtaggtaaagtatcatttattcattcatgtatttgtagctgtgaagtcatgggcaaattagttaacatctctgatcattagttcctttacctgtaaaatgaagatgatagtatagttttcttttgaggtggattgtgaagattaaataatacaatctatggaaatgtttgcagtttttattttagttgcatcatcatcatcatccagcaaacacttgaattctccagcctcaaggagctctgtaaataagagacagatgattacatctagaccatagcacactaattgttgaatcctgataagtcagtaaggcaagagtcacagctaacttgtccatgctgcttgctgtctgggcataggtttaaagccagcataaagaaagtcgtcagtagttgttgaatgaatatattaagtgagaaacccagagacaatgtgactacctagcaggaaaataaatttgaggaaatctttgtagcggacacaaaacttgaaagggttgttagtccttgggtaatatttaaaattttaggcttgttttttcattcctaaaaataagtagagaaattcagataaaggaactctaataactcttaggaatatataaatatattcaagagcacctagtgtcttttagcaaaaaaaaaaaaaaaaaaaaaaaaaaagttatatgctacgaaagatattctttgtgttcctaatttatttgtaagcctgtctcgggttgtagtattacagtgtggtgaaaagctccaaaatttttgttaaaagagttttatatcatacctttgcatttggacattgggtagaattaattgctcataatgtgagattttatgatgaagaaaaggaaactctagggctggtgagatggctcagagggtaatggtacttgccagcaagcctgactacttgagtttgattcctgctgggactcacaatggtgaaaggagagaaccaattcctgcatgttgttctgtggtgtgtgtacatatgtatatatacatataatacaaattgtgctaatttgtttaaaagaaaaggaagatcctggaatatgtatttaagaaataactatatacacgctttgttaaatttatactgtagtagtttcccaaattttattatgacagcagtttccatatcttaaccaaggacaaatgagtagtgtgtgaaacattgggcactgactctaaagtacctaaatgcacactctgtaagtatgatcaccctgactctctctcctccaaccccatttctccatgacttcctggctggcctgttcccttctttctctctcctctctctttctgtcccatttctttcccagactcccttctcacccccccccccttctcatgccccaaaataaacttcattttataccctcccccacaaggaaaggatcatcctgatgggagagggtggtctacttagacacttgtatggaaataggttggcttcagaagatagtaaaaggtgtcttttcctataatccttggacagtgttatttatattgcatcatttaggttagcagtttcactgactccacctgtctcccttaaactattagtttaaaaggagaactgtctgaatttatttgtatatgaataatttcccatcttctatttaggcttaatattattatcttaattaggcctcagtcaagcagtataatgtaatattgaatttgagattatcaggtttcaggtttcttttttctaaagagattttttttaaacatttatttattaattatatgtatgcacactgtagctgtcttcagacaccccagaagagggcatcagatctcattacagatggttgtgagccaccatgtggttgctgggatttgaactcatgaccttcagaagagcagtcagcgctcttaaccactagccatctctccagccccaggtttttttggagacatgatctcaactgtgtagatcaaactggcttcacagatatccacatgcctctgcttcttgattgttgggttaaaggcatgggcaaccatgcccacctagatactatcttttaaaaaagtctatggagcagggtcctctgcaggaatagcatgtgcccttggccactgagctgtcactgtagcatgattatcttttgaataaatgtcttcttttaaagtacgtatttataaagtaattagatgcttgtaaaacaggaagctcttttcactgagaccattcttaattatatttcacatgaatttgacaaattattactagactatttggataacagatcaaattgagaatataattatctcatagtataatcaacatattttaagacatgctaatatgtggggggaaaacctattactagccatacctgttgtaacctatgctatttttttctttaaaaagatttcttctaatggatatatctacatcttgcatctgaggctcaaggaacatagaagaagaaggggtgaaaagattttaagagccagggagtttgttgattgtaagagccaaagatgagtgaggttgtgtctcgtagtaacatcaggagctacactcataaagccttaccagtatgactggccaaacatgagctgaacaacgatgacatcagtgagcatgccaaactggatggagagaagcccatgaggcttcaaccccacacagagaactaaaagcagctgaggaaagctgggagtgggagaggtggccttccccaggggaaagcacacaagtgcttgttcagtgctgtttaagtcagtcctgaaaacatgcatacaggttgtattatatttatatctacctgcatacaataacaattagtgaaaaaagaggccatgaatttgaaggagcgtcaggagggcttgtaaggagggtttggagggcaggaagggaaaggagaaatgtaattataatctgaaatttttttaaaaggtttttcttatggctattaatgtaatctatgtaaacgtctgttcacatgaacatgctttgtttatcatatttgcagagagagcctggaaatctgaagaggaagcattcagagcttgctgctatacctcttagattcccaatgttaatgtttcgcctgggcctgagtcttcccattagactgctggatcatacttcatagtctatgacttacttgtcctaaaggtccagtgggctttaaattgatatctggagcttcaggcttcttggttagatttaccttggtggcttcagtattaggcttacaaatatgaatatggacttgatggccttattagcacatttcctcttatttccagatcctttcttagacatagaagcagagagagctgtaagttggattttaaaaaaaaaaaagcaatttaggaattggtagtctaggcatgatggctctttgctgcaattccagcaattgggaggcaaagacaggaagcttactgtaaactcaaggctaaaataaaagaccaagacaaatattccaaagaaactttatttttaaaaatggttgtttgtttagcctggcattcacaatgtagagcaggcaggcctcatacagagattcacctcccttagctttctgagtgctgggattaaacacatacgctaccatgcctcttagaaaagtattaagtacattttcacatgacaccagtatttggattatttttctctatttcttcatctcataaaagaatggatagctgaagtgatggcttagacattaagagaacttgctgatcttacagaggacccaagttctgttgacagcacccatgttgggcatcttacaactgcctgtaattccagttccaggggatccagtgctcataaaataaaaatcaaaaccaaacattttaaaaagagatagtaatgattggcactgctgaactttctttgatttgggaaggatttattttttctagaaaatgtgtgtgtgtgagcgagatgtatgtgtgacatatgtggaggtcagaggacaacttgtatgagttggttctttccttccaccatgttgttcttagggatccaacccaagttgtaaggcttgtgcagtgattgcctttatacacagcttgctgggctctacctttgtccttaaactgatttcatgttgtctttatgagccttacataatatgctttgtctcttaagtatgatttagaacatattatgtcgaaatgttgattatacaaaggtaaagtgtgtttactgatggagcaataataaattcacactgaaatcaaagcaaagacacaatagaaattaacgttttttttttctttaaattgtaaattttcgattgaacctttaaatttggaacttcaagtgagaaacatttgtatctaaccagatatgaagttagactcttcaacaaatggttagcctggaaggaagaatttaggtattctcaaagtgtagaaccttttggttagcagctgctcccaggaatgtggtagaaatgcagatctcaggcctcaccttgaccttccagatcagaagctagggggatagagtcccattattgccacgttaacaagatctccaagagaattctgatacatatcacatttttttttataactatccacttagaactctagatcagtaaatgatggcttgtagactaaaatggttcactccctctttcttatgtatggctgctttgtatgctataagcagagttggatagttcttcaggactactgtccgcagagccttgattatttgttatttggccctgttaacaaagagctcattgacccctgtttgaaataaagttttaatattgtttccttgcccaaaattctaaagagtgagtagttaaaatcattagataaatattcacatcttcctttacacatgaccctcatatttctacaaacccattccactttctaatatcaacttattaactcaatgactagacttttaaataaaaataaaatactatgttgccctttcttttctctgcttggtgatagtaccaagcttgataatagtgctatgaccatttctcactgattccatgtggtgtgctttggtatttctatattctagtgtaatctaacttaatcatacattgtaatcttcatttctcgatattcctcctgccttttttatttcctcaagacaaatcccactttgtgactgttttgtttaggaatccatgagctaattgctgtgcctgaagtacctttgtcctgcagtgctgtagttgcttgcactttaccagagtgattgacacacagataacaaatatcttgggtactcttcaatcatttcctaggagagttattgttagcatttacacatccaaccaagaatggtgattcatgtctatagttggggtgcaattctgaactgatttttcctttgtccttgctctcaattgttaagatcattggtggtcagcatcacataaaatatagggagtgattttactactgttcttattgatggactgggatacttctgtttccccatatcactgaaggaaagccagtgggttttcttttgaaagaaaggccatgctatagtctcctgctctaatagcaaaagcagaaaaggtggttttgttgcagatgtgattccatgcttgtatttcttttccttctatgaccgttttaagtaagaaaagaggacttggctaagtgttactgagctgtcttacttgtgagtttgtttggttcatgatttatctcagacaaggaacatagttaatgaattcagactggacatgactgaattagctctttcattatttttagggtttccccatcaacttaattcataccttttgccctacttactcatcccggtggtgagatagaaagaggagacacatacaaaggcaaacacacagaatctggtcatttaggtctattgcccaaggcagcctgtcagataatttgagatttactgttttctgcaaaatagtgttggaggtgaagtatttttttaaaattaaattatggctatgactaaaacatgaactctttaaaagaaggcagtgttattttcccagctattacaatagccacccacagaaatcatctgagccacctcatcctttctgttttatctacctgaaacaggccgggtgggtgatgctaaaagtttggtaaatcacactacactttaactaagaggaatgctctgctggtttatgctgtggtgttctctctggtgcaggggcatctgagacagtcctacacattcagaggtaagtaagcttcagtaattatctttacttccttggcagccacttatgtttgtgaggtgagcattcctttcagagaagcaactgctagataaattctgctgaatgtggcttttgaaccattttcaaggctatgatgttcacattcaaaatgtcttagtaagctgggcatggtggcgcacgcctttaatcccagcacttgggaggcagaggcaggcggatttctgagttcgaggccagcctggtctacagagtgagttccaggacagccagggatacacagagaaaccctgtctcgaaaagaaaaaaaaacaaaaacaaaaacaaaaaaacaaaatgtcttagtaagtaagagagggtgatttaagagtgtctgtggtgcattatcagctaaggctcattaggaaatagactttggacgcaaatctccaggtaacaagtcttatgttcttattgtactaatactttcctactttgaaaccactgaaatctccccatgcctctttgaaactaatttgtaaacagaattgtattgtagatattgaatatagtggtataatcctatctagtactaattactaagtagtttccctagtttctgagaactttcaaagtgtcaggcttcataccacagtttttccagagtttgcattgttttcccttctctccttgctattgttacactcagactgcctagtgcagtggttctcaatcttcctaatacagtgacccttttctacagttcctcatgctgcggtaacccccaaccataacgttattttcattgctacctcatagctgtaattttgttaccattatcgatcatgatgtaggtatcagtgttttctgatggtaacccctgtgaaagggttttttcaacccccaaagggttcaaaacccacaggacaatgaacactgatttagtataacccatgtggctagactcgctttcagtcaactagctagcccaacctgaccttgagtaaaggtaggtaatacagtagctacaaggatgcagctgtttcaggttagtaattattaaatataattcattaaacagaactttctctggagagaatttctaaatcaccagtagactgatgaaaaagtgtacgacactgaatcattgaaaaatgcaaataggaaaccatagtgataagcatgttacacttaggacagctagaattaaaaagatagatggctgctttgcgcaggtggctctggttaaactaagtggatcataaaaccgaaagtcatgaatctgggaaaagggctgggaggaaggaagagcagtgcacatgaatgggaggaagagagaagagactgggaagagaaagtaactagaatgctttatacacatacatgaaattgtctacgaccaagcgtaattaatttgcaaaaggctgatagcaagattataaatggtgagaatataaaatggtacagccactatgcaaaatatgctgtcagttcttcaaaaagttagttttgtgggacccagcaattcctttactaggtatatagccaagagaactgaaaacttgtatttacacaaaactcatgtataaaatactcatatgtacattattcataatggaaaagatgcagaaacaactccactgtacattggtagacaaacagttaagaaaatttagtaattgcacagtgaatttttatttggccataaaaggagtgaagtatttatacagctttcaacatggattcctctaaaacttattctaagtgaaagaaaccaggcatataaataccacatgatgtataattgtgtttatatacatttccagaagaaatacatattttgatagaaaaactaaatttgtggttactaggagttgtggggaaaagacaggatatagagtgactgtaagagatcatggggtttcttctttggtctccagaatagtgcttgctcatcaatgcacaattttgaatatactgaagcccaccaaattgtatatttagaagagtaaattttattgtttgtggatatctcaataaaaatgttattttttaaaattttagcttttaagtcacaccagcaacatttcatatgctcaatagctatgtattgttagtggctacatgttggtggcacagatttggaacgtttttgccatcatccacaattttgttgaatagcacttatctagaggatttgagactcataatttgggacaaaaaaggaaggaaggaagggagggagggagggaggagagagagagagagggagagagagagagagagagagagagagagaggtacaagcctaaaaaccaaaaagagtctagaagtgatttagagaaacgttgatttatgatactttagtgctatctgactgtttcattaagagacaccaccagcctatttttcaaatcattctcaaatgagtgtggtaagtggttatgtcttgtatgtcttatttgtgttagcaattttaagacaatttaaatcatagccagtatcttttccaagcatggtgttctaaaactacaaatcaacaagaataactggaaaattcacaaatatgtgcaaattacgtgacacgttccttaacaactgataggtcatagaaggaactgaaagagaaaatattttacatctaattagagacaaatggaaataaaatatactaaaacttgagaattaaggcaaaaccctattctatgaatgaagtttatggtgctcaacaccaaccttagaggctggggaatgactcaagctggaaagttgcttgccaggcaagtgtgaggaccacaattcagatcccagaattcaagtcaaaaatccaaatgttgatggcacattctcataatccctgcactggggaggtagagtcagacagatccttggaactcactgcctacactctagccaaataggtaagttccaggtaaagtgagagactgtctcaaaaggtaagttgaagataactgaagaagatatctgatgttcacctctggcctacacatgtacacacatgtcaagaaaaagcaaagattacaaataaatatttaacttcgcacctgaagtagggaaaaaaaaaaacacccacaaacaaacctaggctccaaagcaaagtgaaagaataaataagcaaaaattagtgaaatagaagattaaaaaaaaaaaaaaaaccaagaactaacaaaactaagttaattctttttgaagatgaaatctacaaactttcagccagattaagaaaagtaagtaaatgaaaggattttttttcttttttacaacaagtaatagagaaataggattataagagactgctttgagcaattacatggtagcaaattgaatcacctgaagaaatggatacattcttagaaaaatattcctttctaagattagatcataaagaaatagaaaatctgaacagaccaataatggagaaggaaattagtaatcaaaaacctttccaccaagcaaagcaaggagtcaaggttgctggcttcattaataaattctcctgaatattacagaagagttaatgtcagtcctttgcaaactcttaaaaatttgaagaggaggaattatttcaaactgactttatgaggtaagtattactctaatgtcaaagcagactacgagaaaaagagaaaagtacacaccaatatccatgatggaggtaatttgcaaattcttcaaccaaatgtaagcaatccaaatttaataacatagtcaaaagggcgtgcatcctttcctcaacctcaaacgaatgagtgacagaaaaactggctttcttagattgcagtctgctattgtagaagttatgatggatcatagacacaccaaggaggcaaaagatgaactttttaaaaggcaaaacaaggaaagttacatatgttattttgtaagaattatccttggttacaggctcagtaaaggatggcatgtgtggtccaaagttgaacaataatggctgggtagacatccttgtagaagtatttctttgtacaaggttgcaatttttggcaatgtttgtgataacttgtatcacgtatgcatgaggaagattttcatgagaacccctttcttcctggtttcctgattattacactttgtcctaaatggcttcattttggtttttacaactttcacacttgttacaaaaatgctctgcctaaagggactcttgagaaagctggttatcatatagaatgacatggacaaatgaacacacctctttgatttctagtttttttccccccagtgggaaaatggagaggttgacgtcactgataatttttaagtactcttgaactctaaaattagtgattctgtaactgattatttcattttacctttgatactaatcaaactttttatttcatttacttactattaaattttaggtagcatggatgggagggaaagaagtatcataccatcatgattaaataaaatttatctgtagggtgcaaagatgtttcattatatgctattagttaatgtaaaaatattagtagaataaactctgaaatccatgtggttatctcactagaagaaaaaagataaaacggaaaaaatccaataaaatttaaattccttttacgataaaaaaaaaaagaactaggaaagaatgtacatgagcacactgaatgcaatgtgtaaccaccccacagctaatatactgaatctagaaattttgaaagcttttcctttaatttataaacaggttatgcatacccaatcaccaattctttttcatatattactgggagatcaagttggagcagttaataaataaaaggcatccaaatcacaaagaaaataataaaaagttcatatatatatatgtccttaacagactactgaagaggaggaaaaggagacttcataaatttaaattttttctataagttttctttctgttctttagatagaatgccttcatatttgcttatttttcttcttgtcagtttaattttatgttgaattcttctaatgaaaatttcattttgattattaataattctttaaagaaactaagacaaattaaaaacatttcttgcattgatgtaggtttttgatgatacccttggttttagcttctttgctatacttcctagaacaaactctcataaatctataaatttcctcctgcatgcacatgtttacatgaacacacaaacacacacgcaaatgtaagaaaataaataaaaagaggactgagtcctacagttgtcctcgcacctctgcatacctgctgtggcatattcatgtgtgtctgtatgcacacgtgataaaactacaatacaactaaagcatacaactaaacccaacagttgggtctcttcagagccaattttggttggctactatttcccttcagcaatttttttctcaatgagttaatattttcaataatatgttataacagttcttgttatgagtctccaaaggtggttgttttcatctggctcagtgatttgcatggactagttatgaagttatgcttcctctctggtagcatggaactgtttggctttcttttagtcaggatctctggtgcctgggctatctttattatgtaactgatactgacctcaaattcaaagtagcactcctgcctcaacctcctgaattatagggattgcaaggattgttcatcctgccagcatgaacattttgtttcattttcttcaatttattaaagtctgttttcctagggttttccatttggtcagcataatttaatgggtaatcaacgattggccagtttaccacaagcattttgagccagtgagccttacatcttttgttagggagaatttgtatgtggagtggagcagacatttgaagtttaggtaatttataagtctttttaggacctgaagagatggatcatgagttaagagcttatactgctcttgcaggagacctgaattgagttctcagcatctgtgtctggtagtggtaactcacaactacctgaaactccagttccagagtatccaaagcctattttggactctttaggtgcctttactgatatgcacataaactcacatatgcgtgacttaaaaaagtaatatgtaaacatctgccttgatttgtaaaccaaaggaacctagtggaatacccagagacaaacccgtacagcactgcacaccagttattttttttttttacaaagtgtcaataacatgaattgagaaaagacttcatatttattgtataggtgctggcagaaaagggtacctagataatttctctcaccttgcataaaaaaaaaatctcaaactcgatcagagatgataatttaaaacaggaaacactggaactgctaaagaaaaacaaaggatataggtacaggcaacagatttctatctataaccccaataacacaagaaacaagtccaagaattagcacatagaattacatgagaattaagaagctgtgaagcaaaagaaactaagatcatctttaaccatcagagaaatacaaagaaaaactactttcagatttcaccccaccctattgagaatggcaatcatcaagaaaataaatgacaagtacaggttcggatataggaaaggggaacccttgtattctgtgggaagtataggctaatgcactactatacaaattggataacctggctgtaccactcctggaaatctacccccaaaatgctacatcctactatagagatgcttgcatatccatgtttatcactgtttcttttacaataaatagcaaggagattaaatcagcctgaatatccatcaacagaagatgaaattgtgtttctgtgtgtgtgtgtgtgtgtgtgtgtgtgtgtgcacatgcacataatggagttttattccactgtaaagaaaaatatatttaggattttgcaagaaagtgggtggaactggaaaatactaagtgaggtaattgaggctcagaaagacaaatatgcacgctctttcccacatgcagattctagccccaaactggaaagtatgcttatccaagtgtgagggggaatgcgcaaaggccaggaaactagaaacgggcacataagactgcaaaaaagaacctcgagcaatgaccagtaggggccacaattaaatatggaagggaggaataatggggggaagtatgatgaggaaggcagactgatgagggatggtgggggagagtcagccaagtgaaacgtttatgaaaacctattattttgtcgactagttaaaataagaaaaaattacacacacacgcacacaacctgcctgactttcactttgagtttgtacagagcctcaccaccagctgcagttctaggtaactgggagcctccccagtccctctcaggaatgcacatagctctgtacataatgcacagtctttctgaacctccaaaatacattaaagttttaagtcctctttgtgtcatttcaaagttctcctatttatatgcttgcctattgtcttatttgcctcaaagaaatgttgtgagtttaagtagctgtgggttttgattgtgcactgatgattgctattcttttcaccggtgctccaagaatggggttcataaatcgggtcaactccctgcaatgacagtttccacaaagctaggagaccacagaatcctggtaaaggatgggaaccgctccatgtcaagtgccacagaccttctggtattacccatcatctgtaggcagaagcctcattctgccgttttatgccttacctcataggtttacactgtgtctgtaatttgttagcttttcatttagtataagtatttcctcctgtccttgataattcattatactttctgatgactgtgtcatcttatcatttatttgaaagccttataatttacttggtgattcccctattattgtactttagataattacttatataatttgactgacttccccaataggcgccaagctcaggaaggcctgaaactgttttgtttactttgttctacttcaccctcagtgtctaacatagtaatttttgtttcctcactttaaaaaatgttacagttagtactttcaaaaaatatgtcttgctggcaaggttttatccagatgtgtgtgtgtgtgtgtgtgtgtattttaaccaagaatgaagttccagaaatataacagcttagtcaaatgattattattggcttctgtgttagaggacaacttggtagatttgattttctcctttcaccttcacatggattctgggaattgaactcagattgtcaggcttgcagagcaaatgccctggttttgttcttgttgtttgttttcagttttgtcttttttaaagtcatatttgattggtatatatgtatgtatgtgtgtgtgtgtgtgtgtgtgtgtgtgtgtatacatatatatatgcaacctataattaagaatgccagaaatacatagagttagcataaatagaaacacatgtgtgaacagacataaatgacattttaatttgtgtggctcttgagcatgttcattttccaggagccaatcagcattgagcagtcagcatgctgtgggcaatcattaaatttcatactgtgaaatttgttagtggaggttggttaaacatatctcttccctagttataacctatcatctttttctttatttctttggttgttttgctgcttcctgagcattatgccatcttcttttgttttgatatcctattgttgttggttaatctgaaatttatttaggttttgagtgggtagtaaagataaagatcatgcctggtaaaatagcttttttttcccaccctcaaatgatgtggcaggatccctgacccccatagtaagtgctttcttcaaagagactgatcaaaggggtaaaatgtaggatcatatggaaaagatggatagactgttgctggccattccaggtagcctgtgccagcagtggagatggaactgaatcctgtaaatgcattggtctcttgatacacatattggtcagctgatattgcagcgggggccatcaccattaatttagttgttaggtgtcctcctttgtatggagtccagttgagggtgttgtaccattccttgatctggtgtgtttgatgagttctgggacctgatttgtggactcttccacaaatagacatttgaagggataactggtatctcatttagataatagtagataaagtagtttcctaagcagtttaataagcatcgttatagtatagttcattaagactataacaaccaggaagtaactaaagaatatctataaaactgtacaatttgaaatcacactttgctctctgttttgtgagtttctgctggaaaattcatcttttaaatatgatatttttatacaagccttcctccgaagtaaacagatatctcttggtgcaactactttttccagggtcatagcattaggtcagctagtggaaacattgtctatgtgctgttcaaggctatgagtgacttcttagtagtatgtggaaaacaatattaaggaacacctatggggtaaaagttcttagtagaaaatgtgattacatgatagtgtttatgctagtcctagccttttcagtactttacctttaaatgttttatgtgttatgtgttatgttttatcttcaaaataatgtttggtattgatagattctgtttagttgccctactatttattgatactatacaaaactttagagtgatccaccagctttgagttgaagtacacagataacaaccaacagaaagattggtttctactgcagaatttcagcctcttaaattagttttcttcccttcctctggaaagcaccaatctcaaggcctatatttctccttttccaggtttaagtcattggaggttcttgctagaaagcacagacaaagcacatggagccagtgcccccaagtttttcagaccatctggaactacctgtggctgcttcacagtctaaaacttcagatggtgttatgatctgttggcagatggctacattgggatccttgtgtcagggttttcatttatctttccttttattctaaaatagaaggaaaaatgaaatggaagaaggatacattgaaagttgtgatattttctgtgaactgagaaatgaaacgtctcagaatatgtagatagatgatagatagcgttcctgctttggattgactagttttgtgttgtttttgtttggttgatttttgttctttcagattcacatttctttacctggaattagctaagaacaattggcatttataagagttgatggtataatagatctgattctctgtctctttctttctgcctctctctggctgtctccccctcccctgcctctctctctctttggtggcctggaacttgttatgtagatcaggttagcttcatacagatatccacctgcctctgtctgcatcatgctggaaaaggtatgaactatcatatctagccttcatagataggattttattgctggtgccttcagcaatacggcttaaaataattagaaaggtgtcactactttatgtttcaggaagagtgttgcaaagcttttaattcagtatttgttgacccaaagtgtctgacacattaaaataaagtcttgggatctaatgaaaagagaaaaataaccctaaatacacactgtgttgcttgctgcctcatttaattgaattcaaggtgatttctcaacttaatatattaagttttaatgcttcgctatatgtgtagggcatatctggctggctatgtaagtacatttatcttaaaatatctcaatatagttaggcttatttacataggtgtctgatagaatgttagctatattaaatatttagttgtttggcaagcaatttgacttttgtgcatatttatgtgcatattcatacataaacacactgacagagacagacagacagacacacacccctaaccagaagccagaggagtaacatgagaatatgtttcagatatatctgtaatgaagaatttgcttctggtttttgtgtaatattgcatttttaccttttgctacatgttttaatttttggtcattttcctgagaagttgttacttccactttcaacgtcttaaaaaaataaattttacagaggaatatgaaatgtatttaaagcttttggtttttttccttgtattactctctaagtcagcccagatggtggccattatggatagtaatagcaaggaagaaagctgttaataccacagtgtctagcatatgtctcccttttatgagtttgtgaactagtgtcaaaggtgtgctacaacatgtattttatgcagactagcttttagaacgttcctaaagccttccatctacatcaaccaatcagaatagattagacaatagttatctcttgtgcttttatccatggcaggtaactgcattttttttgaaggaagctttgatcttctcatctagccaggttttcacttgaaatttcctaactatgttgtgtggtcttaactgttacttttcaaaagctaaggtcttagggctgtagatgtagttcagtggtagatagcttgcttagcatatacagggccctgggtttgaccccaagcacagccagaaagcctctaaaacaaatactaaggtcctctagcatttgatagcatttagagcccacatacagtagagtgggcaattgtgttttttgcatatatgccttttttttctgtagttgggatttctgttctttttatatattcagtgtggaaggtattccgaaagtgatctaaagcaaccttggccttaaagatgtaacttgttctacaatgctatactttcttttacagtcttttaaaggttgtatttctagactttttaagtgtttccctgtgtgttgacaaggacattgaccttagctttgaaaatattaatgggggcagggttgtgactaaatggtaagagcacttgtttggtgtacacagcatgggaggaaaaggtaatagacatgagagggaaatgtgtaacagcacctgcgttaaagacatggacagtgagatctgaatgaaatacattttaatattactgaaatttcagttatatttttatcttggattgcttcactcttcttgagatcagagggagctatgattcgtactattatcataaaaacagatgattatatttagtcagcagtcaactgtgttggttctgtctggctaaaccaaaagcagtagagacaactagactttgatccttttatgccctctctatcctaggtcattatttctttgctgtaaaatcagaataatgaacttggtacattgctacatgggacagtatagctatgttcttcaaatggacttgagacctaaaaaaggtggtgttgagtgtatccaaaagggtagcaaattattatattaggtatgaataaattataaactatagatttaattaataatttacgcattcatagtatattaggattcagggtttttaaaaaaatgcacattattgtgtgtggatgccagtgtatgtgtgtgtgtgtgtgtgtgtgtgtgtgtgtgtgtgtgtgtgtatgtgtgtgtgtatgaagctcagaggaaagcttttaggactctatcttctactttcatgtggtttatgggggttgaattcatgtcatgcctgactggcaagcagtctacctatttagagctccttttaaaaatactcatttcgtacatgttctttatgtcagctgtataagtcagctttcctaatattcttatctctggggaatgaacaagtgattttttttttcaaaatgtgattgatccgaagttgaagagttagatgatttaattagatcagaattatttaatatggacagcttaacatatttttctgcattctaaggtctagaatttgtttttgaatccctgagatctagagttgagaagaaactgaagttcatccaagcaggttttaaagcactgagttagaagtcaacagtaatcgtagagtttgagacccttgagggtctcaactggcatattctgtttattggcagagaatctcttggtcaattagctatgcttgaagtggacatatgttaacatgagaatgataaatatctagtgatctgactaaatccattatgactttttaaaagtacctgatagagccttttttttttttacagattctgttttgctgggcatattaggaaaaagtatgaacaatatcatagtaagttacaggattttctatatatcaggagttaaactttcctgtctggtacagaaaatctgaataacagcctaagtaaatttgtgtccattttcccccacaaaataacagttccaaagtatattccatggctgacatgttacatctaagatactattagggacacggctccttctagccttcctttcaactctccttattatatacttaaggtcacagaatagtcttcaagtctctattcatcatgtttgtggtggaagcaagttgaaaggacagtacaagatggttcctgccagctgagtgagccatcttgaataagtttttccataaaacaaaagaaacacaatttccttttatctcactgactggatgatatcatgaaactatctcatttactaaaaagttgggaaatgtattttactggagtacattagaaactaacaccattgggcttctgatagtatgaaatagggggagaatatatattgaatagatgaataataatctttgctacagaataactctctggctatctaatccttatactttctgtacagaaaactgcccaccctttctgtgatgaaaaaaaatctctgcattgttgtctttaattcctcagtgtctttatgatgtacagccttctccattaggacaaggtaaagaatttgaggaagcaaagatacattttggctcagattcagaggtcttggtgcataattcttgtcttcattgcttctagttctgtgatggtgggagctttgtcagaggtgactgttttcgtagaactacaggaagctgggacagagcaggatcaaatacaacctccaaggaccagctggcagtggcctacttcctctaattacattctgccttccaaagtttccagaaccactcttatgtaacactaccagttagggaccaagtcttttatggggagactttatactcgaatcaaaccataataggtagaaaaagaataggttaactagtaaaactttctgccctgaaaagaagaaatataagttatcattcctatcggtcaaggaaagtggactccttaccctggcttcttggatgatctatgtcagcagaacctattcctgggtagctgctctctacggtgtgactttctttgccaggaaagtaaatttgtaaggaggagtttcagaggcctgtgttctgtcagaaatttctatggaatccactgttactgattgggaagcctaagcaaaaggcaggcaattagggtaggtataattactgaaatggatagcagagtcagccaagcaaatagactgatctgtggtgccaaaaggtgttttctttacccaccaagaaacccagggctgtactttagaaactctaaatcacccttcctcgctcgtttaccccatcgagtgctagaagttaaccatactttcctgggggctttgtagcttctcaaccaataccctgttgctggccatttaggaccataaattattttacaattccaataggtatttttggtttgctacaggacaattttggagtcttcatgattatatttaccacaaaagatgtataggagtttatttacctttcttatattagtatgctgcatgggagagaacccatatctttctaaagaaaaagccttaaggggctagagatgtagctcacttgataggatgcttgcttaacatgaatgaagtcatgtgttccatccctaactataaaactgggtatggtgacacatttctgtaatcctagcacttggaaatggaaggaagaagatcagaatttcatgtcatcctttgtgacatggagagttcattctccaccttattattttgagtcaagttttcttactgaacctggagttaggctggcagcaagcaaagccccagaaattctcctgtctccacccaccacagcattgagatttcaggagtgtggccactcccagctttttacatgggtgcttgaaagtcaaacttgattctttgtgcttgtgcagcaagcatgtttacccactgagccaccagtttttaagactagttttcctttaagtctttcatttgcctcaatctaggggataataggcagtttaatatatatttacttagactcaaaaactgaaagaaattagaactagggaaaatgatttttccaaggacaacgtttagagaggacatggaaataatatgagagggaaactatatagacacaattgctaagaagggaattaattgtatcttgggtattccgagcttctgggctaatatccacttatcagtgagtgcataccatgtgtgttcttttgtgattgggttacctcactcaggatgatatcctccagatccatccatttgcctaagaattttatgaattcattgtttttaatagctgagtaatactccattgtgtaaatgtaccacattttctgtatccattcctctgttgaggggcatctgggttctttccagcttctggcaattataagtaaggctgctatgaacatagtggagcatgtgtccttcttaccggttgggacatcttctggatatatgcccaggagaggtattgcgggatcctccagtcgaactatgtccgattttctgatttccagatgtccagatgatttctgatgtccaaactgatttccagagtggttgtaccagcttgcaatcccaccagcaatggaggagtgtattcattgtgtgtggggggagataaatgatcaataaaaaatgggcaaagtagtctttctgtgatcctattgagaccaaatgataccatgctatttaaactaggtgatatacttcacccagactattcactcctgtttacagtgaagggaaccatggaaaaagtaaacccattgctagtagtttctgtttacaaatattagagccaggattagttactttccttttgctgtaacaaagtaaccacaaaaaaagcttaagcaagggaaggtttattaaagaattatttaactttatgtatatcattgttttgcttgtatgtatgtatgtacatcatgtgcatccatggtgcatccatggtgcccacaaaaggtcagaagagggtatggactcctctgtaactgaagttaacagatccaccagttaacagaaccatcatatgggtagggtactgagaattgaacctgggacctctgcaagggtaacgggtgttcataactgctgagctctctctccagccccagtaaaggtgtattttggctcccagtttcagagacatttcagtctagcagatctccttttgcggcagtggaaggacatggcaggtttttttttttttttctcatcatagccaaccaggaaatgcagcccactaactggaaccagggatgtaaccttgaaagcctgcctttaataaccttccttcagacagactttacttcctaaggagatccataacccaagagagcagcactattttatgggtaaaaatataaatccttaggaagccattagactaaaatagtgccacaaactggggactaagcatttagaacatgagctagtgaaggaaactttagattaaaaatacaacaggagctattgtataatcacttctttcttgaaatgaaaagtaaattcttttgctttcagtagtagttatcttgcatattcttttaaaatatttctgtttattctttgacaattgcatacatgtatacagtgtatcttgattatacctacccctctaggttccccatcctacttcctctgaacccctctcaacacatgccccctctcacttttgtgtgcattttgtgtgtgtgtgtgtgtgtgtaactcatccagtttatttaatactgcctgaatgtgtgtaggtatggagccatcccccagaaagagcatgaacaacatagtagcagctatatacttctagcaaaaattgactgcctctttcctaactaccatcaattgtcaatagcttgtcagctactgataatgtcttgtaagtcactcctttatctgtgtgggaatgctgatgctttgcatgtcttgagtgggtaactatagctgctgtgaatttttgagaacaacatccatgttatacacagaagacagcatttcacacagacagcatttcacattctagctctttttttctgctccctctaatgatgttgtctgagccttggattagaaggttattgatacagatatcccattgatatagatgcccattaccttgcatgtttttaagtttacctttataaaaatatgtttgatcaatttcattaagacgtagacattttaaacactcctttttgtagcatgctggactaagaagtaatcttgaaggacaagttctaatggagaactttcatgctatttaacttgaaaggttttagttttataaatttactttgctagttttcctgaactagatcccccaaattggtatataaagactgagtagcatgcggcctttactagaatctcattttcttttctttttcttttttaagagttgctatttttccacaatttatttatttatttattcactttacatcccaatattaccccttcctccccacacttccccctccccttctcctctgggaatggggaatcccccctgggtattaccccaccctgtcacatcaaattactgcaagactaggtacatcctctcccgttgaggacaggcatggtggtccagttaggggaatgggatccacaggtaggcaacaggttcagagacaaccctgctccagttgttgggggatctgcatggagaccaaacagtgcatctgctacatattgtgagagttattgtgtggattatgtccagtccatgcttgctctttggttgatggtttagtctcttgagagcctccaagtgtccaggttagttgattctgtggtcttcctgtagggtccctattctctttgggtacctcaatccttccctgattcttccgcaagactccctaagctccatctaatgtttggctgtggatttccacatcaatttccattggctgctggatggagcctctcagaggacagttatgctaggctcttgccatacatgtcctttagggaggacatgcaacctttacttgaatatcagtttctttaaaaaaaatctcaaatacttttacatcttttaagacattaaggaaagaatcatcattcttgtgtaccagttatcaggtatttttaaaaatattttaataacatgtattatacaaaataatgaatttcacttttatatgcagaatgtatttagatcatccacaataatgtatttagatcttacacacacatacacacaaattactctctcttgtccctttcctattccctctgattctcttctttgctaccttaatgactttcttggtgatccattaagcttcattagagttgattacaagaatatgggagtatgggtaagtctgttttcaggaccatgtgtaccttttgagcagcgattcctctgaagaaaagtgtctttctctctcccctgtcaaccattagcttgcctcagtctcagagaggaatttggagccctgtgaatccatacctcctcagcaacaggttattgataggctcagtcttgtacagaaaccacagctgatgtgtgttaaggagtataacagccattgtatgcctagaagttggtgttccatactagcactccactcttgcctctcctccagctcttgcattctttcttccccttctgtggtgtctctgggcctagtagggatcccatgcgtagctgagcattcaccaggcacctcgtctcagcactttgaacagttacaactctctgcaggtaacactgacctctgcagaaagaagcgtctcagccgaagcagtgcttagttattttattagatagcagggcttaatactggtaaataaataggagctgttttattgaggatttcttaaatactaggcatagcaggaaatagtttacattctttaatcctcaaaacaattcccaaaggtagaaaatattatcctgtgttagttttctggcataataatgtatacttgagataatcaacttgtaatgagaagcgatgtatttgcctcatggatttttgagcatgatcaattgtacctattgtgttgctctgtaacaaggcaacacatcatgacaggagttcatagtggagggcaacttcttacctcatgactgggtgactaatgagagaaagatgtttggagccctactctacctttcaggggtacatctgcaatgatctcaagattgcccattatgccccagtatttaaaagttacacaacctcccaaaatgcagtgctaaggaacacaatctaactcaggaatctgtctctctactctgcaattattcccatgtatgtgtggaagccagaggtcgacactattcgtcttcctcaatcactctccactggattttttgagacacagtctttcactaaacctagagcacactcatttagctagactagttgtctaacagacctcccagatctttcctgttgctgccttcccagcactaggtttgcaggcacatgccacctgttttgtgtttgtttgtttttatttttttatgtggctggttgggcatctaaacaaagatcctcatacttgcttgacaagtgctttaccaactgagccatttctccagcacaggatttaatatctgaaacatttcctttctttatagagatttgtaaactgaggctcaaagagctgtaagcaataaagctgggagtctaagttaatttgattctaaagtctgtactctctaaaattatgcatggcccctgccatttgggaattcattttaacagggggaagtaaatagaaaaagtaaatgttcttagttttgacatagttgctatgtgccttgcagtgtctaaaaattatatgcaaaagatctttggaatgcttagtgaattaaaatggaatatcaactccacatggcatagagcttttgggaagtattaattcaacaaaatttattgagcagttatgttctgggttcttttggccttgaggatataacactgactaatacaagagattctgtttctgtcatagaaattgcaattcagagagagaaacagatgttaaataatcccataaacagttgtttaaaagtcattgatgttgaatactatgaaggaatggcacataggttctatgagagtaattgaaaaggaaattaagcctattccagaaatgagaaataatggaatagtctgttttctgagaagagatctctcaatttccacaacctaatattttatgactcttgattcattattatttctgcaagtatgctacagacttgtactttgtgtcacttgggaagaatgaatttaacttggtttgaagctaatcttaggaagatgattgtgagtggtatagctagatgcggtgcaggtctagattgtattgagagatgagtcaggaaaggtaggcagaagagaaaaatatttatgtgatcaaatctggttttctattaaccttcttcccatcacttcagtgaatccaagaaatatgaaattttatttttccctctttctaattgcattttaaaaataaactatgtcaatattgactaaagtagtttggataatgagatgtcttacagttctaaaaatatctgtaatgcagtaataatgattggaatcacattcccaaagtgtaatggtttgaatgacaatgtctcccataggctcagatatttgaacacttgctctccagttggtggagctgtttgggagaggtttaggacgtggagcctatctggagggatatgtcactgggagccaccgtctctgcttcatgagtggtttaagatgtaagctctcagcttcctcctccttccatcatgcctgactgttgccatgcttgtctgacatggtgaattcttatccttctcaaaccataagagaaggtaaactgttttcttccgcatgttgctttggtcatgttgtcacagcagcaaaaagtaactaatacaaaagtagtaaaatgctggaagggcttatagctaagctgagggcttaggttttataagaagatacagttaactttccatgactgagtcccacatttgtagattcaactaaccacagattaaaaataacaaatctctactaacattgtgcgtgtttttctgtatattgtaacctagtatgaaaactacttaatagtatttgcattatatttgcataattgagaatctaaagaatgtaggtggatctgtcttagttgtatgtaaaaatatcccatatcctatttaatatagggagttagagtaggaaccattatccacagatgctgtactattcatcatttatataaggtcaagttgtcctgaaaagaaaggtggtggttttgtttatttacccccaccccacacttctctcccttccccctccctctcttgcttcatcccctttgttattcctggggcaggagggtggctatgtgtgtgagcacctgtgtgagtgccccccatctgtctgtgtaatgatagggatgggacccagactcttaacccatgctgaacaagagttctaccactgagctacaaactcagtcccaaagaataaacattgttttatttatttatttatttatttagtgctggggattgaacctcagttcttatgtgtaccaagccaagtgctatcccactgacttttatccataacccctggagagaaattggaattatatattacatatttcattttatgtatatttgtgtgtttatcacatacatgaaggccaaaagatctctagaactgaagttttacaggtgattgcaaggtgtgtgagatgggttatgggaactgaacctggatccttttcaaaagtagctcgtgtttttaaccactgggctatctgatctagtccctgaagagaaagtttttaaccttggtgctccaagtattttctgttgatgaggcaacacgaattttgttaatgatcctagagggaagtaagagctcaagtaagagaaaatggacagtaggagcagcacagggagtgtgctacagagcaccaagaactgcctaggactccatgctctgcatcggagctgggcactgccagtgtttggcactgactactgagcattctggaatatgaatcaggatttcacttttcaaagctcactcctaagactgaaccatgatgtaaagtacagcaaaaaaatcaaaagtatatacagctagtaaggttttatgaactagaatcctagtaaagaaattagaacattaccaaaagccctgtctcatattacttttggttatgtcattttattagaaaatggaggaaataatctttttcactttttaggagtaccaagaaacagcacaaagtgtaagaaaaaaaccagcccccctaatatcataaaggcataggtcagttttccaagaagagcatatttgcagcattacgaataaaccaattaaatttgaagtaattatggaaatatcttggagaattgccaagcaaagggtgaaatagttgtcagtctaaaaccaattattcaagagtcagcaagatggttctgtgggtagacatttgcagttaggccccaggaccacctgagtgatccttccacacagtggaaggagagagctgactcctagtgtctccttgagttcatctgcttgctggtttactatctcctctgtcagactttgggactctccctgcatcatctctcttttatcttactattttctcttttatcttactattttcctgccagggtcctacctcctatgtcctgcctcagctcattggccatcagcttttttattgacaggtgatgtttataagagatttttttttttaacagtaaacccctcctcactgggaaaattactttccatactgcagcagactgttttctggcaacaaaagcttattactgaaattaaatctcttcactaaaaagtacttatatgaaatgttttgatccaatattacatttttagtacatttttagtttatttattgtgtatgtgtattcatatgtatgtaggtgtgcataagctacagcacacacatgtagatcagagaacaacgtcaggagtcagttctcttcttctaccatgtaggtcctggggatggaactctggtcatcaggcttggcaaacaatgattttgcccactgagccccagaaattaccttttggacacaagtttattgaatgcagtatattgcgcgcgtgtgtgtttgtgtgtgtatttgtatagtaatagatatatatttcttcataaaagtgtaatggtgtacctattcatgctgagctttttataagtttagtcataaatgtacccttttgtacaaaataaatcaagtgtgtttattagatgatgaaaaaaaaaacaatgaagatgtggggaacactattcctgccatctcgtacagaactgataaaagtttggaaacatttataatttataacttacatcccatagtttactaatttttctgatataactagagggaacatttcaagttacatgggatatataattatattttatatcaaatttccaaaatttagtgcttgtagaagttaactaaatgctgttctatttagcatagactcagctatccctgttgccttcagattagcaggaaacctacataccaaatcttcataatctcttcaacaaaaagatttctccctaaatcggaggggagaatgtcagttttaaaaattacttgttttttggattaggagtagcatgtattttgtctgtctttaatttgttaaaatctcatcctttaaaaaaaattgagtccatgtaataaagacattcaacatcagaatgtgttttgctttttatagtaaatggtcaaagaaaaataatttatcagaaatgagacttttactttggagggtctttatgttgtaatacattttttcttcattaaaaatcagttatgtagttagttgatatcagttcttttactaacactgtatttgatctgttctgagtttttaatgagagagaaataaaaatgtttaaaatatgagtaactattttaaaagacaataaatatgcacaatttcaataaaatgaaatttaaaaccagtaaatgtagtagaattctcaggattcttcctattccactttacaatggagaataatattggtaaatgttcttggagttgccaaggttttgttaaaaattacattttaaaggacaacttaaaaatataaaagtgagccgggcgtggtggcacaggcctttaatcccagcactgggaaggcagaggcaggaggatttttgagttcgaggacagcctggtctacaaagtgaattccaggacagtcagggctacacagagaaaccctgtcttgaaagaatatatatatcaatttttttttacttatcaatcataagtaaaggcacttatggccaaagcccattgatctctaggacctacacagtgaatggagagaactgactcccacaggttgtcctttgacctctacatacgtgcaatgatgtatacacacatacatgtgcacacacatacatacaaataagtgaaataatttttaattacatgaaaagtcaaacttgaattttgttgtttatttatcaatatgacaaccagagcgccagtcatcctgcatttttatattcatgttgctagggtgcaaatagtggcctttatattttgttggttatcagcagctctctaattgaacttaagaactgctcaacaggagggaattcatgctggccaactacatatggctagtgaggtcatggacttcagaggagactctactttcctaaaccagtataattcccagctacattttaaatacttatccttatatccacagataaacacagctctcactttcatcaaagaagcttctttttgtagcagatggagactattacaaaaaacccacaactgataaaaatacaggaaacaactgaccatggggtacccaatccccagttgatagatctaatacaacctttaccctaaggttcagggaatatcacataagtgggtatagaaagagtttaagaggcagaggaccaggatgtctgctgtgagatagtcaactacacttaagaaatcttaactatgtggttgcctaaacaaggccttcgtgatagcaacaccagttggtatacaatgtgaataggggaaatctcataaggccccatccctagattaaaagctatagacaattaatggctgctaagagaaggagaacagtcttctggaatgaattccctgattggttatctgacaccaagtgcatatgaacaacactaaatggatttagcaagaagtgtgtatttgtgtgtgtgcaaaacagtaattaaagaagagatcatggatttgaggagtagagaaacatgggagaagagaggtgtggaaatgatggaaatatatttgtgtgttaaattttcaaaaaaaaaattatagagctagggaaatggctcaacaattacagcatttgccattgcaagcattaaggcccgagtttagatccccagaacccatgcaaatgccaggtgggttgggtggctcacctgtagtttctgctttggatggtggagcaagctggttagcgagactagtaatattggagagctccggccttattaagagaccctgtctcagtgagtaggtggaagagcaattgagaatgattcctgagacatacctcagactttcacaggtatacacttgctcagacacttgcacatatgcaaacgtgcatacacacacttaacacagaccagacactgtcaagtttaaaagaaagcagaaaaaaaaaaataacatttacaggttaaataagaatccaaatagagattgaaacgatttccactttaatcaaataaaattgttgtgatttctggaagtgatcctaaaataatactcattaagtgttcctatgacatatttatagggaccatgagtactaggttttcactctttttctaaagccctggtgtatcagataaatcttgcactcttgagccagtgtggacatttagaaggaaaagaaatagagtggtatgatgtcaatgaaaactgttaatactctgtctctgttcttagtgccttgtgggagctagtgatcatctcttgcattttgtagccatagagtcattgacaaatcaaagggtttggccaaatgatgccttggattcatctccacacatgactttattttattctagatatatctctagtaaaactttgttgccagatgcagctcttgaccttagatatctcagacctcagaaacatgatcaaatgaatctgttataaattacccagtttgtggtaattttatggtagcacaaaatggaataagacattgtagttaatcagataaatcagatactcatgccgatcaatcacttaattctcagaataattctgaattaattatacttagtagtagtttctttagccctgttttacagatgagcaaactgaggtacagggaagttaaataacttggcaatagctctccaatatttttaactaattcaatcaaatttcaaattttaaaattctaagtgtactgtcaaaaactttcttaattactatgctattcctgcttcatacctatattggacttgcactaaaattacataatctttatctcttttattagaagtaaaaactactctgttacaaatatcagagaattccagccactagagtatatccctagcagtggcctgcagtgctatctccatgttcaacagcaaccagcacatcagaaagccaatattataaccttttaaaggaagcattattatgccttcatgattaccatgcttcatttaaaatacattcttgtttcccttgtagtcatatctaccaactttcttccattgtcatactgttaacacagtgccttctaatatcttgttaactttagagtcagagagcttaatcaattacatatgttggtaccagggatgagggtcagatgtccctccagcagtgcttctaatgattagaaaagtagcatagctgttctatccaagctgttctgtatgacgatttagaggtggaaaaaggccaaaaggctttacaagtacaataaagaagctaagtcccagaaccttcagctaagaagaccacaatgtctagtttggtggtaaagaagactcagaaactttaagacttcaaaagttattagtatgtacttttcaaatattcattgtcttggatcagttccactccaatcaaagatacaaacacagactttcactctttagaaagcacattattgagactattctcttgcaaagtaatgactttttggttcagggcaggactctctcccaagattttagataaagccataaagagcgatttgctctaacggctttagcatcatatgctgtgttgatagtttatttaatttttaaagcattaaacattcaaatcaagtactaatccaaattagtaagcatctgttactatccatgcttgtctctgttctgtggagaactatcatggcaaggcaaggaggaaggagctgcgacctagatagaccttgccaatactgctgaccacaatcatattttctctttatcatgaaacattttattatgacaattaatgttgcagctgagtggtctccttaaaatgactaatttttatgaatagtatattacctgtatatgagatttctactataatttgatttgcttacctatacctagtctcgagattcattttatttgtataataaatgaaagcagcagatgtatagcactttggcttatttgtaatacagatcagataagtgtttgtgggaaacgagaggcataaaacaagctttaaaaaatgcagtctgttatatggaagttacaaactacagtttcattaaggatagtaactctgaatttgtgcactgtgaggaacaagaatttttataagtgaaatagtaatggcttttttgatgtgttccctggaaagaatggtgagtcataatttttcaattgattaaactctaattcagtgtttctagtactttttactaataatattacaaccaaaataaaataagtgcgcagtagaactcatttcttctgttgtggctctctaaaagaggtctgagcaaaccctaattgtcctcatcctgcagtgaattgtacaacagatgcagttttaaagttttggttcttggcgtgaatttttcaccttttattccagtattagccttttgtttgaagcacctaatgttaagtggcatcagtgtgtatttctaaaagacataattagagtctctcttttttactcctaaaggaaaaaagcaaggtcagcattgactttttgcagctccttctccgggtgttctttgaatgcaactgggcttggttaggtcaaagtcaacagtatttgtttctttttctttttggctgaaatttaatattaataatataattaaatattttggattaaaaagcccttgtgagaacatctttcaggtagtactcaagtgattccttccatattcttgatagttgtagtgctgataaacaaaaaacacttttctgtaagcttttcatttaatttatatttaaccatgaagaaggtgcttataatgtggacaccaaaagaaatagggagcaaatgcatggtctcagttgatgtattagaaatcttttgatggctttctatcattacttatgtcaaaacacctgagatcattaacttctaaagggaccagtttcatttggctcagtttcagtttgtgattaggcagatctgtcactttcagcctctggtgactagtagtggcaggaaacatgccacaaagcaaacctcttactttgtggtcagaattcacaagagaactaggaagatgccaatcgaatccattcaggtgcctaaagaaagagtccctgtcccttaggcctcacctccgaaagattccaccacctttcaattatgctattctggggaccaagcttccaacacctggacttctaggggataggaatttaaatcatgaaacatcttctagaggagtaattttacattagttttgcaaggtgattttaactatcaaaaccaagataggtaaaaacagccacagccaggagaaacctaaggagatacgatggcatgtggtataccttggtgtagatgagatactgatacagaaaaaaaaaggatatttaagtaaaaattaaggaaatcgaactaaataatagacatgatttagtacccatttatccctgtaggttcatttattgtaacagatgtgccattttaacttcatcaaggaacgaagtacatgctatgttgaaacctgtacgttgttttatgtatggctttcatcctcctgaaaacctaaaattatttgaaaaaaaaaaaaagacatgatatgattggatgtgccttgagatctgcacttcagcgatcctgcattatgcttgatcaagcataattcaaacatgattccatattttaaagaaaactgacaatccgagttcacttgtagcagagctgaagaagtggtgaagataatcgtatctcatcgtctgaaacttcaatccaaatgtattctaaaagtgaaagcaacactgtttggggtataggcaacctatttctgtaaagtacctgatagtaaacagtttattctttgcagtccatatggtttttcattgacaaccactcaactgctattgaagcaaaaaagcacacataatacataaggcaatgaatgttgctgaatttaaaaagtcatatttattgaaacaggtgagtctggttttcacctgcatcttgtagcttgctgactctggagctaaaagctcatactgctccgtaggtaacatattaactcctttaagaattcataaaggagtacagtcagaacaagttagaatagtattgctttgcttcagttggcagggcgtatagaaatggcagcggtggagagatgaatgtacatggtttatttgcacataagctcatttgccatacttgtgagggactatcttgattaggttaattgaggcgggaaaccccatcctgaaagaagagccttttgccttgtggataagactgatcagctgcctcaaccccctaggtttgcctggaggctggcctccaggatgattccagaccctgtcaaattgacaacactaaccatcacagcatttagggtcaaagcctgggccctaaatgccctcacaatctaggctgagcactcaccatttataagccagtttaaaagacaagtagcagcaaagcaaagaaaggattagtgtgagtacattgggaaaggaacaagtagaggccaagtacccaccctccccagtctctagtgtcttgacatgaagattaggcttaagtaaagaacaagaggtagacatacagttctggtcatgatgtgggagtgacccatcattggcatacatagcattgcctaggcttctggctactagctggcctgcatttgtcagtattatgtaatatctctttctggaagcatcatcccctctccagatggaatccagaccccagtgtttttttctgtaacataaaatcctgaggtaattttaattccttgaaatccattgtctcaatagttgatagtcaaagaggaagagtgtttccctttagggcagtgcttctcaactttcctaatgctgtgatccacaactcagagttgtttttgttgctatttcattaactataattttcctactgttatgagtcataatgtaaatatctgtgttttccagtgctattagatgacatcacccctgtgaagggtctttccacccccaaagggatctcaactcacaggttgaggactgttgctttagagtattttctctcttgctgggatagttctattcttactgctccttgcactattagaaactatacccttctctccaatgccacccctccccccaacaaaagagactgaagagttttagggaaagtaggctattcagtacgtgtctcatatgacttggtggtacttctgatatgatgacagggagatcttttttctctggatgtagtgtgaccatcttaacagcataaaacattgtgtaggaatttctttaaaacacctggataaattactttatttttcctgtttattggattttaagttttagttatttgggagaaatcgcccagcatatggtttaagaagtaaaatcttgctagtgtatgcaatggtgtcatcgtttggatgctgattatggggtggatccctggatatggcagtctctagatggtccatcctttcgtctcagctccaaactttgtctctgtaactccttccatgggtattttgttcccaattctaagaagggacaaagtgaccacacttcggtcttcctttttcttgagttccatgtgttttgcaacttgtatcttgggtattctaagtttctgggctaatatccacttatcagtgagtacataccatgtgggttacctcacacaggatgataccctccaggtccatccatttgcctaggaatttcataaattcattctttttaatagctaagtactatgtatcagaagatggcctagtcggccatcagttgggaagagaggccccttggtcttggaaactttatatgcctcagtacaggggaatgccagggccaagaagtgggaatgggtgggtaggggagtgagggagagggtatgggggacttttgggatagcatttgaaatgtaaatgaagaaaatacccaattaaaaaaaaagaagtaaaatcatagctgggtgtggtggtgcatgcctttaatcccagcacttgggaggctgaggcaggcggatttctgagtttgaggccagcctggtctacaaagtgagttccaggacagccagggctacacagagaaaccctgtctcgaaaaaacccaccccccaaaaaaaaaaaccgaaaaaaaaaacccaaccaccctcccaaaaaaaaccaaaaaaaaaaaaaaaggtaaaatcataaacatttccaactagacaaaggtaatgagacaggaaaacacagtattgcccagagattaagaacacctaagattttatgaacattaggacagtaaaatcaaagagaaccattagaaaccaaagcaaggaagaatggctagcaatgagggatggtgtgtagctgttgaaaatggctcagtgttggctttccaatccagtctgaaaactctgtgtgtatgtgtgtgtgtatccaagttttattttatgcctcaataggaaagttggcccaggctatctatttaactattattgaaaagaaagcactccctggttatttcttggttcttactcttagtgaaataacaccttgtagtatgagagataacatattttaggggagaggtagttaagaggtacttacaagattacccctagctgtcctatcttgtgtgtatgtgctaggtatgcctgctatcttctgtgttccttgtgactttccgaagtatcttccatctctgtttcacagttcaaataagctcgttcctaagatattaaataactactcatatcatcgtaattaataataatgacacccaggacccaactcctgttcttctaaactcgtagctacttactttataatggacttgattcaaagaagaaaaagttgaagtctgtcaagaatggcttttttaaagaagacattttttttttctaattaaaaattattttgaactggagtgcttggactcctaggtttcttcggcatgacaaaaggaagctgtaaattcattgtgaatgttaatgcttggctagtataaatgaatttgtttctttcgttcaatggtcagtcaatgagagtacctaaaaaccctcacatgttgaggttatggagatggctcagtgagtaagagagctttctatataagtatgaagacctgagttcataatccccagtaccaacataagaagcctagagtggctgtgctctttcaggtagagttggaagaacagttgggacatgctggttgctactgccagtctagtcaaaatggtgagttctaggttcagtgagagaccctgcctctggcatataaggtagaaagttggacatttagcatcctcctctagcttctacaactgtacacctatatgtcactcccaaaagaaaccttgcatttaaaacatgctccttttgatgattacttaatttattttgtgtctatactagatagctttaatgcattatcctatattttttcctactagttggctcaagggttaagacatgacaattgcttatgtgttcattttaaatgaactgatgagtgaagtggttatggctaaactgttcctctttttcttttttctgtctgttccatggctatctatcagttcaaacttatgcttagcattaatttggaaccataacctttttaaaaagtcattgtctgcctgtacaaaaggagttatatggataattagttttttctacttagtatttcttctgttaaaactattagaagcacatatataatagtataaactgaattatttttagtgaactattgaaacatgcaacaaattactgtcattcctttttataaaattttaggatggaaaactttctgagctttcaaagagctacaaggttctattttgggaaacatctcaactttacaaggcctgttttcagtcattagaataaggaagtatttaagtacaagctgcccctggtgaccttcctcaaatgagacttcttctctttataaagtttccacaacttcccaaagtatcagtagcagctgaggaacaaatgttcaaaacatgaaccaacagggaccgttttagacctaagccacagcatctcccttataaatacagccaactggcctagaaatggggtcatgtaaaagcagtaagtgctttctggatattagaataaaaaaaaacggagagagcagttaggaacattagaatttaaataaaaataacaagcactaattagctcactagattttttaaaaaccttccacttgctcctagactgagcatcagaaaatctatgacacatgtcatcagtaaacatagaaaacaaaaatcccttaagcccactttccctgacaagaagaccaggaaataggaatcccaacaggtcttacacatctctgctgctccacactggacccccccgccatgtgggcaatattatctacccactggaacggaaatatccagcccctctaagcccttataccacaattggactctagcaggtagtctgacctgacagccactacaatacctggtcatttcttcctctcaatacctggtcatttcttcctctgtgccacaattctggttggtccctgtagtctgaaatgacagcagcaaaacaaaggttatacctacttcttacttctaccaacaaaggataggctgtgtaggttgcaatcatttgttttccttcccttcaccccatatcttaaggagaccaagacccaatagcttgtgagctctttccctcagaactgcccagagataattagcacatggtcctgggaaacaacttttgtccctacaggtgatatctcaatagaggttgaattggagcctgtcttagtttctttttttgttgctttgacaaaatgtgctcacccaagtagcttaagggagaaaggatttattctgacctatagtttaatagttatcatggtgaggaaattcagggtgacagaaacttaaaggagctgctcacatcacatctagtcaggaagcagaaagtgctgaaagctgtctctccacctgtgtagtccaggatttgagctagggaacaacagtgtcattcacagagggtgggtcttccaacctgaattaaatcaatcaaggtacttttcataaacatgtccagagtcccatcttccaggtgattttagattctgtgaagttgacaatgaatactagccatcgcagagcccttgaagaataggccagagtagccttgtgagtgttgagaaaattacacagccattggaaacaaggcctaaaaaagcagtccatagtttatgtactaaacctaaataaggtgactacctgctaagataaaaggtcctatagtccctagtccctaaataatatgcatactatcctggatacacaagtgccaggtaaaacaacttaaatgagaatagccatccaattgactccaaggctgaaatgaagcagatactagaatgaactgatgaagaaaatttttgttggtgtcctaaagttgctccaacaatcagctgaatgaaaaggtttgcaaagtgcagtaggagcactaactaattaattacagttagaatgtcaaagaaactggtcaagaatggcaccagaacttcttgctaagctattaggagttctcttcaactgtaaaagggaaaggggaaaagagaacactcaggagttcacttgctcttgctttgagggatatggttggctgttcttgtcttgttctccacgctgttttgtaccttacttgttactaggaagtcatgtaaacgatgagagcttgttctgctctttagacggcttgcacaggagctttactaacgagggtacactattgccactcagggacgttggtttcttacctaacttaagtttttttctaaatgttttgatattttactatcttgcttaaacaattatatccactgtactcttattttcagatttctttccccaaagcaattattttccagatcatctactttacttctttagacctagaaactgattactacaattataattcaaaacctattttctgctgccctgcacccgagctgggtaattgagtgtaaatggttatttcctttgcatgctttgttgttgtgttaagtgttttttggttaaaagaccagaggttgcctgctgaatatgcgtatattaacaattgtaaaagaaagtaaattactttggggagtattaatgaatagacatttaaattacatagctaaatcttttgaatccattattaagcaaacaattggattaacacccccaaagttatttaatcaacagtttataagccatatttgaatatttgttacagaaaatgatatttgaatggccattaaaacattacaacataataatgcatgttgttattctaaatattaagattcaagttatctctctatatatgtgactttgacaaagaacaaatttaatccttaaaagaaagatccatatcattgtagtatcagtttttttccagagaacaccaatgagtagtaatttttacatgcgtggcagggattgataggctcagcaaggtaggggtgcttattcccaaccacaagaccggatcactaataagtcacaggatagaaggtgggtaggtcttcatgtgatagtccacaatctgacttgacttagaagatttcattctttaaaaaactctgtatgataccaattcagaaaacctcaatttagagtgttagctaattatgtttttttgttttaatattaatattactaccttaagcagctaaaatgaaaagtaggtaagtagatattactggcctcaagatttcttttactaacttaatttaaactagatacattaattttatataatttacgactaggtttaactagggatctttaaaacatgattctgaaaagaaagagatttataatactccacagaggtatattgaaaagcagactgttagctgtagcttctgagcctgagtagtaatcccacctcattcttaggtacagttgtgataatggcttccaaaaatactattgtatgacgatatgccatcttgaatacaatctgttagtgaattgcaacaaaaacacattactttgaagctgtgatttacaatgcaatttcacactctcggacttcaataattattagtttcagtttataagaattggattatgtacagaaaatttgacaattgtgataatgctagcactaattataggtaattttgttgaacactagtagaaaattaattaaaaagagaaaaagtaatcccagcactcgggaggcagaggcagaggcagaggcagaggcagaggcagaggcagaggcagaggcagaggcagaggcagaggcagaggcagaggcagaggcagaggcagaggcagaggcaggaggatttctgagttcgaggccagcctggtgtgcagagtgagttccaggacagccagggctacacagagaaactctgtctcgaaaaaataataataataaaataatttatacaatatattctgatcatatttcctctctatccccaactccttctaggaacccccacttcccctcacacacatataaccctccaaacaagcaacaagacaagatatgccaacacatgtacacacacacatatatacacacacaggcacgcacgcacaaactatggaatttgtattgtgtcagccaactactcatgggtgtgggacctgctctgcaatttggttgatagatccaatgtcactccattggagaaaactgattttccctttgccagtggatatcaattataaatagtttctttgttaggggtggtagcccaagtccacattcccttcacagtgctgggacccaatctggcttgcagctgtataggtcctgtgtgtgttggcacaatcttcgtgagttcatatgtgcatcagtcttgctgtggctgagattgtttcctttgagacatccatcacctctggctcttacagtctttctgccttcacttccacatagatgcctgagcgttgaggggagaattttgataaagacatcctatttagaactgagtgctgcaaagtttctcagtctatgtatattctctagttgttcatctcttaattcccatctactgcagatagaagcttctgtgatgcagttgagtgatgcactgatctatgggtatagcaatatatcattaggagtcattttattgctacgttccagaacgtacgttagcagaattgtattaggctttcacctaagtccatagcctatctagtatcaggttcttagcaataagggtctcatcttatggagtgggctttaaactcaaccaaaatgtagttgtctagtcccataacatttgtcctactattgcactagtatattttgtaaacccatcactgttgcaggtaacagggtttatagttggctgattgcctttctcctccagtagtacacagagtacttccctcaccatgaaaactattcgtgctgctgcttcttgtatggtaccagcacaactttcctcatgtatttgatgacatacgtaagtgttgtcttctgcagtagggccttatcattaggttgtaccaaacaaccaattgcctggcaatagcttgtgatgtttgggagtgttccatggtacccctttactcagtagctcaacaagatataacctttttctgataatggagttttcacttactggtataagatatctagttggggcattctctcccctattatttagattactttcagatatgtaatattttagaattctacagtaataagtttccatatggtttttcaaaagatcttttacattggttaactttttcttttttcttattagatatcttgtagtctttcaataatggtgctttttcttctccttcgctctccccaccttcctctccaccttcccttttatctgcccaatcatcagctctcctttattttacaaattaaggtgggaagcaggtttacaggaaatcacctgagtgacccccccccaaccactcacaggagaacagaattaatatcaaatataattagccccaaggctatccacaacagacgccagacaattattttttaaaagccttttttgttgttgtttttgtttcctacaatttctgggtttttttcatagttattttcagtgcttctcttgtttggtctgtttgctctagattacactttctgttagcactggccactgttttagactctccttcagaagtcttgggagccatggctctctggccatgattagaaatcaagcattgttcttacttggaggcagtattacctcccaacttctaggatatttggaaacacttggagatatttttgattatcaaagcctggggcgggggggggcactgctacaagtcttcagtgagaacagttcatattgctttcctatacaagaaaaaaaaatcagttcaaaatggcaatagtgctaacttgagaaaccccacagcagaagacttaaaagcttcctgggaaaccaaaagtctctctggaaggggatttaattaattcagggcatcttaacctttctccaatcatgacccttttcacctgagaaacttatacaacttcaggtaaaataagcatacaaatgaaacattttctttacaattcataaagatttttatttaaaaacaattagtttgtacatatatatgtatgtatgtatatagttttatttaccatttgttaaggaggaaaacaaatttgcatactaatcaagaggattgcttatttttacatgaattaaatcttggttgaatgtttgataccaaagagcatagagcatattaaatatttttcagacttgattgatactaattttgcaattgtcaatgctgagaacattgttttacataaatacacaatagaaaaatgttagaaatgtgtttaggatcattttagaaatttttagaaattctgtcctgataccaatccaaaatgcatttaatgattttttttcaatcaaactcaaatcagaaacttaacaccaattttaaaagtcaatcactctaacccaatgcactaaaaaggtgtatgctaatttactatatgctcaggagtcatagtaggaaaatattaaaagtctgattttcataatcaaaacattgttttcataagagcagaaaactttctatgtacactaaatacactgtggttcataacatattagtctcaaatgtgagttaaggtggtctaggaaggagtcatccgtgttgagtggcatgtgcagtgcaaagtgggcatactgctgtgtatttaaagtcaaagctctgacacagtgccagtgagtgctgccataaatttgattttggattgttgttgttgattgttgttgggcatgagaaaccttggcattttgtgtgtgtgtgtgtgtgtgtgtgtatgtgacacatttagatttgtggatccatggggttacatcccatgttgtaagaagctgatatatagttgaatgatgtggggtaacctcattttatcttggaaaaggactgagactgtcaataacacacacacacacacacacacacacacacacaaaacaacctcatgctcctttgctttctatccctttctcaatgaccttctctggtcttgataatgtattgctgtctctaaagtatgaatccttgttaggatgagaaaggagcagttacccatggtataagatagagacataactgcttctttaaaatctttcttcttgattctatgccccagtacaggggaatgccagggccaggaagtgggagtgggtgggttggggagcagggcagggggagggtataggggactttcgggatagcatttcagatgtaaatgaagaaaatatttaattaaaacttttcttcttctagttccagattcatgagattgttctgtaacataaatgggtttggttttaaataatcttccttgctttctcctgcatcagttaacattattgtgtctgtgtacactctttatccctcaaatttgattatttcatctctcttgttctcccagttatttctttaagctccttttaatagatttgggaaataagttaggtgcactatgctcaatttatcttggttttctggaaaccaggcataatttatagcatagtttcatgtaattatagtctttttaaaaaatatatttagctcttatatgggaattatctattacctacatttaacttttcctataaagggaaagtaaaggagagtattctgtgtctgcatagggcagctatggtctttctagaattctagaagatattctaacaatacagattttttgttatttctttatctgtctttggtattagagtagtactggcttcataaaaagaatttgtaaacattgctttcatttccattctatggaataatcttcatagtatcaagtgttagttcttttaagatgtattagaattctgcagtgaatctatctgcctctgagatgtttttagttgggcagcttttttttttttttttttttactgtttcagtcttgttgctggagatgtatacatacatatatgtttaaatttttatttcatcttggttgcattttagtgggtcatatacactggaaaattcatctatttcttctagcgtttcaaagttaagggaatataggtttataaggtatgtcttcatgatttttctggacttcattggtatctgttacaacatcttacttctgatatctaattttatcgatgtaggtcttctcctctttatcttttggttaaattggcaaagaattttccagtcttgcttatcagagaaacaactctttgtttaattgattctttgtattatatttgtttctagttcattaatttctgctctgatcctagtttttttgtgtgtgacaaggtctcactgtgtaaacttgactggcctagaacttcctgtatataacaggctggcctcatactcacagaaatctgcttgcctcctctcttctatgattctaggagtgtgctcccaagccctcattctctccctgtctagtgttttcaagtttggtttgttcttgactttccaagactttaggtgcaccattcagttatttatttgagatttttcagatggcagcaaacttgtgtgactaagcaaaatttccactagcaggtatgggatacctccacagaagtttatcagcgaagccccagatgtcccccccaaaacaggttctgcagtacttttagttattcatcactagatgatatgacccttttgcagaagatgccctagttataagatagagagaaagtaagctgaaactgagctggaatcttcttctctgctggctactctcatagtactagaatgtgctactctacatgctgctggaagagaaaatgtattattggccttacccatctgtgtaccctaaaaaacaggaaaaaaaaaactatcctgaaaagatgtgtctacctatgcaatagtggcataattgtgagaacagctgccatctgataagatttgaggcttgttcccaagagtgaaactcatagctagtaagcccacttaacagtctatgcctagggaagttgtaggtccaactggagtaactagatttatacatcatcaaactgccttctaaatacgtatatttatacccattgacataggttgttctcagtcataatgagagaagcctttctttgcaataatcagcaatgaatacaaagactagatagactcgtagcaccctaagattctaagaatgggtgatggttgaaggctcagtcctaaacagacatttatattcctccctttaagctcagagaacactgggagaggcatttaggaagtatgcaaaagccagaagataaggagaaagcctgtggatgccatttcctgaactcaatagaaccatcacagtcatgaactcagcaagtgcacttaccctcagtggtccacatacaagacaggtcatgttaaaagggaaggggctcgtacaacttcctattgcactgttggctattgatggtttttgggaacaggggaataattattatatacactgccaagcccaccagagcctgacagatagctgcaaacccacagtcatttatacagccctggttcacacagtaggtcacaaagaaaaacaaatagacacatatgagaaagaattctaggaaagaggaggggtgtgtgtgtctgcgtgcctgtgtgtgggtctgtgtgtgtgtgtgtgtaggagtagtagtgagatgagagagttgaaactgagagtggttagtgtgcattatgcatttatattaagttgtcaaatagtaaagttaactaaaaattttaaaagtcatagaataaataaataaataaataaattctttttcatccggcaatatttaatcaaatctcaaatatcaccagttgttactctattttggtcaataccctagtagagaaagataatgtatcattttcttccacatcaatagtcaagagttggctatatggtacattaaataaattttaggtaaaaacttccaagaatcaagaaggggttgacaagcaaaacagaaatctgttcttcctgacttttatttcccctaaactatcagctaaatataagtaatgactataatatggttctatgttaatgctgcttattacttttcattttcataaaagaccaacccaaattcttttagtagtatctgctgagttttaagttgtgaatgaaatcataagcaacctcagactgttttgatgtctttaaggttattacatgggtctcagctcaccttcgttagcttcctgcttgttagtaaggaaaagcctttactctgctttacttaggacttgtgttcaggtcttgaagaattcataaatacattccttttaaaattctattaaataagcttaataaaccagtggatttaatttttattcatatttttaaaaatattttgagactatagttacattatttctgccttccctttattcccaccaagttctctcatgcactgctcctctctctttgggatttgtgtccttttctttttaattgttggtattttgtatgtatgtgtgtgtgcctatccttaaaaggtggttcattgtctcattgctttttctctcctttctccaaagctatcttaatttaattctcatacaatggtagcaggagaagcttatgctttcttctttgcctatatttaagcaattgcctggattggccacaaacaaccctacagacagaactcagaaattttacaaaatgatgcagtgagttgaatgatactacacaatatatatatagagagaacatgtggtcaaaacctgattatgttaaatgtttcctgaaattgtatgctattgtcagacgaaataatcacaagtaagactaggttaaaagtggaagcatttgtaagagtcctgcctcacttctttgtgttgtcattgaggaagatctagtggttttcagtgactgtggaaaaggttttctttctgtagatttgtgatctgaacgttaacattatcaacactttcctttccaggctcgctttgctctttgtgaaaagatttgaagctaggtggaattgatgtttgtgaagatggcattcaattgatcacggatccataattaagtataggttagattaaatttatttgctagtcccttaactgaaaaaaggaaaaacagtattacaaatcaaaggaatactcaaacacacacacacacacacacacacacacacacacacacgagtgccctctaaaagccagtgagagcgtcctttgtgtattcttccaccagtcgggattggaaaaaaatgtatacatgcacatatgctcctatatttaatgggtgaatcatagttgaagtgctagtttcacacaacaaatctgtccttgggtatcttaaattcttgagttctgatatttatttgatgactgctcaggatccaagtattgacattttatttccctctgcatatccaattgtgcaacatgtattgagtcactgatgaagattgcagggaggcgtaggtaagcaagtcactagaccagtacaatgacttttactgataaggcagttcattatttatggcagtttaaaatagttctgatttgaaattttagaatgatgaaggatttctgtaatttttttttttttttagtcagactagagaggttcctggacaccaaatcatgcagggatttttccttgagaactccctgcctaagactgtaatccagattttgttgaggattatcttttccttattttatgtagtattgcttatatgttttgtattttggttcttgattaggggtgtgtgtgtgtgtgtgtaaaactttttctctgggattttaagtgagaccatataagattttaattttttcaataatttttattagatattttctttatttacattccaaatgatatcctctttcctgatttcccctccaaaaaccccctctcctctaccctctccccgtgctcctcaacccacccactcccattcctggccctggcattcccctatactgagacatagaaccttcacaggaccaagggcctctcatcctattgatgaccgactaggccatcctctgctacatatgcagctagagccattagtcccaccatgtgttttctttgattggtggtttagcccaaggagctctggggatactggttagttcatattgttcctcctatggggctgcaaccccttcagctccttgggtcctttctctagctccttcattgggaaccctgtgctcagtcaaatagttggctgtgagcatccacttctgtacttgtcaggcactggtagagcctctcaggaaaacagctatatcaggctcctgtcagcaagcttttgttggcatctgcaatagtgtctgggtttggtaattgtatatgggatgaatccccaagtggggcagtcgctggatggcctttccttcagtgtctgcttcaaactttgtttctgtaactcctcccatgggtattttgttcccccttctaagaaggattgaagtatccatactttggtcttccttcttcttgagtttcatgtgttttgcgaattgtatgttgggtattccgagcttctgggctaatatccacttatcagtgagtgcgtatcatgtgtgttcttttgtgattgggttacttcactatgtacaagatatcctccagtacaagaatgaatgagaaaccttttttcagtagttactacaaaacatttggagcttaaagttaagagtttatgatgtgccaagaagtgatggagataaactcagtaggatatggaaataaagattaggtttgtggcaaagtaagagggagatgttgatttaacttttggcttcaaaaagagtatgtcttatacgtttgcagcagcagttgatgaaaaaaggggccatgaatttgaaggaaatcagggaagagttcatggaaaagttcggagggaggaaagggaagggagagttgttgcaattaaaatacaatatcatattaaacaaaaagtgtgtctgtatacaaccacttctacaaacttcccattgtatcagatgttggtaattatttgcaattactacatttgttttttgtcctgactataaggatagtatttagaattttatatatataccatatataagaatttttatatattttatatatatatgaaaacctatttatttggcctccatttttggtataacaatatcttaaactgatgaattacctttgaattagacaatagtactcaaaattgcattgcttaaattttattgtgaagctctctatagtttgtagtgaataaagaaacacagtaagatgttgatcaaaaagaggaaattaatgtcagtgaattaaaattgacttttttgttttttaggggtcccttcagtgttgtacggcgatgtatcaacagagaaactgggcaacaatttgctgtaaaaattgttgatgtagccaagttcacatcaagtccagggttaagtacagaaggtaagagatggatttcaagtaagttatttgatgtctggctttattccatctccaaaacccatttatcaacctaacctcatctgggggtggggaagcaggggatatgatatagtggggaagtgggtggagacagtgtgaactccagttgaaatagttgctcagaaatctaaaagatagcatttgaaatatggaatcattaagtcatatgggatctttatgagcttatgctttttttttttttttactagaaagagagtgaaatagggacatactttttaaggtataatttgagtcctgttctgtgaggtgtaggaagggaaggaaaggaaataactataagaatgttaattgaagatttagaagcagccaaggtcctttaagtataatttttggcctttgggattactatctcctataactagatgattgatattttgattcacatttggctaatcacatactgtatttgtaaaagttgaaaggtcagtagtattagaatttgtgggacttagatttttttaaaatatatatatgtgtatatatataaatatatatatatatatatatatatataaatatatatatatacacacacacacatttgagttacttattatttttaaattttaccatgattcacattaaagtaacaaaactgattattatattgactctcctaattatcctatttactagctttagactttcgccacctagtaaaagatgtattcttccttagtattttgtttttgaatcttaaaggctgtgcaattgaagaaaatacaaagtgaagtaccctatttgtgttttacccaattatctagttttgcaaagtagaatctcacacagtgtgagctccaatctattcctatagatttttattcaggacaattatttctaaacacgttgtgactctttaaattattattatcaatataatgtttatagaagattgttaaaaattattgctaagaggctgaagacatggctcagtgattaagagccctagctgctctcccgaaggacttgggtttgattctaccaccacaaaaaaggactcaaaaaccatctctatcccaggcccaggggatcgcttgccctcttctggcccccatcagcaccagcccatgcccttggtatacagacatgtaggcaggcaaaacccccatacaaatacaatgaaaataaatacatcttttaacaaacatttttaagttacttctaagaaaacctcccttgctgatttgtttttagtgctttaatctttactggatgcctacaaggggccttctcagtcaaagtgtatgcatgcatttagattaaataaacgtgaccacagtactgagggaaaaatcttgtagtaaaatttaggtgtttcatagttcatgatttcattgtcagaactggacattaactgcttttaaatatacattattttatatgcttagcaaaatggaaaatttgccatttgatgggccttacagttatttttcctttgaactgttttgtttggatgtattgttggctttgtagtgctggggatcaaacccaggtcctcaggcaaactaagcaaatactgtttttcttaacttttaaatacttttaaagttctctatgcctcagtagtctataagggcactgaggaaactttgtgcaaacctgattattaaacaagtagatgttttgctaaatgctgaaaaaaagttctgatattgtttataaacagatctaatttgttgattggtacagatctaatttaaaattacaaatgttaaatcaattatccaattatctatattaaattagaataatggaattgaaatatcttacataatattgcaaataactaaaataaatacttataggttatttcttagccccaaattactaatatcaaagttttgatttgtcctatcattatacctaattttctgtctttccagatatgtttctaaatttccaaagatatttttaaaggaaacaactactttttcatttgtctatagtaaattattgttagatttctttagttagatctctggaactagagacttagaatgtgaggaggaatctcttttactacttacgtaaagaaggttatggtgatttacacattcagtcccagaatttaggaggcaggcgcagagataggtggatctctgtgagttcaaggtcatcctgctatacataaaaagttaaaggctagcctgtatatattgagactgtctcaaaacaaacaagcaaacaacaataaaacaaaacaaaacaaaacagaacccatttcgccagagggttaaactccaaaccatttttttttgtcattctaataatttttttattctttaatctttttttacagtccagactttatccccctcccagtccatcctccaactgttccacatcccacacctcttccccccatcccctgtctccaggaggaggtccccactccccacccccaccctaccagacttccccactccctggggtcccaagtctctgcaggattaagtgcattttctctaactgtatctagaccccacagtcctctgctgtatatgcgttgtggtcatcataccagctactgtgtgctgcctggttggtagctcagtgtctgagagatctcaggggtccgagttagttgagactgcttgttttcttatagggtcagcctcctcctcagcttcttccagctttcctctaattcaaccacaggggtccccgacttcagtccaatggttgggtgtaagtatctgcctctgtctcagtcagctgcttgttgggcctctcagagggcagccatgctagactcctgtctataagcatatcatagcatcagtaatagtgtcaggccttgaaccctcaccttgagatggatcccaatttgggcaggtcactggacctcctttccttcagtctcttctccatttttgtccctgcagttctttttttttttaattgggtatttatttcatttacatttccaatgctatcccaaaagtcccccacacgctcccccacccacccactcccacttcttggccctgtcgttcccctgtactgaggcatataaagtttgcatgactaataggcctctctttccactgatggccgactaggccattttctgattcctatgcagctagaaacatgagctccaggggggttctggttagttcatattgttgttccacctatagggttgcagatccctttagctccttgggtactttctctagctcctccattgggagccctgtgactcatccaatagctgaccgtgagcatccacttctgtgtttgctaggccccggcatagtctcacaagagacagctacatctgggtcctttcgataaaatcttgctggtgtatgcagtggtgtcagcgtttggaagctgattatgggagggatccctggatatggcagtctctagatggtccatccttttgtcacagctccaaactttgtctctgtaactccttccatgggtgttttgttcccaattctaagaaggggcaaagtgtccacactttggtcttcgttcttcttgagtttcatgcgtttagtaaattgtatcttatatcttgggtatcctaagtttctgcccctttagacctttctgcccaacttcttttcatctcttttctagttactacgggcaaaaaccgtctgattccgtcagctcttctattccatttataaattgttggggtccaaaaataacccgttttaaggcaaagcatgcaaaacatactgtatcaagaagaaacaaattttgaaggggaatatagcatagtaaagaagagtccataagttcaagtaagattatctagaaatatcttttaattctagctatttaagacaactttttttcttattttttgttaattcctttttcttcaaattttttattagatattttcttcatttacatttcaaatgctatcctgaaagttccctataccctcccccctccctgctcccctacacacacactcccctggtgttcccctgtactggggcatataaagtttacaataccacggggcctctcttcccaatgattaagcaacaaatcatttaaaatccatcctgtgccttattctttgcttactcatatcttttctccccttggcttatagtttctttgacccttatcattgcccattttttcctgttaccatatctgtttcaaaatatattatgggctagatgtaatcatttattttcaaaatatattttaagctagatatggttgagcaggactgtaatctaaagattatgtggaggccagaagatcagaagttgcaggtcatcatggactccatagttcaagcccatgaattcaaagccaatctgtgctacatgaaaccctgcctcaagaaagaaaataataaccaatatgaatgcatgtgtctaatgaggatcactgtggagcctaccatacatcacttatttagataggtcattgtttataatatgattttattagaaacatctgtagtaaattctgtataagtaacatacaaatttaattttgaaataaaatgtttattaattgaaaatttctatattagtcaataaattttaagtttatattgccttagggaagcttccacatgataatttatttttctttattttttgctgctaatattctaatttttgttcagtagggtttttcaagttgcacaaaatccaatagtcccttgaaaataaatatattttgtcatgtgttcatttttcattgtttttacaagattctgaaacagacatatcactcctaagtattttataatttcttcctctatatgtatatagaagtaaaattgcttatgagtatgagataagtgaaaagtttctactaaatgaaagctaaatgattttatattaaaatatttctgatatggggccagtgaaataggtcaacaggtaaagcacttgtcatcaaacaggacagtgttagtttgatcccaggaatcaacaaggtaggacttacttgactcctggaagtcatgttctgagctgcatatacacacaaactcacagaatcagtaagtaaatgtaataaaacattttaaggttttattatttatatgtgtatgcttgtgtgaatatatgtgtgcgtttctgtagaaaccagaagaaggtatcaaatcctctgagtctggagttacacaagactgttagccacctgatacagttgctaggaaccaaacttgggtcctgtgaaagagcaggaagtatatttaactgtgagtcatttctcccgcctctcattagaaggtattttcatacacatatatagaaacaaagacatacaggtacatcccattagtgaaattcttagattcttatctttgaacgtttttttctgaaaaaaataaatttttactgtttttattattactaattaattattttttagtttataccccaaatgttgacctctcctagcccctccctgtctcctctgagaaggtgcccccccccccagcattcccagtttctgaggcatcaagtctctacaggattaggcacatcctctcccactgagaccatacaaggcaaccctctgttacatatgtgccgagaggcctcagaccagcctatatatacagcatatgtgctggggtccacagtccagcccatgctgtacactctttggttggtggcttaatctttaggagctcccaggggtccaggttagttggtactgttggtcttcctatggggttgccattcccttcagttccttctgtccttcccctaactgttccataggggtccctgacttcaacccaatagtttcaacccaatagttgggtgtaagtatctgcatctgtctcagtcagctgctggtagagcctctcagaggacagccatgctagactactgtctgcaagcacaacatggcatcagtaatagtgtcagggagtgctgcttgcccatggatggatcccaagttggggaacaaaataatcatgggagacagagggagggaagcacctgggtgaaagaggggaaggggaggggaaaaggggttcagtgtcaggtatagggagagacaggagagaagcccagaggacccagagaatgaatggaaatatgcagctacctggggtggtgggaggaacctctagaaaatcccagagatctaggatgggagaagctcccaggacttaatgcgggtgaccttagccaaaatgcccaatggtggagatatgaaacatgcaaaccacctccagtagttagacaggaccccagtggagggatggagacaccaacctaccttgaaaaatattgactcaagattgttcctgtccaaaagaaatacagggataaaaatggagcagtcactgaatgaatgaatggccaaccagtgactggcccaacttgggatccatctttggatttttaattaatacactttttgtcttttattctgctgtgccactaataaggttttatttttaaaatatgaaaatgtattcaagcaaacaaagaaattaaaagatagtaagatagatagaattagaaactgaatatccagagttccaagttacttttaattttacttacttattttggtgctagggtttgaacccaaagccttgattttgctacgtctacaatctaccagtgaactctactcccagtccataaccacagtttgaataaagattgtatagtgaaagatctcttttattggttattttatttatttacatttcatatgttatcccccttctcaatttcccctccacaagctcccatccccttctccctccccctacttctatgagggtgctcccccacctgcccacccacccacccacttctgtctcagcaacctagtgttctcctatcctgggtcagcaagcctccacaggaccaaggggctcccttcccagtgctgctggataaggcaattctctgctacatatccagctggagtcatgggttccccctgtgtactctttggttggtggttttgtccctgggagctttgagggttctggttggttgatattgttgttcttcctataaggttgcaaaccccttcagctccttacagtccttgccctaacttccccattggggtccccacacttagtccaatgtttggttgtgtgtatccgcatctgtattggtcaggctctggcagagcctctcgggagacagctatacctggctcctgtcagcaagcacttcttggcatcagcaatagtgtctgggtttggtatcagtagatgggatggctccctaggtggggcagtctctggatagccggcttttccttcagtttctactccattctttgtccctgtatttccttttgacaggaggaattctggattaatatttttgaggtgggtgggtggccccacccttcaactggggaccgtgtctatcctctggatatagtctctacaggttctatctccctaaattcctccagttggatcctgggaaccccctgggtctctggcatgtgggactttctagtggctacccccagttccccctctcccactgctacacacctactttcaaattcctgaccctctgtatttcaacccccttctcctcccatatctgacctggttcttccccttcccctcctctccttttgtgtaggtatttcctacaagttcaaacattccctcctagaggaaagacagaggtttataggatcagtgaaactcgcaaggcacaggaagttataagattctcttcccaaggttctataggaagccagcaatttctggggagagaagactggtaaactgcttccagagtccctaagtaaaaccttaatgtactaggagtgttgagaggagagggaaaagaaagagaaagaatgtgtgaaggaatgcttaaggaactgatggcacagaattctcgtaagttctacatagataaaccaaaaggatatatcataattaagctgtcaaaaattgacaaggaaagtaaactccagaagaaagcaagaaggaatgaattcatcatagagaagggatctgcattagctaccagcagatttttcatcagaaatcatgatactagtggcaatggaataggatccaacatgctgaaagaaaatattatcaagaatcctttatacagaaaaagcatacttcaaaaaatgaagtataaattattttcagataaacaaaacaaatctggctgcctggttattgggactaataaacttgctctacaagaaattctcaaggtagatttttacagtctgaacaggaagtatttgttaatattttgaagccatatagaaataaaaaaatactcttaacatcacatataaaaatgtgacagccagtatagacatactttttgcaacatggtctcaatatgtaacattgatatgttgatctgaaactgattaggcagaccaggctgatcttgaattcagaggtctgcctgcctctgcctccccagtcagattaaaggcttgtgctactactacccctggctataaatacatttttattacacctgtgtttctcttaactgacttaaaaaataactgcataaagtagcattataaaactatgttaatgagaccattatgtaagagtgtcaccccaaattaaccaataaaagtacttaatagctatagtagacatagacaatatggcaagatgatataaatggtgtagtagatactatctatacaatgtcaaagaagtaactggtagaggaatataggcacatagcaaagtttctaatataaataatatcttattggtaataccattaaacataaatgaattaaaactaattataaggcagagagaggcacaatgactaaaaacatgccctattatatattatctacagtaggaacattttatttttattatattggtttttttttgtgtgtaggtatgtgtgcatatatgtgcatgtacatactccacaatatgtatttggtgatcagagggtaactgtctttctatctatcataatgaaacttagttcagcattctgggcagctagcacctctacctgttgagccattgttctagtcagagtcacattttagactcaaaaggcatttaagttgaagtggtaggaaaagatgtatcttttcaaactgtaaccaaaagaaatctaaaatacctgtacaaaaaacccccagaaatttgtatttcagtgatacttttctatttcagagctgaggagacagctcagcctgtggacttcagttccatccttagaacccatgttaaaatgtcaggcatgatggcttctgcttgtaatttctgcaccaggtacagggtgtaaaagaaacataataatttgatctttaatgtagaaaatcattatataaattgaaatgtgtatatatagacttaataagagttacatacaggaaacttgaaacttacgacagtttttttaatctaaataaatggggagcctttctcatatttgtgattcggaagatagtactgtgaaggttatttcctcgcaagttaatctgtagattcattgcattccaaattgtgatcccaaccaactactttttggatattgacaaagtgattctaaagttctataaaaaggcaaactatccagaatacctaccatcttattacagaaaagcaaagttgcaagactactactcaacaccagtacttacttaagaggtgcagggcatattgattgttttgtttgggacactacaatgttagggtaaaaaaaatcatgaaatatgatcagtgtgattttaaaggaataatagcattgggctcgttgtggagtatcttcttcgtggcacacatctattttccattttgttggcgacaagaattttcatataatgataaaattgagtaattatacatataatgccttagtacatggaaacctgtgaaaccaaacggatatctattgtttgtagcagtgttagtttcctgcatttgatattgtactgtggttgtgtaagatgttgccaagggaagaaaggactaggttaatgatatacaaagaccctttgtattatttttgcacatttctgttaatgtataattactctagaataaaagatgttctttaaaagttgttttgtggtttctacaatcttctacaaagtaataattatgcttcaaatattcaggagtatgaaaaagcacaattttaactaacggttttggtttctaatcgctcaaattggtatgttcaggcaaatcgtgattgatgtaactgagagcatcatcaaacagttacttgctttccctaggaaacatgaatatttaataatcctcatttacataatgaatttgcattcattttgtaggataattactggtctagctaattaatctatatcctctcctgtgtgcagaaagcatgtgaaaatattttatttgctgtgatattttcttagtgttattccttttctgctgtggcatgtgtggcatataacagtgaatttcaagacattaagggttatactttaattttgtcatgtgcagtttctgaacactttcatcatgaattttgaagtcctggtcacagatttaatgactcaaattgtaatttgtgaattcagcatttgaaatgaaaacacccattctttcagatgttactgaattatcttgtatgtgcctcatcctgtgcatgtgagacaaatagattttattgtggagctatgacataatcacttttagcattggtattattaaacatgaatagaatcatgaaataattaaatgtagccaatattttgaatcactttatttttttgatattagttttatggagaaaacaagggatttttgtattatgaaatatttgagcaaagctagttggagaccagcttccagccagttgtataattttccacagaatgtctatttttaccatttctgaccgtatttcccatttaattattgcattgggtcactggctagtatattctaaaagaggattttcgtgttagatttttttctatactgttgaagcataaaaaacttcgatgatagaagtactattttttagcaaattacattaatggtacatcattggctatttttcttgagatgcagagagagaggaggggagcagtcagtttatctgtctgtctgtctgcctgcctgcctgccttcctgtctctttgccttccttacctgtctgtctatattgaactctgttgagaaaaaaaagtcagcttttaaacaaatgtatccattttaaaaatatttgtggtagtctagattacctgttcgtagaagtatatatgggcgtttgttcacaaaaatgactcagactcactaggtaataattctagatgtgaacatttaatatgttgactatattcctggtgccattattataaatgtctcttaatctagatttctcatctcacatattagatgtgttgatgaagaggctgtcgtgttttataataatgctctcaaagctccgtggtttatatattcaatttaatcttaatatcatcttaatgtcatattcaagaactataacagtatgacacactgtaaaatgagaacctctgctcaatatttattctgaaataatatagtattttaaggttatctcacccctaccacatgcggattttttaaaaagttccctattccactttctttatacaaataactatctattcttacaaatctttatttcattgttatttactttatgtgatttagagaatttctctggaaactataaagatagacagtgatagatattttagtaggttgatggatgcataaaccctgctagatggagataggaaaaaaatctataaaatgagtatgagaatttgattgtaatatttaagtctgaagcaactgagaggtagttcttttattttgagttggtgttgttaatggctgaatacgcatttgaaataagctaagaaatcatattttgttattaaggttgttatccttcagtagttcacattatgtagttcaatgtatattcaaaaaagcaaatgctaacttaggaacgaaaacatctatttaaaaggagtattacacaaaaagagaaaggagctattgaaatgtattatggatgagaatttttcttagtcccacccagaatcttattgtggtctactgaaatatgtacagaaatcttccagatgtcaaacaaagggagtagaatttgttttagcagataaatctgtgttcatggaaggtttatatacttctcaaatatcagccagaacagcatttttcttacatgggaggagtaaacaaagctagaaagaccttggagagagagaagggggcttaaccaaattttgttcttgttcatttattcatttttaactggtatattgttcttattgattatgtagttgggctaatcagttataaggcaaggaatggtaactcagagtgtctgagtttggccttatcatagataagtaaaggagctcatgaatcttatgtaagtcataaaggaaaggttttgtttttgttgttagaagctgttttttaaaacataaaagttggtaaatttattaacattttatatttttccacaatcaaggtgtttaaataaaatttaacaaatgttcaattgtaaagactttgaaaggttattaatattcactgcatcatttttatattcctaatttatacaagaatatattattagtcctgattttctttggcaaagaaaaattgtcagcaattttttatgtatacagttcaacctcattattcatgggctctagatcagtaggttcatccaaatacagattggaaatattttgcaaaagaaaaagttatcgtactaaataagtacaaactcttacctaataatgaattgggattggaaagtattgactaccctttaacattaccccattctcagtaatgtgaagaacatacaaagaaacataagcaatctgtcctattgtaatttgcaacattttagagatagtgtagaagttgtaaattttaagtggtaatagtattacttgcatctgtatttgtcaggctctggcagagcctctcaggagacagctataacaggctcctgtcagcatgctctttttggcatccacaatagtgcctggttttggtagctatagatgggatggatccccaggtgggacagactctggacggcctttccttaagtctctgctctgaactttgtcacctgctcgaacacatttcctcctgtgagtattttgttccctcttctatgaagcactgaagtatccacactttggtcttccttcttcttgaccttcatatggtctgtgaattgtatcttggttattctgaacttttgggctaatatccacttatcggtgagtacataccatgtgtgttcctttatgactgggttatcccactcaggatgatattttcaagttccatccatttgcctaagaatttcatgaatttattgtttttaatagctgagtagtagtactccactgtgtaaatgtaccacattttctgtatccattcctctattgagagacatcttggttgtttcaagctcctggctattagaagtaaggctgctatgaacatagtgtagcatgtgtccttattacaagttggaacatcttctgtgtatatgcccaggagaggtgttgctggatcttccagtagtactatgtccagttttctgagaaaccaccaaattgatttccagagtggttgtaccagcttgcgatcccaccagcaatggaggagtgttcctctttctccatatacttgccagcatctgctgtcacctgagttttttattttagccattctgactggtgtgaggtggaatctcagggttgttttgatttgcatttccctgatgactaaggatgtagaacatttctttagatgctttttggccatttgctattcctcggtagagaattcttcgtttagctgttccccattttttaatagatttatttggttctctggagtctaacttcctgagttctttgtatatattggatattaactctctattggatgtaagattggtaaatatcttttccccaatctgttggttgccttttgtcctattgacagtgtgctttgccttatggaagctttgcaattttatgaagtcccatttgtaaattcttgatctgagagcataagccattggtgttctgttcaggaaaatttcccctgtgcccaagtgttcaagactcttaccctctttttcttctattagtttcagtgtatctggttttatgtggaggtccttgatccacttggacttgagctttgtacaaggagataagaatggatcaatgtgcattcttctatgtgctgacctccagttgaaccagcaccatttgttgaaaatgctgtcttctttccactgggtggttttagtgaaaattaagtgaccataggtgtgtaggtttatttctgggtcttcatttttattccattgatctacctgcctgtcactgtaccaataccatgcagttttttatcatgattgttctgttgtacagtttgaggtcagggatggtgatttccccagaagttcttttattattgagaagagtattcgctgtcctaggttttttgttattccaaatgaatttgcaaattgttctttctaactttatgaagaattgagttggaattttgatgggaattgcattgaacctgtagattgctttttggcaagatggccatttttactatattaatcctgccaatccatgagcatgggagatctttccatcttctgaggtctccttcaatttctttcttcagggaattgaagttcttgttgtacagatctttcacttgtttggttagagccacatcaagatattttgcattgtttgtgactattgtgaatggtgtcatttccttaatttctttctcagcccatttatatagggaggctactgatttgtttgagttaatttaatatccagccactttgctgaagttgtttattaggtctaggagttctctggtggaatttttggggtgacttaaataaactatcatatcatctgcaaatattattttgacttcttcctttccaatgtgtatccctttgacctccttttgttgtctaattcctcgagctagaacttcgagtactatattgtatagatagggggagagtaggcagccttgtctagtctctgagtttagtgagattgcttcaagtttctctcgatttagtttgatgttgcctacttgtcttagtcagggtttctattcctgtacaaacatcatgaccaagaaacaagttggggaggaaagggtttattcagcttacacttccatactgctgttcatcaccaagaaagtcaggactggaactcaagcaggtcaggaagcaggagctgatgcagaggccatggagggatgttctttactggcttgcttgctctggcttgctcagcctgctctcttatagaacccaagactaccagcccagagatggcaccacccacaaggggcctttcccccttgatcactaattgagaaaatgccttacagctggatctcatggaggcatttcctcaactgaagctcctttctctgtgctgactccagctgtgtcaagttgacacacaactagccagtacactactgtgtattgcttttactatgtttaggtatgggtcttgaattcctgatctttccaagacttttatgatgaatgggtgttggattttgccaaatgctttttcagcatctaatgagatgatcatagagttttttttccttttgagtttgtttacatagtggattatgtcgatggattttggtatattgaaccatccctgcatccctgggatgaagcctacttgatcatgatggatgatcgttttcatgtgtccttggattcagtttgtgagaattttattgagtatttttgcatctgatattcataagggaaattggttcaaagttctctctctctctttctttctttctcttttttcttttttaactgtgatttgatttattatgtcaaaatagctcctggaacaaatatggttatttcgataattggtttcatattgatttctctttatttttttcctcatttattttctttcatttcaccactcttttgtttttttattagatattttcttcatttacttttcaaatgctatccccttttctagtttcctctctgaaagtcccctataccaccaccaccacccccccgccctgctccctaacccacccactcgctcttcctggccctggcattcccctgtattggggcatataatcttagcaagaccagggcctctctgcccatgggtggccaactatcctctgctacatatgcagctagagacacaagctcttggagggggggggtactggttagttcatattgttgttccacctatagggttgcagacccctttagctccttgggtactttctctagctccttcattgggggcccaaagttctctttctttgttgggtctttgtgtggtttaggtatcagagtaattgtggcttcatagaacgaattgggtagattcttctgtttctattttgtggaatggtttgtggagtattggtactaggtcttcattgaaggtgtgatctgatagaactctgcactaaacttatctggtcctgggctttttttggatgggagacttttaacaactgcttctatttctttgggtgttataggactgttctgattcaactttggtatttgtaatctgtttagaaaattgtccatttcatccagttttttcatttttgttgagtataggcttttttagtaggatctgataattttttaaaatttcctctgtttctgttatgtctcccttttcatttctgattttgataatttggatactgtctctgccctctggttagtctggctaagggtttaatctagttgattttctcaaagaaccagctcctagttttgtagattctttgtatagttctttttgtttctacttggttgatttcaatactgagcttgattatttccttctgcctactcttcttgggactatttgcttccttttgttctagagctttcaggtgtattgtagtgtgtgatctttccagttcctttttggaggtactgagagctatgagttttcctcttagcactgctttcattgtgtcccataagtttgggtatgttgtggcttcattttcattccattctaaaaagtctttgatttctttttttatttctgccttgaccaagttatcattgaatagggcattgttcagtgtccatgtgtatgtgggctttcttttgtttttgttgttattgaagaccagctttagtctatgattttctgataggatgcatggaattatttcagtctttttgtatctgttgaggcctattttgtaaacaattatatggtcaatttaggagaagatagcatgaggtgctgagaagaaggcatattctttcattttaggatgaaatgttctatagatagctgttaaatctatttggtccataacttctgttagtttcactgcatctctgtttagtttctgtttcaatgatctgtccattgttgagagtgggtattgaagtcttccactattgtgtgaggttcaatgtatgctttgagctttagtaaagtttcttttatgaatgtaggtgctcttcatttgaacatagatgttcacaattgagagttcctctaggtagatttttcctttgatgagtatgaagtttccttccttatcttttttgataacttttggttgaaagtcgattttattcgatattagaatgactagtccagcttgtttcttgggacaatttgcttggaaaattgttttttagccctttattctgaggcagtgtctgtctttgacactgaggtgtctttcctatatgcagcaaaatgctgggtcctgttaataaatctaatttttaaaatggggcaaaggccagatacatgataaaggttcttgcatgataacttgagtttagtattctgagcatacatggtggtggaggagaatggactcctgccagttgtcatccgacttccacaatgaactgtgccacatacacactcacacacttatatacaagcatgtgttggcattcctgtatgtacatacacaaaatgaaaaaaaagtactgttatttaaatagacaaatgaagggctggggacataggttgttagtgatagagtacttatgaacaaggtccagggtcttatccataactccatggtgaaaaataaactatatcttcttgggataatggtgcatacctttaatcccaggattccggaccctgagagaagaagattgcagcatctgaatcaacctgaagtatataatgagttcaagacaaaacaaaagataatcagtgggtataaatagatacttattgaaagaagaaataaaataacccacatatacttggaaaaatgctcaatttctatagttacacaggaaatgttattaataattacagttaagggctagagagatagatggcttagttgttataagcattggatgttcttccagagacctggcttcaaattctgatacccacatggcaactcatagctgtctgtaactccaagatctggcaccttcacacagacatacacgcaagcagtacagcaatgtacataaaataaaaacaactgaaaaaattacaatgagttacctatcatcttaccccagtggaaatggctattaaaaatactgtcatgtatatatgtgtgtgtgtgtgtattatgtatattatatatatatatatatatatatatatatatatatatatatatacacgtgtgtgtaaattaataaaattatagagcagtatggagcatcctccaaaaatagacctatgatataatccagttttcctacttctgggtatatgtccaaaagaaatgaagtcagcatgcaagcatgcaagtatgcaaacaagatatctgtatgccaatgttcatagttatactatctacagtggctgatagaaccagcctaggtacacacagacaggttgattgattaagaaaatacattatatgtgtacagtatattgtttagttatatagaagaatcagatcctgttatttgtagcaaacttgttggaatcgaaggatattttgtttaatgaaatatgtcagctagagaaagtcaaatattgtatgtcctttcttgtatgtcctttctttaaaaacaaaaatgtcaagctaaaaacataatagtattagtggagttagggaaggataagctacaggtttggggtagttagaagcagggagagaagaggctaaatttgattagtttttggtattaacatgtattataataccacactcagcctcaatgataagaacttaatgtatgttaatcaattataaaatactaaaaatatcttattcatatgtaatttacatatcataaaattctttgcctgtatattttcagtggttttcactgccacaactcttatatgtagaacattcttatcaaccctgaaagaaatttttagctttctgaagacctatgatccttgacccacaaacctgtgaccaacctatcatctttgattctaatttgtctctatggatttacacattttgaacattaatggagtcatacaataggagacccttaaaactgttttctttcacttaaaatgtttcaaaaatgcatctatacatggtatctctggtcagtttttaaaataaattattttatgtatttacatatcagtcatttccccctctcttggtccctctcccgtagttcctcctcccattcctcctcccccttgcctctgagagggtgctcctacctcctccagacctccccctttcctcaggcctcaagtctctcaaagattaagtgtatcttctcccactgaggccagaccaggcagacctctgcttatatttgtgccaggggtcttggaccagttcatgtatgctcctggttgatggctcagtgtctgggagctccctgagggctgagttagttgagactgctggtcttcctatgaggtcactctccccttcagcttcttctatacttcctctattcaacaataggggttccttgacaacagtccaatggttggatgtaagttcctgcttctgtctcagtcagctgctggtagggactcttggaggacagccatgctgggctcctgtctgtaagtacatcatagcatctgtaatagtgtcaggccttggatctccccacccccaacccacacgcacaccatgagatggatcccaagttgggtcactggacctcctttccttcagtttcttctccatttttgtccctgcagttttttatagacaggaacaattctgggtcagaaatattgactgtgggttagtaacctagtcccaccatttgaggccttgtctatttcctggatgtagactttggctattatatagatatattatattgtatactaatatatggatgtatatccattcactaactgaggattggtattggaccaccttattagctgccatatgtaatgctgctgttaatattagctagcaatcagtctccattcatgttttttgtactttatacattcatctattcagcaatgtttctttgtaactctcaaactaatacttgtggcatttttgtggtcacccacagacctacaaagcagtgaaaatttgaattgcttaacacttgggttcctagttaaggttaaacagtgtagctcttctcttattttagctctcattctgtaaatgagtgctctttttaaggtctatttaattccacacttcacttttttgtgctttttgctattgatttagctgcttcaaagtagccaccaagtgtactgccaaagtgttgcctagcattccttcaatgtaagaatgctattacaaatgctttacaacggaagtgctcaatttggatatgaatcacagagctcttggcagtgagttcagttaacaaattaatatatgttaacaaatgtatctttacacaaacatatagaggatatatactgatcagttgaccagaaatacatgaccagaaatgtacaggaacctgatgctctatttcttctgtagagcaatggttcagtgtttatcccatgtatgagctaactagaaaataataactatgaaaaattagttgcatattatttttcatagatacatatgtttgagttttcttgagtgtatgtttaagagtaccattgcagagtgggcatatagcttagttgttttgcctagtgtctgtgaggctgtaggttccattcccagtagagacaaaatagaaaaaaaaacggggggggggcagcattgttaggctataacatagcatcttgtctttgtgagcaaggtttctcaccctttatacatataaagatgagaatacaattcaaatttgagttgaacatcgttatattcagccaggcatgagaaaatggcttcattgttgggcaggtattagaattgccctggcttagacacccatagcacataagaatcattatcttttatatgtcaatatgcatagctttcaggatcctctaaagagatatctctaatttaaaggaacatttacagttttcctaatgtggactccatactttgttcattgtatcagatttttatcacctgcctcagttctattttgtccaattcccttgtggtcaatttatgacattgcatctagagtgcttaagtcttatgtaggaagatgttaagcctagaaatgagttaagacagtgtttttaagttgacaaatttacatgaactcaacccttctagtagcatgaaaattgagtatgtaattgaaatattttaatgacaagtataaaaacgagcagtgtctataaagagaataatttgtgcttctgttgtagtaaagattgtatctggacccaagtgaataagcacattttaatgacacatgcccacttcagactgttctcccctactttatatcacagtgttgagataatcttggctttacataccccatacttcaaaaccatctagaatactgcccagcacaaaatagacacttgctgaatatttcataatgtattgaggattccagggatactacagcaaagcaatggtgtgggattttgactggttggtgaaggttgttacacctgtaaaagttcacatggttttattacatttttatggccaatattccaaagttgaactataaaaacaaacaattctaatgttatttatccctcttaacctgaccaactctctgggttatctagactactttcttatgcaagcttattctgcagctgtatatgaggttatataatcagttatggcagtagttggtgacttttctcatactataagaagtcaagtctagttatcttcaaagtaaaccttgcaaaggtcccaaacgcagatcaggaatgggcaaaatcttgaaaaatatttcaggattcaaaaagaaagtcactccatggccagtaaatgatacatagctcagtcatcagagaaatccagattaaaccacaaactgatagcactgtgttactaacagtgacaataacaattctacgtgtcactggagatgtaaaactaccaagagctcttttagtacaagaataaatttgtaaactggaaatctctaccaaagcatgcatacctaatatccttatgagtagcattttcattccttaggtgtacactaaatagaaataatttaacatgtatgcaccaaaaaataaaaatgtgcaagtgtggttttaatagaattctttatgatagtctaaattagaaacatcccaagttccaaaaagaacacagaaaattatagtgtccttatatagtgaaatagtaaaaagaaaatagatgtatatttgttacatacaaaatatagatgactctcacagcatagtacgtaaaagaaaccaggcatatgggctggggagatggctcagcagaaaaaagagccaagctgcacaagcctgatgacctgagctcaatcgcctgaacccatataagaaagcaaatgtagcactctttttttttggtattttcctcgtttacattttcaatgctaccccaaaagtcccccatacccaccccccaattctctacccacccactccccctttttggccttggggttcccctgtactggggcatataaagattgcaagtccaatgggcctctctttgcagtgatggccgactagggtaatcccagtgctcctactgtatgtaggacaggaggctgaggcagaacacttgcctggaagctcacataccagctggctcagggtattcagcccagcagcagaaacaggagagatcctgcatcaataagctggaaggcaagaaacagttcctccaagttctcctccaactctcacatgtgtgcaagttgatactagtaatggctcaggtgtgtacacacatgcctcaacactcgcacataatacacatacaataaagcactattctctatctggccacatttatttaaaatacaaaagtactgtgagtaatgttatgtttgaactcaaactgagaggagatactggctggtagtagacagcagggctactaaggtactggttgtacacttttttgtttttttattagagagttcactgaccattcagcaggccgcactcttgtaagttatttacagtgaaggggtgagcacagttccaagggcaagagactggaacagttttaatatgttattttgtccattgatgtggtaaagatggactctttagatatttacattttaaataaagaaattttatttgttcttaaaaggctttcttctagttttgtgcttattagataaccattctgagggatactagtaatggctcaggtgtgtacagataggtacacagcatagagaaatgtgtgataatccagatagaagattgtcatctcagtagtaaatataaagaaaaaattactcaggacactaggaaatctgatttgttatcttcattggatacttagaaaatgatgacaagtcacttgatttaattattataaaaatttttatctaaaatgataacatagtatcatttctgaaatgtttagaaaataattttcctagtctatttaaactggccttgtattttctgtgctattagcctttatcttgacttgcttaaatttattccccaacaatgtgtggtaaattgtttctgttccatgttatacttcagaaatgactgccagcatatttaacattactatttgagaaatgattgccaaattactcattattgaatataaagctagtaagcagtgttggcttttgaagaagctctgccagtttgtctctatagtaatgtgttcatatttttaacactttggatatgtaaataaaggtgttacaaagtatctgcaatcttcaccataattgtctgcttactcaatcctggtgtttaagctttagaaactgtttattgtttctaaaaatagttttaaagatttcatccatgagtacttgtgtttacatcatttctaccctaccttctccacctccaaccccgatgtcttcccacttctttttaagttcatgaccttcgtgtgtgggacatacacatacatgagagagagagagagagagagagagagagagagagagagagagagagagagagagacctgcacagtccatttcattttaatgtgatcatcttgcccactgattcactgatatttgaaaattcttttcttattcatggagattaagtaaatgacatttctgtcctgttgagttcttattaaattcaaggaaaagtttaaggttgttaagttctaaggggattatagctaaaaggctttagttttccttcttggtccaggaaaaacctgagaagagctgaagtcagacattccaaatttgtctgtacagcatgacctcagcttttatgaggatgatgatactgtcttcacagagctggcactaagattaagaataaacccaagccaatgcttggcacaaatgagacatttccaacaggagtctgtctgaaaaaaagagcccaaagagcatccggtggttttggaagcaggaagctttctattgggtccactttctccttacatagaccatggtggagaacctggaaggttgaacttggtgccttcagcatcctgctctgggacacactgagaaggaagatccctcctccgaggatcagagtactcagagtactacatccacatagcgctgtctcaatcttcagaacctttatggttttccttttatcttattgagttggggatggtggggctagaggcagacatgctttccctaaggacccattcaatggatccttaaatgagcctcctatgccctcaatatgtgtttccaagtagggtgaggggcacctaggttgatgggaaatgaaaataatcattacaagaacttagcaggatttctgataatcattcaagttataatcatttaacaaattaatatgtatgcacacatgattaaagtattgatggcagaaaaaaagaataaggatgtttgaagttcttcatcttactgcatatcatatagtatagataatgtataatttcctgccctttgtttcaactgtgtatcatcaattaattttggagttaccttaatcttagcaacatcaatctcatctctataatttctgtttgcttattttaagtactgttttctttcttcccaagtaaacaatgagtttttatgaacaatgagaagataaaaaaattgttctaatactgttaacaaaatgtctaaaaatattttaaataaaaaaattcaaagatgctcatggatattaatgtttccttccaaatgctctgtcagcagaaccggtaataacattaattttctgttttccaagtgtgacatattaaagacagctgacttaggagaaggggcttgaatccactacaagtatatgagtacttgtgactcttcccacatttatagttgaattctaatccccaaggattaggaggtgggcctccacaaataggattagtgttctttttaaggaggctccaaactcagtgtcttcacttgtcaaatgaagatgatacaagaatgtggttatgcagaataactgggatgtaacatatatttatataaggtaatgacattaataagaagacaaactacacactaaataccaagctctttgctaagagaatgctttatcgttatctccttagttctcccagcaactgggcttcttgtgtccagttgacaaagaggaaagtggagctttcaaatggaaataacttacctagctataagtccagaatgggaacacagtttaatgtgagatgccactcaaaaactcgctagtcttaattaaatcatcatgctatagaatacaaaattaggatatagatggcaaaaataaaaaacaaatattcaaataattataatatgtaattttctgtaaggcaatacaaatttaaaatttattgaatcatctaatgtttttcaattacataaaatcggtacttatgagcatgagatgagtaaaagatttctaccaaatgaaaactaagtgggtttatattaaaatatttctgacatggggccagtgagatagctccacaggtaaaggcacttgtcaccaagcataatgattaaaataataataattaccgttatttaataacattagtactattatttagaaaaatgatataatctattttaatgtaaagacatattttgagtgaaaatgcaactattagacaatccatacacataaatgtgacatttcaaaactaaaagtccaagtggtgtggtaaataataagaaaaatgatccacaagcagtttcttttccagtcttcatttgtctaaaaagtcggaaatttttggtattgaagaaaatatacagatcccatctttgcatgggaaagataaaaatctctggctgtctttatcctgccataccaagtacatctaaaaaaatttttatatatattattatgtgcattggtgttttgttttgttttgcctttgtgaatgtgtgtgagggtgtcagatcctctgaaactgtagctatatatagttgtgagctgccatttgggtactgggaattgaacctaggtcctccggtagagccgctagtgctcttaactgctgagccatctctccagcccataccaaatacatttttaaactcaagactgttagtttaatgtttgagtgaggtcttggttcttactccatcccaaagcagtaagtagcagatgttctcaattgaagaagataaatatgacaacagtgaagaatttgtctccgaatcagagactaaaataaggatatattgtgctctgcaattagacactaaaatccagtctagcactgttcattaaaatggaatttttaatagttttgtaatcaaaagataatttattttaggcagattgttttcatatgccttttagcatggtttttaagaatattataaggaaacagatgatgattgccttttgaactgtaaaacacttctcagttttggtaaatggtttaggttcaccaaaaaacctgtaaggacacatcttcagtggtagactagcattgaagacaacatgacattcttctgtaagaaactagttagatctgagtacaaagctagtttggtgtgatcaaaatagacacaatagatttcaacatacatctgttatatgttagatcacaacatacatctgctgtatgtggttagctgagaaaaatcaggaaagaaagtgtacttgcagttgttgctttcataatatatttttaaatgtttgatcttgaaacaaggaaaaattctaaggccattctctttctgtttgtaaccactttaatatctatagtttcaggaattcaaagaatttgctgaatactttttatcattttaattagttacccccaaggtgcatagtcccttctagagatagaggctaaacagcaagtatttgaacaggcaaagtttaatattatgaattattgccctctgtagtatgggctagtaagaattctagaactctgacaaataaatataggacttgcaagcataaggactagccactattctcagggctgaagtggaagcctcaggcagacgtttggccaatctcccagtaccactgaaattcaagccttgttggagacagcatgtggtagctaactggaccacaggtttgctgagatatcctgctggtagaaaacaatgggaatctgccttccagagtttaacagccaccatccttagggattaggtcacctctgaatgtgcagaaaacggactaaagatgtgcctgaggaagctggtcgcagacagagtactctactggctgtactctgctgcaaagccacctcaagagggttctcagaagttgcttatggacaggtgccacatgctgagcactgaaaataaattatacacataggggatccttaagagaaaagcactggaaccagagagcaaaatgcctctgctttagtgttcctccaatgccctctgttggcaaaccttaatgttgggtcagctgtaaaagcattgagttcagcttcagtagtgcagagcagtaaataacctgcagaagtgcagagcctggattcatgagtagtgtaggggcaggaagcttttctggatatagtggtggttttgttgtattgtgtttttttgatacaaaatctcattctgaagctcaggttggccttaaactcacttccaccttgccctccagagtgtgggggttacaggtatatgcaaccatgcttagctgaatatagtgagggtttttattattagcttctaagatagcatacaaattactgggtttcattatgatgctttcttgtataatttgttattcactccctctttgctgccctaccctatccccttgcctccctctcgatagtctcctctcccaggagacttttcttcttaacatttggtcccattaccttacttttttctggttttgcctccccccttaagattttttcccctgtgagccctttctagtttcatgacctgcacccacacagatgggatagcttaatgccatattgtatcttagctaccccatctgtaatacttggcagtgttttcattttattttgctttcttttccttatttcccttaaatgattaataactaaatagcatagcatatccacattagaattgttagtattgatgattatcaatctgggaaaattcagtttttgaagtaaaattttaccaaaaacattatgcatataaataaaataaacccatgatttgattcagaatattgtgttagtccatattgtgcatttagacttgttatagtagggtttcataaatattgcctagagagtttctgtaaaataatataaatgaccaggtgagtttggatgaaaattctattggcctatatattaaagtaaaagccataatttctttctgaaaaaaaaaaaggactttaaagaagagtatgaagaattaggtatgatccaatggattcctttaatagtgtgtcacataaatgccaaccaacatattgcagagtagtaaactaataatgtgtcctggagagcagtttattctttctgtaataacaggaggcttattcctttgctgtctttctccattccctcttatcaacacctaagttggaacgttaagtttacccattgctggaccattgcagaactctttctataggctgttctccagtcacaacccacctctaatttttttctaccaattacctacaattttttctttcttaattactactttcttcatttccccaagtcttcagaacatgtcattaatagtggatttctctgtattactctattgctttgagattgaattaaaacactgatattaaattatctgatgtttgcatttccaggacattcatgttttatgtcatttccccacaggaatgctttgctagattgacttaatagatctttatttttttcttcttatgttagataaattcaacctaccataaaggaagccataaggcagcaaaggtagattcatctagaatcaaaattttacacaattattgttacagtgtgtgaagggtaagtgatgttcactaacccctaaaagatgttcatatccaaatcctacaattcaagattatgccatattaccttatatggcaaaatgaagttgtaaatgtggttaaagatcttgagatgggagattatcctggattatttgtgtgggctcaaactaatgacaatggtttgataaaaaggcaggttgagtaagatttaacttacaggagaagatagtgtgacaaattagagattgggatgctccagctggtatctcaagaatgttggcagcctgtacaagtctaaagagacaagaaacaagattctctcctccttagaccctcccaaggaaccaaccttgccaacaccttgatcttagtttactaggactcattggagatgcttacctctaaaactattacataattatgttatgttgtttaaagccatagagtttgaagtgacttactgccaatgcaacaggaaactattgcattttaataggcacttgctcaactgtagcatagaagggaaagtgagaacttctcttaaaagagtcagtgaattaataaatggacttgttgggggtaggtcactgaaggtgggagaaaggatgtatagaggtgcagagtggtgaattagttgacttagtgtgcaagtagttggtgctattggagagatggtagctagcttatgaatgctgtgtctgtgatgctaagaagtttgagtttattttttatcactgaggaaacattggtagacttaaagcagggaagtcgcacaattgggtctatatttaagaccaattagacagtgttacaaagagagttatttaaagagagagccagcaagcaaggaaggtgcagtggccctcatgagaaataggagactttggatggaggaaaggagttgcacacgacgtctcaagcagtgcgatgtggtacctttcaagagacaatcctgagaaatgctcatttgtttgcttcataggattagttgcatagtgataacatctttttacagtacacatgatcaaaggatgagctgggaaaaataaatgagttttgttaaacattttactcctggtgaacttctaaaataaaaatgtgtttattttgatctaaaagttaggaccaagttctgcgcaaaagatgaaataaagaaacaatggagtggggataccagggtcctgaggaaaacctccatttataaagggcggagcagagacagacttacccaaagacacttggagagttatcttctgagaatgccgtcattaatgctgagagagaaaaatcatttctctgctgtcagaaatggcttagagaccagttgatagaataactgtgatgtcagtggactttggcagtgtggaaatcagtgggaacctcagcaagatcatgttcagtcctggggtaaagctagcatattgcggtagtctgaggaaggaatacgcagacaggaaatgaatacagtgtcgcgtccgctctcgaccagcaagaacgacacgaccaccagtccttctaacagaagtttattcagcaaacttcagtcttcgtctctctctcttcatctttttcctcatctctcccgaacccgggcctctcactcttatatactctcagtccccatccactcacagcaggccacgtcacctcaccaggcacgcagcttcagccaatcagggcggcagggacgtgtctccaccaaatatggacttgtttaaaccgccagcatcatggtgcaccttgtgcagctctcatgatggtcaatggtcgtggcttattttcaggtgtatgaggaagtcaggtgcaagtcataagacttagctgcagtccctggcaccttcttgggactgctgccacacccgctcctcacaatacaggatactttttttttggttttgtttttgttttttggatttttcgagacagggtttctctgtgtatccctggctgtcctggaactcacgctgtagaccaggttggcctcaaactcagaaatccccttgcctctgcctcccaagtgctgggattaaaggcatgtgccaccatgcccagtcaggatactttttgagagaaaaaaaaattgctctggaaatattccagagattttctagagtgggaagacaagagacatgtgtaacaagagtgttccatcctggcttaagatatgggtagcaatgccatatgacatcctataacagaatatgggggctgtaaaaatttggcaacaggaaacagtttctgaacatgcaataaacaaaacttgattcaaaagcaagtgcatgctgaatttgaaattcctagcagcatgcacctgtgttacatcatgtggcgtcactgctgccttgcttctgagcccacagtgcacgcacactttccacctcatattctgtcacatgatctaacaccaacaaacactgccagaaacacctgagctctcattcctgactattgtatgctacagcctagtgttttgttgtacacaaaaagggtttggcttttatagaaatagaataatggtttaattattttaaaaaggccatattaccctaccattgttccttagcatataaatatcaaatatcattaaattgtgtttatatgtttgactcttttttttacattattgtttgagtttctgactttggttttattttctagaaatcattaaatgaatttggatttcaattagaacagaatttccagcaatttctgaaatagtcctacatatacttctgccattttgtagtacatatttatgcaaagaggcattctctgcatcgacaattataaagtcaaaatattgattaactctgaaaagcaaagattctctatgtcctgcagtatcaaatatccagccagaatttaattctttgcaaataaacaagcacatctctctcattaccatgcaaatttgctttaatctttaatcaatagtaaaattatatgagtgcagaagagttattttatagcttctttatgatttgtttatcagtaaatacttgatttttatatacctctacacccaagtttgaatacaaatttcctgggcaaaaggggattgcaaatagaaaatatttagaagctcgatctaagaagaggaacagtgtgtgggggaggggtagagattaaggccgggtgtggttcagcatcagtactgcttggaggtggaagctactaggaaagagtaagaaagcatgactggtgggagtgggttttgatagcaaacagggggtgtcccttgacatatatcagaagctgtcctggttagctttaactgttaattggacacagcctagcacagtggctctcaaccttcctaatgcagaaactttaacacagttccttatgttctggtaccctagccataaaattattttgttgctactttaacactgtaaattttctacttttatgaatcataatgtacatgtctgatatgtaggatatctgatatgtgaaccctgtgcctaaaggagtcacaactcacatttcactctgacttagagtaacctgagaaggacatttcagtttagagattgcacgatcagattgttccatcagcatgtctttggagtattatctggatttctagttgatgtaaagggccccacccatcagtgagcagtgctgtttccttagtaggtagtccttggctgtataagaaagctagctaagtatccacctgaacaagccagcaagcagcctttcctccattcaagtttctgctgagttcctgccctcacttcccatcaatagtggagtgtaaccagtaaactgaaataaaccctttcctcctccagttggtattggtcatcttgtatatcacagtaacaaaaagaaagtagaacagaagctgaaggaggaggacccacagtgatgttgttggtaaagtgggaagcatggtggtgataggagagataggaacggtcttaacaacacttaggaaaatgcaatggaggtaagaggggagattgctaggcctcctcaaggggacagttaatacagacttcttgtcctttggtcattaagaaaccatcagatggtttcccatagtggttgtactgttttactttactaccaatgataataccaataacatgtgagaattacagctactctatatcactgccagggcttgagattgtctttttttttttcttcaatcttagccattctagtggtgtgtcatggaagtccatgtggctttttaatttgtatttacctgatgactacatatgtttctgcttaaggactattgtgttctgttgttgtagtactagtaatagtagtgcacactacagtactactagtgtgtgtgtaaaggggggagttatatctccattgtattaagttacagtaacatattctccatacttacttgttgtttgtcaggtatacatattacaacttttgtctcacaccttgtgacattcaatcttatatatttctaatttgggaaaaattcaatttgatttttttcttttatggttctgtatcttaaaaaacattactaccatcaggtttatataaattttttattgtattttctactgtaattctagttttaaccattactctagattctgaaatcctttgatagtttcttttttcagtgtgagattagagttgaggttcatgaatagctacttactctggtggtgtttattgtaaaagttacctttgtctatcacagcattttggcacttttatcaaaactaatatgttgttctctttctatactttctcttctgtcctatcctaatgccaggcctatgcagtctgggttactctataactaacacttaagttgcactaacttacattctattattacttccaaacattcttggtctattctaagttctttacatttttgtaaaaagtttctgagataatgtcatttgttttgttttgtttttgaagcatgaggttttgattcagatttattttaaatctgcaaacaaatttgggaagaatggtgtactggctagttttgtgtcaacttgacacagctgcagttatcacagagaaaggagcttcagttgaggaaatgcctccatgagatacaactgtaaggcattttctcaattagtgatcaagggggaaaggccccttgtgggtggtgccatctctgggctggtagtcttgggttctataagagagcaggctgagcaagccagagcaagcaagccagtaaggaacatccatccctccatggcctctgcatcagctcctgcttcctgacctgcttgagttccagtcctgacttccttggtgatgaacagcagtatggaagtgtaagctgaataaaccctttcctccccaacttgcttcttggtcatgatgtttgtgcaggaatagaaaccctgactaagacaaatgagataaattaaagttactgttaaggcctccaatacatgagcattttttatttatgtaggccaactttgtgtgagtaaatattttgaagagtagagagcacatgcatatttgatttaatttatttttaggactttctgtgatttctccagtttagacatatttttgtctttctaaagtaaattttcttgcatttcacttttacccatatctttccaacatttgttggttttcattattgtttccttaatgacagccattttgtctggaatgagaagtaatctcagtgtagcttttacattttcccaattactaaagatgctgaaatcattttcatttatttgttggctacttgtgtttcttccttaaaaatattttttgttgttgttgttcagttattgatacatttgtttgttattttgatgtttaattttttgagttcatttatattctggatactaattccttgttaaataaacagctggcaatagctgcctctaattctgtaaattgtctttttactcttttgattgtatacattcatgcaattccatttctcagttcttcctattatttgatgaaccaccagagatctatttggaaagtcattggctatgcctgaatcattttatctcaaagtgttaataattctcttcttagttatagttctagctttttgcttttatttctttgtaatgttttaaggaaaatgtattatttcataactaaatagatatgatatactaaaaattatttttatttttgagattaatataattacatctttctccttcccctttcctcccctgaatgcacatatatatatatgtctttgagttctttccaatgcatagccctttaaaactaattggtgttacatgcatttgtgtgtgttcctaaatatagcctgcttactctatacaaagttacttgtatgtatgttttcagggctgattatttggtgttggctgatgaattgctgtgctcctctctaatgaagagtagttctccctgtcttactcagggtttctattcctgcacaaacatcatgaccaagaagcagttggggaggaaagggtttattcggcttacactaacatgctgctgttcatcaccaaggaagtcaggactggaactcaagcaggtcaagaagcaggagctgatgcagaggccatggagggatggatgttccttactggcttgcttgctctggcttgctcagcctgctctcttatagaacccaagactaccagcccagagatggtctcacacacaaggggcctttcccccttgatcactaattgagaaaatgccttacagttgtatctcatggaggcatttcctcaactgaagctcctttttctgtcataacttcagctgtgtcaagttgacacaaaactagctggtacaattgaacccttgtcaacttgacacacaagtgcatcactagtaagcctcaacccttagttcttattcatccccaagatcttaaataactttaaaagtcccacagtctttacatattaaaagttcagtcctttaaaaatatccaatatcttttaaaatcaaaagtctttttacaattaaaagtctcttaactgtgggatccactaaaatattttcttccttcaagagggaaaatatcagggcacagtcacaatcaaaagcaataattaaactccaactgtccaatgtatgggatccaaatcatgatcttctgggctcctccaagggcttgggtcacttctccagccatgccctttgtagcacacatcttgtcttctaggctccagctgcctgtactccactgctgctgctgttcttggtggtcatctcatggtactggcatctccaaaacaatgcatgaccccttcagtcctgggccatcaacttcaactgaggctgcaccttcaccaatggccttccatggcctctcacagtgccaagcctcagctgctctgcgtgaccccttcatgccttcaaaaccagtaccacctgggtgactcttacacattaccaagtcctactgcatcacaaggtacaaccttggctatctctggcacacagcctctgtgctctcagaaaacacttcccagaagatgtcaccttgatgatgctggtctcttcttaataaccgctaatttcttagctccagctaaccaccatcaatagtcccaggaatgcaaagtttttgctttagtatcttgttaatcacagctgattcttcagccccagctaaccagaactacagaatcttcacaatccaaaatagtaatggccctgaaaagagtctttaattttccctctgaaattttacaagccaggcctccatcttctgcactgttctcaacattatcttccaagctcctatacaacatctcacagagctctgaacaccgaatgaaacttctggcccaaagttccaaagtccttccacagtcctccccaaaacatggtcaagttgtaacaggaataccccattcctggtaccaatgtgtcttagtcagggtttctattcctgctcgaacatcatgaccaagaaacaagttggggaggaaagggtttattcggcttacacttccatactgctgttcatcaccaaggaagtcaggactggaactcaagcaggtcaggaagcaggagctgatgcagaggccatggaggggtggatgttccttactggcttgcttgctctggcttgctctggcttgctcagcctgctctcttattacccaagattaccagcccagagattgtcccacacacaaggggcctttcccccttgatcactaattgagaaaatgccttaaagttgggtctcatggaggcatttcctcaactgaagctcctttctctgtgataatgccagcctgtgtcaagttgacacaaaactagccagtacactcccactcccagcacttcttacttgcctgtagttttttgtgcatagggttgagtgacgccttgtgctctttcccccatctactttggcatgtctatcggtgtcatccttgttcaactcatatttagtcatccatgtcagtgaggctttatgggtatagcttctgatgttactagaagatacaacctcacagcaagcatcttgttcctatgtctcttacaatctgtgtctcttccgccatgctccctaagccttaggtgcaggaacattgtgtagctgtacccttaactctgcattttaattgactgtggttttctacaatggtctctgttacaaaaagaagtttccttggtgagggagtgtacttatttgtgggcataaggacaaatatttagagtgtagtagggattgtgctggtttagtaaagtagtaagcataggttctcctctaagagtcttgattttactagctctgggtagttggctaggtttccatttcctcctatgatttctcttttgttgaatggccttaagttcaattagaaagctgttgcttattgtcaagctatgtgggccactatggaaccattaggtctattgtgccatgctgatcactgttgtggtttatcctagactagtttcaaatttggtgtcttagagtaagagactcctttattttattcttttttttttttttttatgtttttgagacaggttctaactgtataagtctggctgacctggaactcattttgcagaccaaactagcctgaacttgcaaggatccacctgcttctcccttctaagtactaggattaaaggcatatgccactctgcctacccttacattaagatctttgatctattttgagttgattttagattgaacaagttttagattccgttttctagtgtgaatatactgttttctcaacatgacttgttaaagaatcttttcctccaaaatatagttttgctacctttgccaaaaatcagagctgaaacttcttgggcttgcttcctgattttttactctattctattggtgtacatgtcgtgcacgtgcgtgcgtgtgtgtgtgtgtgtgtgtgtgtgtgtgtgtgtgtgtgtgtgtgtttgtgtgattttaatattgccatactggtggtgggttgtttttttttttttttgcctgtttctgagaaaggttgtttaagatactgtaatacctccagcattgctccttttgcttaatactgctttggttatttagggtttttatgtttccacataattttttgggacaggttctctctgtgtatccctggctgtcctggtactccctgagtagaccaggctggcctcagactcacagagattatactgtgccttcccccctagtgctgagattaaagacgttaccaccacacctggcatccatgtggatttgaagatgccagttttactttttagtctctgtatgccttttatgaggatttcattgaatattggcagtattaatccagtccataaatatatcttcgatttcttcggtgttttggagtttttattgtagatttttaaatacctttggttaaaataataaataggcagttttaaagctattgtggtgtttccctgagttctttttcagaacaacatctcttattgttgtatagagaagctactgacttttgtatcttgctactttttaaaaattcttcttcgcatatcctgactgcagtttcccctctctctatccctcctattcccttccccagctcccttccccctgatccaccatttcttcatttcctttcagaaaagaacagacctccaagggatatcaactgaacatggcatataaagttacaataaggctaggcatatacccgcatatcaatcaagactagatggggcaaccaagtaggaaaagggtcccaagagcaggcaaaagatttagagacaccctccagttccactgttaggtgtcccattagattactaagcaatacagcaacaatgttagaggacctagctcagacctatacaaggtccatgattgccatttcagtctctttgagccccctatggaaccctgcttagttgattctgtgggccctgttctcttggtatcctcaacccctctagctcctgcagtctttcctctcccttttctacagggttctcctggttccacctagtgtttgactgtgggtctctgcatctgctcccatcagtagctggatggtgcccctctatgacaaatgagttaggcaccaatctattggtatagcagaatatcattaggaatcatttcattgtttttttttttttttttggagtgtgtttagctctatctatcctgggtctctggactgtccagcctctggtttctggaaaccaaggcagtgctatttgtgtgttccctcttttggtgtgggcttcaacttggaccagtccttgcttggccactctcttaaattctgcctcaccattgccccagcatgtctggtaggacaggtcaaaggttttgtggctaggttaatggtccagttccactgttgggtggctagcctggttatagaagatggatggtttgggcttatctttcattactagggtcattctcagagattccagggagtttccactgcagtaagtttctcatctcacccaaatgccccccaattcctcttttctctcccagtactctctccatccctcccacccctaaccctggctcctaaacccttctgtttccaaccccaacccctccccccagcctacattcaaattcttttcaattttcccttcccagagagaaccatttattgtcatccttctcaacccctttgagctctccttattccttagcctctctgagtttgtggattattctttacttaccagctaatgtctgcttataagtactagggtactatgtttgtctttctgtgtcttgattacctcactcaggataatgactttttttctactttcattcatttgcctgcaaatttcatgctgtcgttttagcataaatatatcaacaattcctgtattcttcagttgagggacatctaggttgtttccagtttctggctactatgaaaaaagctgctatgaatatagttgaataagtgtccttgtggtaggatggcaaattctccaggagtggtatagctggatcttcaggtagatatttcccattttctgagcaatagctgtactgatttccagagtggttgtacatgttttcactcttaccagcaatgaaggagtgttccccttgctccacatcctagccaccatgagctattacttgttttgttgatcttagccattctcacaaacgcaagatggaatctcaaagtagttttgatttgcatttccctgttggctaaggatgttgaacatttctttaagtatttctcagccatttcagtttcattctcctcaaaagaactctgtttagatctgaattgattattttaaattggattatttggtttgtcgatatctagtttcttgagttctttatatattttatatatcagccctctctcagatgtggggtttatgaagatcttttcccaatctgtagactgttgttttgtcctaatgactctcctttgctttagaaaagtttttcagtttcatgagctctcctttattaattgttgatcttagtggctgagctattggtgtactgttcagtgagttgtctcctgtgccaatgcattcaagactactccccactttctcttctttatatatatattttattaggtattttcctcttttacatttgcaatgctatcccataagtcccccatatcctccccccaaatcccctacccacccactccccctttttggccctggcgttcccctgtactgaggcatataacgtttgcctgaccaatgggcctctctttccactgatggccgactaggccatcttctgatacatatgcagctagagataagagctccggggtactggttagttcataatgttgttgcacctacagggttgcagatctctttagctctttggatactttctctagctcctccattgggggccctgtgatccatccaatagctgactgtgaggatccacttatgtgtttgctaggcccggcatagtctcacaagagacagctatatctgggtcctttcagcaaaatcttgctagtgtatgcaatggtgtcagcgtttggaagctgattatgggatggatccccggatatggcaatctctagatggtccatcctttcatcacagctccaaactttgtctctgtaactccttccatgggtgttttgttcccaattctaagaaggggcaaagtgtccacactttggtcttcgttcttcttgaggttcatgcgtttagcaaattgtctcttatatctcgggtatactaagtttctgggctaatatccacttatcagtgagtacatatcatttgagttcttttgtgattgtgttacctcactcaggatgatgccctccaggtccaaccatttggctaggaatttcataaattcattccttttaatagctgagtagtactccattgtgtaaatgtaccacattttttgcatccattcctctgttgaggggcatctgggttctttccagcttctggctattataaataaggctgctatgaacatagtggagcatgtgtccttcttaccggttggaccatcttctggatatatgcccagaagaggtattccgggatcctccggtagtactatgtccatttttctgaggaaccatcagactgatttccagagttctcttctatcagattcagtgtgtctggttttatggtgagaagcttaacagtcttctagtgtagttttttgagtcttctcaatatagggttttattatctgcaaacagggataattttacttcttttgttgtttatatctttttatatcagtctcttgccttattgctttcactaagatttcagaaattattttgaataagaatggtaatatggaacatcttttcttttgttaattttagaggaaatggttttagttttctcataaattttatttttaatattaatagatgattgcattttgatgattgttggaattatttatattgtttcaaatctttcacatcatttgtaaactttagttattacatttgattctattattattttttaatcctagtgtccagtttttgtattagaatatatgcatgccattgatttttgatattttagttttgttgtctcctgcagacttgctaagttcagtctttgtggcgttttatgatagattatctctgaatttcgccatggaagactgattatgtgttaactatgtcatctcaaatatacatcttttctactctgtggggtgtttatttctgtactacactagctaaaactttactcccatattacaagactagtcttgagatcaaatgtctcatcctcatcttagaaagcatttggtctcttaccagtatatataatatcaactgcatggggtttttgtgaatggcctttgtcagatcaaataaacttctttctattcctactttgcacaagattttgttttgttttaaagaatggatgttttattttgtcaatttctctttctacattaattaaaatgattatgtattttacttttaagtttattgacagtcacctgtttttatttctgtaatgataaaccactgctgaaaaattcagatagctctatagttttcttgtaatgtctctagctggctttgataacaaggttatgctgatttatataacaaattaagatgcattcatatttttttattttgaaaataggtttgtataaagttgacatatttgatagaattagttaatgatgccatgtgagtctagaattttcattgaggggtggtttaattttaaaaaaataaaagtgcttctgaagtatttttattactccagaactaaaatagcttttcttctttgcacctgttttagtccccgtatttaatgtgaatcgtcttttgcattaagtgaggtttctctgtcatatttggttatagctccaagtgtcaccctgctctcttcacttagcttttggagatttgagctgtgtgtacccagattcctaggaaggtgaggagccactgtgttgtttgacgttctttcctgtgccttctctttcttctagtgctgtgcccagactatctcctctcccccattctcctcagaagtaatctgccttctcagcccagaaacactcttctgctctgcgttatctcctctcctgattaggaaactgggcatcacttccagaattagctcagtatctgaaaatatttgtttcatacatttttttccagttttctagctcaatgggaaaagaaagttcttttccaattaaactttcattctttagaaaaagtcctcatcatgacttttaatgtgcttttaatgtgatttcaataaatcttagttctaatgactttcagaaagggagatagtgttatcaaattctgacaaatataatcaaccttatcttatttccattgatgctgtggttggaaaattatcactacacttccaatgtggttaaaaatagaattttgttagagtgaagagggataaatatgatgttacagtaaagagagttaataatacaaaaaaaattaacacatagcatttacttagcattttagttgtgtgaagtgctttgctaaaaggtagctccttttcctcattactagtctgttatatagtctctatattatgacagttttgcaaggggaagaactgaaacttggcagaggttaagtggcttgttcagactgagaaaaccatcaagtaagtgtcctagattctaactaagtattgacaaagttcaagtcaacattgtcaatctccaaggtccccttcataatcaccatgctgacttttaagtgggcaggcagctctggcagctaagggatccccttcagaacttgaagtgtgggatccactgctttgggtggagtcagggcagcagttccaggtttcctacggaagtctttctttgggtgccttttcagtgctttttctgctttatgagagaaagtcagcaagcttttaagcacaacttacacagagattctgatgccgtcttttcttttctctatgtgtgattggaaatctaagtggacctagtgggagaccttaaaattggctttcatttttattctgtgttaagacattttttggtaatgatgaagtggcatggaagcagagagtactgaaaacatggttactgtgttcatagtttcaaagtatctagtaattttgttaagtctgaaattatatcaaagtaaaaggtgttttagatacaatgtttacttaaacattgtatctatcttcatggtttagccactgactggctgtattattaacttggttcactctaattttattcctggctctttattcctgtaccttctatttaatgtttttaaattagagaaaacagttagatggttctgaaagtaaactaactgtgaaataaggtacattcacataaatatgttttctattcttgtttccttcacatttaatcatttccaatagtgtttattctaaatctttaagattatataaaagttatggttcataattacagcataattgcagtattataagtattgtattgtaaacatacacaaacacattcctctttcttgattgagaagtgtcatgtttcatacagcactttgcatctttcgttttgaagaaaaatagatattctatgattcatttcctagcaggatatgtaggtcctccttattctatttgtagctctggattgccattcttcaaaatcttatttggtgaacatgtactgtctgctatgtgcccatctattggatagattctatcagatgtagtgtatggccttgtatgataaatacatatatcttatctgcattcaagttatggagtttcaaaaatttttaatacattgctttctccaatatacagtagctgattcatcagtatttatttttattagcctcctccttccttaaaacttagaacagcttatgtcatttttgtttctgttgtacataatattgttcagatattatttgtaaacctactaatgagtatatcgcaatgtttaaaatatttagatagctggttgtaaaatgtaagcaaatagtatgataacaaagaccagtaaattggcctgacaaacaaactacctgtcatgcgagactaagtacttaagtttgaaatgcagaatccacataaaggaaaagagatattcaactgcacaaaggtgtcctctaacacaagacacacaaacacacacacacaatttataaaagatgttcgccaatggattgattatacttttttgagatgcttttctatccctataaattcagaatgtctgccttcctttatgtatgctgtcctttcgaaagctcaacatccatttattggctgtattactcctagcattttctttttgcttcttaggtctttgagttttgagacatagactcactgtgtattttgggctggcctttgtatcttatggccttgaatccagcttcagccctccaggtgctggtgctgctactacaggattaaaggcttagactaccacacctggcactcttgcttttgttttgttttctgatatcacttctctccacattttgcagtatttattattttttattaagccccaccttataaaaatctgagcttttcctcaaagtcctatgtagtaggtccgtggggatgtagtccagaattacaaatacctataaccatttgtcaaataactgggcagatatggtggacattgtttttctatttctgtgttaggtctgacacagtctcttcacactacttcaggatcctaactctggtttttcatttttaactttgccacctcttctttatcttggtcatatcttggtttccttttctttgttctccaaacttggctgtaaaggctgtctgtggctttgtttgcctcctcctggccctcctggccaggacctgttatgataatcactcttgagctgtgcatatgattccctcttttccttccacctatacctttcttgacatgctctcttggtttcctgctctcttttctctcaagagtaactttggtcacaaaatatagtgtcccaccttcctaaggaaggacatttaataaggtctctatatgccgcctcagacgtcataaattacagcatggttaaatagctagaaacaaaagatgaacacagtttgagattgtgttcattgcatcgacaatccagcacttaacacactactcaaagcatatcctacagggaaagcttctaagaaaataaatactatatgagatgtagcttcacaaagctctttaaaaaaaaattcaggaaattgattccatgtgcatgaagtcagcgttttctctcagcaggcactgcaactaatgacattaatgagacccatgccatattaaaaagagagaaagagaataaaacagacaaaactgataatttaagaggaaattatttccagtggtctgtttgaacattgtaattaaccaagaaataaaatgagaaaaaggacctttttaattgtggtttttagcactccattaagaatggctcaaactctacgtgaattgggacaatataaaatgagtacttatgtttaagtgggagagccatccgtactcaatatagaggtgtggatttatttcagaatatcttagacttaagtgagtattggcattgtttttggtaatgcttttaaaatctctagtattttgacaagaggttttaaataaatgttatacaggaaaacaaacacaaaacttttctaacatagcttccacaataaataaaaataaataagtaaaaaaaaatttgtttttacacctttttagccccattatagtatatcagtttgctaaccttgaaaacaaagctttataatttgtaacatataaaataatattcccctaagcaggcagttttatccaagattcctggtattacattactaaatgtagtgagtgaaatacttcttaggtaggttcattcacagctgtgctctccttttctatcctttatgcctcctctggtttacttttatgttgctacgtgataaaatattctgaccaaaagcaacttggggaggaaagggtttatttcaattttctctgagaaaagaactatacccacatccctccacatagattataatatcaactcacactacctcagcaatgacacaaaaggaatttctgtcgtagttcattccccctcagcactccgttattggagacaacctctttaagcattatcactgttccttttgtacctaacaccatatactatctcttgactttataattctaaatatcaattatcaccacactgcttcatacgttgcctctcttttccttcttgcttctccttattttcctttgttgatttatttctctttaatttatacttatctttttccccttcatcccatcttcctacaacctgatccttccctgtccccacctgcccgcagtccatgccatatatttttctatgtccccatttctaattattaatacttgggttgttgctataatgtgattttatataattatttattactcctgttgtaaatgcttggcttagttcatgttgggatgtttgtgtcttttttatttatccataggctggcccttgaactgtgtgacttctctcagtacgtacattatttttcatgatagcagagggatccttggttgctgtatcttgcttttcttgattgtcattaaaggaattctcattttcttatgtgctagtgtccctattttctaggtttcctgtatttcttatttttcattttgttttgtttttacttagtagactctctagtaacttcctgagaaaagatattttttggttttttgtttgtttgtttgttttaaactttacatatgtaaacatgtatttatttaattctatgctttgaacagtaatgtagctaggtatatgattcttggtcagatgtaatctctcagggttttgaaaaaatatagaaggtatataaaagtttatgcattgcaattagcttctttatatcaaacctaccagttgtgtgacatgtgtatatcatataacatctctgcctgtttcttcatctaaaaatcaggtatagcattttaccattctgtagaattgctgagaggatttaatgagagatatatctcactaggacaatacctgctcccttgctctcctttgaaagctttagtgatattctgtttgctccagtaacccttcagatttttttcagtgatatgttgtattatgggctcttataaaaatcatgcttggaactctttttatatctagaaacccattgtctttggttccgagcagaaaattcttagataactacatatctctaatttctctgttctgcctttctggtttctgctatttaaataacatggcatatataattagccaccatcgctaaccttttgcctccctgatcctatctcttgttactttgtcctagctttactttttcaacttggccttctaacccttctgtttggatctttgctcaaatttatcatttccagaggtggtattcactgactgttttgtttaagttagtattgtacagtttcctagcatttttacctactgtgttaggtaaaatcgctctgacaacgtatctgaggggaaaactggaaagcaagaatgccaaagggtttagctcatcatggcaggcagggtgtcagtaatttacattattattgtaggaggcagacacaagtgactgcttatactacagagctttcccccattccttctttgctctacttaggagtctaacctataggaggaggatcctttctccatagttaattcctggaaatacctgaggaggaataactagaaatatgctttactaatctaaatgcttttcagaccaaccaagctaactatcaaaatcaataatcacaagtctactctcaacaaccaggcacccaaatatgtctccttaagctataatattttaccctttccccttccttccctcttccccaaacctcatatctaattcatattgcaaaatgcacgtattctatcttccagagtcctctaagtcttaacagacaaaacctgttcagaaatccaatttccaaatctgagacaatgcaaacacttagctgtgagcctctaggaaatcaagaagacattagctattcccaagctcccacaattcttgtattctgcattcttgaaaacacggaatcccatgaactatgccaaagtgtaccacagttctaataggaaccaggatcctttgggctatggctgcagtggcctcagaatgcctgaattactgagtaaaggcaagaggcagattctctgtcagctgtatgtaagcagagagatctaacctttattagattactcattattttaaaaaagaaactttccacttttgaggctccaatggtggcctaattcttgagattctttcaagagatctttcctgttgttccaagtcaaagtgtttggcttcctcttaataaccctgatctcttcagcgctccaagtttccttggcaccaactttacacatttatttcttttctgagcaaactgcaagtttttcagacatttttgttcctctttttgttcactgtttcattatgaacttggctaaaagcagtcagcagtgtccattcttcatctgaatgctggattgcccagagacttcctccaccacattagtctaccgcttttataatcagcttcagaccagatatctaggcaggttttggtcagactgtaattccatggcctctagtaatgtccctacagagtcctcatttccacgtaaaactttatgaagtctttactctctatactcctaacagcattctcagctcagctcccactacaaccactaagttctgtttatagaattctggagtttctagagcccacatctccagacttccatattccttccatggcccagttccaaagacttctaaaccacatagtcagatgggtacaataatagcactacttttctggtaccagtcttctatattaagtacttgttcaatgggcatgacacaataatcttagcaaaacagcagagggaaagaaagatttgttttggctttgtatttcaaaggttccatccattattgtggctaggaaacaatgcatgtggtcactggccaccttatttttcattgttaattccatctagtcctctataggattgtgcatgctatgttcaggaatagtctccttcttgtagttaaccccatatggaaatacccacacaggcacacgttcacaaacacacctagatgtgctttattaatcttctatgcttctcaacccaatgaagttaatcaagattgaccattacatatatcatgttgtatttgacattcccctggtttggcttttataagaaatagcctcctgctcagaattttttttctgtttctttttacattgttttcttttgagaggctttcctcttatatctggtgatctttagcttttctttctgcctgcctgtctctctctctctctctctctctctctctctctctctctctctctctctctctctccctccctccctccctccctccctccctccctccctccctccctccctcccttcctcccttccttccttcctttcgaggggagtattcaacacttgcctagaaaatgtaggtataagagtaacttaactataagtgatcagaaaagaactgagccatatttgacagccccataagttgtctatctgtagggtttgggttttttgtttgtttgttgttttattcttaatacagtcagtttgataaggaagagtcttgtgtgcctgtcttgagttagagatatatctgctgatacgatgagacacacatctaagcctaattacatgagtttcactagacaacattaactaaatgaggctgaagttgttttgtttggcacatgaaatttctaagtgattatcctgtttaaatacagcacttcatttgacctgagctatgtatctggggtccaaggtctccagaaagtaaattacttgaccacagactgggtttgtgcaaggtcatctggtactcttgttttctactctaccagcactactactctgaaaatacctaatgcctcctatttgtgaactttcttcagtagtttgataagcatagtcagcttgtttttcacagtcttcccttgttggaggtatgttagttcaggttctacaaagaagcagttattgggaaatgattaggtatataagacatttattgggaggtgaccaatgagtggaatgggtgggtaaggacccttaggagactgagaaagcccttacaggttatgtatatttgaatcctttagaagagggaaagaaaaaataaatgaagaacagaatgggaaattcttagacagttttaagagtgcttggacctctatagcatacttggattccttaagccaaggttgaccatcttcccatatttcacaaggataaacttgctttagtattatctcatccctttatcagtagctgattatagccttagtaagcatagtcttagaatgcaatgatggactctgttgcatgacttttactgggaaaacatgaacaaaccactatttactctatctggggcactaacaacaggtgaaagaaaccatttatcttactcaaatccagcttatggaagtgatgaatttataggagtgtagatggcatgctacttgcaggagcatgagtatcttaaaggcatcactgaaaagctaaccccagcatagatggaaattaatggaagctgtgtctgtggtgctccctggaggctgatcaaagagtaccctctccccagaagttgttatggcttagataaccttgcaaaggagtgtgtaaatcttcggactttcagaagtttcatagctttttaagttttagtttacttcctagatcgttcctgtttcctttacttcttggtcttgtatgagcctccctcctctccaggacagtgtttctgttgagaggaagtagcatataataaagtccttgtgctatacctatattatcagtcctttacactccagtctaccatcctagattgaggtggcacatcataatgctaaccctaattaaacttcaactttctttgatccactgaccatttactttctcctatctgaaatttgttttacttatccatataatctgcctcctaactcattattttaagcttttaatttataatttgtttattaaattattagctagccttcaaggggtagtagagattggggaaaactggaggatggatttgattgaaacatcttaaattctcatacaataaagcaaaactatgaagaactttcagaaattgtagaggaatatgtgtttaaccattgtttaaatggaaatactggttcacttataaagttcaaacatgatctattaaactatatacattctattttgttgtgttatgtgctctttggtcacctcctcctataatgcagtcctgtgtgggcatgcagacccagtagtgactaaccttagttaatttgaataatgccaagaaattggtaactcacatctcattggccattccatgcagattctccttattggtagtaacaggggctttatattgtagggaagagtatagtctgacttgatgccctcttggttctctatcaaaatcaaattgtatagatatcccatggccagagagcatgacatctaccagtattcaccagatggtgtctgtacttagactagaccttttatactaggaagctgcagaagatggaagttatcagtcctgctaccaaaccacccctgaagctctctcctagttcagaaagaggtgactacaccctgtcatcttctcctaaaccttcagagtttacctggaaatgaagtgaggagaacgctggaagtgaaggtggaggaccagctgctccattggctttttcacctgttccctttaggccttcctcagtatgatatctggagaaggtggttgcctattctaccctgaaaggtacttttaccttaaggagcagatctgaaatccagctgctgaaccccctaaaacagttctttttgctaaacactggggaagtaagtaccccgaccccctgtacattggctctccattgtggaggctcctcattgttctttcacagattctgtagattgtattgaataaatgcttctcagtttgttgtaagccttttgatctgtctccagatgcttttttcttggttctaaccagctaaatacagtaagacctctgtaccttcaggatctgcatccagagacccacccaatcgtgaactgaaagtatttggacctacagctccaaagacctacaatagtcataacacttttcatagctgtaacacttctggctagtatcccaaagctaccaagagttcacatatattgttctttttaatgacttttattttcttacagtctagtcattacccccttcttatccaccctcccacagttcctcattccattcttccttcctcaatctccaagaggatgcccccccacacacacaggcttccccactccctggggttagttgcatcttctcccactgaggccagaccaagcagtcctctgctgtatgtgtgtcaggggcctcatatcagctggtgtgtgctgcctggttggtggctcagtgtctgagagatctctggggtccaggttagttgagactgctagtcttcctatggggtcaccctcctcctcagcttcttccagccttttcctaattcaaccacagggattcctgacttcagttcagttcagttcagtgtaagtatctgcctctgtagggcctctcagaggacaatcatgctaggctcctgtctctaagcacaccatagcatcagtaatactgtcagggcttgaagcctcctcttgagatggatcccactttgaaccagtcactggactgcctttccttcagtctcttttccatttttgtccctgcagttcttttagacaggaacaattctgggttagagtttttgactgtggggtggcaaccccatccctccacttgatgccctgtctttctactggaggtgggctctatgagttccctctcacctcccaggtcactggtactttctagagattcccctccccacccctccagcctccctccagtcccacaaagaccagtttttccagtttaaaattggttaatctcatttaaggctgttaatcctgtgataataaagtacctctcctgtgtacacacttggctgcctgcccacctcattcttggaaagggcaagataagaacctagttggcaacaagagggtcttcaccaatcacctcaatatatatatatatatatatatatatatattcacacacacacatacatacatacacacacacacatacagacacacatagatcttagtgatactgtgcttccttgcaaagtatatgtgattttgagttccctctagtggaggaaggtcagatgtgctctttttaaaaactcagctcctgactagttaaccaatagtaaacagatacacatataaatcccttaaattgataaattttcccgggacctttgttcttaagtgtttttttttccaagaaaaaccttagagctatatgatactattaaatagtacaatatatgaactactcaaaggcatagaaatgccaagcatacattactttgcctaaagttggtgcattctgtggtggcagtaccctgaattttccatttgcagtcatggtaacaaaatgtggagggtaatattcacacccttttgttgcatatagattgtatgttttaaccactctgaaaagtctagtcagtgtgagtatgctactgagaagagattgcctcaaagtttggatgattttagcatcatcttccatagaaagtatgtgatatcagagtgctggatggattgggaatcaaaaacctgtgctcatctttcacttgggttataaattagccatgagaatttgagcatgtctcttgtctaccaagcctcattttctttctgagtaaaatgtgaacataaagaagagtgttacaatgatggcttacagtaatgtccatttttagaattctcagaacttttatgtgacaatagacatgggtgctgccttccagcaagattggcagaatcaccagcagcaagcaaagttggtaaatgctgagatcttaaggcatgggggtgcaaatgttaggagtgcagtgttgctatgtcatcacagcagcatatgcctacctctgctgaagactgttaaaaacagctgtggggctgagtgtcaatgggatttaggtgaatgagtaacattcatcggggtaaagaagcgtgtgaaatgttaaatggggaaggaacatttattgtgatgcatttcataaagatatttttactcaagtacatcatgtacttgaccatattcatcctcctatcccttccagtttttctaccaatccatcccactagtcccttccttttttatgattttattttttttatcaattttttttatcaatttggatgtttcaaaaaaggtgcagttttaggttccctgaccccgcttttaggcatctcgactaaggacacttccattgactcccggagcctcccccaacccaggtctctctgggacttactagagatgcaccccaagcccacccccccacccccaccagctgcagatttccattcattctcctgggcttctggacctctgactttccccacacctgatcctatcctcccatttccaccctcctcctatctcccacccaggtccctcccttcctctgtctcccatgactattatgtcccccgttctaagtgagattcaagcttcctcatttgggccttccttcttgtttaacttctttgtgtctgtgggatgtgtcatgggtattctgtatagtatccacttgtcagtgagtacataccatgcatgtcctttggggtttgggttacctccctaaggatgatattttctagttctataatgatgtcctaattagctgaataatattccactctaaacgaaccacattttctgtatccattctttggttgaggaacatcaggattgcttccagtttctggctattacaaataaaactgttatgaacatagtagaacacatgtccttgtgatacggtaaaacaccttttgtatatatgcccaggagagatatagctgagtcttcagatagaactatttccaattttctgaggaagtaccaaactggttttcagagtggttgtaccagtttgcaatcccaccagcaatggaggagtgttcctctttctccacatcctcaacagcatgtgctatcccttgcgtttttgatcttagccattctgattggtgtaaggtaaaatctctgggtcatactcatttgcattccttgatgactaaggatgcaggagccccagtggaggtataagatcagcaacccacccacaaaacttttgaccaaactttgtcatgtctaaaagaaatgtagggattaaaatggagcagagaccaaaggaatggccaaccaataaccagcccaacttgagacccatctcatgggcaagcactagtctctgacactattaatgatatttagttatgttgagacaggagcctagcataactgtcttctgagaggtttcatccagatgctgactgaaacagatgcagagaaccacagccaaacattagactcaggtcagagacccctatggaagagttggggggggggagatcgaaagccctgaagggagtgagaaccccacaggaagaccaacagtgtcaactaacctggacccctgggagcttccagactctaagccaccaaccaaagagcatggactagactgaggcttccagcacatttgtatcagagaactgcttttcctggcctcagagggagaggatgtacctaatcctccagagacttaatcaggaggatacccagggggccccatcctctcagaggtgaatggggtggaaggcggtagagggattctgtgagaatgggaccaggagggggcagcatttcggatgtaaattaaataattttaaaaataaataaaaaattgaaaaggtgcattttaaagcacataagcatgggtcagaagctgaagggaaagcagctgaaatgtagatatgtggaaattttttagtagaatgaaaaaaagcccttagattccagttgtgctgctaaatatgtctgtggacttagttaagtggttggaggtaaaaatcaaagccatcctgaaggagtataacattttaatgcatggaagagaacacagtggaggggtttggagtatatgataatagctgctttaaattcctataacactttaatgagtagaatgaaaagaggaaactgaaggtaaaggagcacattagataattactgctgtggtccaaactagagttggtgaagactgaaactgggctaatagcaggaagggaaattgacaggtgatgcagaaagacaatggacaggtgatgcagctgtaaagaggaggagaaacagcggtttgtctgaggataattccaagaagtgaatgatttcccgaaaagttatagatgaaaatttacggtgttaaagttggatcgaactatataacagtatggcttagtgatggggtattcacattgccatctttttatctttaaacttggttcaaatgattttggtaaagataagaaagaataatttttgtcaaaaatggtcaaagacaaagaaccatgttcatgttatgtactagacatagtgctttcctgtgcattatgaactctgtaggcttctccataatcctgagtagaagttgttctcttactcttcccattttacagatgaggaatataaggctccaagggtggcacaactaccggttgttgggaacaagacttttaaatggacctttgactacaagtctgttatgctatcagcacaagtaccttcctgcagaaagtgtcagtgctttaaagggtacatggcagatctatgggataatgtgagtgatgtgcctgatgtgctgtgaccaagggtaacttcccaagacacaggacctacagtgctgtggccaggaaagtcctaagtgaaaccaaaaaagctttatatgaaatataaaactttacatgaaatgagccattatgtagaatgatctaaataatgggcccattgtaactgtttaatgtaatgctgtgtcatgagccagggcttttgttatgactaagtgaccactgattcttaaaatgaagaggaggtgaggccggcctatgtgcctcacatcagaccgttttcactagcccagaggattccactcagctatgtgtgaatcagatgcgagaggcctctgcctctcaaattccattgttaaggcaactgttgttttattcatccccagtttgatgaactggcgaaagagctattcagaggagaaaaatgaggaaagacgattgattgtaaatgtatgttctttacagagtaagaaaatgcacgttctggcattctgcctacaaaagctagagaagagcttcagtgtcattatttggcagacactctaaaatatatttatttcattcttgtaaacatttatacactaattagtacataatttatattattttgatatcaagatgggaaacagcaaattggactgcatagaatgtccccaagggaacttcttataatttttttcaaagaatagaggaacgcagttaatggtggttttatacattgcacatagcacagtgctgagtttggcagcaaacagctgaaatgttatgagagttttactctttgaaacctcaacagttattctcaaaactgctcattgctggagtgcatgacactgcctgagttccccatgtcataacagccaggaggtacggtagacaattacctgtctcaatcctgaccttactcatagcttttgtgcttcccttaaatgtcaccgaagagtctttggaggcagaccacctactatttcaacagactttctgaaatgagttctggctcctaagaagttttaaattgtgtgtctagatagctactatattttgagagctaaataagacacttcgttatttttatgaacaatgaaatgaaaagtttgttatgagaacaagacagtataatacacctaaaatttattaaaacactgggaaaatagagccctttcagaagactcttcccttataccagagttttactatatataaaacatctttttgccactttgcggcaattgctgggtgattctcctttgaactaaaaattttctagtatttttcaagctttgtgactagtttaaaaacttaagactaaatggctatttacctacacctattcatatgcttctcttgataatacactttgttagtagaccatcaaaataaattacacaaataacttggtggttgtatatatgaatttgtaagtatatcactatccctgattttacagtgcttaatacaacaactaccttattcttttcattggtgttttccacagttaatgccaaaattgatacttttaatatagacttgtttcatacttatttttgagagagttccactctgtagcccatgccttgcatccttctgctttggactcacaattgcagggatgccaggtgctaactgtggtacacagcttttgtactattctatgatactttgttgacaaaagcattttatgactagatgaggaatgctgtgtaattaaaaccattggtaataatttcactgtactgtagacatccttggtcttagttatttacttatttatatattaaactagatcataagttgttttctgaggaaatttttggcctcacttgcagtgccttcataatggagaaaggcttagtagagaaaagtaaatggtaagaaaatctatcctggtatgtatattttgggggatccccaatacatttatttatcaataaatgaaaataggaagtaaatcttgttaacatatcaggaactattatgcactagatatatgagtgtttgctactttgacaaattagttgaacttctgctttattattataacttttttgctatttaaacttaattggataaaatttatgtacaataaaataaacccacctaagtctgtagttcaatgagctgtgtaacaaatgactgtatttcattttcttacaaagtatcctcatctattaatatatatatgatgctttttaagacttaatattgagacgtaattgaagcattaagtagggtttctccaatttcctcttataaagtgaaaaatacaatgttgaaataggtgtctggtttttgtcatcctaaaatgccctgattttcctttccttggtttacacctcctcaaatgaaaagcaagccgaactgtacctattagagacactaggaacattgtatttagttattatcatgcataaaatatagtctcaatagtcattcatatgtttgagaaaatgaagcactgaacttgatttgctctgaatatcagttacctctgccttactccttttagctgtttgattaacatgttttattagtcggatcccccaaagacttccaccattttcatggttgagtaactccttgcacagaatactgaaggctatattttctgaaacaaataagttggtttctttttaatctaatgttgattcttacccacaaatggcttttaagcagatgcttttctttaaagacactttaacataccagaagataaatattaataaagagatttgaatttgtcacctggaacatttattaatatccaagtagaaagatcaataaattttttgatataactcacagcagggtctttattctatttgagctagcttgccctgcctccaacacaccaccatcacataggatggttttggtggtgggagagccccaaatgtctactggggcaagggtttatagtaagcaacaagtagggagtacatgtgcaaccatctaattgaaaagctactgtggcctttaacataattggctgatgctgggagtcagatcatgaacttaatttctgctcccctctgcattggtggtctttaggcaaggggtgggcttgtaacctggggtgcaggtttgttgggggaataacctggagacactggtcttgttgggggtataacctggagatgctggtcttgttggggattagcctagagactggagctaggttcaggttttgttagtgggcaacttggaaattaatgctaggtactaaccagatagtttacctgagttcaaacgtaggtcaggttctctaaaatggagtctaaattttaaagatttggcatctcacagggcattcatgccctgtcttaggttgatccacctatgagtgaatcttaccacctttgactaccagcctctgcagtggggtatgtaacctattcggctacagttttgggccacatatactggagatctgcatggatgttcaaaaagaaatggaaggcacacttaaccacaaggggcaacatgtataatcctttaaccactggagtacccaaggcaagaattaggaaggccagggagtacaagaagaccagagaggcatgttcttcctcaatttctcttgcagcattgaatttcaggggtttagcatcttttagacaaaccattaggtctgctcaaaactttttaaaattttattcaacacatgtaagcctctatctgaataccaaggtttttaaatattaactggaagcaaaacaaatgaacattgataacatgccataacagaaattccttgtacaatgccagatatacaattaatcaaattaccatcatagaaagttacattaaagctggacccatacagttactgacagtgcaattgtcacaagttacattaaacaaatatccagacatagaaacattcatttgcccaatcatcaatacatgaggcaaggatacaaaagttgttataaaacctgacaagagacacggggttattttcgtagtgtaccatggttgggtggtgggttcctttttgacccagcattccagcctgtagagtgggacgacaaatgccatatctctcttctgtatctgctttctctgacattaggatactgcaaaggatctcaggaaggctgaaatgctagtcaaaggctgggcaatagggcatttatcaaaatcatctgattagctgatccacatgaaagatagggagcaatcccattgactgaactggttatcattagctttcagcaagtccagagttcagcagctccacaggtgatacctcagctccacaagtgatacctggatagagtctgtcaagcaggcgaaaatctgctttctctctggaacccagttgagtcaccgcatgaaggaaaacaccacacaaacttggtttagaataagcagataacataatcactgggcacaacaactagcatcttaatttgtaagcttttcttttttttttcttttctttcttttttttttttttttttttttttttttggtgttttgagacagggtttctctgtgtagctctggctgtcctggaactcactttgtagaccaggctggcctcgaactcagaaatctgcctgcctctgcctcccgagtgctgggattaaaggcgtgcgccaccacgcccggcaatttgtaagctattttaagttatacatcctccggtagcaaatcccagtggatctgccacctgaatacctgaaccaagtggggtcttccgctacctacattttggcctccatgctctctccctgtcccaaaagccaagatgagtgatttttagtacttaaatatacattaggaatgttctgacagttttataacttaaaaccaaagtaaagaaataatattcttaggcagctatttaaccacttatcctaatgaaaaagaatgacaagcagctatcacaataagctttattttatagatgattggtattggtacatatagtattggatttagtttgaatttaatattaaactgggcagtgtgcgtgctttaatgtatttgttacattgaaccagaacccaaaactttgagaaatatattaccaaactctcattcattctgaaatactcagtgcaattaagagtaatttctaatcaatttacatttctctagttgaaaacaacaacaaaacttgttagtcagatatcctcagtcctcagtttcctttcttcttcaaaagacaaatgagagtttagcttatagaaataaaaggtgggtgagaacacaaagaagttagaaaatgcacagaactctgtgtgtggaaagaaataataaaaattgtagaggtaggattaaaatgtgtaaaagagcaaagaaataacttgtgaggatctttctgggcctcatatcattactagttgagaaagtatttcttgatttatagaaaaagcgttattaaagcaaatccgaactgtactttagccttcatattggttattatatgaaggtagaactcagcagcagcaaatgactttactaatgtaatttctccaaggttctgcttagattcctttcttaaaatattatatggttattaattttatgacaacaggaaaaatgttatcaatactgatttcatttacttattttgttcttaacacttgttttaataaacacattactactggccctgattatttctaggacaacattaggatactcggtgtgagtttagagctggggtgagcttttagtgaattgtaactgtcgagcttatgatgcaacttcgacattatttacaagtggataagagtatttctgtgctttgtcaggaagtccatggcaggcttctggccgtcagtggtgacagtgcaacaggaagaagctggagtgtataacagttttgctagctgcacagccgagcatgcattatcgggttagcattgttccccattagatcttgggacatatgtaaatgacacagtcccgggtgtcatagtggagtcatgtcaagagcactgagcttttgttattagtcttacactttatttagaaattatgtgatttttttcagcaacttacatcattgaactaggacctcattttcttttctctgtaaaatgagaccacacacaaacacacacacacacatacttacatgggtgatcacaattatttagtaagtacttgaagtgggtgcttgaaaatcacaaatgaaaatctcaaatattttattgcatattctagagttagaatctataaaacaattcatttcattaagttttaaagcacacagctatattcagtgtatacaactatataccatcttatttggtaaattaagcaaaataaaattagtttaaaatgacagaacaaataaatgatttagattaacaatagtggaaaaacttcagatttagttattaattgataaattatagttattaagataagccattaagttttcttgacatccttgaactacacataattgaatgtagattcttttttaaattattaactgcaaatgtctgcccaaaaatggcacaagaaagcttggggcgtgtaagttatgggtagaatgcttacctggaagtttgggggtatgaatttgatgggggagggagtcatagaaaaaataagaattaatgtaaattgggctggtgagatggctcaacagatcaagtcccttgccatcaagcccaatgacctgagaacattcgtggaatacatggtggaacaagagaactgacttccagaagttgtcctctgacatttacatgtaactgtcacacatgtgcacatgaacacacagacaaataaataaaggtaatacaaaaacaagtctatttatctagagctgtaccacttgtagctgctactcacatgttgctgctaagcatttaaattgtgactagactatttttatataggctaagtataagacacacacactggttctcaaagagcacaaaagtaacattttattaattttaagtacatgttcaaataatatttttcatacatttgcttgaatatgatataattaaaatagctgatctaatcttcattgaaggttcctgggcaactgaactcttctttttattctttttttttaattaggtatttctttatatacatttccaatgctatcccaaaagtcccctatacaccccccgcccgccctgctcccctacccacccactcccacttcttggccctggcgttcccctgtactggggcatataaagtttgtaagaccaagggcctctcttcccagtgggtaagtgaactcttatgtgtaggctttttaaagtacagatactgagattgagattgctattccaaagctaaaccttgaaattgctccttcaatcatatttataaatatcaaacctagttgttacccattgtcaaatgagcttgctgcagaattacagcactaaatggcaccaaatttttataaactctaataagtggttgtaaaatgaataataaattttttcaggaaaatcgtattttaaacttattactgaagtagattctctagctttcccttatttaagagtactatttattagtaccgtgcagtggcactcacgatattattgctattggtcagcccaaacttcttaggaaattaatagtagttttaagtttgtatagtatgctgatttaatttaaatatgttactgacttgagctataaaattaagtatcattagtgcctcttttaaaaggaaatgagttgattaaatatagttacatagttaaatgtgaaggcactaaatatagaaatcgaggattgaaagtctctttcaaaaatttcctaaggaagagggagaagagaaggggggagggaggaaggtgaaggctgccagtgactaaccaagcagtcactccaagcagagatggccccactaagccacgttcctcacaggtgggtttcatggtagcatctgtaagcattcacacagtcatgccaaagtattaccatctgctttccagctcttccatccctgcctcatgagtcaccatgtaggcaaacagtagttttaccccactatgttatcatggacttaacagcactcaacaggtgcatgttctcttactcacactttcaaatggccatttgagtttccttcttctggactctaaagttaaaatgcatatacaatatattcatgcttttttgagatctttgatttaattttcattttgatacttgttttttaaaaggatggtttttatttgcactatttacttgatacttgaattatggaaaacaattgtgctttttttttttttttacattgctgtccctatcatctcaaatttattttcatattgtcagttttgtgctatcctgtcagcattttggctacaaaatgtcagattcaccgacatttatgtcacactgttattggaaagcaggggccccagaaattttgcctttgtttggagagtggtaggtattaaactaagagctttttcagcccttcgccatgcggagcgcagggcagcgtttggcagatctgtttctactaaaagctttcagtgtaacaaagctgtcatgtagcagagtgggaactgaagcatggtgtagttgcatgaaagggacaaaatggaaaagaaactgcagagtggaaaagagaccaggcttgattgtggcaaacactcaatgtgtttgcttcatgagtgtcagagcagagttaaaactgccttgcatcagaacagaaacgaaggagtcactaatgtgaaagggtgacctctgataaaacgagactctagagagaagataaaacgttttccctggagctgggaagcagaccattcttgagaagagagagccatacaggtatctgatgtcattaggctcagtctggccctccagcacacttgttaaagaccttcctcatggttagttagcagctccctacacaagccctgcaactgcttgaccctctcctcctgcagggccttcccaactggttttgaacataaaggcatttttcctcagcctcagtcttttccttttttttccccctttttcgaggtgaacacacacacacacacacacacacacacaccttttggcctcttcccccacatgctgtgttctacatgatcctctcccacatggctacttgttgtgatcttagcactgccctttgaaaccaattagtagactctgaaggtaccacatgacctctcaccattcccatttcgttgactaaaagcaagtcatttgtagaagtcggtacttggtatgcaggtggaagagacaaagacaggattcacaccatttctgactccagattctgtgcacttcttatcagtgcagggccactgaatgcctcaaacagtgttgccttcacaaccacagggagcaaataagcagaagttgctttggcccagccatttcttctactagtttttcttccttccagattctttatctgggatcacacccacatccataacactgcataatgtaaagcttgttgactttggagtcagggttcaaagctcactcctgtaatagctgtcgagctgtgtgatcttgaacaggtttccaatcctgagggagtttcctcatcagcaatgtacctacctcacagaatggttggaattttcagctcagtgagagaaatgataaattttaatctaacattaaacaatggtctcttgtataccaagttcagccctgacctgccacatccttccatagcctgggttccaagaccctgcctaggagtgatgagggaagaaaaacggacagatacaagaaaagatgggatcaagtggtctgtgttctaggatggagaagctgtagtactcccccaacccccaagctcagcataattataatctacagctgaatcaaagaggcagggcttatggtatacagctaaatcaagcaggcatgcttagcaatcataacagcaactgtgtctgaacagaaacagtcctcaagctgtaaacattgtgtggaggagagagaaagctactgtgtgcattttctgcatacactttcacatgcacacttgaaccaggagggaaagctttgccatttccttgagcctaagccaagagaagtgtttccatttcccacgggtctaaggcattggagtccttgccatgtatgcccttgtcaaccacacacattcactcgggacttcatttgctccctacatatccaccttctttatttcttagatgttcaacattcccacttggaccccaggaaggctttgccatccctctgagcctcacttggggaaggctgtgccactcccgtgggtctggaacttttgggtcctagacacagctgtgcacatgccaatagcacacgttcactcaggacttccctagttcctgacactgactgacctctccttggaactttaccagctcagaatgttcatggctttttctcagattccaacctttatatacctttattttctctatgtgcttgactttattaacattgtattattgatctttccgtttctcatggtacctattctgtactgccttcttttctttatgttgcctgtatgtgagtaggttttgtaaggttttatctgcaaccattactcttgatgacaggactaagtttgaattaataaacaaaaaaagagttcatgttgtctattgcattgtgcagtgtggacttggtactctcttgtctccccttctactttcagatataacaacaccacattgtattttatgcatcagcaaacaggtttagcactattagtagtggaagactttagttatatataaaacaagtgatgtccctgcccaacattaatgtgaggatgttgatattaattttgttttccaaataggattattttgttgttgttttgtagttgttattgttataagatattgtctcatgtagcccaggtttgccttaaactcaccatctaggtataggtagccttgaactcctgatcctcctacctccaccttccaagtgctaggattacaaagagatgctaccatgcccagctgcaaacagtactttcatcttatacatggtagtgctacctgcattatctgtttgttcttttaaagatcctgagttagtcaacatgttttgtagataatattttaaaattccccaggctagagctgtaatttaacaacagaccaaatatttataatacagaagaccctgaaatccttttccatcactgcaaaacctaatcagttgattcatcctaactttagctgtgggaacagtgcctttttgtgtaaaccatactatttcttattatattccacataaattctgtgaaatgtctctaagtgctatattttattcttatctggcttaaggaaaagtaagataaaggtaaaattcaaaacaataaattgagttacttatcagcagatcaaggagaagttatcaatttggaggctgaaacttgactggaagagtttgtgggaatatacatgcacttattttactttgggacaagctgattctgtgcacaaaggaatgagaacctttattagtaaaagcttcctcccatatctggatggaagctgacaaagatggaatgttgtattgccatagatgtgaaagggtgagaagataagcttagtttaaatgggggatttcatctttttagacagagaagtcttcatgttaccatagatcacatccatccattcattcatccttcactctaattgtctcttgttcctacctaatgaagtgtgctgtgtgtttgttttgcagatctaaagcgggaagccagtatctgtcatatgctgaagcatccacacattgtagagctgttggagacatatagctcagatgggatgctttacatggtttttgaattgtgagtggacattttatttctcgagtaaagttttaagtgatattggttgcagaaaatcttaacacctttttcttcaagtttagcaacagttgtggactcatctgattcaagagacctggagtcacaggtaaaaaacaaggactttctcatttaaggacaaatggcaaaggcaacaaaagctggccataccaagtacgcttacattgtcagtactcttcagagaagaggctctaaaatgacctagagtctcccaaaatcttgagtttggatcttagtgaagaagaggaagatgaaagtagaggattccacatagaaagtctctctggcaactcaaaatgtataataacacacataactttctctttttatgtaatcatattgccataaaaggaaacttctccactaacagtgtcttgatttcaatatgctacttcactttgacagtcacataagtttgtttaagatggagcagtgtgagccaagcacaactaaataatctatagatgcttggataaatgttcaaagagattatgtaaagctttatgggatatcattattcaatattttgtctttaatctctttctatttaaaattaacccatgactttgattaggaaaatagaaaaaggaagataaccagcttcactattcaagatatcaaaataagatgatgtattcatgtattcattgtctattgcttcataatacattactctaaactttagtgacttttaagcaatatccatgtattacctcactctctgagcatcaggaatgaagttcaacttagataagtcttctggctctagatcactcacaagatgctaagttaagggccagagcatcttaagactctactgagggtggatgtgcttccaatttcattcacatggctgctagcaatcatgtaatgagtgaggacctcagttcccaagagccattggccagaggcattcctttgtcccttgtcattggacctcttcataaattaggatggctactagctttgacagagcaagcaacaaaaatagacatcaaccttagaacctaattccaaaagttgcacaacatctcttctggcatattgtattatctagaaatgagtcattggatcaagctcacataccaagacctacatagcaagaagtgggaacctcagggaggcattttacaagttgcaccctatagaaggctcactaatactttacctatctatgtagaagtttgaatctaaagaactgaaacaaagaaactcaaattgaagaaaagttcagctacataagtgactttttactgggaaagatgtaaatgttttgattagttgtttgcaatagcttagaaatcctaaatagaatcttaggccacattaattagaaagtatatagaattcaaaacaaagccacactcccacccttacacactactttttcaccctggagtattcatggttagcaatacaccgcagtgtttatagaaaaggatcaccagaacaaaaacacgcggaaagtccattagggtagagtcaccgtcttctagcatgctagaattttgagctgggtctgctataagttgatatataaaaacttctattatggagctagagagatgacttagaggttaaaagcactggctgctcttggagaggacctgggttagattcctggcacccacgtggcagctcacaactatttgtaactccaattgcaagagatcccttgccctcttctggcctctgtaggcaccagacatgtatgtggtacatagacatatatacaagaaaaatacctatgtataaaataaaatctaaaataaaaattaaatcttttattgtaagaaaatttctttcaacactttgaatgttcttttagctatatttccttcacatttaaggaagtatgtactatgtgatctacctagcaaaggaaatcctatgtcatagagccagtcagacttgatttctgtcaaagaaaaaagtctaactttttttaaaataaaattaaaacattaatagacatcccaatgacattcgtctaagtgttgattttaaattctaaaatagtccaagctctcttatgaacacattatctagctatgaggtgcgagctcctttcattcctcagggctaggctttgcttctaggctacttctaggggctttgcattccctgactgtctgtgaagataggcagactttagaggataggggagagaacttgctcttttgagaaggcagactgtaaatccagaaatatgaaaggaaaagtaacaccatagaatttgttttcaggcagactaggttatggtaagggaggaaatggaaattaattgctttaaaacatcctagttctggagcccagcaggatggcttcactgggtaaaagctctggccgtgctgcccagttctgatgacctgagttaaatccccaccacataatagcctggcagctgtcaagcaagctagcctgaagtagagtatatcagaaacaagggagaccctgcctccacaaagtagaaagtgagaagcaactcttggaagttgtcctctgacttccacatgcatagtgtggtgctcaggataataataggtaatttttttaaaaaaaaaaatctagttcagatgtcccttggaaaggcttttgagtacttctagacatacttaaatcccaaatgaagtgctgtggcatggaagagctcttaaacacattgaagttgggctgaagagatggctcagaggttaagagcactggctactcttccagaggtcttgagttcagttctcagcaaccccacctacagtgtattcatataaatacaaataaatacaccttaaaaatatcattggaatcatagatgcccataaatgtattgattttcatattctaagatacctatatagggaaaacataatcagtatctgcagttatttgaaaaactgtgatctgtaagaatatgtgcttgttcactgtggcattagaggccaccactagaatcaacaagagacaaatttcacctttaagtaagaaaggttctctaatgataagatttagtccaggaatgaagccactgtcaatttttaaattcacattacatcccaattgcagccccctcccacctctcctccctgtcctgctcttacaaatccttcaccccatcaacccctcccttcacagggcacacacttgcctccttgcactcaaaaggatctgtagccatccaaaatggctgaaggtagagggccttactttgagactagagaggatctctaacttctcactcaattttaagatgattcttttaaaatcacttttctggtttaattttattcttccctcaagaactctgtttctatccatatttttattctgagggaactaaaagcagatttaatcatatatcttaaaatgacaagcaaagaaagcaacatgttaaaatttacctaaattttgatccccattctgcttgtatcagggccctaaaataacactagtagagagaagatggtctttgttgtcataaaatctaggatttgggcttcttagtattgatgcagtccttatgagatttttgtggctgattttatatactgttgtgattaaaacaatccaatgactgaagatgacatctcattaaagattaacatttatcaatagcctaatcctaatcttagcctaaattaatagaatgtagctattctctttttttcaccttctgttttgggaattttcaaatgaaagggagactaatataacgaaagtcagcactgagctctagcagttatgaaaacatttgtcattctctgttcaaactatcctttcctgttatcatttgccactgtagattgctacagcagtttcatttcaccagaaacactcctgttttaaatgataacactattatcatgcctaacaaaatcaccaataatttctcaatatcatatcttattaacttgacattcagtttttcctaattgaacatgaatcttaaatgacagctatctaaatttagaacttttttatgagctctagggatctgaaagtagattataaattcacagctaaattaacagtgatttcttcttaaaaggccagaaccaaaatagaaatatcaaactcttcttctctaccattattttataaatctatcttcacagctatctttgctcagtttctctacctcttgatcttttggattcaaaggatcaaaccagaaagaggttactctaaaactactctaaactgtgatcctatgtatggctcacagagcaatgctggtacacttgtgtatgcctccacctactggcccagaaagagaatgcatctacagctgcagtgtggattaagctattccagaatccggtccatatttctggcaatagatgtaagctcccctggcattcaagggctcattgctcaagttacgagggatctggatcatttgcacagttttataatgttacatcaatacataatagatagggaaagaggaaagaaatcaaattaggcccattgattttcttgtttcatggctttctggaagctcttatgaaggaaaaagctagactgaagaacatatttggattaccagcatgtttttatatttggtatccatatctgtcttttcctccgtctatgtgtgtccaatactccttctaatttgcactcatgaacttatatggcataattatgttgttggatattagaaaatcctaggaaatagttgatatatgcatgactagaaatagtgtgcttagaattgagaacaaaacacccatggaaggagttacagagacagagtttggagctgagacaaaaggatggaccatctagagactgccatacccagggatccatcccataatcagcctccaaatgctgacaccattgcatacactagcaagattttgctgaaaggacccagatagagctgtctcttgtgaggctatgccggggcctagcaaacacagaagtggatgctcacagtcagctattggatggagcacagggcccccaatggaggagctagagaaagtacccaaggagctaaagggatctgcaaccctataggtggaacaacaatatgaactaaccagtacaccccagagctcgtgtctctagctgcatatgtatcaaaagatggcctagtcggccatcactgggaagagaggcccattggacttgcaaactttatatgcctcagtgcaggggaacgccagggccaagaagtgggagtgggtgggtagggggttggggggagggtatgggggacttttgggatagcatttgaaatttgaaatgtatataaagaaaatatctaataaaaaaagaaaaaaaaagaaatagtgtgtaaatataaggcatacttaaatatagactcatagaaccagaattgtagaactggaaaggatttagagcagtagatttccaaacttagaatgcctagttcaagctggtcttagtggcacttacctttaatcccagaatttgagaggcagaggcaggtggatttctgagttggtggctagaatgagttccagaactccccaaagctacacaaaaaaactctatcttgggaaggaagaagggaggagggagggagacagaaaggcagaaaataaatcctgtgtagagtatcttaggcaagcatgtatctaggtcccatacctgagttcaatttgaacagatgcagtcttcatggcaccaggtgagagacgtgacctttaaagcaggagtaatgcttagagagtatattgttaatcccctagcactcacaggaagacagttgacaagtgtgtgtgctggcactatatccattgctttgggattattcttaaatatgaacctgtttgtagtgatttgccaaacttattttaaaatatagattcagatttgaagatagggctgagttgtgtttccccctccaaaaaaaatttaaatatttgtttctcagtagcacattcaggcttgtttttagtagtgtctggtacttgagttaagctgtaaatcctaaattggctggctaaggaattttaattaccttattatagtgtgattacatataccacagggagaattttacagtaattaaatatggattttaaacacgtctgacatgaaaacaatagtttttttatcttttaaaataacattctcagtttgtatttttgaagcttacaaaggagataataggctggaactgctctttttgactttaatttttttgtctgatatgaattcatggggaagagaatgtgtgtgaaattcattaactaagtggaactaattattacttaccagcgaagttgccacttaagcaaaaatgtctctgtctcctatcatacaatgaaaatctggactgtagcatcttaatttatttaaatgtatacatctcaaatagccttctctagtctgtttgatatttttatgtatgatgatgcagattactatttttgtgaagcacagtgacatttttcttgattcttggtcaaaatttttcatcgatttttttttgttgttgttgttgttgttctgaataccatttcagggtccccaagactactcttgggttgatgcttcacttaaaagattaaaaggatgcaatgttactgtatccatggatgatttattgcaacaaaaggaaatggtgcataagatccagggaacaagcttcccatggtcttttccagcaattcaattgtgacctgctgccaaccagagaatctcatttgagacgtaatgcccagagtctttattcaggggtggctgcataggtaccctatacctggcatgtacccagactccccaaacccaactagattttcagcataaacaaaactcctgtttgcagtttagatgcaggcagtcattcctttcagttagtgagataagaacttcctgaggttcaagccctcagatgcctgcctatcagggccaacattggaagtgggcatgtcagaactttcacaagatctgctatggtaatcctatgtaaactaaaacagagaaataggagatggattttttaattggttaactcgctccacaaaccaaatgtaattgcttatgaagataattataagctttgggtttggagttgtttttaacttttaagtgtaattatggtatcattttaacacgtagtagaaaaaaattaggtggccagatcactgaagcaaatcattagttgagattttataatgtagcagggattttaagcttctaagttatatttgaaaacaaagaatactctgatactattattagaaaaatacatttgaaattgtcgctctagtaatttttgttcagcatattaaatctgatcttcaatcaaataaaataattttaattaatgatatgccgataccataggattaattcagttgattttttttctggaatttaaaagtacaattaatcttaaaaaattataaataattttaagtatataaaattggtacaatatacctactttgtaccaattgacaaatggttaaaaattataatgtcacaaaaaaatgtcactcacaaaccttcatcagtggcgtgtttaggattatttttttctacttaatagccttatacatttttgtgacattgattttttgagaatagtgttttatgactgcagtaagatacctagaggtgcatataccacatttaatttgataatctccttattagaaatgatgctgtatttaatattctttttaatataatattttaatatattaatatttaatatattatatataaatatttaataagtgttcattattttattgttgtatatgtctgagtatttggcctgagtgtatatctgcataccatgtacatgtctggtacctatagaggccatcagatcccttaacagacagttgtgagatgctatttcagtgctgagactcatcccagtcctctagaagagcagccagtgctcttaactactaagccatctagagagagagagagagattgattcatccttgataattcaataacccactaagtacagtttgtgctgaccttatactcatgagtgtaaggccatccacaggagcatggtccacctaccaggggccacacctttaaagaaaattgactgtctctcgcccagcaggtgtcaactggcaataactgttactcagctaggggtaggtacttgtaagcctcttcctcctccatgctcgaatgaattctatacagatcatctgcgggcagccacaactgcttcagtcttgttatgtccagaagacaactgtttagctcaggttccccctgacctctaccttttacaatctctctgccctcccatccacaacagtaccagagccttgaaggtggggctctgaaataaatgtcccatttatgactgagcataccacagatacttgacaattaatattacaattacttaaacagaattactaggtaatcagaatatgactattaacaaacataatattcatagatttaagttaatacatataccatatttagaataatacatgcacataaatacagactagggaattattctaaaaggaacatccacatagctacaaccacatcaagaaataaaaataattgccaacatttctgtagccttaattctaagtctttgtgaccatagcccctttttctgtacgacagctttaatatgcatgtcatttttatgcttatccagctgtctcatccaaataagcagcatgcataatgtaattcactgccccttgtttttctatgaagtcacacagtgtatattttagatctataagactcatccaagttgctttgtgcatctattccttttcatcactatacagcaagcattgcaatgaacagactttcagtatttattcattttaaagttaatgaatatcagggaaagccctagctttccttgaactgccgtcatttcagcatgttgttggtcattactaatagcgccttctccttacactcattatctatcctgtactgtatagccctcctgatacttagtgatgccagatttttttttttaattttgctaattgggatgaagtttttcctcattgccctttctgattgccacttgtaatcctctatcttcattcttttagttttgttttgtttaataaaagagactttggtagttttaatctaatgtaatcgtcacttgttttgctttttgttagcatttttgtgtctgaagaatcatttaccaagcctgagaaaatggatattttctcttgtattttatcatccatctggaattgatttgagatacactgtaaaatagcagtccaatttcatgtctttccatacggagattcaattgtcccagcagttattaaaaaacctgctctgtggtatagcctttaccataaatcaaacaccatatatgaatgattgtttccaggcacagttcgagcccattggcttgcttgcatgcctggcattgtgccaagactctgttgtcttatgagttctggaaccttgtagagtcagtccttccagctacattcctttacaggcatgcttggaggacatacttggctctgaattctctaaaaatgttttagaatatggccatgagtttccaccaaaaaaaaaaaaaaaaatagaactattggcagttttgacattaatgtttatatttaatctttataacaatttgagaataattgacctgcttgcagtattaatattgaatcttctaattcgttaacgtcatatgtagcttcccatttagctctttgacttctttcaatgaatttgtatgctttctttataaagactgtgtacatctatattagatgtggctttgatcaatacatgttagataatgataacagcttcgttaagtaagttttattagtttggttcttaggtactagctatccatttccattcatcaggctttaattctggtaattagtacagtcatttggattttctgaatacatgatcgtattgtttgcgtatgatgatgtttcattccatacaagttcttttttaaattacattcattcatttattcattcattcgtttgtttgtttgtttgtttgtttgtttgttgcgagcacatggaagtcagtggacaacttatggtagttggttctcctcactatatgggtttcagggattgacctcagctagtcaggcttctgagcaattgcctttactcactgagccatcttgccagcccataattctgttgtgtttctttttcattttattgcctttattgtgatagataaagcatctagaaaataacattgtgtataataagtgtgaataggaagtgaatttcatcaaatgctttttttctgcgtgtcttgaaatggtcagatgctagcagcctttaatctattgatgccctgaattgcgttgattcttgtgttgacccaattaaattgttatgtataaataagctttataatccttcttatatgtgctggattttgtttacatttatgcttatgggataattttgttataattttcttgttctatccataccatgttttcatatctagattacattataaaatagttgaagctcctttctttatctgggttttcttttccttccttatatagttcataaaactcacataaacaaaagtttcttataagaagcgtttctgtttctggtttaattctttaaatgtttgcagaaatattaagaagttctggccattagtatgccatgtttaccaattgcattttactagggaaaagggtcaattttatgtggattctaaacagttttggcataaacctgttctttgggctctgcagccgtaacttttctatttagtttgtgtgtttgtgtgtttgtgtgtgtgtgtgtgtgtgtgtgtgtgtgtgtgagagagagagagagagagagagagagagagagagagatttggaggagttgattctctcactgtctggctcctgggggttaaactcaggttatcagggttggcagcaaatactttagccttcttgcctctctacttcatacctcttgatttacatgtgtcatcttcttgtgtgctttcttttcttcttgtggttgtttgttttatttgaattacatttatttttattatcttttatttttgaggttataaatacattgtactctacttgcagtacccgttagcatttttctttccctttattttatttagatcaatttaaaatcttttgtcattatagcttccttttatcttttttaaggtttatttattttatgtataaataaaatacataagacagtttcagctgtcttcagacacaccagaagaatgcaccagatcccataatagatggttgtgagctttttcttaattagggagtttaaatgctacttactgagtagcccagaaattccaatatacttcctaacctagtacattcaaatatttataagcaattatagtcctgaaaagtacaaattctgtagaatgcattaattccattgaatatcacctttgacttatatcccatgttttatttaacgattttttattaataaattatgaggtacatatattcatatcatttccagcttcttttatttaacttagtcatttagatttaccccacacttacctatctttgttctttattctttgagcatagctatgattttatcttagtttgttccccttgtgtcagtctcctcagtacaaacttctatttttgttagtttcctttttttcttgcagtccctttagtttgaaggctgtccactgtatggagaggtctagattggcctattagacatcattcactcttttccagcttccattgatgttgaaattttagctagcaatctgacatttatctaaaagtagtagtattatttttcaagctattaaatttttccttcatctttggctttctaaagttttctctgtgctatatctcaagaattgtgtctgtgtattttaaccttgacgtgagttctgtaagtgtctgaaatcagtgtgttgatattatttgtagttatggaaacttctctgccattatctcttcaaatacttcctttgtccctttcatttttggaacccatttaaatatatttaagagataataagccttataatattctatgtgtagactacattctttcttggaatttgcatccttatctcttgccttttctgacctgtcttccaggtctgtttttctcttcagcattgctaaattgctgtcagtctgctttctagatttttaattacactttttagtttatagtttcatagtttctacttatttttaaatatttactgcattacatttgtcatttttttacaaaatttttgcaaaaaattaaagatggagttttatattcagtaaagatagtaagcttcattacttaataatcttgtgttcaagaactccacttgattttgtttttaatctgttctctattctggctctttgtcaagctctctgattccatcgagtgcccaattcgttttgactttctgctagatatcatgttgacacttactcgcctaagaatgatgctttcttcctcaagggaggattttttttgccccttctgctagttaccatcaggctctagcaacttgaaactgtcaaagtctaagacttagacttttggggatacctagatattgagtcagggatcagatctggtgattggctaattacttacaacacacagcaagatctctatgtaggctcacattactttccataaatatttacgtttgtatccacattaatgagagatgagcagatccgtatttaccttgtgcgtgtgtacggtagtatgaatggaggccagaggtcgatgtccaatgtcttgcataggtgctctctactatatttttgagacaaggagttttaatgtcactcgagcctgctgattgggtagactagctggcatataaaccccagggatttgcctatctctgtccagtcagttctagtattgtaggcacataccactgtgcctgggttttaagtagatgctgggaaaagaaactcaggtccaaatttgacaagtactttatgaacagctcccttgtgcacattttgatgtcaagtgatgttatgggttaattgccatttattttgccattagtgctataaaatgcttttaaagcatgtttactagtttctcttccattcagtttctttagggtttttgggagtttttttgggttttggttttttgtttgtttgtttgttgtttgtttgtttgttttagttttttgccaatttaaagaattcctaattggttttgtttttatttttttattaaatttacttgttttatatgtagatgttttttcttcatgtgtgtatgttgtcacatgcatgtttgatgcttttagagatcaaaagacatcagatcccacagaactggagttactggtgtttgtgagataacatgtgggtgctgggaattgaacctgggtcctctgcaagagcaacaggtgctcctaaccaaggagccatcgttccaaacctaaagaattatttcttttctaagcatgcttgcctttttcgtgtatttgcaaatgtttctccaaaaagtgcttgtttaattttgtttatagtgtttgattattttacttgttgatttaaaagaagaagaagatgagctaggatctgaaagattaccgggtggccaaacctagagcagttggaacagccaactaaagtaatattggattataacaccaagtgtaccagaatatgtgactacacatagcttacaaaggacaatgaaggaaagaagcagagctctcaggaatgctgagcactctgtaagcacactccccctcttcacatgagcaccctccaatatgtgataagaaaggcatttcacctctgatacacttctctccacccctaaaacaataaaggaacataatccttacatacagaagacaaaacgatcggacagtacccaagttgaggaacattataaaatccttcaccagggttttaaaattatctatgaaaaaaaataaggaactgtcacccaagatgtaaattctgaggaaaattgatgaggtatgcacaatttctcatatttgcaacttatatataaatataaaataaaaccttatgtttcatggtgctccttgaagaaattgtcacttaatttctgtgcttccacagcactgtgtgcatggcacttggcaccataatttttttaaagttgtctttagttaaacctaaaaataaaataaaaccacgagtttacgctattagaagctaagattttcttttttctttttttaaaaaagatttatttattttatatatctgaatacactgtcacagtctttagacacaccagaggagggcatcagatcccattataaggtggttgtgagccaccatgtggttgctgggaattgaactcaggacctctggaagagcagtcagtgctcttaactgctgagccatctctcccacctagaagttaagattttcaatcattagataatacacttattatataataaggttattagacaacaagttattagttctttttattttttaaagatttgttttatatatgtgaatacactgtagctgtcttcagacacaccagaagagggcatcagatcccattacagatggttgtgagccaccatgtggttgctgggaattgaactcaggacctctggaagagcagccagtgctcttaaccgctgagccatctctccagccccaagttattagttctaatatgtaattttgctgctgtgattattttaccaaatgagttctttctgtctggaaataaatagtgaaatatttatatattatattttactgatatccgagatttgtctcagaatcaaccaagtagcagtccaagtcatctctgtctaatatgatctgattaatcattatcttggcctctcaaattagaccattcaaaaatgctggtcccaagaaggaactgctgttgtttagatactcctactatagaaacccaccctgatcttaaattttaagatattcaccaacaatacctgttgttcctgtaatccaaggttacattaaagaaaacctcaagagacttatgaagtagggaaaataatgaggtcagtgactgggccccccttcaagacctttgggaatggggctatagatgggccccatctcaagactataggtaaaacaaaatttggtagtgtgctacattttttacagaagggttcatatttttaatatttgaaattttctgtagttatgttttttagtaaatgaaattacacaatgttttaacttttacattatcttatccctaaatcatatctctaaagcatttttggttctttaccacattaacacacttatttgcttcatctcactagtttagctatatagcataagtgtaagtgtgaaaagcaggcttgtctttcattgcatttagtttctcctttgcttatatacttactcaggtacaaaatcaaaaggctaagttctaaagtaatttgaaatagctcccctttctggttataccacagactgatgtggatcaattagatttatttgggattttgtttgttgcatcactgcagtgttttgagacaatgtcttactacatagttctggttgtcctggaagtctgtatgttggccaggctggcctcatactcatacagatctgcccgactcctacgtgctgagatttaggacatgtgtccccacacccacccagttgtttagttaaaaattttattgacataatatgtagtttcacatgtagctgtaaaaagtaaggtagatggctaaaattctgcaaaagttgtataatgttacagcaagactactgataattgatacaatctaggaatcttatttagatgtctgtatccatttgtttgtaattaaagggattatctctttttttttctgttgtttttagtttattaaaatgtttacacggctacacagtcaaatttaggattagggcttcagaaagatttagttttcatcccatcagccccttacttccttgccctcatggaaactttttaagatttattttgtttttctgttatgtttaatatgtgtatacatatatatgaaaataactgttttctagtccacccctacacgttgtcgcatactttcttccatctaaaccttgagttttgtatttttaagaatgtggaaagcagctgggcgtggtggcgcacgcctttgatcccagcactcgggaggcagaggcaggcggatttctgagttcgaggccagcctggtctacaaagtgagttccaggacagccagggctatacagagaaaccctgtctcgaaaaaccaaataaaataaaataaaataaaataaaaaataaaaaagaacgtggaaagcactgaaggattccatagtagtagctagacattttccttcctatttatatctgcttagctgcttagtaccccatttataatacaaactagtcatcaaacatttcctctgttggtagatatttggattgtttccaattttattctattatataaataacattatgcaggcttcatttcatactgctgcaaatgtcaaatattaacctactagcattctatgaaaatgtaagctttgattttacattgtgatgaaagtcctgagctgaacctcagtcatattagctcatttccctcattataaaacagttgtacttatgtgtatatatctggagaaggatggttatagataaattattatgtattttattgaccttatccatatctgtgggattgactaacatgttgttaattacagtgggtttcttatcaccatatgattgctgaatccaagaaaaatgtaatgcttgccgttggatactttaaatgttcacagtatcattggatcttagtaaaagtatgtgtgtgcgtgcttgcatgtacacacacacacacacacacacatgcacacacacacacatgcacacacacagccaaactctttaaaagtactgcttgtcctgagtctcaagcataccattcgggcaacaagagaatgaatcacaagatcttgatgggtcttttaatgtatagcaaggagtcaggattttattctaaagatgtgattctatcacaaggtgtttattctcaaacagtcatttaatgatttgtttgtctgttttattaattaagttatttatttactttacatgtcattttaaaaagactttttaaaaaacaatgtgtcatgaggaacgtatttggatttagggagaattatgaaataatccaagtagttaagtatgtatattacaatgataatcaaggtagatgaatgtcaacagacagcaaaagaagcaaatacagtttaaaagtacttagaaattagaaaaagcagggcttgatgattggataaaggtagttaggaatgaggaggaaccaaagttgagtctccatccctgacttgagcacttgatatgagataacgcctttgaatagcttaggcagtcctagaagtaagtgataaaatacaatttgaatatgttgacctgtctatgagacacccaaatggcagtgctaaccacatggattaggaaggtagagatcttgggtagaaacagatttacaagtggccattatagaagcaataatactgagacttggaaggatgggtaaccaggagtttgctgggtggtagcagcagggatgaagtctacaaacttaagcaaaattataaaaatatggcaatctcatgaaatttggagaagatacacagaatgaggctaggtctgatgcatattggggacagggaagatcacagaatccaaagttaatactcccttctgggaagtggagaggggcatctttctattaactttgctttagaaagatcaaccttgcctgtttacataaaagggcttgtacttgcctctcaagcaggttccctagtttccagctctcatgatcttgaatcataaatacctttaagtatctctttagattccaaatacagagagaaaatactaatagctttatatgattgtctcacgtcccacctcttttttctttcctaccatgtagtgccctaagctatgtacctggcctactatggatagactgctttgaatccagaatattttctttgttaatccagagcaaatcaaagcccactgttgtttccatagtgggatggatggataaatttaatagactgtgggtggcagattgatcacatttgtgggaaaggagataagcattacagccaggatagcaaacatgcagaatggccagaaatgtgaggcagggtatgtgcctgaggcatttctaataatgctaggtcttgctttgaagtaaaatataagatgagagcatgactggtgataagtttgaacatgtaataataaaaccatcagtaatgtgtacattacttcatgctgcactttctattttattgccttttaaggcttcttaataattgactaactttaacggcagtgtccattttgtagttaaaaacaacctgaaacataaagttgcagcttgctcaagtttacaacactatgtgctgcagccagacttctaatttaagcagtttgattgtagggttccactcagaattactctgctaagtctatgtcttttgattccatattactaaggtctttaacccatatattcatcaagtacttatagaatgcatgcagtgtaccaggcactgttctaagtgctacagatttagcagtgagccagtctaagttcataaacacatggacttagtattctagtggaagagactaataggtatatattactaaaaataagtactgaatgtgccattacaagggacaccaggtgagaaatagggaatgctgagcgttagagagtactgcttcagataggacattcatgaaagccctgtctcaggaagctacctttaatcagatgtaaagctccactgcagaggtgatagagcacattagaataattttaccaaagtaataatataaccagatttatacatgagagagagagagagagagacctctaaattcagtatgaaaatcagtagtagacacttgaaacaagtcagtgagtaaccccgtgcaaaatacaatttggagctcagcttcttcactgagagggccgaaaagctcatgcaggggagaggaaaccagagtcaagcccatgaatgaagttaagacaggtggcgatcctgagcctgctctaatggctgagaaagactctgaccatcagatgtgaaggagtaattcaaagggtcagaaggagaaaacaaaatctctgcttagtattcaaattaaaacattaaaagttccatggcaaagccaacatcataaaactctctgcatggaaaatgtgaatatatatatattagaaaaaggaattctgaagtcttcaaacatttgagctcaagaaaataaagataatataaaaggggactttgaaggaataacaaccacagaacaagaggctgttctatttggtaaatgttgaaaaagccttaggagtgtgtgtggtatgtgtgcacacatgtgtgcgtctgtctctgtctttggaactcaatatgagccagttgaaaggtagcattgaataaccaatagagaacaaagaacagttagctagaaatcttaaattaagtataaaagagaaactgagaaccatgaaggccaattggagaatatctgacatgctttaggaacagtaattctgtaaggagagcatagaggaatgatgaaagggaaagaaaggccttattaaaggaacaatagccaaaaatggtcccaacttaaagaaacactagctttacagaataaactttgggaatagatattacttgtagacttgggtcttttgcatttgcgctgattatagaacacagagctctatattattgtatattatatataatttattattttattctatattattacatatataatattatacatactgttgtccattacaagccaccttatgagcctgtctcccatcacaggtagaatatataggagtcactcactaccattgacacagggtatcttctatacattggcacctcagtttctactttgcctggtcataaaatgaagtgaaatagatgagtagtccaatcagtgagctaaatattgtcttcattgtcatagtcataaatgctatttagtatagagccacaggattagagattaagatctcagaatcccagagcccattgcttacattcaatttcttactgtactactttgtagctatgtgaccttgaacaagttacataacatttgtatgtacacatggtgggactcatggctctagctgcgtatgtagcagaggatggcttagtcagtcatcagtgggaggagaggcccttggtcctgtgaaggttctatgccccagtatagggaatgccaggaccaggaatgggagtgagtgggttggggagcaggggaaggtggggggaagggataggggaacatttgaaacatttgaaatgtaaataaatgtaaacaaagaaaatatctaataaaaattttttttaaattttaaaaagcttcaatttgttcacctgcaaaataatatctgtctctagtatgtttatggggattaaattaatacttacaaacgatttaaaatggtgcttgccatgtagttaaatgctcagtaaatctttggtattagctattaacatagctgcttttaacaggaacatatagtattttaatcctgaaggagtaactaatataaaaatcatagtatataaggataataaacttaggtttctgcgtgttcctgtaatacacaaaggatcagtttagttaactgctggattttatttgtccatgtaaacagttttgtcactgtttgaaaattggccttgatactatttgaacattcaagggttcatattttttctttataatgtctgaaatctgaaactttgaaataatttacaagcatataaaatgtcctcctcaggaaaaagcagtggttgttttgttcttgcttaattaagacagttaagttttaagcacataccaatgtttgcacctgtttttgtttatatttgtatacctataggtttataactaccagccattaacatttcattttagctaggaaatgcctagaagtaagaattaaaccagctggtttgattttaatatgcaaattacagtcaaacaaaaacagaaaaccaataattaactgcatgattattttgtaatctttgttacatttgttcaaggtgagatcattttccaaattggcctactctcctcatctgcaggggcacatcaaagcctagcatgattgttttcagtcctttaaatgtttataaaacagattgacagaagacatcccaaaagtagaaactgtcagagaaaggtgctaaatccttaattctacaaatactgtgaggaacctgtgtgctttccattactttttctatccaggagctttgtgtttagtgttggcaataccaagagggaaaccctatttctatggttaaacgggcaagaggatttatagatatttaatattacacacatgtactcacctacaaaagctgtaagaattgaggggtctggggagatagtgtctgctttaaacataatgtgaaaaagtcggtgcggttgcacatatctgtaagcagaggtggggacaagtggatctttttaactctctggccagccagtgtagctgaatctatgagctccagattgaatgcagaccctgtctcaaaaaacaaggtagaaagacatcaggaaaaagacattgaacattgttctctggcctccatacatgtgcacgcagtctctctgtctctctctctctctctttctctctctctctctctctctctctctctctctcttgaatggcagaccgtgtctcacacacgtacgcatgtatgcatgttctcacttccacatgaacacagactttagatgagattggaagcaatcaggtgcattgattgtgatcagtttgatgtggcaggggtttttcccaagctctcacaagggtgtgcaggactagaacggactccttaagaaatttgaaatccgtttaaactagatgagctagtatacacaatggatgaagaattgtgtgttacagtatttatgcaattttatcttagaaataatgatggtaaaaaaaaatagaggctttctagaaaggagagactaaaagaccttggactttagacactgttgtgtgcatgtgtaagtgttctggttaaaatctaaagatagattggaaataatggtagcttggaaacttgacttacctagtgagttccaggcccgcctggacttgtgagaccttgtctcaaaaacaagttctttggttgactatttgtcattgatacctagaggttggggacataggtattcaactgtggggattagtgagatcactaagtgaacagccaagttactatgtatgtatgaacaggactgtagctcccgtctgtcttactttttgactaggaagttcgcagaactttagagaggtatgggaacagctaatacttcggaggtctgctgctaatattttaagatgctctacagtcccttgaaagaattttgaatttggcttggtttttgttttttatccactaggaggcaccattatcaaacagttctaatgaggcgatgtgaggaatacaagaattccaagtctctttaaaactctgtttgcaatttgtcaaggcatgtagaacttagtgtctgtctctctctctctctctgtctctctctgtctctctctgtctctgtctctctctctctctttctctctgtctctctctctctccagtgttgccctatgtggcctttgtctcttgagttccagatttggagttgtataccaccacactcagccttgtagaatatgtttagcaatttgtaagtttaatggatgtgttcaatatccccagtccaaaaaaatccaaaataccccaaaatcataaaattttttgagtggcaaagtggcaaaggcaaagtaaaagcataggtggaaaaatgtacaccttatcatgtaatagatgacagtaagatgtaaatattacatgtaactatttagaaaactgccttcagtttatatatatgtgtgtgtatatatatatgtgtgtgtgtgtgtgtatatatatatattccatccttttaatataacacataaataaatgtatgtcctcccctgtttcccttcagacagggatgccagttgaacatgacataacaagttaaaataagactaggaacaaaccttcatattacggctggacaaagcaacccagtaaaaggagaaaatggttcccaaagcaggcaagagtcagagacagccctgactcccactgttaagacttccataagaacaccaagctacacaaccataacataaattcacaggacataacataaattcagacacatgtaggtttcctgatagctgcttcagtctctgtgacctcctatgaatcttagttacgtctgtggaccatgatcttgtgatgtccttgacccttctggctcctacaatccttcctctccttcttttgaagctctgcctaatgtttagctgtgggtctctctgatgacaattatgctaggctccctgtacaagtatagcagaatatcattaagaatccgttttattggctctttgttttttgtttgtttgtgccagccatgtttggatctgccctagttctctggtgtctgctcctccaggcagggtcaggcatgggctccctctcgtggcacgggctaggagtcttcactagggtcatcctcttcgattctagggaggttctattgccttacatgtctacattaccccctaaagtgccccccaatttaagtcatctctcagtactttctccctccactcctgacctgatccctcatattcccaaccccagttcatcctcgaaatcgattctatttccccttcccagagagagccatgcgttcgcccttgagccttccttgttacttaacctctgcaaatctgggttgtagcatggtcatcctttgctttacagctaatatgtacttatgagtgagtgcataccatgtttgtctttctgagtcagggttacctcaatcaggatgattttcttttctagttccatccttttgccggcgaattttatgatgttatttttttaacagctgagttgtgtaaataaaccacattttctttttccattatttgtttgcaggatgtttctgactatggtgtgtcctctcagtatatacccaggagtagtagatcaatccccaattttctttttttcttttggttttttttttttgttgtttgtttgtttggttggttggtttttttgtttgttttttttttgttttgttttgttttgtttttttgttttgttttgtttttttgagacagggtttctctatagccctggctgtcctggaactcactctgtaggccaggctggcctcgaactcagaaatctgcctgcctctgcctcctgattgctgggattaaaggcatgtgccaccacggccaattttctgagaaatggctgtctgtattgctttccaaagtggctgtacacgttttcacccccagccgcaatggtggagtgttcccctttgctccgcagcagcaggagctgccacttgtgcttttaacataagccattctggcagatgcaagatggaatctcaaagtcgttttgatttgtatttccttgaatggctaaagatgttgagcatttcgatttaaaatgggatgaggaactgtgggaaggcgaactgggatgggggtaaatgactggactataaaaaataaaacaaaatcttaagaaaaaccatctatccagctgttttgtaagggctactgtagtactgtcctgaaggagtcttttcacatttttaaatgattagacctgatttcatgtgataaatgcctgtttgtttatgaaaaaggaaaataaagcaaagtgtttcaaaaaccatcttatttatcaactgtttaatactcttactatccagcaacttctgcatctctgcaaacagatatagatatctgttgctgtgtcttcttaaattatgaacatctctttatgtcaataaatatatagcatcatttaatattctccactatgagtttgccacaattcatatgcacactcttctattactgacatttaagttgcttccaacttcctattataaataattataataaacccttagcattaaaactgggagatagccctaatttttcctttagaataaaattcaataagtcccaagcaacatgtgtatattttaaagcatttgacaagcactataaagttgtccttcagaaaggttatattgattattgatgtgtttttccatgaacaatgagtttgataactaaagaaaagtttccccaatgccaagttgtatatatgtgtatgtgtctgagtgtctatgtgtgtgtatgtgtgtctttgtatgtctgttacatggattgccatcttcttacactggaagattaaactatgtcccagcatattcaaatgtagttctacaatatactatgtataccaggttggcctatgactaggggcaatctatctgcatctgcttcttgaattttggaattaaaggtgtatactaccacacccatgttgatccctcaattttatacaagttttgacacttatttttttatttttaatgttagaaatattttctaattatcattgtgagttttttcttgattgataagttactgagtatacattcttcaattaacaagttttagaaagactttgttaatgcttcattaatttacatctaacacaatttatgatcaggaaacataccctgaatgcttgcttttgctgaaatttctaggtttatctttatgtacataattaataataataagcttttagtggtttcctgtgctacaagcatgttacacaagaaagtactctatacccagttttcaaaatgcagctgtttcgtgctaacaaggggtatttcttcaggacctttggcagactcttcagacatctaccaagcaagagttcagtctctcctcttagatctccctggtggaaaagcatcaggactgtgccatttcatagttccacaatagtgtcctcccacagctgcctcctttgtatagctcgctgtctgcatgcctcctcccccaccaaggcagaagcagctcttcttgttctctcttgtctttgagctctcatcatccatcccctgttctcaagagattgtttcccactctctgtgctgcttgttctttgaaaatgtaaactattatttttctaatttctaataggttgtatagttgttttgttatctttagaaaaaatgctggtcagagaaatttgtctgtcctttataacagtgttcctcaaagaatcatttgcatacaaatgccaatataccatctgttacatgttggtctgctgtgagatagatacagaaactgagtgtagacatgtagaaaattgctgttgcaatttgacattatgacagaatcatgatatatgatgctgtgctttcagctcagagtcatccttaggccagattggcagaattgggtgtggcatattctcatccctttcaacatgcacacaatcagaccttgtagtttcatacctataacctattttgtttgtttaatacatgtattttggctcatttttctaattcttgattcataaaggatttctactccctcacacttcactttctcagagtagagacaactaagagaataggagaatacaagatgtgctttttgaagattcctgacaactgaataaacacccaaagatggaaaaccaaagagaagagcagcaaattaggccttctcactgttttttacaagtattgaattttcaaatgatctatcgagggacataaatcaattttgtgtaaaatgttcaaggttattatataaggattgtatatatcatgaatatgtataaattaaatttttgttgaatgaaatttgcataaataacaatagttttagtttttaattctgtacctaataaaatttaaaattagtgcattgcttttagttaataccaattaatgttataaataatcaaatggctttaacagtagaaaggtactttcatggtcattattctttcagagtaatccttcctaaaacatgctacatattttaaaagttacacctgtggttttttcagtgctcctggttataaatccctgaatttaaaaagatagaatgttcaacatacctcatttttaataagtaaaacaccagagctagggatggagtttggtagtagagtgcttgcctagcatgtgtaaggccttgggttctctcctcagcactacagtcaaaaagaaaggaaggaaggaaggaaggaaggaaggaaggaaggaaggaaggaagaaaaaggtaactatttatatagagatataatacctatgcataaaactgaatcagtctttggaatcagtatagaaaaaacttaaaactgtaatttagagatgtgaaaagaagtaaaagatacgtcattcagagatttaaaaatattagaaaatattaaattctagaagttaatatataactaattccatcttagctaaaatataaagatactttacattacacaaaattgttttaatgttcaactggagtaaaatgttcttaatgatactatgaaattttttatttttaagttattttatttatttatattctagttgttactcccctcagtcccccctcccacagttcttcaatccattcctccttccctttgcctctgaaagggtgctccccactatcagaagccttccctttccctggggcctcaagtctcttgataattaagtatatcttctcccactgaggcctgaccaggcagacctttgctatatatgtgctaggggcctcagaccagcctgtgtgtgctcctggttgatggcttagtctctgggagctccctgagggcctgggttagctgagtcttctgatcttcctttagggctgctttccccttcagcttcttcaatccttccccttattcaaccataggggtccccgacttcagtctaatggttggatgtaagtgcctctgtctcattcagctgctggtagggcctctcagaggacagccatgctaggctcctgtctgtaaacacatcattgagtcagtaatagtgtcaggccttggtgtcccaccatgagatggatcacaagttgggctggtcactggaccacttttccttcagtttcttctccatttttgtccctgcaattttttaaaattaggtatttatttcatttacatttccaatgctatcccaaaagtcccccacacgctcccccacccactcccccaaccacccactcccactgcaattcttttagacaggaacaattctgggtcaggaattttgactattggttggtaaccctgtccctccacttgaggcccttttatctactggaggtggactcttccagttacttctccccaatgttgagcattttatctaaggtcccctccctttgagtcctgagagtctctaatttccctggtacattctagaagattccctaacccccatgccctgaggctgcttacttcccttcattctcttgtccctctggatttccctcctgtcccccaccccatatctgatcctgttcccccttacccctctccttctactctcccacccaggttcctctctccctctgcctctcatgattattttcttcccccttctaagtggggttgaagaattctcacttgagccttctgcttgataaactttttacagtctgtgagttgtactctgtaattttaggctgatatccatctatcagtgagtacatacatgcatgtccttttgggtctgggttacctcacttaggatgatattttctagttccatccacttgcctacaaaattcatgttgtctttgtttttcatagctgaatagtattccattgtgtaaatgaacctcattttctgtattcattcttcagttgagggacatcagggttgcttccagttaccggctaatacgaataaggctgccatgaacatggtggagtgcgtgtccttgtggtacaatggggcatcttttggttatatgcctaggagttatggtgtagctgtgtcttcaggtagaaaattgtataatactagatacaagaatagaccagtcagtggaagggagcagaaaccaaaggggggaagtatctatatgctgtatgagcatgtgtacagattgccattggagatactagtatttcagatatgtccagaaagaaacagatttatccgttccaataactatagttatgtcagaacatggtcccctacttacactttgaccttgttattactttgccatatcccctccaccatctcctttcccctctcttgccctggatccatctcataagttttcctttagatctcaagacagattcaaatttttattactgtattatgcaacctatttggctttctcctccacccaattttttgagtagtacttatccttaaatttcagtaaaaagggaaaatacctaaatagaagaaatccctcactatgagatttttatttttattttttagtcctcatacatcaacctacttaaaactgtagccagttttaaaagtagcattttcattccaccataaaaagaaataaagagaatactcagcttttctagtaatcaaggaaatataaattaaagcaagcataaatgactcttttcctcctttctggcaaagatgaaaagaggagtcattgtgagggcacgggagaggaaagggcacattcacacacagcaacgtcagtacgattggtaagatgtgtctggcaatatggattgcaaaagcattattgcaagtaacttgacctagaaacttccactccagaatgctcctctagcacatgatcagaattgttcacacaccatgtgagccttgaatacatcggggaattaaaaaaaaaaaaactcaacagtattttcataatgaacattttgaagaatttgatttcacactgaaaaaatgtccaagaagtatggcatgtaaaagccttatataaatatggaaatgcttcatttgcataaagccacactgagaaccaaatgatacaggtaaaagttctgtgtgctaggcattctgcagagtattgaattagactgtgttgaaagtataaactgatttttaggactttatactcttgggttgttataggatgtgatggtgtacacgtgctctttgcataccatatatttatatatgtgtaatccttcgggaaagcaataaacacaaccagatagatttaaagcagtggacacagccaggtagatttgagtccccatcactttatgcaataactagatttacttgagaatcaaaaatgttgactttatggagtgcttagctgtaagtatgaaaagagacctgacagactgcttctcatggaatctcataatatcatgtgtaggtcccttgaatttgcattttgggagtttttgtgttacctgcaataattatttgaaaactaacctaagtgaatttcaaaatatcttataagccttaaagcattatgaaaatgtttactgctaatatttgaatgaaattttaatgaaagtaatcttatatgactgtcatatatctgcatatttgtgtgtgcttaggttgcataaagcctaaatgttacaatgcaaactgtagcttgttagcagttaaaaactgttaaggactgagggagttttctttatagatgggaatggaagggaattttgaattaatgcaggcttaaatatgaaacgtggtatatacagaagcatatgcctggtaaagataaagaaaatggcacattaagaaagtactaacagaaaggaggcccgctcttttctgaaaaggaaatggagggggagtggacctacagagatggtaggggcagagtggctaggaggagtggagggagggagtggaaacttgttgggatgtattgtatgaaagaagaatctattttcaataaaaaataaagaaagcaataagatcagtctatgtacagtttgattttcttaaaaatgtcattggatagattaggtcaaagtgatctgacctgccagataagaaattagaaataacttacattctatggcaatgtagtaacaggttattaccaacacattagtgtaagaatatgtctgcagtaattggaaggtaaaataaataaattctgtgctggcttatttttttttcctttcatagcatgtaacttaaatttcccacttattggtaataactgttgcaaaatattataaaaagctttgtattcttaaaatacattatttgacgtggagaatttggagatttaattcaaagcttatccccttcacctttagagttgctcccacgtgagacttattactgtgttttttgtgttacttggtacgtccgttggcttatctctcttaaagattcctttttctgtaaatattcaacagctggtttacactgaaagaagggagctttaaataatgtagtcagtagtcagctcccaacaatggtatgttcacttgaagtattgtcttggaaggttttctttgctaatattctttttcacatttctctacagtatggatggagcagatctgtgttttgaaatcgtaaagcgagctgatgctggttttgtatacagtgaagctgtagccaggtatgtaactgcatctaatccccagaagtaaagtgggaagtaaaagaaggaaatgaccaagaaatcacaggaagtagccagctcttctgtctgcaagcacacacactgctagcatctctgcaaatgacatagatgcttcagtatgtgtggtagcagctggacaatggatggaagtgtgtaatcaatggcaaacattggatctattaacattttgcatacaaatgcttctattttactgattcctggtgcctttctacaaagaggggtctgtcagcccaggaattaagcttgagggttttatatgaagctcagcctcatcagattgtgccttattagttctttgctttgcttctttgagatatcagattattatgtgaccagttaatctaagaaaagcacaaaagagtaagaggagcaaaaataaaagcaccattttcctgttgaatatattgcttcaggccactatgtggtctctcaaccaagccatgactattttactaagtggggcagtaaacataaaaactgaatgactccaaagaaaagtaaatatggaaaattatggtagccatgaatgcattacaccactaacttacagacatgaagcaatgcagctttctgctttgggttgtattcagtcacagcgtaattatgcactggcaggttaccgatttgatacgtgagatggagcatcccttcctttctccctccatcagtcactgaccacagtatggtgaagggcttacactcacaaacctacaatgatcgataaaatgttttgtcagttgaaaaacagtcacatcgagtgattataacgtccctgtcattccttttataactataccaccctgggacatagttggaaacaaccaggcaactaccttaatacattttttagccccatgtagattggctgaggatcaaaggctctggtgtcaaggatgaagtggatgtaactgtcgcacagaataaaaatatcctcagtgtgggatagtcgcttttttagatatcctcttggatctgggagaaagaagcaaaggaaagcgtaatatgttcactgcactacttgcttgtatcactgccatatggcagaatgaaagccaagcatcttctttacttgtatatcatgctttctgaagcatgtttttaggttccacttctctattttgagcttatatcacaatttttaaattgtcattcttgattgtgcttccaaagtaaaaagcatgctctaaaactccaaactgtcagtattatctggattttctgtggcattgttgtgagacacctcctcaaagtaaattgaattcagacttttgcatacacacacatttcttacttctgtaagaagaaacttctgtacgttttcttaccatcaaacaccgacctggacctagaacctctcacatgcccatcaggtgctcctatcccctttttcatacagttattataaataatagaaagtaagaaaaatccaaatttcagaattttcattcttcaaacttccttaatgaggggaagtgatttgttgtcgatatttttttttcctttttgaaaaacattagcactggaacaactggcatacatggtggccaccacgtttcctcacatttccagtttgtggtgacttttctgagttttcctttaacttccttcctagctctacagttggcctggatctcagcatagacatgaccaggtgatgtcatgcagtaattgccatctgggctctctcatcttgagacttaccaaaaaggttaatgtttgtgtatatatcaggatgaaagcttattgattttttttttaaagactcacttagatttgctgttaaaatggttttatgaaaggaattcatcagaatggagtgggaccagtaagtgacattattcagagagcggtttgaacatgctttattgaagtctttccttcctaacaatgaaaatggaagcagggagactcaggtaccattcattattatctgtgttccctcttacaccagatcaataactcttagtggtggggagtgtgtggccaggtaacttcgaatttttccttttttctctccggttctatgattttctgttaggaaattcagcttgtgtgggtattctactgagtgcaactgcaagacttagagactcaatcaaatggctaaagctgtttttatttcaagaagaatagcaaaacatggcacaaagcacagatatgtataatgcttatttaatacagaataacacagcccagctaatgatagtccctgttcttcctttgtggaataagttaacataaggtcatcaactccaacttttaaaatcagagttatatcttccctagtagcaagctttcctaatgatgtgaagtttgaagacaaccagaaggcccatctgaagccctgaactaacaagggctccccatatcacttcttcccacattaactaactagcaatacacctgatccagaacaaattctctacttagggcaagtgggattccacgaatttcagggagcatttcaattatgaaacattgttttatactgagactgttggttggcttacatttctattctccctgaagctggccatgtctgcttctatttaccatagataatatttagctgggaacatttcagcaaatatttagaggggttttaacccatttttgaccacaggaggaagctgagtcatctctctttgtcatcaaaaacatctcctagagaaagtaaatggactattggacagttgtttctttgtatagaattatcatttttcctgattcttttttttcatttctttttttaattagatattgtctttatttacatgtcaaatgttatcccctttcctagtttcccctccaaaaaccacctgtcctttaacccctccccctgctccccaacccacccactcccattcctggtcctggcattcccctatactgaggcatagaaccttcacaggaccaagggcctcccctcccattgatgaccgtctaggccatcctctgctacatatgcagctagagacacgagtctcaccatgtgttttctttgattggtggtttagacccagggagctctggggttactggttagttcatattattcctcctatggggctgcaaaccccttcagctccttaggtactttctctagcttcttcattggggacactgtgctccgtccagtggatggctatgagcatccactttttatttgtcaggcactggcagagcctctcaggagacagctatatcaggctcttgtcagcaagctcttgttgacatctgcaatagtgtttgagtttggttgtttatgggatggatggaagtaaatatatacattgctgaggttctctgaaaaaattaactgtgattattcatgaaatgacttatatgacataaagattctgctgtgtttgcatatttgaatcaaataataaagtaccccattttctagtggctgagaattaaatctacagctttttgcttattaaataaatcttctgtcactgagcttcattcagccaaataatgaaatacaatgatattcacactttaaaatgcccagccacggagttttctttggatttttaagactagaaaatgggaattttcttttcgctgaagataatttaggtgactagctcagtactatgtatccaaaatagtctgttatgtaggtacatgtccactttgcttaatttaaaccctccattttgacatctcgattgacatttgagactttgactgagcttaataataatgttataataatggtgacttcagtacaggtttcaaaccatcatgatacttgttattagccatttcaggtgatcacagttcctccaagatctactttgaatgaccaaaagtccccaatgctaggttaaatctaccctgatttaaacaaaacttaattatagtctacactggcacagacaaagcccttacatgtccattctcaatggatcatcacactaagaactgcttagggcccaggtatgaggagatgatctatgtagaaaaaagggttgctttgctttaagtttggaggatattctcctctacctcttatttttaagggaaacttgtaatccattataatacataaaataatctatatcttgactagatggatgtttgtatgagcatgttagacagtagtgtaccaaagaggaaccttgatagaaatctttcagttaatttgtcgaaagttataaatacattggtaaggtcttctatgagtactctattttaaactgtaagtttaaattagtgtaagaaatatactgtctgaaagtacaaccaagttcaataaaatggtgaaatagagcatttctatactatggctgcttgagatgaaaagagaggacatccatgtcttgccttagtttgacttacaagttttatactttgtgatggcattaaaaagatgtgcagtcagtagacactacacttccaagttttgctgggctattaatgtgtacacactatgatgtagctaatgttagtgttttgagaatgcttaaagcaaaatgcaaactaagcttagactctcatattcagtaacatgttaggggtgtgtttgatgcactttcaccttgccatattttcagcttcagatgtgttcatccagatataaacccataataacagaagaacatttatattcctgttataatctgttgctagttgaccctgtcagaacttttaaaaaacattaattccttctttgttcttttcttgtacccagtggaaaactctgcagtccccagctgtcaaacaataactttgctttattcaagagtgccctcaaataaagcctgattatgttgcaaaaagaaaccacatttgattaggttctgtaggttcctctcatggtcaaatggaaaccaagcagagagctggtttgagtggcagacaaaaggctacaactcctttggtcagaataattccaatagctccaagcggtttctttcatagaaatatagtttagctaaatagaggtagccaaggtttcggttttgttttgtttttttaaaatattttaggcttgctcctttagtgtgtatagcaatgttgtttattaaattatgtggaattcttttttgacttggctcagaagaacattctgtttcttaaagaagcatataagtttggcaaaatttttattaagtctcactgacttatctactcaaatgaaagctatttgtggctagctaatataaagataggagttataaagcagagaagctgtgtattaatttttgacaatggaagttctttacagttttaaatttctcttgtattttacagccactacatgagacagatactggaagctctgcgctactgtcatgataataacataattcacagggacgtgaaggtaagtattttttctcactaactttaatgtttctgaaagggaactagataataataatgacaacaacaacaaccaggaattttctttaatatagagagcatcttaaactttatttgaaaataaaaaataatttatctgctttatattgagtcattgtactaatttttaacaggaacactgtgatttcagtttccttacttttccctaaaagatgtgtgcaaactaatgtttttcctcttttgccatcagaggaaaagaatcacaaagccagtaaaaaagggaaacaaaactatttttttaattaaccaaatgcttaaatttatcacttatttttctataacttttcttcaaccagatttctgtctttcaagtaaagctgaaggattgtaaactgaaagaaataagagacgagaatagtgccaaagtaacagacacccctaatcaaaagcatttatcacacaagtgagaaagttgctttagaatcagaatcattttcatggtctttgctgactcaccactactttacagcatcattgctatttgctaagtagtaaaacacagtgtcacaaaagataggaattatgaaagaagccagttcattccagtaagttaccttccaacttcttacacgcatacctatcagcataaaataattaaaaatgatgcctaagactagaagaaacttagtgtaggttatgaatcaaattaaagagaatagaaccagtagggttaaaaaaaatcctctcactaaaagtcgttacgaaaataagaatattttaaaatgaaaatagaatcaaaactctagtagtacaaactagcctgaatagtttgataaatgggggattcagttaactgtcactgtactttgacaagtggatgccattttaacatttcatgttaaagtggcacatggatgtaactgcataaaggacaactgctatattttgataggactcaactagttaccttatatccaagaaataaaatatagtttactttaataactgtctgcatatgcacagactctgtaatccaagcctgtggtggtttgctgcacagtccttaacagttatttttaatgctttgctgtaaagctttgaccctatggtgttcatagcactctaattgccctccagtatgcaccttattctctgagcactaagttgttagattatgagaatcgaaggtaactaaaccacccatgaactacagtgatattaaaatagatagtattgttctggttaggtctttctttgtttgaaatgcattgtaaagtcttaaatagaggaattcctatagccagatttctgtaaccttcaaagattttcccattaatcacaatgctggtgtcatcactaccttcccttttctgttcacctagttgtggaagaaattggcaataataagaattctcatttggcctactattaaaatgatagcaaactctttctgatatcattttcaacttgcatttctgaggatggtttcatccagtctgctcagtaaacatacctcaggagcaagattttcttgtaatggcagatccctcatgaaagcttattatgtcctctttggagaagatatactctttatcctcaagagtcttttaatgccagcagtaaaaaggctggtatccttggaataccacagtcaagggtagtctgtgagccaggactgaaagctctgggtctgtggcattagggacttgagcccaaggaggaagtgaatgataaaggaagtgctatcagtaagcacttgttggcatccacaacagtgtctgggtttggtgactgtatatgggatggatccgcaggtggggcagtctctggatggtcattccttcagtctctgctctacagtttgtttctgtgactcttttcatgggtattttgttcccccttctaagaaggattgaagtatccacactttattcttccttcttcttgagtttcatatggtttgtgagttgtatcttgggtattccaagcttctgggcttctggactaatatccacttatcagtgagtgtatatcatgtgtgttcttttgtgatttggttacttcacacaggatgatatactccagatccatccatttgtctaagaatttcatgaattcatgagagcatcccactactcttccctctccactcctgctgctgcccaagcccacccctcccccttctccttggtgctgtcatacagctatttttttaatatagcagggaatcatgattccaaatacaatccactttgtactcttagaatatcagtgagattgttattctttcttccttttccatccttttattgaattagtgcgaattctcagtccctgttcattgttgtcaaaaaatacagaaacaggccatgcaggagcggtgggatttcccactcaggcctagcaccttccaaggtgtttaactaccagagagtctctgaagtctgtagccgtgggatgttttcatagttagctgtgttagccctggtctatcaaaccttcagcatgcagaggtggtatttcttccttctaggcatatttttaaaggccttactctttggtatactttaaattgttaaggaaattaggtagaggttagtagtggaaattattgtagctaaaagctgagaactttcatgagcatttccaaaactgtctaattaattgtaataatagcaaatgaaaatcattgtaaaatgaacaaaaatttccattactgcaaattagttgtacaatatcttattgttcattcttttcaaatgcaggtctgatgttggtactctcataaaaacttgacactaaacaatccaatagacacataatacttttatttttaaaaatctttagttatgcatagagagtaaaaattgtacaaagctgtcttaatattctattactctggtgaatcactatgagtaaaggaactcataagagaaagcacttaattgaagacttgtttacagtttcaaaagattagtcatgagtatcatagttggaaacagtcagattctgagagtttttgcagtagctgagagctttgcatcctgattcttaggcagcaggcagagaaagagaaactgggacaggcatgggcttttgaaacctcaaagtccacccccagtgacatacttcctccaacaaggccacacttcctaatccttcccaaatagttgaccagctggtgaccaagcattcaagcatagagcagcagggtgtgtttctaggagggtggtctcacttgaaccatcataagagggaatagagggaaaagaatcaatagagttttaaaatgtatgcttctttgcatcattctgaatgaatataagtgaatatatatggagtaaaattttctccatatatacatataggacaaatattctataaaatacatccacgagctggggcctagcaaacacagaagtggatgctcagtcagctattggatggattacagggcccccaatggaggagctggaggaagtacccaaggagctgaagaggtctgcaaccctataggtgcaacaacaatatgaacaaaccagtaccccggagctcatgtctctagctgcatatgcatcaaaagatggcctagtcagccatcattgggaagagaggcccctaggtcttgcaaactttatatgccccagtacaggggaacaccagggccaagaagtgggagtgggtgggtaggggagtgggggggaggtatgggggacttttggggatagcattggaaatgtaaatgaggagaatacctaataaaaaatttttaaaaatacatccaggaaaaaatgataatctgaaagcttaaaatttgtaaaatagatcactagtttatgtaatgcaattgtgtttaaaacagtttgctcagcagttttattttgtgtgaattctgctcttcacaaaaattttgtcaatattataagaacaaaatatgactatatataataagtaattatagtaatatatttagattctgattggccatggtatttgatataatggcaagcccaaccaaataatacacaaaagtggttatatttggcttcatcttctactttagcatctgtttatatagtctacaaatatttggttgcctacttcacccagagtgtgagctctaaaagtatcaggaaagagactaagtaacatttttatcacatactgttggagtctgaccatttgtcaacactaagtgactttaaacaacagctggcatcatttgctccctattgtacagtttagttagagccatggaggaactgctcacctctgttacccagactgttggccaggatcatgggaccagctgcccaccagctcaagtaacagaaactagagagctgctaagctttttccctctgtcataattgacacctcccccactctttttatgtggccccatgtccaaaagtacagtggctcaggtcttcacagaaatggaagttagcagatgcgtaggtgcctaggtctcagttctcgtttcatgttggaccttttgcatttgattggttgtatcagattttaaaagtggaattagtctgagttccagtgaaagaaacagagctgtctttttcgggatctttttttgtttgtttgtttttcttggtttttggtttggcttgggggattcatttttgttttctaagacagggtgtgatgtttgccccagctggtcttgaactttctgtatagctgaggttgacctcctaactctaccaacccaagtgctgatattatagaaatgtgactcccaccccaccatgtctggtcagctgcaacatttttttaaagtgctacaagtatacaagggtaaaataagttgttgggtatgatctttatagacagacaaacaaattgctatagagagtggtgctaagtatcagtaaaagacagaatctaagggtttcctgaaggaaatcttgaatgagggggtaattgtatgaggacagggagatatttcacatagaagaaacagtgtgtgcaaggacctaaaagtagttttattttgggttgtgttaaattagtttctttttccgaaggacataccatgtaatttttaggaagcacttagaaacctgctgaagaaggaaatagagaagtaattctcagactgcaaatcaagaaagcactaggcaaaagcaccatactccagctgtcagtgagactcaacagagggcttacattaatgttgataccctttataccatttcaggtaccattatgttgaaggtacctgaaatatggacgttttgcatgattgaattcaatgttccacttatttaattggcgttgttgaattgggtatatttctctaaaatattcatccaaaagatatttttcaagtgcctactatgtggtagaaactgtcctaggatctggagctacaccagtgaacaagacaatcacagccctagtagagctgacagggagacagctagaagtcaatgtgcaaaaagaagtaaactggcagtttagaaactgagagaggcacttgggaggcagaggcaggtggatctctgagtccaaagttagcctggtctacagtgagttccaggttagccagggctacacagagaaaccctgtctcagagagaggggggagagagtggggagagagactgagagagggtggagaggaagagggagaggagaggagaaaggaaaagaaaagaacagttagattgtagctgtatttagaaggttgtggcaacagaatttcttaataggactttagtaacttacctaaatttagtgtgattccggtgtttattctagtgggtaatcctgcttgccagtcattgtaaaaccttcatagctgttaggtctcaggacatccatatatatccagaaatcccccaacttcacccctcacatataataccaatatatttcacatgactaattatttaaaatgtcacttgttttgttatgttaatctttgtttacttccttttaattagttaagaaaatagaaggccatgacaatactccactttcatgagggaatcttcagtttaatttgtctcgtctagctaacaattatatgtttgcattctctctctctccccctctctttcctttccctcttcctttcttctccccttcccctttcctgccttaccagattacctaaaagcagatttttatgttgattaattacatttttcttctgcttggtatctgtttccttttgaaatcataataatgaagttgaacgaggtgttttggttagatttgagtacatagtaccacgaagccacagtggaaactgctggcattggagaagcaatttctcaagaaattgcactttttaaaatggtgagtctttgcagtttagggagccgtgtcatgatgatgtaggatctcgcagcagtctactattgagattggggtttgacacttagttttgggaagctgtctaagatgttttaatatgcctaaacagtaccctgacctttgcccagtaaatgccagtataatatctccaaccctccaagttgtggcaaccaaaaacgtctcctgaggcataaaactgccctcagataacacccattgttgtaatattatattgcggtttacctccttgtagacattaattgaggtatgtatattctttttttcatccatcttcttccctttctttatcttgtaaaaagttggggaaatttccattatgatgaagtgatccccctttgtcctctcacccctgactccagagaactttggatagaatcagaccattgacaaggtcagtacagcttctagctccttggctgactcttgactctcagctcccctgaaccccaaagcatcgcctgggtttgcagagacacagcacacttcagccctctgtttctctctcactctggtacaactttagtaattgaagacaaagtaaagcagtttggcgtacagactgctggccaaacacaattactttccattctgagtggggcctggcccaggaggtttgagagctcagtatttagttctcaaaactgctagcctcaggtgcatatacactccatctaaggcctcctacctcaaggtttctgggtgtgcttcctcaatggtttcctttgtagcctttgtcatcacgcctgactgctctttggaccctttctggtctcagttctcctttcacctgctaagtgcctgactttcttataaatgtgcattctccacagttacagtaaacaatggtggccgcagcagtgtggatctcatgtagtgttccttcctcttgtgctccctcactggcatttcttttataccaactaccacaattccaaaagtccctgtgttatagttttaaagaattacttctcatcaaaaccaactcacatttaattcttttttaattgaaaatatttttcatcacaatatattctgattatggtttttcctccccatactcccagttctttcccatctcctctcccatccagacccattcctttctgtctttattataaacagctcactgataattagtacttgagaatgactttaaggtccttgagcatcttacccacattttatctgattataggctcttaatcattggactctaaaaaatttctcacaaatttttaaaggatgaatatttcttttgcttattggaaatagttccttccaatactcctcacctgagcccaggggagcatgtgtcatataaccagataggttttccatcagttataaaatgtttctgtctctagtaacttttgaaatgatatcaaagggggtaggggggaccagatggcaatccccagctttaggccacactactgaaatgctcagcaattccctttgtgtgcctgctggctttcctttcacctacttatctatcatagctcccatcctgacaggctgtaaggaagtcctcatcaaatcagaaccaagggccatcttcctctcctacccagggaagacagagttgcttcagattaaatggtgcatcttaaattttgtttgcccagtcttaatggtttaaattcctggtttataatttcacaattgccttaaggaaagagtgcatgaggaaggaagaaaagggaatcattcctgttttctatagttaaaatattatttgagatttctaaaatacaaactttaaaattaggatagatttaggaagttatactttataaaatatttttctataatatcaaataaccaactctttaatactttgaaaaattcaacatgatttatagaaatcatacaaagacaaatatattaaataagctcaatgtataatttaatatagcttccatttcctgccagaatgagcaatctgaagagaaactgcatacctctttgcatatcaccttttaaatattagtaattctagtttgccaatatcatttatctttaacatggtaaatagaactgtaaagcaattttcaaaaaacagaaaaccaacagcaacaacaacaaaaagataatatctcaactgctgttcacgtggaacccttctccacttaggccttcaaagttctcaactgctgttcacatagataagctctcatcctgcagccctagctggcctgaaactcgaagatctgcctgcctcttcgtcccaggtgctgggattaacggctcaccaccacacctgcccttaaaggggatgtttttaaattattttattattttatgtgtatgggtattttgcttacacgtatgtctgtgtccttggagggcattagattttctggaactaacgttacagacagttatgaaccacagtacgagtgttgggaatcaaacccaggtcctctgaagagcagcagtaaagatgagccatttctccagccctgtaaagtgatttttaaaataacactttttaaaagtttatatatattttaaactcagtgcagtgagttaatatgatacaatttccataaaagttctgatcatttcagttcctcttagtctaatcagtttggggtttaaaacttttttaaaaagatttatttatttattacatatgagtacactgtagctgtcttcagacacaccagaagagggcatcagatctcattacaggtggttataagccaccagatggttgctgggatttgaactcaggaacgctggaagagcagtcagcgctcttaaccactgagccatctctccagccccgggactagaaactgatttaaggataagtggttgtaactttggagaactctgggcatttcagacagtctcctactggagttatatggagttattctgtgctttgcaggtttgcaaagtcactatattagacatctcagttttcagcctgtacaggtcaccgggaatttccagttatcctttgtctctgcatgttactgagccaaaaacttaattggtcctatgaaaaaaatgggtactcagactgggaagataggtacagactggagagaagtacttgagttcaattcccagcacccaagtaaaaaggtagtcttagtgacatgtacttgtagtcacagtgctggggagaccggcatatccccagcacttactggccgttcagccttgcttgtacaatctgcgagccccatgtcccactgaaagactctttctctctgtcaaaatcaacatggatgactcctgaagataagaactaaagttaaattctagtctctaaacccaagtgcatgttccaacacatgagcccacacacgtttgcacgtatgtatgcaaacatacacagaagaatagatatacactgtaagtatctgaaggcagaatgtgttcctactttggatattttcatctctcagttaaagaatgagttaaaaaggtcaagtatttactaggtatgtttcagttttggattttgatgagaactacataaaatgtctactaattttgagcacatggctctagagaatctgttctgtgaattgcttctacagttcttgttcaggaacaaaacctgctatgagactgtagactcacatgaacttaatgtaaacctctctttgaataccaaagtgatcaccatgtggaagagaggaaagtgagcctttgagcagctcctaacagcgtgccgagttgtgctcaatggttgattttactcagctgtttcatttggttccattcacgaagagaatgcaagtgccatggaagtagaaaaggaagatgcggcttatgatcatttgaagaacactttttttattttttaatcataatgtatacaatacagaatataatcactcttttcgttactggcaagattacatgaaagaaattatcactaagaaatgattgcttcttaaatatacttaaatactggaggaattgggataaccacttcacttcatatctgggttttttcatcagtaagtacattaacatgctttgtggttgtgatgattaaaattataatcatgaaacatatacacagagggcctagcacatagcaagtgctggtagctcacagtaggaacagtatctgatttaataatagtgatatgaatcaggtcatattttctgttccacgattaaagaaactattatgtaaagagagtaagtagtttgcccaaaattctccatctaaataagagatggagacagtataatacccagacagtttgaatccagaggccagccttttatccaacatggttacaattctttatacttcatttgtttagtttacaaaaattaattaaatagatggcaggtactatcattgatagcaccattatttatattggaaatatataaaatagcatatagatggacatataattttatatttttttattttgacaagtgtaatccaaatgtgtgtaagtaaaatctatgtattaaatattagaatcattgaatattgcctttcccagtaaaatgagccaaataataccaaattgacttcacactgcattattcatgcagttagatgggatttaaataaaaacatttcttactgctcgacttttccagtacttacattttaaaattattttttaaagttaccaacaatataaaatctgaccatagatgggtacttgcattaggttagaaagcaggcaaacccataagcctttttggttcttcatcctatagtcataaaatattgtgttttgaacagaatatccacaactgactgaaaacaaaacaaaacaaaacaaaaagtctgacttcacacacagtagaatccctttggtatgcttgacttgtctctgaaagtctctgccatctggtctttcaatataagtagaactgtaagtccaattttatgcatatatctttttttaaaaaaaccatagaggttttcttggtgcccgttaatgtcactaagagtcacatgcattttttttcctattttgtggtgttttctatccaaaagtcaaccatatgttagaatgtgcagtgaattaagattttgtaaggagaccatatagtgtcttcttgaatgttttatctaataaaagaaatataatggggtctgtactacttctggctgatgcaagacaagtgaggatgttttttgcttctattaaataattcagctgctgacagtctccttctctctggtgcagaacataaaaaatgggtttaaaaatactatatggaagaaagcaaactactaggaggacctggatgatcaaaaggtgtcttttcacagatctgtaggtcaaatctttctcggtaatggaggtacaggtccttactcttcgcagatggctgacaagagaatagtatgatgtcactactactaaaaaggagaatccaataaatgtggttccaatgagacccgcaatctgagaaggtctggctcccagttccatctgccgattgtagcactggctctgtccttcttctgtagcctcgactactgagtagtatagggtaactggaataattatgacaagcacaactccccatatgtaaatacacattgttctggcaaagttgggctggcgaaatcttttcagtacgtgaccataaaacattctctcgtagcatgaggtggcctcttgcttggactcctttttcattaaggtagcatagcggcttatggcaatccagcttaaaattaagaggctgacaaacatacttacatgcatagaaagagttcccaaaaaattgaccagtctgcattgtacagattgatatttccaataaaaacctctcaagaaatatatacccatgaaaggcatagcagtgcacacaagtaagtttgcagtcacaagatttgccaagtagatatgtgttgatgttttcttacctatttttgttaaaaatacccactgagcaagtgagtttccaaagagaccaataataaacaaaaagatgtaagtgaccggtaaagctgtggtagaaatcacggatggttgaatgcatgtcgagttattagtcatttatattagattttcttgatttttgtcacaggagctagaatggaattatatatacttaatattaaaactaacaacaacaggcatttttggttttgatggagtgagaaaatccaggttggttcttaccttttctcgttgtcacagtggtctgcttaaagtaaaagcaacagtacttaaagcgatggataagtccttcgtctaaaaaaaaaaacaacaaaatttggtagaaatagttaattaaatgcctgagatttatcattcgtaggttagagaaatttatacttcttagattataaagcaatatgtaaatgattatagattttgcctagaaatctagaagcacaataaaaggacagtggtacaaatgtgggcacattaacagaccagtaaaacacatcactttataaggtgatttaagaattaataatttttattagaaagtttttatatttaagcttttattttttaaactaataagtaaaagctagtttttaattccaacattgattatatccagaaatccagaagtaaaccccattccagatgaacaaaatactcagacaagatcctgaataaagataaactccagaacctatggtcattacaaggtcatcagtaatctcccattccaaataatgctaaactctcacacttcaataaattacattatgtgtcaaaattatacttggtatgcttgatggctagagtaccctaacgtgtcctctaatatctgtggttttccagggtttgtttatttgatataggtttccaacccagcataaatgcaggcgtgggttttactttcttaaaaatgtatttttattttatgtgcctgagtgttttgcttgcatgtatgcccatgcattgtgtgcatcaatgcctgcagacttcagaagagagtatcagcttccttgggactagagttacagacagttgtgaattcctgaatggctgctgagattcacttaaccttggcttctctgaaagaccaaccagggctcttaactacctaggcacctctccagctctggtgtttccttttaagtcttccctgtgaataagtgagaaatcccagtcaagctctcttctttttcaccttacttactttttttcaggtgagaataacagaaaagttactaggttctggtcaaacaacaatcctgatttctatcttccaaagttgcagttataattaccaacttaataaattatatttattgatttttaaaggcacatgatttctctattttcaccattgacttttggggcaccatattttgcacacttttatgatttataggagagtttcttaatcttttgttaaccatcttctctcttttgatgatgaacataaaaaggtttttccacagagcatcttctgatctctgccctttcaggattgtattctctaccccacttcagcatcttggtcttattattttctgcatcttgaattgctttaaaattacattggattttattaaaaatgaggatcatttcataatacattatcattctgaaacaacttttaagccaatctcttacctaaatacttaaaaattttctgcattcaagtactgagaccctttatcaaggtctgccactatcttcactttatttctttacaatttttattcagaaactgcatcatatgtttcagagtgcctttatggataggagttgtagatactcttaatatcaaaccttaatctgtaaccttgctgatttcaaaattaggcaaataacaattgaaatgaaccagttcacttattaagaaaaatccccagccgggatgtggtggtgcaccctttaatcccagcactcgggaggcagaggcaggcggatttctgagttcaaggccagcctggtctacagtgtgagttccaaaacagccagagctacacagagaaaccctgcctcaaagaaagaaagaaagaaagaaagaaagaaagaaagaaagaaagaaagaaagaaagaaagaaagaaagaaagaaagaaagaaagaaaggaaggaaggaaggaaggaaggaaggaaggaaaagaggaggggaggggaggaaaggaaaggaaaggaaaggaaaggaaaggaaaggaaaggaaaggaaaggaaaggaaaggaaaggacaggacaggacaggacaggacaggacaggaagaaagaaaggtccccttctgttcaaaagaaatgttggttttactgaagggccaaagctttttttaagagatgaagcttcttttatgcaaagcttccagtagcctctgcctcatagagataatgcattccatgctgaaagcagcagaggttcctctatgaatatcagtagcaactattccctaatgaaagaagagcagaatactattacttagatgttaggtgatggtgagtctctataaaacaaataacaactcactccccatcttcagcttcccaaattcatgccccattcagtaacagcctttgattcaaaagctactagaaatttagttttaaaaatttgtaaaatgcaattaaacttgagaaggcaaataaaagtgagtcttacagaattgcttccaaggatatctctccaagtgtacattctcctcagcagaatgtctgtgtacacactgtgctaatttgacaaatgagaaaacttgtacaactctagcagttacttgtggctatttaaacacttcttgagctgactaccttatttaatgatcagatttcacaattcaaatagtttagtccttttagacacttacaaagttaacctttaagctaaaactgagcccccccccaaaaatcatccttacctgtctgagtagcttatgctcattgactgtttcacactcacagttctctgatcttcactcttccagtatccttaatcagtatgagtagagtcttgcatgacaccaagtacagtggggagaaaaagggaaattagattgttgaagaaagtcaacagttacagtaaatataaccagtacctccttaaaaaaaaaaaaacaaacacaaccctcatttctctatttctttagtgggaggaagttagtgggtaatacatatatttagtataaatatgtactgtataaataaatatatatgtagtatacttatgatgatttcatgaagtagttagctttattgttgtgattggctgaagttgcatttctaaggtttaatcacacatagctaattatttttctgtgagcatagtaaaaggaacttctttccagtaactcaataaaataccaacataaatttgtctctaaacttcactacaaaatcatttgtgaacagcttctttgcaatccatcttttctaagagtagaacaaaacaaaacttgaagttttcttatttataccggcttgctcaaatcaaatatcactaggctggattaaaattcatgctcatcagtggtctctgctgttttaagattgaaaaaaactgatgcccagagatgcttgctctctgtgtgctcagagtatatatagggactagaacccagtttggttactaataaacaacttttctctacttctaattggcatgttctacctccatttggagttgtaataatgagtacatgagttagaacattttatgatggattttggaggtagcaaatgtgtttcaaaacaaattaatagttatagcatgtagtctgaactgaccataaccgaaggctaaatgtgcatttagcactgaccactgagcaacctgcatccccagcccagttctgccaattcttgtttccaaacccaagtccacctcatttgcttaccactcgtctagtacgtagatgatgagaagttgggcttactcaaagattgatcctgagaagctggagagggcaaccatcagcaaagctctgtcttggagaattgggttataagaagggtaggaaagcctgggttatacagtcgaacgatgggcaggaggctctgtgcccattcccctgcccgcctctggctagaactgtaatcaaccttgaccttctgaaaatagctacaaacacattagttatctacaagttaacctccacagcaatttgtatgctttgtgttaactgatgcaggggattaaaagaacaaggagagctgcacattcagatgttatcagaaagtcaccaggagttggaggtgggggtgccaataaatccacaaattgtttggcaattaacatttttgtcatttaggtgagctcttctttagcacaaaggtaacttctggagaaggaaaggggaaggcacataatttctccctactgtcccactgtgtgttcattgtggcccatctccaggatgtttgcatagccggcaagccctttcctagacctgagttccccaagatggacaattccttaaaatggtggccattgctccattctcagaccattttggatttcactatcatacattttccttaaacagtacagttcactcaaatatttattggagtttctactacatttctagtagcacatggaggtcccagaagtataatgctaaccacaaactagagtgtcttcaaatccaaggaagatgtagatgtgatgtgtctgagaaataaaaacttagtgagttggtaaatcacaatggttcattaaaagaactgaaagggaagaacagagaatgtgtgatagatggtggtggaaaatgaggctcggggaagaaacgactcaagtgagacgactaggtaaatactataaaagattttctaagacagtaaacaatactctccagtagtagaaaaaagtaatggcaggaaatactaagctaacaaaaatattccttgtcatggagctatttcaagaatatcaaaccaagttgcaagttctctaggacatagtgtgcccctttggacttcgggatcacaaattttctctggctctttgtgttctcatctttctcctcttcagagtgcggtttcctttgtccacatgtaaatctccttatctgattacttctcagatcatctgcccaagcactctccagtacatactcttctgatccttctgatctgcctcaggtgatggttttaaatctggcccctggaattcctttggagtattttagtaagagtgatccaaaaggaaagctcattcagttttgcagcccatggtgagctgttgttactacctctatcaactttgaggggtgggtttgagggtcacttaccagtttccctcaaaaccaaaagcaggaggacatgagataccttagacttatctgaacttgtgtgtttcaaatgggaacttactttttggctctccaagctaatatctaaattggctacaactggacagtttaaaatttgtccatctgaccaatcagtagctcagggcattgagagggaagctattgtgcaagacaagaacacgtgtctaaatgtgtgcatattagaacaccattcttaatttccctcaaaggggaccacagtaagccttgttcatcagttcaatgcttacacaagccagttagctttagatgtgcagtgcagtcctgttactcaaagctgtggtttgttcaagttcagtgaaccttctgttctctttaggatgtggtatctggccatagccttgtttccagtgctactgctctcaggtcctcacattctactacaagaatctgtagtcgtggaagacccaagtgtaactagagttttaggataaaagcgctttctccagcaaccctaacaggctggccttggccacccatcttaatatgccaactcaagaagcaaatgacaaatcgtgaaaatcagagacaggagaggtaatcatgtgcacatcaaaaagaggaacagtgtctggtgaccccaaatccctctcagggtactgatatcagctgtagattagaggacaaattgaggcaaggaggcaagagttgtgcataattatacagccttagtcaaggtgtagccagtagtttgtgtgactcactgatcattgtctcagttatggttcagcaaaggtagtctgtaggctttcttattgttcaagggaacagggtggtccccaggagatgattgctcacactctagtcctcactggttaaatttcatcatctaggtgatagaatccaagggagtcctggtttaggataataactggatatctttaggcaccttttaggcatccggaacagaacatggtaaaaagctgacactaagatgccccctttagtcctgtctctgtgtccttggcctcaaaggacaatggaataagtgataatttgatagacactccttgagtgattcatattgaaagaagtagacaaagctaatgagccagattaaaagagatagatgcaaaatgaaggcagacacaccaggcttacactgtgcttttaggtccctgggggcctgaatgagaagtcagtggtttttaggactatcagggggcttttcccctctttttatggatgtgtacgtgtgttcatgtgtgtgcagttgcatgctcatatcatgtttcagaaccaaccattcttccctgtgggtactttgaaagccaaaggtaaagatgtaaatgagccagcaattcttgtgttactgcctgccgtgcctgtgctacctttgaagtgtacaaagaaacttattttctttccttaaaagcaggcattttagaaaataaggcatttgacaagagtctgggagaaatgtgacctatcacgaattaccacaagtaaacacatgcccatatcacaacacagcaactgggaatgcaaagagattacgatcatgtatcagtgcccagaattctccatgtttctttccaagaacaaggtcatcttatttctagccacttctttttaatttctcgataaaattgttttaagattaagactgtgtttgtgtccctttttgtctttactcaaggaggaggttatatcaatggccagggaaagagaattgggcacgaggtgttctttcctgtacctgttagtgtttgaattcaattgctcatattgagaacccccaaaattgaagtactgcagtttatgtgaactgctagaacaattgataacagccaggcatggcagcacaggtctttaatcccaacactctggaggcagaacagatggatctctctgactttgaggccagcctggtctacacagtttcaggtcaaacaagtctatataatgagaccttgtctcagaaagcaagcaagcgagggagggagggagggagagagagagggagggggaaagggagagagagaggagaggagaggagaggagaggagaggagaggagaggagaggagaggagaggagaggagaggagaggagagagtttgggtgatggtggcacacccctttaatcccaaggagatctctgtgagtttgaggccagcctgttctgctacacaaaaaaaccctgtctcaaaaaataccaaaatttgataataaatgacaaccacttaactatattttatatttatgtacatatatacatacatacatacatagaaggtttaagatatatcggagataaatgcttttatttcttcaacaggacaagcatatcatgtgttgtaacacaactagggcttgaattgatcccaagtgttaaaggttgtttatcctgactcacattagataagatagcactcatagaatctgttattttttattttattttaaaaggcatttcatataatatatttgtatcatatcctttcccatcctccaaatcctccctacccaaattcacattctctctccctccttcccctccctctcaactttgtctctttctgtctctctcaaaaaaagaaaagaaaactaaaacaaacaaaaactaagtaaataagataagtaacaacaaaaagacaaggtacccgtacaaaaagctgtttgggcgttgatgcttctgataaggtgaccaagtatctcatatctcctttgaccaaaaatagcttttacttatgtcaactttttatgtaatctgaagcttatattttgagatcctaaatttaatgttacccttttacacagtggattttagcagtcactgataattcctattaaattaggagtctcatccattggcacttgcatcttgatgcaaccttttgatatgtggaaataatttagagttgaaatcagtcactctagacaagtatacatacctggctgtttctaatattttcttgttgcctttattttaggaaaaaccaacctgaaatacctagtagaaaacaattggaaagaaaagctttgttacattttaacatggaacagctctgtaaagtgcttgcttctttagagctctggccagcagagggcagtatatcaccgcaacacagttctttttttttttttttttttttaaataatttgcttagtttccagctggaaatgactgcagtacaggctaggggaaatttttttttttaatattgagggttttgtccttttaagctctaagaaatctataaatttactttttctagtgcatgaaaaccactttaaaagtgataaagtgaaaataattttaaaacaacaaattctctcaagatgaaagcccagtgccactcatcagccatgaataggataaatcatttaaggcttggctttgtcttattttgttttaatgattatcatgagtcacgtttgtgaaatattcatgactctaattatcctggaggttaaaagaaagtctggcaagctgagtgtggtggggcacacctttattccctgcactcgggagacagatggatctatgtgaagctagcctggcttctaggacaacccaagccacatagtgagatcctacacccactgaaatgagaaaaaggaaaaagaaaaaaaaaacagtctaacattttagcatgggacaattttgtggtcaccttgtgggatttaacttctaaaataaaattatagcagctaatggatacagtttgaaaagtcaagtaatgctaaagggcttataatgaaaatagttaacaaatgtattttatagtacattttatcctctgaagaaagtactagaagcgatgccctttctcctccactgtcctcccttcttccagtagcaggccaactatgccgatacttcctcctcgaagtgcctcgcagcttagctctctacatcaggggcacatccagggttttatccccgagaacgtgtgctttgtcactaaagcttcagtcaccaccttccatcctgcatggatctctcacatgagtacacaactccctcatccctcctcacaaacaaaagagctggcaagaacatactgttttcattttcatctaccacatttctttgaatatgctttcacttttgatgacctgactaggcttttatatttttttccctttagtgcagtaaaatggctctctccctagggattaataaggtatgtgtagcttagagtccactgtttcctcagcaacattcctcaaaggaaagagaattatgctttgcaaagagacctcacatgtccaagtgctggaagtgtggaactgctttggttccttctcataccaaatgtatcacaaagctggccctttgtaattttcatctatgaatatctctttctgtgcttctagaacagcaatctagcttggcaagaaagctagaagaaaagcctaatcctgctagctctagaagtttatttgctccttagagctaggtattgtcactaacatctatagtaccacagcctgaaaggatgtagaaaaatggtcctttcagaaggttaagggagcagcccccacgcctctaggctgtacccatcactcaaggtttcactattatgagggtcataaatatccaatcattggatcaggagactcacttgctacttgactatcttctcttcctagttgccacacatacttggaaccatgtaatctttacccacaagatctgaccccatgtgtcctgtgtttttcaagccttgctggccacaaaggggaagtgaatataagcatgcatgcaaacctgtcagttccctttgcagccagctcaatgtcttcgcttaaaaatatagaggaaacggtgtttttcttctgagtacagactgaatttccccatacagatgagcatttctgcttctgacagatggagagggggtgtggaaaagaagagcgcatgcagttatgagaaaagggtcttaaaagagaaagtagggacacagagacaaaactgaactggggaagagaaaggtgctactgagtacaggaaagaaaaacagcaggagggagtgtccggggtgctaagaacatctcatttggaggacagcagtaagaggcaggaaggaaacagagaaaggaactgctattaaatgactctttgtaaagtctatgccagcaggattagcagaaggcatgaagaactttgatctagaaacttgcagttggccaatatttgaaaatagggtagactggccatgatggtattcacttagaatccctgaacttggaagactccgtcactagaatagcatgttgaacaccagcctgggctatgtaaagagttcctgcctccaaaagaacaaaagcaaaaataacacagcagagggcagaactctagggaagtgaccttgttgctattttccattgcaatatgaagactagttcagcgatccagattatacagaaaagtcaaggctcagatacatattaatgtatcttttggcatctgcccagataccctcacagtctttgcttgctgagccttagagtatggcctggctagcataaagcagaatctatctgctacatctccagaagctaggattcagttcgctttgtgagtttcttctagagttggcccacagtcactttcattgtatacctctctagatctcatgtttaccctcagcttccagctgtgtatttctgcctttcccctggtatttggctatttggataacttaccaaatattttctgattgctgggtacctcaggatcattcagccctcttaacaactctgagtgaggtccagcaattactcatgtttttctctgtaagagaaagaacgtgtccgaggcaacttataaatgatggagcaaatatttgaactcaggcagtcttttagcctgtctattttgctagctctctgttcattctttactgaagtgttattaagctctaagttgcatttggcctcaccaggcttcttcccatggtcatatcaataagtcacatattgtactccatatccattggccaaactaacccactggactgttggactaggcaatactgacattcccccacacagcttccccttaattttctttccttttctagagaaccactaattctttcccgtgacatgtttagtatttaatcaggacatctgatcaagacattgtgcttcttaaaagtatttttatgtaattatacacaagtgcttaggttttgtagttttaactctcagaaaacatttctatttttatgttctcaggggtccccacatttaatacctcagtactatttgtaagtaaaatgctaagatatcaaaaatatgatctgatctatgaatttgagagtccttgaggaatgtatattaagactagtgactagctagatttagtttttagttacttagttcctgactacagtttcccctccctcctttcttcctggtcccccactaccacctcccctctccacccacccatccactcatcctctatttctcttcagaaaggggcagccctctcatgggtatcaactagctacagtatatcaagttgcagtaagactagacaccttctctcctattaaggctagagaagtcaaccctgtagaaggaaagggtcccaaaggcaggcagcagagtcagagacagcccctgttcctactgttaggagtcccacaagaaaaccaaggtacacaactgtatcagatgtgcagagggcctaggtcagacccatgcaggctccctagttgttagtgggtccctatgaccccaggttagttgattctgtggattttcttgtagcattcttgatacctctgactcccacaatccttattcccccattaatgcaagattccacaagctccacctaatgtttgtctgtggtctctctgcatctgtttctatcagttgctaggtgaagcccctctgatgacaattgagctagacaccaacctatgcgtataacagaatatcattaggagtgtttcattgcttggttttttgtcagtcatgtttggttctgtcgtaggtctctaggttatctagcctcttgttcctggccctgcaggcagtatcaggggtggattccctctcatgctggatcagtcattggttggccactcccatactttctgtgccacctttaccccatgtaggtaggacaaattgtaggtcaaagttttgtggctgggttggtgtcccagtccctccactagaagtgttgactggttacaggagatgaccaattcaggctccatatcctctcttgctaggagtcttatgggctctatttattgataaagggtgttttttatttctttttattttgtccttgctattgttgcctggtagaaggagcctctgaactaagtataagtatatacaagttgaagttatttgtgacccatttcaacaagaaatgattgaggcccagaatatataaagaagcacttcaacaataaagaaagaaagttaagcaactgaggaggagggggaagtgaagctatgaacagaccattcacctaagagaaagcctacatgcaggaagtattacaaatgacactccattgccctagtgatcaggaaagtgcacactgaagccacaaggagatattatcttacacctatctgattgacaaaaagtagtgtgtgatgaaaccaagtgttagcgaggatgtgggcagctaggagctcatttctgcccacttgtgagactgggtgtataagtagtaaaattgctttggaaaattatcagaactgggatatgctgaaggccttcagtcttacagccaggcattgttgcttgaggggtcaactctaagggacctccatgcaaggacctttggcaagcagaagactgctcctactaacagaaaaactggaaaccacctatatgtccgttggtgggggaaatggagaaatgaactcatgttgttttgtgtcctataacacttcatctatgaaaagaaataaagcctttgtgctagacatagataagcataattacagtgggaaagagctatgaggtgataaaatagtagttacaccacatgtaaactttttttttttttaaaaagaaagtgtaagccaggcagtgcatgcctttaatcccagcacttgggaggcagaggcaggcggatttctgagttcaaggccagcctggtctacagagtgaattccaggacagccagggctatgcagagaaaccctgtctcaaaaaaaaaaaaaaaaaaaaaggaaggaaggaaggaaagtgtatcttgttatacacatgtgttataaaagtacaaaaaataaaccctccttacccaaggttaataatgcacacgtgtaaaaccccagtatgaccaaacagtaagataacaagttcaaggtcagcctatactacatatcatttttctgtttcaagaaaaaaaaacatagtttatatacatataaagtaaacttacacgtgaaattaccaaataagataagtaatggctaactgttgctcctgaactaatttcactgggtgaccaaagctaaaagtgacatatccaaactgcaactgaaaatctttttcagaactcattctgtgatgattctttacgtgttttatgaacttgaaaaaaattaaattagataaaatgtaccaatttatctttttttttaaaaagtatgctccgtgtgtctgggattgcagtgaattagctttcaagagtcaagtagagtttgtaaggtatacaaatgtaagacagccagaaagccagtcttgcaggtttggggatttgggcaccatacaattttgataaatgctaaaagtttttgcattaattgcatattaatattactaagttttgaggtggctggggttgtttgtttttagtaactatcatcttggaggcttagggaagtagatcagttgataaattgcttgctacacaaacagtaagacctggctctaatccccagcctggatataagtacacatttacttggattcctattttgttgcttgtaagcataaaggaagaaaataagaggcaaaatggaatttaggacaaacctgtttccataactagaaccattgctcccaccaccaagtcttcatctggaaacccaaactgagctaagacattacagcagccattcatccaagcataacctagacatttctctataaggattgctatcattgcattaatagaaaactatttcccatcctcagatgatttagccatctatgttttttttttaacaactaacttctttatttacaactaacttttaattccatttaaatttcctttggtgtggtacaaggtgaggatataatttggctttttattttaaatttgcacaacactatttattaaaccatctcttccttcttgaagctctttgcagtggttcctttatttgcaatgattttctctcagggaaagggatgtgtaagagttaccttagaagcttttcaaaactatgcgcaccataagtaacaaagctttaggttttcctctgattagttcctacccacttctgagtgtcagtcacatgccaatactctcctcacatcaccaagggtctgcttcaggtgtatattccattcccctcgtaagtttctctgcatttactcccttgtttgtttgttttttaaatcgaaggttacaaatgtatttaatacaaataaagtaagtttctatcatcagattaagtatcccttatccgaaatgtttaggactataagtgtttccgttttcggagttattctgatctaggaatatcttcacagactttactggttgaacattcctaccctaaaattccagtatgtaaaatttttaaatatttcagattttggagcattttaactttcaggttttgaaattcggcattctgagtatgtactttagaaacctaaaaaataataattctgcagcattcatattgtctcttgaaattttcctacttttgtgttttctgggtaactttaaataggctttggttgaaattgttgtaatttgattagttctatttttgtataagcaggataaccaaagcttatatagaattgttttttctaagatggtggagacagacaccatctagcctggctctgtgcataatactttccaaaaactaacagcagtgcttagtactgagatgtcactcagggagccaggcagttcatgttgcccttatatggcattgtacatgtgagatagtatttggaagcttattctgtctgaagatcttttgtaaggtgaagatatgcatgtacttctgaatttccttttctgtgtatatgtagaactaagccttgtgttggcagttggaaagtcagtatttcctaagtacatacaccaatgatcactaagacattatatgtgataaatatctctaaatttagtgagtcggtagcatgctttttattaaattctagaactctccagattcaggctaatttaaaggatgtttaaaaatgaaatttctatcagtaaaaaaaaattacaggattactataatcaaattttactttattacagttaacataagttaattcagtaaaacattttcaaatattttatagagatcatcgtttaatatagatagtaagatcacttctagagctatgagtattttattttaatgttcctgaacattatattaactgatgataatatagtttgtgtgtgatacatgcatgtgtacgggcatgtgtctgtgtgtgtggtgtgtatggttgtacatgcacatgtgttctgatgtgtgcagaggccagaggagaacagtaggtgccctgctctatgtatctgccaagtcacctggccatcaagttcccaggatatgttccaccccatgtgctttggttacagctgtgacccactgtcttagatacagttaccattgctgtgatgaaacatcatgaccaaaagcaacttggggagggaagggtttatctggattatgagcttccacatcacttcatttttgaaggaagtcagggcagaaactcaagcaaaacaggaacctggagcctggagccaaagcagagaccatggaggttgatgcttatggcatcctcagcctgtttcttatagaacctaggactacctgcccaggggtatccccacccacaatgggctggacctgcccccatcagtcactaattaagaaaatgcctataggttatcctacagctcgatctttttctcaagacattttctcaattgaggctccctcatctctgatgactagtttatgtcaaaaagacataaactagcaagtacactgagccatctgtacagctcttgataacatttaaactgtgtttcttaatgtgacattaaaaggtagggaatgcttaccactgataggatccaagttttcattatttaagattacacaaacagttactaaatttaatttagatattatctgataccattgtcaggacaccaactaaaattgttttaacactttttataagcctctaatagtttttatcgacaaatgttatttgtatttccagatatacttctgcttgacctattcttttttgtttggttggtttttggttttttggttttatggagacagggtttcttctctgtgtagccctggctgtcctggaactcactctgtagaccaggctggcctcaaactcagaaatccgcctgcctctacctcccaagtgctgggattaaaggcatgcgccaccacgccaggcttaacctattctttattcaacctgtttatgcactttctgaaatatagtgccaaatgaaactgagtgctacaactatatacaagcaaatctcattgagatcaggcccaaccaaaaatctgcatgcttttttctcatccaagttattttttgcagtttttaaaaattatatcatttctccctccctctcttccaactaacccatcctatatccccacctcactccctcttattcatttcattattattcttacatatatgtgtaaatatgtaattttgtaaatacagcatactgtttaatgttgcttgtgttgtatatattttcaaggttaagcacttggtattggataaccaattagaggcacctccctgaggacaactagtttttttctctcttggcaatcactgttacctttacttcttcatctaagggtttggccttatgacatttccctcatccacattgacaaatcaactggtgttgtagttattaaatcttgcttaagcaaccatattgttgagacttcttaggtatatcttctgtgtcctatctagaagcaaatattctgatcttctggttcttaaatttttcactttcctcttctacaatgttccttgagccttatgtgtatgggttttgttgtagatttatcagttggggctaggcagcccatgatcagttgatgtctgcattttgacaagatggtgcttttggtaatagtctctgtctgatacaaaagaagcttctttgaggggcaagagccacttatctgtatatataaggagtatttagaatgccactggatctgacctgaaagctttatccttgaggattagttttcatagtactggaaagtacattacaagctgccttgagaggaatacaaccaatagtcctacccagctatgacacctattagccacaacaatgaccagcatagcaacatatctctaaaggtgcaatagtggcacatattttggtagtaaccaacagctttctaattgggcttaaggcagcagggaaactatgcctgatactgtaaacttagagctaacaagatcataggtcttagagaagaacctgctactgccactttccttaaaccagtataattcataactgcattctaaatttttagtgctttatgacattgttttccagccactggcttaacttgagttttaagacatattctaggctggacatgacatatacctttaaccccaacacttgggaggcaaaggcatgtgatgtgatctctgtaacttcaaggccagtttggtctacatagtgagttccaggccagccagggctccatagtaagactcctcaaaaaagaaggaggaagaagaagaggaagaggaggagttgtcgttgtcatctatgtgtaaaactaactatgttggaagagtgttaagagtaccaaagcattctgatttttaaataaaattccatattctgtgatagaaacttaatcaaagattcatggagtttgttacagcggtcttttatatattcagacaatggcattctggttctgtgtttagcaagatcaaaacctacacaaacactggccaaattttttttcagtttctctaaggacacctcctgtctggattgcaatgtataatgtttcttcagctctatccagaataatgactggaaaagctaattagcctattttttcttttacatcttttcctccccatcttatttgttcatctatcttttcttcctttgttcactcaactactcggaaaatattgcttctgacttgccaaactacactgacctaggagtcagtgatgagtcccttctttttactctgtgttcttgaacatacatgaagttttctgtttgcgccttttaatgtcaaactccaggttttctgtattgtcaggaaatgtttcactcagaaatttatcagactagcacttatgtacctgggtttaatatacattaagcttttaccatgtttgtgccaaagtcttcacatgtgaccattaagtttaaattggtctgtatgatatatatgttatcattcatgctttgatttttttatttatatggacgtaaagaaaatgataatgttttaatattttacataaatgatttcatatagtccatacctttttactcttgggtatggttttctttcctgttcaatactattttttattcgatactatttttttaatgtgtatggatgtttacattgccccaggatgccagaagagaatccactgaaactggagttacaaatggttgtgagctaccatgtatgtgctgggaatcaaacccaagtcttccgaagaataccagggcttcaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagctacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacatttttccctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcagaggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaatccttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaattagaaggagcaatttgcaaattcatctggaataacaaaaaaccaaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtggaattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcccaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaagatggaccatgtagagactgccatatccagggatccaccccataatcagcatccaaacgctgacaccattgcatatactagcaagattttatcgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaaaaaaaaaaagaataccagggctttacatttctccagcccattcaatacgatttttgctatgttcccatgtctgatgtgtatgtgttgaattgaagtgttaaaggtatttcatgtggtaaaccacagtttatttctttctgcttttacttgtacatccttaagtgttctgagtgatgagtatcattgtatatatgctcgtatgtatgtatctgcatgctcctgtaagagatgtacctgcagtgaacttgctggtcatatcatcacgtgtacagtctgtgtctcactgtatcaaagtgtgaagtggatggataatttatgaatgtgcattaagtcattccttttgccaggctatcatgttcttagcttgactgtttgctatttaaattcttcacatttttttttctaagcagcaatagtgcgcagtctcacttttattagaattttattattttcatctgttagcagagatttagacataaatgaatatagcatcaagtgatgtaagattttgaagtaatactcatgttcactgacatttcaactcagtccccagattactttatttttagacatatttaaaattagtattaagtgcctaactttagtaactctttagtgacttggaaaaaaaaaacaatgacatttcatctgttttgttgttaaatccatgaacttcacttaacattgtaaccgttgttaaaagtgttagcttaacaatgtattctgtgaaaattctacatacagttctaaaatctagggattaatgtaagcttttctttgctttgaactactttgcaattaagcaagtgaaagatcacttctaaagatctgagttttgggcatattaggactttgttcgataattttaccaacctcaagaaatgaagagactgttttatatcattcattttagtacatttgcctcaattacccttagtgctgtactggggcattttgactgtcacggacagatcatgcaaggaatgtcctggcttaaattctgaagtgctttcacttctgcttgcttcactttgaaaccttctaaaaagaagttgacacatgattttgcgaatattactggacatcaggaaatacatgacaggatccaggcaactgttgaaagaggagaaaaccagcatgatctcgttagttttgtgaatgatttccttccaataacaagaggacacatttagctgtgaagaaatgtaaatgaaccgaaaggcatggtaaggcacaaagcatatagtaaaaatgatcagtacaataaaggagttccgggctgttgtagcatatttgccagagtttggaaattttgacctccgtttagaaatcctcagtagattcttgccaatcttaatatatgagaggattatcagtaggaaaataagccagaacattactacaagaacaaagttaaaaattgcttctccctttgcattatgtctgtctctgtaatggaaacacattgtggaattatgacctcccttcttcagtgtcaaaatgatcatagttagaaatccagcaagagcaaccgtccatactatacagcaaacataaatactttgcttggtggttattgcccttctttgttgtatagaccgattgatttttatatagcgatccaaactgataaacccaagcaaaataatgctaatgtacatgttcatgtaaaatagtgtccccacaactttacaaagaatcacacctagtgtccacttgttttggttgatgtgatacattatgcggaaagggaggcagaagatgagtagaaggtctgcaacagccacattaagtagataaatttgaatggaatttcttttacggtgaatgcccagaaatacatagagggcaatgatgtttccaaccagtcccacgaggaatataacagagtagaaggttgttaacacagtagatagtaatttttcatccattggacagctagtgacatttggcactcctgagaaattttgtgaggcttggtcactataattagttataaagtgcattccatgagaggagcaaagccagctgtcaactgaagtagtagtcattgttacagtgtgacttctcaacgtcttctgtaactatcaggaggagagctaaatgacatgctctttgtacttctttgtgtcttcagattttcctacaacagaaagccaaacattgagtcatttgctgtgataatgacagctactttaacataaagcatagataaggatttcgtttcagacctaaattctacttggttctattttgctatctacacatgcattattgcatcacaaaacagcagtaaatatggtaggatctctctaaccttttctgttgctgtggcatgctcatttcatttattatattaaagtaaataattgaaagaaaaaataaataattgaaacatatgataatattttcttagagatactgttttaggactagaaatagtcaaaagaaacagcagctcctattttttaaggatgaatctcaatgtcccataaaggtgcttctagccatgagtgagctgggtcccttcctgatcctgcttgactttaggaatgcttcctgttctgcccagtcccctcatagctggcatccattcattttgatatatgttgtcgtggtagtgatgtaccttttcacagtaagagtaagaaaggggaccctaaatttccttcttcacctaagaccaagataggagtattaaaattacttatctatagaaatatgcagttccaaaacagaccaaggtggcacctgcctcctttcagagattcttgtagcacttcaccagagaccatactggtcaaataaaaccagatcagatagcagatagctgacagtaaacctctgccagcctagaagcataggacagtaatatagatgggaaactaactaaacattaattttaccctgggttatatcatttgagattgtcaccagaaccttcttaagtatgtcaattttacttgttcccagtgctacttgctattgaacaattcttaggcatttgacttttgggacctacaatatatgtaaggagaattcaagaaggtctcctcacattcttttcttagagcaactgccctgtttatctgtaaatcccttccgtgggtgtaagatagagtacagatgagacagctcagaagagttaaggaacgttgtgccaagcttaactacctgaaactgatctccagacagaagaagagaactgtccccacaagttgttctctgacttccagatgtatgtagtagcacatacttgtcacaaacaaacaaacaaaaagtaaatacttcaaagcaggactttcgaaattatatttaacttcataatcaaagataaatgatcattactaagcctattttctcatatgttaaaaatgcaaagttttgccgggcgtgatggcgcacgcctttagtcctagcactcaggaggcagaggcaagcagatttctgagttcgaggccagccagggctatacagagaaaccttgtctcgaaaaaacaaacaaacaaacaaacaaacaaacaaacaaatgaaaagtttttatgtgaaacacttaaccccgatgcatagtaagtactcaaaatagttgtctttaggcctgggtcttgtagctcagtgatagaacacttgcctagtatgtgtgcaatcctggtttaggtctcagcactgaaaaaaaaaaaaaaaacctaactttaaaaaactaggtacctaatgatcaatctaaacattatatatttgtttaaatactgcttggctattacgaccaatattaacaatattgcatattaacaatattaagacagagaccctgttctcagtaatcagttttagaggactgtatgttgaaaccctaaatgcagtataataaagtgtagatttttttgactcagggtttctttatgtagctctggctgtcttggaacttactttgtacatcaggctgactgtaaacatccgcatttctgtatctcctgaatgctgggattaaaggaatgcaccaccatccagctataaagggtagatcttaattatgataattaatttttcatgttgtcattgttttatggtactgaggattgaacccaaaaccttgcacatagtaggcaaacattctaccactgaatcacatctcagcacaatggatttttcagttttttcttccttttaaaattaagcagttttagtatacaaaatgtatttcactaaatatggcattttatacatttgttttattgtgcttccactctcctctgcccattgtctgcttccctcccccagattgtacctctgtgctgtgatgtcatatggatggataggtatttaactgtataatcctcatgaaagaaaacattcagtctttgtgtttcttcaccttcattatttctccttgttctacctcccttagatccattcctctcccacaacctccttctgttatatttttatatctagattctatatatgaccatgtaacatttgtctttgcataatcaatttcttgattggatgttatatagagagaaaatatttggaaaaatgtagcctctcttaaaactatattttggtcaagtacaggcttttagtagaaagtagcgttcagctttgaatgtttacagactgaaggcaggtcttggtttcaaggaagaggaagtggctggtgaggaggaagttctgttaagccatcttgagaaaggtctccacaatttaggactatggaaggagaaagagagaagggcactgggaggaagggagaaaggaatgaaggaagagctggggctgtgttgcagatgcaggaagacagatttcacaatgcttgtagaaacatccaggcctgtttcttgtgatctgaaacttaaaaggaagaaacaatctaggaaaggtagcaggctgctgatacttcaaagtacattgtcagtaatgggaagagaaacctgtgctgtgtggttgcacaggaagcactcagaggctcagatagaaacatccataggtgaaaggatactgagattcaagtgataagactcaagaaggtgaattgacttggaataggcatctgtaagtagtttttcttcctcataaagtttaaaccctattaggattaagaaccaagttcgttttgtttgcctctctgtgtaccaggtatttagcacaataaatattactgaatgaaagaaggagtttggaaaagtagatgtaaagtgttaaaagtacaagtactggaagcttcaactgtattcacaataacacaattccctgtcctctatcagcaatgtaatataaccattacaaaaactaaccccatctttggtttaactcaaacttctgtggtattttaaataaaaattgttactgctgacctgaattctgtctcaagctaatagtctcccctaaaatatctttttttattaatcatccccagtggtatacttaagaaagaccatgcaccaaacaagaagtagaattcagatattgtagatataagttgaaggaaataggcacattaacctatagatgaaaatgttttgcaaggccatgaagagggtctccccttcttattcatgtgtgcagagatccaagcaaggacaagtactggaaaagtgcagagacaggtattgtctccttgtgaggtaatgcttttgcagaatgaagcagtctagctcagaaagtactaagtcttcaagctagagacccaaagctgcagcgctctataggagggattctcagtggtactctagtctgtagatgagcatgtctttgaagataccaatgtctagcttcttcccagataccctgatacagttgttctggaatgggtttgatacgctggtttaaaaattcatgagaggtagccagtgtgtactcaaaattgaacacttgagctaaatggtcaaatgatcaattagtcattatttagcacttactgtgatccagatactatttaaacacatgatataatttcttttatatagtcttttttttaaaaagaacttctatttagtttatgtatgtgagtacactgcagttgtcttcagacatcccagaagagggcatcagatcccattacagagggttgtgagccaccatgtgagaattgaactcaggacctctggaagagcagttagtgctcttaaccactgagccacctctctggctctatatagtatttataatagtgtgtaagataaggaaagagtcataggtactgtggtctcagagctcttaagtggtagtacccaagttggggctcaactctgactctcaaagaccctgaaccgccttggtaaacttcacttctatcataactgatcaccgtttccttactaatgttaaattctatcaactaaagtagtttaagaggattcctttaccactatctactttagttgttttatgaagaggttgtactgtctagctttgctcctctggaagttattaatctttccatttgctaggtccataacaatatgcaagtaaacctagatttcatggaatcaaatcattaatcagaatttcttatttctgggccaaagagcaataatcaaaatgtttctaggaagatatcagtgcagagaacatatcccgagaccatttcttcaactctagtattcaagtaaaattaagtgatcaataataatagttggacaaaagcacgattagtgatgctgctagtgtcaagttggagaataaagcaaaagccgtgttgtttcaacaacaacagaagcatggcatacagtgccagatagtacctggccagcagcaagtgatttatcaatcaattcacaagttacagcctgtctcaaatttggtaactagtgtcacctttaaagtaaattgggagctgggcttggtagttcatgtatgccagcaatcatagttccttttgagtccagggcaggagaatcacaagtttacagcaatgttgtctaacttagtgagaccctgcctcaaaagaacaagttaaaagagggccaggaacatatctaaatggtagagcggttgcctagaagtacaaagcccttggagtttgatatccaatactgcaaaagcaaggaagtaaatgagtcatccataagtcatctggtatgttggtatcattcactcagtgatcatcatcaccaccatcatcagtattataattaatttggggaggtcaagacagagtttctctgtgtagccctgactgtcctggaactcaaactcaaagagcaatctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctctgcctcccaagtgctgggattaaaggcatgcaccatcacacctggattcactaattattcttaaggctacttattcatattttacttgttcgctataagaatttgccagtgaagatgagaaataagtgagcatagcctgttggcatggcagagctgacttgtagctcatacagtagtcccactcattctctaatagcaggtagtgtttgttactcagcaagccccattcctgtttgcagccctaagtgagcacttgtaccccaactgccaccatcctacctcccagattttcttcagtggctgtagccaagaaaagatcatgtaacatgttatttgggtgttatttctatcaatatcatgtgctgaaatacatacctatttgacaatggacttataataatgactgaatctattcaggccatacttcagaagctgcaggaactgctgcatacagaacaattgaaagcatgttacttgaaaaataacgatattagtactatatttagttttgttataaacttaactgtttacttttaattgtttgaattaatttttaaaaatatattgtggtttatttttcttttctagagtattctctttatttagttccaaaacatgaaacttaaattgtaactggtctgtaccataagataataaaaatataataaaaatgtttaagatggggaaacagtatagcattgtgaagtcaagagataataaataggaaatctgtagtatattgcaattaaatttactatgtctgaaaataactttagttgattcaaatacaactgcaaataattatgactacgcaatgccaataaacaatgtgaccattgttcttagttattctatccaaaaagaagtctcctttgaaaagcaaaggtgtcgtccaaagcagtttactcagtgactctaaaaaacagagatttgctgaaagcagaatagtgttaccagcatacatcgagcttcactctgaacattcaaataatcaagttttaactaaaacaaaggctgctgtgtgtggcttttaaaaatcagagaatacttacagttgaagctttcctgaagtaaaaggagtaaacccaaaactccctagaccaggttgtgtcagctgggctcttccatccggtggtggtggtgcaattggctagagttctcttcttttttatatccacatgtggtacagttgtttttccccttttctttctcttttcactgtgacagcccttgggtcccgtttggagctaagaaaagataccactcttagcaacagcttcaagttgaagtttaggaaattgcatcttctgtatgagtcccttctagcctaaactaaagagcatttgtcccctaagatgccaacaaactataaaatacaatcagaagtgggcagatgctctctttcctaagaaatgatgagtgatgtcctgtatggattttagaatataacccctgaatttccatttccttccagattcattttagaagttactaccatcatgaagtatatgaactttctgccccaaagtatactagcattgctaatagttggcttttgttttgttttgtttttactctttggttctgctgaagttttatttactctctatattattttagtatcattttgtatcttccttaaagaccatggattcatttcctaaaacatcttaaaatttggagactaggtgggatttgtagcactattttcgcctcagcacaatagtaaactcacccaagtaagccgaagtgctctctcctatttcaaggaaaagatgctgaggctctgcagcttccattctggtcacagtccactgtttaaccaccatcaattcatctgtgttactgctggccctgcactcgagtgtcatttccccttttggttgttgtttggaacatgattgttatcctccagctttgtctaaatctaacattgtaagtatttctggaaatattcttctgaacttcatagtccccagaacttttagtttagttttttgaagaatcataacatgtgagaccataattttacattgttagaataaaagtattttataactcttacttccccctgagaatctctgagcaggaagatggttactgtatctgtccagcagtattttttttcttactgtggtaagcgacacataccactagatttaccacatagccagttttgactctatcatgcagtgctgctcagtgtacatataccatcaggcagcagatcaccataacatttttatgatgcaaaattaaacctctaaaccctctatacacgaattttctctgcccctagtcttaacattggcaaccatgattctgtgacattgagttccattataaaacctttttgtgacttgtttattttacttagcctactatcattgaggttcacctataacgtgtaacctaatttcctttgtttttaaggctgcatatttccaatgtttgcctatacttcgttttctttattatctttcaataagcatgtaaattttctctgctttggggcaattatgaatattgcaatattgctgcaaccaacatgaatatgcaaatatttctaagattctgtcaggattttcatgactaaatgagtcataatgtgctttttatctcctgaaatacaatataaatactagttttgtattgtactattgtcctacacttatgacatcccatttcaaaattgcttttcagcttttagtgttctcatattgtagccacattttctcgctgatgtaaggtttgaatattatgttctagttcctgatcattctgaactttgtcaccattccttcattatgtgaaacccaaccctagtgaagttcagcttgccacctcttccagttctgaacctccccagtgaagatgaggactgctggctacaagcacacagccatacagaatagcctatcttcagattggcaatccaaaaccttaaggggccctgcactgccagaaatccttagtgtgaattctaatgtccttagtcccgtaattctcaaaggatgacttccagaccagtagcaaagtgggatcagggggagggggagggtataggggattttcaaagagaaaactaggaaagggggtagcacttgaaatgtaaatgaaaaaaactctaataaaaaattcttcatatatatatatatgtgtgtgtgtgtgtgtgtgtgtgtgtgtgtgtgtagtcccacatatatatatatctcattcagaagcttgcaactgaagttcatctagacccaagagtctgtgtgattctggagttaaaatgtaagggccattgccctagttaatcctccctcagaaatagcttttcacacctttgaccttctcaaactgccagcaacctcatttccttccccactctcagctaggagttgctttttgtttctctaattaaagagaaacccttagaaaggaacctcctctatatctacaggcacattacaggaaaggtctgtatgtctctatgtatgttatttcttacttttaatatcctacaaagaaggagggaaatattgaagcataatcaaagaaaagaaaaattagacctctgaatataatttgttttgcaattttgagtttggaagtacagacatgttttctgtaattaaaaccccaaactgtacaagtctaattaaactaaatgagcctcattatatgacaaaataaaagcataaccacatgaagaagttattttaggttcctttaaaataggattgggggtcaggacatacttttagacttatgaaaaagctacattatacagcacagtaatcaaaattgggaaatttatattaaaacaataccattatatatttgacaatccttgttacaaatttcatcagctgccctaataatatttttagagcaaaaataaaaagatgacatttatctgtgatacatctttagtttcactgaaatccttgagtccaaagctagttttgaagagcataagcctgctactttctagaatgtctctattattagatctgactgcactgtttgccaaggataccacaacattatttttaagtcctctgttagaggctctgaacttggtaaataagtgaaattttatgattggtttttgaatacttaaacaaagagtaacaaatgaagctaaataaaacaagaatggcagaagggtggttcagctgataaaggtgagtgccaccaagcctggtgactaagtgtgatccccagaacctacacggtggaaagaaagaactgacatgtacaagttgtcctttgacatggcacacaattatgcacacaaggacatacacacaagagtgtaataaaaagctttggagaataagaggatttgttcatacaaggtgataggtatgtggaagtttattcattttcctgcaattgtgttacactgttgaaaaggggtttcttcaattccacatgatcctctcgctgcatcccctgcctccattcctagcacagaaaactttgaaacttatctttacttactgtctccacacccattccctgcagaacctagaccaatggacatttttatgtctatcatgccaccaataccacttttgtcattggtactattgacttccaaactgccaaagctaatcatctgttctcacttctcaatttaaatggctgtagtaacactgatcactactaagcatttcttcttgacaaaaatgtctttccattggcttctgagatgcaaactctgatgctcaccttgtttccctgtctgaccattggtttccatttgctagattcttctgatctttctgccctccatttacccactgagacccaactcccatcgtcttctctaatagtagtcactccctcagaaacttcattcattcattatcttggctgttgatccccaaattcacatctctaatcccagctcctatcctaccctatcttataaaactgaataatagtctgtctttcaaactcttcccctagaattctccatttcagtaagtagtatctttatcttcactccaaggctcattgcaagaacctgcttctcaggcttgacctcctctttcaatgtatccatcagcagctcctgccagctttacctttagaacagaagttcttgccatcgctccatagcaccatcctctcatgtctaagcagctcagggggctcttttttctcattcctgtttctgtagttactggtctgcagagtactcaggatgatcctttctaaaccccaaagtgattacagtgctcactcttcagagtctccgggtagttttccatcatgatcagtgtgaaatccagtgtgaaatccagtgtgaaatccagtgttgaccatggttttaaggatgtgtgatcacattttctaccactctgcctttgcttattctttcctagctatccttcatatgtcttcatatccttgatatgtcttcatacatatcaagcctctgcacatatctagacctttgcagttattaacttctctgcccagagtttgcttccatgtggcttgctttttttttctctcctcaccctagtctctgtttggattttgtcacaataagaagggctcctatgacacccaccaaataaaatagcagttccctaattttacattatatgctttgggcttattctctctccatttgtatctatggatatagttttttttttaacctggagttcaaattttatcactcttgacagataattgaaaatggcagaatccacatagtgatgagaatttcatagattacagtttaacattaacttcagaagacataatcaacagactatgaagagtgtaccatgagcttctgaccctaggaaggtgataagatgcttccaccgatgtgaccaagagaccctatttgggtctaagctataattttccccctgcatcatgcccatgatttctcaggcatgcaggagctaggaaagagctctgcactgagcagcatccacagctcgcatacattcttctcactgctttgtcatgacagtttgttcactattcatctgtataccagcttttccttccttccttccttccttccttccttccttccttccttccttccttccttccttccttcctgttgttctcatatactatgcacacttctattagaggattcatctttctttatgacagactatgtacttttccacagtagatttctgatgttctcattaggaagaataagatccttcccactcccatttatatcaccatcaatatctgtgtgggtacactagctcagttttgttgtacagagtggtgggggcctttgtttcaaggcaactttcttatcacctaaactttaaaatgataccaattcccagcacacatactgggtggcttacaagtacttgtaaatccatcatataaagagagaataaaaagtgtcataacttaaaaggcttgtctttttatatttgagaatcatccaaatgtactgttaggtgtgtcagagaatagagtatgtgagcagacaccaaaggtcactactactacgttcttctctgacaccacctccaacaaacttccatagagaaatagatgaagataagatcccatgggaaagcacattgttaccacaaggtaggaaggaaagcagatccacaggcaatgcccagaaagaaatccctgggaacacagctcaattcaagttagtaaaacccaacatccacaccttccatcccagcacttgggacccagaggcaggcagatcgctgtaagtttgaagccatcctggtctacactacaagttccaggacagccagagttacataatgagaccctgtctcaaacaacaacaacaaaatagccatttgatattcctattactctggggtagaaaacataaagaaaagaaagaagatggggaaggtgagcaaagaaaagaccattggcattccctaagggtcaaagtgtagtgactttaaataaaagcacttatgtagcaggaagaagcatgccatgcatttctgctgaaacaaatataaactttaaatcaaatacagagactattacacacacacacacacacacacacacacacaaagaaagtatatctgcacttgtagaatacccatgctttctgggtgataatcttggaaacaaataattcctaaagtctttagagaaagaatttagaagtgagaaaaggacaaagaacttaagcatataaaataattcaaatgcttttatttattatttattttttttaaatttgggacaaggtttctcagtgtagtcctaggtgtatggaactcatacacctgcttgcctctgccccccttgtgctaggattaaaggtttgcaccaccactgctcagcttcagaaacttttttaaaattgaaatttgtttttataataggtgtcttaatacatgtagtttttattttagggagggttgagaggatcaggaagcaatttgtaggagtctccactttgtgagtcccaagttgtcagacttggtggcaagtacttttaccctctgagccatcttgccaaaccaatttccaagttttgttttgtttttaagtacaactatattgtattatttagttttatgcaaattgaactcttttgcattaaattttatctttgatttgattgttgcttttttttcttttcagccccactgtgttctccttgcctcaaaagaaaactcggcacctgttaaacttgggggctttggggtggccattcagttaggagaatctggacttgttgctggaggtaagaccactttaacatgctcccccttcaaaacctgggtggtatgtatgaagattggaaggaaggatagctgggaaagaacgagcaaaggcagggtggtagaaaatgtgatcagacatccttaaaaccatggtcaacactggatttcacactgatcatgatggaaaactacccggagactctgaagagtgagcactgtaatcatagtgcacaaagagcttaccatttggaaattgaactggacaaataaagtcacctctagtataaatgggtttgccttttaggatcacagcatgcctaagcttaaatttcctaccattttcctttttctatatatcaaagaagcctgctaaagtcatcagcctatgtgtctgtgaagagcaaatggaaaagaataacaaggctggttttctcattaaccaaaacaaaacatgattttaaaatgcctgtgccatagtagaaagtgaaatttttcaccagagtacagaagtggatgctaattcagattccactattgtagagtttttatgaattcttttccagaattcagaccacagcagtgcccagggtttacttctatttcttagttttgcaaattgcagttctccattctgtactgctggtgtaggcagtgctccgaatactaacagcttcacgaggaatcaaaacttcatgaagcatatcctttagcatagagtcttcaagtcaatttgccaaccttcagaaaacctctgttaagccaggtgtggtgatgtacacacagaatctcagcgcttaggagactgaggcaagaagattgctttgagtctaagaccagccttgagaacctagcaagatactatcccataaaagaaaatgaaacaaatgctcatgttaaattcaaatgctttccaaaccctaacttttaaaatagctgtctgtttcacaagatagttcgttcaatttgattgtggctagagcatcaagcagtaataacaatggccatcttctgaaaaatgagcctgaattatacttgtattttaaaaatcactctctgccacactgctctctgagattaaattgtgttaagatctaatcttacatacttttctagctaagtatttcctgtaaacatgggaataagagaaaatgagccacagtccttttatgttatatgctaagatgattttgtgtctgttactctggatctccattctgttcatattcattgtagcatagactatttcacaaatcttgatgggggtagattcactaagtttgcctccatgttcacctcttttcctaaagactataaactcatcctctaatttttattttttcaacaatattgaactcacatgttcattattcaaaaattactatttttatactctaaaaaggttttattttacattgagaaagaattttatatggtccagagtggcctccaagttgttaaagagttgaagatctgaacttgtggtcctcctgactccatgcctgaacagtaggattacagatacaccatcacacccagttgttggcgctgggggtgagactcagggtttggacatgctaggcagggactctgctaagctgcaccctagtcctaaagtactttctggtagttaaaatattgtcatttcttaatgtacctttccatatacctttcaaataactattttaaagattacagtactttaaaaaacacaatgtgaataggtaagagatacatgattttccataggaaaaaaagcttttcttctgtttaaagtacttttgaaattttactaatatttatcaattttggaacagaaagctcttttcctgtagattggaatctttgactacctgggcttccaaagagaaaaagattatcttcctttacatgttctacataccaaaaccatgtaactccattgcatttcccctatctaacattcaactgtttagagaatccacttactctgaatacaatgtagaaaacaattacagtgtagtaaaactggttacccttaaaaagtcctctccattgaaaactaactacatacataggagactgccttcctctgcttttcattaaattgtatagatttgtgtcccctcataatttgcacctcctattccatttgcttagaatgcctattgtcattttatctgtcgcatttaggtgtttgcttgaagactaagctaacaattattgccttttaaaagcaagcctattataactgccctagttatatgacctatcccctcttccatctaaccagaactatctagcttgcttacttcctaacaaaatgtgatcaaacatgtaatagcagcaaaggcaagagtgagtggtaggagagccatggctcatccctccaaatatctgccccagctatcacagtgcctaggtcctggcacgcactctagaaatgtttaaatgaaagactagtggctagccattttccagtcagtagcagattataagcaacaaatcaagacatgccaggacttgagaaagcatggtgagaagaaagaaaaggaaagccaggtgacaaaatgcacagcagccatctgataccacagaggttcatcgttacatacctgtgaagctcctgagagaatctggactgtagcattgttcctttgttgatagccagagtgacaagtgaagtcaccacaaaagggctaaatgctgtgtaacagcctatgaaaaactagtgaggaaattgtaaaaaaacaaaaacaaaaaacctacatatgaagaagataacagtggttgtatgtatgaacattcaaatcctaaagtattaaaaacataaccactcagaataactccctccctgaagtttgaggcaagggttattattttattgaaattagcatttaaatatttatgtacctttctgaggtatttcaaaaagttacatgtttggtttggtaattggtttcctgttcttagaattttgtgatcaaagtcataaaagtcaagtggttaagagaggggagggagagggagagggagagggagagggagagggagagggagagggagagggagaggagaggagaggaagaaaattagtagcaaacacaaggggtttagtgaagtctttcacattctactgatgttcttgacattaaaaagccaccactgttatctgtcaccactgagcaaatttttgaactcaaagtacacatcttcctgaagaaaaagcataaatttcttcatagtgggggcatgcttcaattcatattaatggagaccacattgatggagagagcctctttaggatggctgggcctgactgtggaggtttcgattattcctcacaaggaggccccccacaatgagtcactctgcctgagtaggaagtcgtaggaggtgcgtgtcaaagtaccatctgaacttttcagcaggtaccaaatgggttctggtagctgtacttcaaatggtaccctgagatattcgccctgcttttttttactcctcgtagctcctgccctgtccatcaaaacaatgtttattttcctgggaccctgccttacagaagctgccaatgaagtgggaagttcagttcccaatactataaaatcaattttgctgcttgaagaaacaaaatcagacaatcaaaaaaattttttctctcatcaggtccttatagccaatgctgagttctcattgtacattttgagtgaaggtattttccctgctagaatcctgagcttaatctcttcctttcagaagtgtgagagagacagctctatcagggtcctttcagcaaaatcttgcaggcatatgcaatagtgtctgagtttggtggctaattatgggatggatccctgggtggggcagtctctggatggtccatcctttcatctcagctccaaactttgtctctgtaactccttccatgggtgttttgttccccattctaagctgtctcatgtgaggctatgccagtgcatggcaaatacagaagtggatgctcacaatcagctattggatggaacacagggcccccaatggaggagctagagaaagtacccaaggagctgaagaggtctgcaaccctataggtggaacaacaatatgaacaaaccagtacccccagagctcatgtctctagctgcatatgtatcagaagatggcctagacggccatcattgtaaagagaggccccttggtcttgcaaactttatatgcctcagtacaggggaacaccagggccaagaagtgggagtgagtgggtaggggagcagggcgggggagggtataagggacttttgggatagcatttgaaagtaaatgaagaaaatatctaataaaaaaatagaaaaaaaaaaaagaagtgggagagaacacagagtgacctgcagtagaggcgcacctgtaatccaaattgaggagctaactagcctctccacccctgctgaatttgataaccatcaacaggccttggcagcatgttctctatagatgggttaaacggtctcttaggttctttttaaacacaggaccacagtgagataaagtattttacaatctccaaagtaaaaataatcttggattgagcataagagtcatgcagatggtcaaaaaacagaggaaggaagggcagggctgggcctgcagaatgtagacgagctgccaagttggttaggcagtggcctgtcccaaagtcctttcccggcacagttgaagccttttattcctccacagaggaaaagactacctcaaggctactcagtgaaagatggttatagtgtacatgcagctccaaccacattcctcctagaaaactggtttttgtaagagagggaggaaaatatgaaaacgctttaaagaacatgagagtcaaagaggattgcgtgggcgggagttcctgattttgctttagtgtatgctctcattcccttcaaatgtttacattaggaataagctaagtattcccattccagtagccactgagaattgctgattgacctaggaacttggcagttaaaagtcatctttttgccatcaaactgttgttcacttatgcatgccctcttcctgcccctgcctctccttaggacaggtacagactggccaactcactcttccccttcctctgctctaaataggaacatataaaattcttcaaggagcaagaaatagaagacctactatataacatacagaattcaaaaaagaggaccagagtcctgttctaggcccagtcttttctgacccagtgatcagataaactatttttgctttctatgaattcctttcagaaagggaaaagaagtactagaacattgatattggtaaattttttatccagactgatactgctttttttaattttcagatttcacaaaatcagttttccataatgttgctgttttaaatacaggccgcgttggaacacctcactttatggccccagaagtggtcaagagagagccttacggaaagcctgtggatgtctggggctgtggtgtgatccttttcatcctgctcagtggctgtttgcctttctacggaaccaaggaaagattgtttgaaggcattattaaaggaaaatataaggtaatagactatggccattttattttccatacaaattaaatgatcctgagaaaggtacttgtcttgaagttgttgtctgtctttgctcattaacttactactgcctgaattcctaccccgccagagcaaaggtctgtgttgccatcaggacccagtagccttgtgaagcacagtggggtcttgggaagtttgagtcaccatgagctcaactcaatgagcagcagacttctgtgggccttttttgtatagtttaaagcccttcatttttaaagcttttttcttaattcataacactcaaatggaaatttcactcaggtactttttcagtcatttcttatcttaattttaagtttccaccatcatagccaaaaaagtctttatattgcagagtgaactgacatgtgagctttacaacatgtttcataataacagttcacaggtactttctttaaagaattctttttttattagttttgtgtatatgtctgcatgtaggtaggtacatgtgaatgcaagagtctgcaggagatgttggggaccctggagctagagtacaggcagtagtgatcccacccaacacggataataggaagcaaactcgagttctacggaagagctaagccacctcttcagtcccatcttagggacattttgatatgacttacacattcatattccttagctactatgcatcaaaagcctgaaatattatcactgtcttgtaattactagattactgctttcattattaaaaatcaatgctgtgactgacattatggagagttatatcaaaaaagccctaaggactctcagaaataaataagctgaaggtccattcacagtcccaacccatcttactctaactatgtatcaatacatatatctggtaaggtctagagctgtgatagtgtgtatctggtggcacttaatgctggggaaccccccccccattattactgaagctcatactttctatacaactgaatcattgcttcatttttggccatgcctgataatgtaagaccaaatataaatttatataacactagactcccaaactgtgaagctgctaacatttcttttctatttgtcagtaatgttataatttttaagatttattttatttttaactatgtttgtgtttgcatgtgggtataggcaccagagagaatagttgccagtggaggccagagacatcagatctccctggcgctggagttacattacaggtagttgttagacaagtcatgtgaaagctggcagttaagcacaggatctctgcagcaccagtattcactcttaacagttgagccctctttccagcccatcatatggaaaggtagtttcagagttacagccttatccttttaaactataaataagcacatggaggtgaaaatggcaaatactttagtttaccttgtgcactgtccactcatgagagcaaacggtatctttctgaaacagaagttgtaagtatatgcttttctacttgtcttagagtcagttgaccagaaaataaaagtaatacttttaaagtattgcttattaagcaatggtccccctcctatcctgggagattgtgaatgttaccagtaatacaaagactgggctttctggtcaaatattaccaaatcaaatgaaattacacatgctaatgtattggaagaaactcagttgaaaatgaagggccaggcatggtggtgcatgcctttaaccacagcacttgggaagctgaggcaggagaatctttatgagtttaaggctaatctgggccacatagcaagctccagaccaaccaaagctacacagtgaggctctgtttcaaaaataccataaggaaggaaacaacaaagtcaagcacaggttactaagcatagcagcagacagtacttcatctgcagcaggacctgaactttagctgagcactttagtcagtcttctcagcagctgatggcgtacttaccacatgataaaaatctcccacctgcctttttgagttataagcatttgctaacaatagaattcttcctttgtgtttgttcatttgcttacttcctggtttccaaggcaatgtgcttcgttccaacagcgtctggtatttgattttgtctatttttaaagcattgaatacttattttttatgccttggtaagtaatttcgactgcttgtactgtctaaaaattaagttattttaaaatttcctattcttagcaaataatggcaatattattaggaagcgataaggtagcagccataccatgatttctgtaccaagggtttgcagccttgcatcttagaatttatttcccattttatttagcttttctctcttcttgcttgtcttcatggtttcctttacaaaaggcccaggtcttcagcagcagtttaaagcatggagtccacttctgccacttctatgaacttcatgggccttgactttctgttcttttctttttcttctttcttctttctttcttttttttttttttttgatatagtgtgatatgattctatcagtatgcattgatgcttctttatcatggaaatgatcaaacacacaggatagtggaaagctctcagcttcaatacttaatatattaccaatcttgttatgcatttcacgcacttttatgctattctaaaacatctcaaaaaaatcatttcaacaccatgatggtacttaccaaaagaagcagtaaaatcctgatcttggacatttgtaagaaaagctcaatgaaatcacatgaggcccaggacagggaagaagggtgttttagttaggtttctactgctgtgaacaccatggccaatagcaagttgtgagggaaagggtttatttggcttataggttacagtccataattggggaaagccaagacaggaacttagaggcagggaatgaagcagaggccatggaggaatgttgcttatgggcttgtgctttgccagtctgatttttttaatacaacccaggactaccagatgtagccctcccctcccacatcaatcattaatcaagaaaatcccacagacctacctacaggccaatcagatggaggcattttttcaactgagctttcctcctgaataactctagcttgtgacaagttgggggttgggggacaaggaagcatactatctaggcagtggctaatcagtcaccaccatgcatttcagacattgcaacacatgtaccaaagatgagcatctaaaggtccattgaccacaattccaatagaatgacaatatttaagcagtcttgtgccagttaccgcatgagattcaacaactgaaagtggttgctttagtaattttgcctctaagaaaaggaaactagaacattgtccaactgtaagagctctccctagcatacagatgctttgccctccccatctgtaagttcaaagcctcacctgagccaaagcttggtgtctgttgctagcccttggccaaactggaatgattcctttatgctgtgatgcaagtactgtgatttcatttggctttaaattattatatttattctccatcattttctcttaagaggtggcattgatctctaaatggttaaggtcagcacactgagccagagatgtagttccttggcagagcacttggaccagggttctgtctccaacactgacaaacaatagcaacagttacaaaagctggatactataagaagcccctggtaccaggcaactcccatatggtcattcagtcaggcaacttccccttttgccactaccttcagttcccacttcccttcccagctccaagctctgagcaatttccttgagtgtttttctcatttctggccttagacatgtcctctttcccaggagccttccaatttttccctcaaagatacacatccattatcaatagacttgaaaaacgtgtaattctttttgtttactttcactcagttttaccacatgaattagttgtctcgtctctaaaagaaaggacttcactgagtagtgtacaagtggaattggctattttacagagatatgatgataatatattttttcttatatattgaataccccagtcagaatatccaattaatgatttttttatagcttcacaattaatgttgcccccagttttgttttagagcttgtgtgactgtttctttcttccctttaggaatttttccccagtctaggctgacctcaaactcattattcccttgccttagtatctcagttgctaagattaaactggtgcataccacactcaacacctggtcctaacgttggaagacactggttttcaaatctttagctgggtgtgatggtacagacctgtaatcccagcacttaagaggctaaggtagaagcaactggaggttcaaggtcaacctggactacactgtgagttctagtctatcctgggcttaaggaaaccttgactccaaaaaggaactttctttaagttttttcacttcaaatttatttcagtggaccagtatattctagcctttttagctaaaaatcaaaaactagaaaccagcgtcatgagcagacctttcaaatattgaaaatattataatatagcagcaccaatacaataattgctgatataaataatgaggaacaaaaccacaaagcactgcatgtcttcttccttgggaagcaggtctttttttttcaagacatataaagatgtatttatattatgtatgtgagtaccctgtcaatgtcttcagccacaccagaaagggcacctgatctcattagagatagttgtgagccaccatgtggttgctgggaattgaactcaggacctctggaagaacagtcaagtgctcttaacctctgagccatctctccgggccctttaacagatatactaagtcatgaaaagtgagagaagttgaattgacttaaaattcatttttctcatgatcctcattaataacttatttagctctgaggttaagaagtagaatatgaattactcctcaaagatataatataatttccatagctatatcacaactgttaaatacataatcaatgtttcttatagttgttacacttattttgaaagatgtgtcgcaaacctggcaaaggctcaggcaaaatccctatttgttgttgttgttattttgcttgcctgtgctctcttatttcacctgttgtaactttaagaagttatgattttgattcaatgtgtatattttacatgttttctcaatgtgtctcttgatagtcttgttctaatattcttgcaaatttgtgtacttttttcttttttttatattactgggtatttatttcatttacatttccaatgctatcccaaaattcccctacaccctcccacacccactcccccacccacccactcccacttcttggccctggcattccccagtactgaggcatataaagtttgcaataccaataggcctctcttcccaatgatggccaattaggccatcttctgatacatatgcagctagagacacgatctccgggggggcactggttagttcatattgttgttccacctatagggttgcagatccccccagctccctgggtacttcctccagctcctccattgggggccctgtgatccatccaatagctgactgtgagcatccacttctgtgtttgctaggccccggcatagtctcacaagagacagctatatcagggtcctttcagcaaaatcttgctagtgtatgcaatggtgtcagcgtttggaggcttattatgggatggatctccaggtatagcagcctctacatggtccatcctttcttctcagctccaaactctgtctctgtagctccttccatgggtgccttgctcccaattccaagaaggagcaaagtatccacaccttggtcttcgttcttcccgagcttcatgtgtttcacaaattgtatcttaaatcttgggtattctaagtttctggggaagcaggtcttttaatctctgttatttgccctgagaatgttacaccgaaagagtataatagtaagtgttgacttcttgaagataactgtgtagctttccttgtttcctcctcagatgaatccaaggcagtggagccatatctctgaaagtgccaaagacctagtacgccgcatgctgatgctggatcctgctgaaaggatcactgtttatgaagcactgaatcacccatggcttaaggtaccgttgctcccaggtcaccatccacactgcccttaaagaattctacaacatggaccttttcaccattacttgttcctcagccttaccatcagctttgtccattatgtttgctctcttgcaccttgtccaagacatgtttgatatttagctattggactgggcacaaaatcaaattaaaacaggctattgtccagcaaagatgaaaaggaacatctaaagtaaccatttcatcttacattatctttacattgcatatgactgtatactctgtaggatttcactggttttcagtaggtgtagatttacagttttagaggagagacacatgtagaagttggttttgtatcccatttttctggattaaggaaaatcaaatcttaagacatcagaaagtagtattgtttcattaaagcattgtgccataattccaggaaattcttgcttcataaggaagaatacatcctcagagatgttcagaattttgccataagtcacaaaagtttttactgttagagccaagattttatttagttcagcctaccatacccattatttatgctatatatcctgtccctctcactaacttgatgacattgctccagctacttccctctttcctacattatcagttttctggatcttttggagttaatgtgttgtgattgtttttattgcttacatacacatgcatgcataaacatttgccttctcttgatcctacaaattcctccagcttctgcccctactccttggttctctcaattacaaaacttaaaagaattatctgtacccatttctccaatctttcctatccctttctcttaagctcattcatactagtcgggatctaccaaccccactaaaacaattcgtattggctatgggtatgcttcagtagagtacttgcctgacatgtgcaaggccctgagtttcaacccagaaccgccaaagctcaaaagaaagccaactcttgtctagtcactattgaccttcacatcactaagtctactgctcaaattccagagctacagctgcttaatctgttgacaacatttgacatccatctcgtgaaactttctccccttgactgccctctgtttctcttctactagtctgactgctcctcctccagtcttgcagattttccatcacctccttatatgacatcacatggatgtgccactgactgacctccatcccagctctacatctctttctccatctcactctatatgtgggaggcctcattaagtttgactgtgtttaagtatctgtacatgatgagtcctgaatccaggcctctcacctgaagtattcttccttaacctactgtctaactgggtttcctggtaccttgctgatttaaccatttcctagtctcctgtgactcagtttctgtcattctggcctccttgctgatcctcagaccacagtgttgcctcaacattcctgtagtaatcatgctgtctctctagaatatcctttttctaggtcactttggggatttccctcacatcaaatcaatatttagataccagcttcttctggtgactattatatcatgatgcttcctcagaggttatgtaaggcactaagatatgtaaaaatatcgatcaaaaatgtatcttggtgactacgatgtggaatgatattatagagcaattttgacatttcagtgaatcttgatccttcttgggctgaaggggtccaatgataaagcacccataaatcctagcatgcataaatccctaagtatggtccccagtaacatttaaaagaatattacttttgaaatcttcattcagccttttgatatcttactactagtatttctggttttcctagcaaagaatagattattcagtactttctttcttttagtaagttttagtatgtttttctccctgatatgaaatgaaaatcttagaagattcctattccttccttgcttctctcagctttttctaataagggtcttttgtcatttagaagttactttaaatgccaaataaggacactagcagctgtttaagtcatttttaagatcctttataaaaagtcttagcattatacagttgcagtggcttacattatcaaagcttatcttgtgtaataacgtacttcttcctggaaattcttgtttctaccgatgattatagatagttctcaccctaagtagtctgagctgtatacagaatagatttctggcaccaaaaaatgttttaaaatgtcagtaatataaaaagaaaagtctggaaagctgaactcagagtcacctgctgtgtgtgaactactgcttattcacattgtttatgtgtcatctggagatgatgcagtcaataaggagcttatctagctggagggagcaactttagtttacatttagtccttgttcctgtagatatgtgtcccattacagtgggcgtaagttacgttgatttagaaaggccaaaatgtaagccttcatttaataaaaatgcctttaataactacaaagcaaagaaagggaataatgaaacttatgcaataaagtatccaaagtcaaagtatcattgttttaagtcaaaaataagagcaaaaagaattatttctttggtttaaaaaaaacagatatttttatttattccatgttgaaaaagaatctgagtattaaaccaagtaatatatgaatcccttatagttattgactttcacccttttaatgtctttatcttattaatgaaataatggattaatgaaaacttgctatgaatattcatcctaaccaaagtagaattaagtaaatactgagttcagggtcatagttgtagtgaattttctagtctgaaaggaagcccgcgacagactgtaaatagagttttcgatgttactcatggggagtaaagacagagggttttctcctgcatggatagcttcttctgtgggcatttcctggggctcattttctcagggtttcttgtcctttgacttcccaagctgaatcaaaaaaaaatgaaataaagcaaagtaaatagaataaataaaatcgcagcaatatcagcctaggatctctcctctaaccctcaggcccctaaactgtctaccttcctttctccagctttcagtcttcagccattacatcagggaacctccccagggcctttaatcagcagaagcatgcgatgacatgtgattgcgttgtctcaccactcaccactactcattcctttcagcacgtcatttctgaactgatttccttattgtcagtacctaacagtttggggaaagtgcttatgtattaggtagggaatattgtcacaatcaaccgtaaaccccatttgttgatgtgtatccaaataagacatgcatctttcaagctgcttgtcctagtcttcccagtacaggaggaatcagacttccatttactcatacccaaaattgtggtatatcatggtgtcttcttcctcccattacccatagtccgtcagaacaccctattctacctccagatacatacatagctaaaaactgttatttgagggacactagtaagaggatgagaaacaagctataaactgagaataaatctttctaaattatgtatctgataaaggacagaattcttttttttgtttgtttggttttttttccattttttattaggtatttagctcatttacatttccaatgctatagcaaaagtcccccatacccacccacccccactcccctacacacccactccccctttttggccctggcgttcccctgtactggggcatataaaatttgcgaaggacagaattcttaaaactctataagaaaacattgaatctgatgcaaactttgaaaatacttaagcaaacattttttacaaagatacgcagatggctgataagcatgttcaaagctgctcagcattagtagtcattagggaaatccaaataatgccacagagagagacacctgtacacttgggttagaatggcttaaataacaattgttagggctagacaggtagctcagtggttaaaagcactggcttctcacaacaatctgtaactccagttccagagaatctgtgccatcttctggtcttcaaaggcactgcacacacatggtgcaaatctacaggcaaaatgtgcacattaaataaatccaaacaaagaattaataaatgtgactaatcacacatactgttaacagagatgcagaatatctataactcatgctgttactacgagtgtaaaaggatatgttcagtttgtaaaaacagtttgactgcctcttaaaaagttaaacataactcatttacatggcctaaccattctgtctgttccttagaaattaagtgtatattcatacaaagagtgacttgtgtctgaatgttcataagaaggtttttttttacatttatttacttacttacttactgccatgtgagacacattctcactccttggacctttgtgctaggtactttgctctatttcagttgctctctaggtaaatagtaccccatcatatgttaattgtttgcttactgattgccagtctggctagttgtgacttgtattctccaaggactaatgaggttgaccattttttttcataatgtttattggccatatttatttcatctttggtgatgtatccatttcattagcccagttgttgagttggttgtttcttaggtctcgttagtcctttgtacattccagatattacgtttctgtcagatatttgtctagcaaagatttttctgtataggctgccttttcagtcaattgatagtttctttgttgtacagaagccttttaatatcatgaggtccatttgtgtgttgttgaccttatttcctgagtgaccagggtcctattgagaaagacctttcatgtacctaaatcttcaagtgtttccctatttttttttcctttagcagttttagaatttcaggacttccattaaggtatttgatccatttggagttgacttttgtgcagaataaaagatagggatctagtttgattcttctaaaatagagtttgaaattactctcttggaattctaaagggctgctacaaaggaagttatttctttctgggcaagggcagatgcagaccctgtatggatgaagtggttgaattagatgcccattgaaaagtctgtcctagttggaagactatacatttttttgatgttcagttgttgctgacagtacagaatgctgaatcagtatagacttcatttttaagagctcattttacctgaaagttcataatgaagacaacttcaatacaacatgtgtatgtgtcttcaaaaaaaaagctgtaaagaaagctattattttgcatgctaactaaaaaattaaatagaaaaagataacttcatacttttataattattatgaaaactttgtctaaaaagtagataatctattactttattcttactaagtccttcattcttactagaaaatattatttagccatcaattttaatattcgtagaacctctatcagaatttgtatcagtatatagaataaaatagcctagccagttccctaaaattaaatctcaacgtcaaatcgaagaatatgaccaacacaatttatgttaagcttcttgattttctcagcggttatgtatgatcataatcttcttttataggagcgggatcgttatgcctacaaaatccatcttccagaaacagtagaacaactgaggaaattcaatgcaaggagaaaactaaaggtaaggttttaagaccctaagagctcactagatggagtttgtaatcatgcttctgttaggtttggatcttcataatcacatccttgtgttggccattaattttgctacagctaaattatctctaaaaattgttgctatttcattaaacttttgggtatttaaatcaaataaataagttaatgtttcagtatgaatcaaaacaaatttagcaactagaaggcacatcatattttagatttgttttgttctgctaaacttcatagcaaagacatggctacattatgaatctaagctatgtttttccaaacataaatatctggacaataacatggcacgtgtctgtaatcccaccactaaaaaagctgaagcaggaggtttatgcatttcaggccagcctgggctatatagagacactacttcaaaatgttaaattaacaatgataagactttaaaattgttaaatgtgaccttagttctctggaaactgcagctgagtttacattggctctagggttcaacaaccatcttaaagcaataaataaaaggcacactgccataatgtatgagaaaatgtttgcagatctcctattatcctttattctttctccgtggcttgcttaccactctccctgccctctgtctcaaaaagtaaaggagcacaaggataatggctcctcacagggagccattgtagttcagaactttctgacaaacacccacaattcagtggtggagctccccagctctgggaggaaatgctatggggcagcagaagctcgccacaaagatccagaggaaatgattgatgtttgtttgatctgtgctactgaacgtgttaggtctgttctagaagtagctgattggataatagtctctaatcacaagactcctaccaactacaaaacttctggagtattttcagatgtcttaaattataatactatttatcattctttatgccttgaagattatgaatggttttacacagctggaaattatatgtaaatgttttggggagactctcagggtataatagtaccatagaaggcagaaatgcccacaatggtgtccattagccacatgtaggtgtgtgagtctaagttacttaaaatttaaaaatccaagtgctagttccccattcataccatcatgtttcaagagctttgtggcctagtagttaccttactgaacagcacaaacacaaaccattcctaccctattaaaagattccactggacgtgggatgctgctgaacagcagaacttttcacacatcactgttaatgatgagcatttttagttaagcttttctcctaattcttttgttgccaggagttcgaacgggctcttctctatgttttttgtaaaatccttggcaaaaaatagttattaatgatatgccattgttgagatggtgcccggagaagtttcttaaggcttaacatctttactttgacgtctccctgaactgctataggctgcaaaggaaagaaaagctggtcagagtaaaatttgggcagctctcttgcacttagttgtttgtccaaagaaacaatgtctgagcttctttcttaactcttctctaaatctctttcatccttggctctgctttggcttcacataacattactctatgcaaggtcaaggcttcattgcccaaacagaggtgttccactcaggcttgagctcacccatcacaggagacatgctcttcccttggtgccacagaagcagactggaccaaaaatagccaaactggtgactgagattcgtttggacagagctaaactatcacaacaagcaggggtcatgtggatttaccacatccctttacagggctattaaaagtctcaagacccgccaagctgtgtggaattagaaacatcagcctgatgattgtgggcttgttttcagctaaggctacattcccagagttgtcagctaccaggttagcacgtgcaacaccttccttcctcagggagcttattctccttcttatacttctatgaagttctacaacaaagatggtaatttccctggtttccatcacccaccaccccacagcttatttccacaaataaacagctaggtgcctgctcatctttacccccagacactgatttaaagttcctcaaatggtgcagcaaccaaaattttaagaccactttagaaatgattctaaaattcactgaaaagatgctgaaagccaattactgaattttgattaatagaaaaaaaaaagaggtatagagcaatgcaagaagaagtacctcaaactctgttgagtgggtgaatcctggttctctatgcttcagtcatctttatctgggaagtatacatagtacaaaatgcagctaattcctaggagtagcaggatccaatgagctactgttacagcagttagaagaacaccaggatgtggtaaatgctccaaagatctcttttgctattaactttgtgatttttattaatacattattaagattttaatggtactaccttagatttattaatctataaagactgtaattcccaaataaatattgtatgccattttagagtcttgctagtcattcactttaatattttagaacttttagaaacttttaaccttttattacttcttatttattttgtgcgcctgaaggtcaggaaacagacatgccatgccaggcatgtggaggttggagggcagcttgtacgaggcaggcacctttacccactgaacactcttgccaggcctgaggaacactaaaaaaaaatgtataaaacattgaaaacttttactgaataatccttcttatatttcttccaaagtaattatgcttagacttttctcactacttattatcatttccctctaaattatctacaagaagtttttatacttgtaggattatactcacttccttgtaactattttccacaagtaatatagccatgtaacataccagacccttactaggtgcctgaaaaatttgttttgaattgcatatattctgctgttttataaataaatatgcttctaataaattataataaatcaggcacattaatatttataataattaataataaatgcaataattatagtaatatgttattataaaagtcattaaaacatttaaattattggtgcctagtatattccctgtaatattttcatacaaggaatgattgtaagtaactagaactgaggaaaggcaaaacgagtctatgctcctcatgtggggctcttggaccagcagatcagcaccatctggagcatattagaaataggaattcctaggttataatatattcagataagaaaacacttccatttggaaaaaataacactatctttgtagatgacgcagttccatattatagaaagtcccaagaaattccctagaaataacaagtttataacaagtataggttatgagtcagaacaaaatgattcatatatatatatatatatatatatatatatatatatatatatatatattacatctatatccacacatattgagcaattaatagtcttaagaagaaattaagaaataagtctattcactgcaacataacaatgaaatgttcagaaataaatccagcaaaataaatacaagatatataaactaatattgctgggagaaattaggaatctaactaagtaaagggtgatttatctgggaagactatgttatctaggctgcaaggaagatctgtgccctgaggtacaggctccttaagtggtatattagttacattctcattgccgcaacagaatacctgacaaaaccaactttggctcactgttagagggtatggagacataacagcaagagtatgaaagagtagtcatgttgtgcccacagtcaggaagccagagagatgaatggtggtagccccttctctttactcagtcatagtcctgagcccgaggaatggtgctgcccacaattagggcagctcttcttccctcctcagttaatcctctctaggacactctcctagactcactggcagtggtgatagttttggtgattccaagtgcaggcaagttgacagtagaaatgtaagtatcatgacaaggcacactgtcttctaacctaagcatcagccactaaaggagttataaacaaagggatgtttgttggtatatggccttgtcaatctagcaacaagctcaacagggtatctgctctaaaagttatcccctttgcttcaggaattattttgacccatagaaagcacatttctctataatgaagcaaaatacattatatatgcatgtatgaaattctaaaatagtttaaaatgtttgctaagtttaaaaaaatctttaatcaaaataacatgttttgggataaaatattttcatccccttcactatcattattgatttttgtatacacagaagttatctattataacaattttcatttcattgtttgtatttaaaataatttctattaaactgaaatataatggaacataaatataagatttgacctttaaaggaaaaaatatatctaaatagaagcaatagtctatgtttgagtgaattaactgcaatcaatttaggaagtggtagtttgagccaagcagggtgttgcactcctgtaatcccagcacaagttcaaagctctcctaggatatctagccgtgctgttgcaaaccaccaccaccccatccaaaactagggctacagtgagttgaagccaagcagttcaattaagaggataaagccacttatacttttaatatagaaagcaaggaagaacctcctctcaagaaggctcacatgaactttccccaactgtgatttcctacatagagtctacacaagactgaggccctaaacatttagtcataggtggcagaggggctcatggggcgccaacccactcaaagaagctaatggcagactgagactgctaggggagaagtcatctttctcagtgtagtcactggtaagttacccatgttccagtggatagctcgaacctacatccatgcaggtggctcaggttaagccccatgaagtcacaaagtaaaatcagacagaagacaaaaaggcgtgaaagtaggataagaacttagtgggaggatataggaggttggggtggccaaaaaatattaaatacatggagaaattgtcaaataagaaaatcaatttataaaggaaatgaacacaagggagatttctgagaactctttacaacttcgttgtttttgcaaattgcaaatgtataccttattataagaaaacacagtttaggaatgctattttagttctttaaaagcagaaagttgcaactttatcatagtttttcctaacagattttaaatagtattaacttaaaattatgtttcatccttaaaacatgctaaagtatacctaataaatttgaagagatttgtcaaagttggataaaccagaaaaaaataagagatgtttatttaagcgatcatttatattgctgtacccaataggctcttcactagaagtatactataggagttggcaaacaatgtccagggagtctagtccaccccactaccttgtggaggaatataaagttttattaaaattcagtgtcatatattcatttacattttgtctgttgcttttgtgctttaataacagagttgagtagtagcaaaatatggacccttcaaagcctaaaatatttatgctctggctctttacagagttaaaaaaaagttaactcctagaggaataaaaactcctaaattaggaagactaatcgatggatctcagttctgaccatgggtgattgcatctttaatcataacagagcactaagcctgtctggacctcagttttccctcctatgagatgaatccttttgaatggctcatcaccaagattgggtctcaaactgtaataaaattctgtgaatctgagctgttttgaaactgttttcctgtttcacataattgtcttgcattgggtagtagaaccatatatggtcactgaactgagaaactaaataagccaagcttctaggaacttattgtttcaaagctgtttttctctcaggctcttttaagtaccagtctaagtacttgtttatagatcttcaactacagaagtagttggggaaagcctttagatgtaacactaacatacaaagaaactcagctcaactcacttggaaataaaaaaaaaaaaatctctaaaattctggtttgggtttgtgggaaatatgatttgatacataagaattccattccacctagcttttagggagcatgtataatatgcaaagtgaaataagattcttctgtagaaagaaaattcaaccttcactctattttcctatgtgactgataaagttctgcagaaaagcttccttgttttagccccatactgtgggaaatgtaggcagttgcatcaaatggcaatttcaaaaccacttgtatttttttgtgtgtgtgtgttttccccattttttgtcttttttgttcttgctgctgctatttcaagacatgatcttgctatgtagcccaggctagcctggacctcccaatcttcctgcctcaactgcaggcatgcaacatcttattggttcttcacttcctgtagtccatttttcaagtaatatttatagaaacttaatgtgatcccccaaaattagaccttgtggaaatgctgctaacattgtcatgtatgtaccaacaagtgcctacatgcatggcagatttatctttccttgcagaaaactcatgagcttaatatttaaaatttacatagaaactatgatagacttagaccacttcagtgatttgatatttaaactaagtgaacaattctatgtagagcagtagaagattcactcatgttctgcctctgttttagtgggctcagtaatgatttatacttccagaatgtccaacagttttcaaagcacttttgtttacattaagactttaggcaatgtaaaataaggcacatcccctttcatactctaagtttacagattataagacctagagaggaaatgaggagatcaatagctcagtcagaaaagtacttcctgcacaagcatgagaactgagttccgttcctagcaccacataagaatacacctaaggccagcactgaggcctctgggacaagagagaatacacaaacgtgccctggggcagagacaagaggatccctggggcccgctgaccagcccagcccagcctagtctcatcagcaagtccctgttcccagtgagactctgttgcagaaaacaagtggctgactcctgaggaatgacacctagtgtagacctctggcccttacatgcacatatgcatgcacattcatataaacatgctcaaatacacatatgtacgcatacaccatgcaagaacaggaaaacctagaaagtatgaatgatctactcaagcaatgctgtggagccagaacatgacgaagctagaaagcaagcatagcaactatgagtcttcctattgctaaaacagtaactcacattgctgtcccacacagtagtcctaaagatggcagcactctggatgacaaagcttctctcctatggttcagtgggtcttctctgtggcttctagaacccatctgtaaccaggtatgatgttgcgtgtctgtaataccagaccttgggaagaggtaaagataattggatcaagagtttggggcagcctcacctacatagcaaattcaaggccaacctgtacttcatgatatctagtctcaaaacaaatttacatgtagttgattcagatgtgcagtctgatagagagttgatgtgcgagagtaacatagtcattgttacacaaagaaagcagggagaaaaatgagaaactcataatcctcaatgataccattgttaacatgctgatatatgcttattagtttataattgttaactatttttccaaaaaaagaaatcagaatatgcactgttttgaaaccttttaaaaaatatgatttattacaagaatcttcctatttcattaaataaccttctacagcatcattttatgacagaattttgtaccatttaatatatgtgcaagtccaaaatgtaattagtttatacacttcattctgcatatggaattcatgtcaagtattccgaagttgttttgtgacacccccccccaccctctcttctagccaacgtgacttacaaatgtcactttctgactaatccttaagcttagaataacaattagtaatgccttatgtttgcatgtttgttgtaattgtgtactttttcatcttctcctgcagggtgcagtactagctgctgtgtcaagtcacaaattcaattccttctatggggaccctcctgaagagttgccagatttctccgaagaccctacctcctcaggtaactgggtaatttgctcttcaccagtgggaatcacttgccatctcttttctcttccattctgaatagtctttgtgggactatttagtcaagtcctctgagagattctaaggaagtttgtcacccacaaaatcatacttacatatgtctggttcctctttatttgaataccaaaactgtcctctctgaatgctcccaaaccaacattatgccagtttcttttttacctcaatacttcttcccctttgtacagtccaaactctgaactgcatttccttccctctattgttgtagttagattcactggatctcgatgatcatcttctcccactgcaaaaccttctaatgtcctgctttgtttatttacttagctctcttttgtttatttacttagctcctgactcatatgtcatctggcctcagctttacttctgttagagacgaaaattttatgtggtggaattttcccctctgatttgattttttttctattcttctttaaactggcttctttaatatttgcgtatgagcattagaaacttgactcaggactcgtcctacagcatgagtagtatgtcctacagtcagcagtagaagagtgcttttccctggagggtctggaattgtctgtcagtgcttagcttctgccctcttctcatgcacatacagattcaaaagctcttgccaatcagtatgtacctataccatatgcaaatgaccagactgagtttcctagtccagcaggtgtgtgcttcctccttttgtcttttacaaatcgggatatgactcttcctcttttgagcaaaggtgatttccaaacatattcagaaacttagagaagtgactgggcttcctcttgtgctgtggcatggttgtgactggccacgtcctctggatcacttcatctctgcccttcttttcttcctactatatgttgttcccatcccctggaccatttttagaagttgaacatctccctctggctttcagcatagattacagttggccctatttagggaacatggatccaggcataatttttattttgtatctgtgatgacatgaaagaggcacagctttactatatttagaataaattatctcttcaggatttatggtcaacgactatcactttcatttttgaaatgagcctagaaaacagtatagtccttaatcttgagaatttgcctttaattaatattttcctctgcccactgacaacttaatagcaccttaagtgttcttttcctggaagaattgaaatttttctttacaaaaagaaattatatttgtaaacatgcttgcttatattaaatatattttatcacctggtcctctttagtatattttttaaatgatttgattgaaacagttcctttagtgtaaatctatgtttttaaacaagcaaacaaacagcaacaacaacaacaaaaccttccaccgtcttgtaggctgccttcaggatttcatattaattgtttccaattgaacatttcttcttcgctttcctttcctgcagtctcactttgttacattcttttttcgtctctttaattctgggtacgtcatgatcttctaagcagtatatattttatttattttttttgataactttgggttggaaggcgattttttttatttctttttttaattaggtatttatttcatttacatttccaatgttatcccaaaagtcccccacaagttcccccacccactcccccacccacccactcccacttcttggccctggcgttcccctgtactggggcatataaagtttgcacgaccaatgggcctctctttccactgatggccgactaggccatcttctgctacatatgcagctagagacatgagctctgggggtactggttacttcatattgttgttccacctatagggttgcagatccctttagctccttggttactttctctagctcctccattgggggccctgtgatccatccaatagctgactgtgagcatccacttctgtgtttgctaggccccggcatagtctcacaagagacagctatatctagcagtgtatattttaaatggccatggtaaatatctgtaaaggactttttcagtgatgctatctgggtgctacaagcgaaaagtagaattagaatcaagtgaaaagtaaaattaaaatctaaatggaaatcactaccccaagtaaaggagacatttttatgtggtcagaagtcagaagcaaaggagatttttaaagacaagtgtaatgttttcgtacacatttcacatagctatcagaaatcatacatttccaaaattaatttttaatgctaagcaaattgaggaaggcattctgccctaatcaacagtattaaccgagagccatctgccagcccatggcctttctgcagccaacagtagtgtatcagcttcagaaagctgtttatgtattttatctggactcaaagctttgcacttttgtaaatgaaaatatctacatttgtttttcattatttccatctcatttttggtattttcattgctttctaaacctaaaaaaaaaaatcttccttttatccttatgcttgtttatttcaaattcccaaagtaacccttttcctgtcttgatgtttggatttgtacgggtttgttttacactgaaaaaaaccaggagcactttctgtaattacctgcaagtgcatccaagcctgagatacgagaaagaaatgactgcagagcatacgcttgtagggtgctgactgtatctacctggaccatggagttttaataccaaaatgttccttgaaagcatgacatgaaatttcttaggagaagccacctagctactgacctagtttcctttctagtgctgtgataaagaccatgaccaaaagtaacttagggaggagagggttcaccttaaagtctacagtccatcatcaaaggaggttgggaagggctgggaagatacaagagaacagtgtatttcaccagcttcctattctctaaatgtactgtctttgtgttccacattacaaaataccttttccagtctaatgaaattatagtgggtccattttaaaaaatataagcctaccaaaagtaataattgtccatcccaattttgtcccccaatatttttttcaaaattccttctacaacattctgaagtttggggacagtaactaaaactgcttagccacaaaatgcagcatgttgtttccttaaattaaaattactaacaaataagagtatgcatttgagaaatgtgagtatttaaaatcacattctaaaaagtaatcagcgccacagcctaccatccagagagaagctgaacatgttcaggtgtgtcattgtaatacaaaataatttttttctgaaaaatacttttccattttgattattgaagtttattcattatgcttttactggattaatcttatgataaacagtatcttgttgctttgttacttaattaaaatgaaaatgttctcatatttcaaagcaaagcatttagaatgagatcagagtaatgtctgaaattgggtgggggggtcagcatgggggctgtgcttgtggattatctaaaggacccaactatggcttaatgacctgcttgctctaaaatcataacgtttgtcctttgtccatatgctgccttcctcctaggacttctagcagcagaaagtaggtatccctttgttttcctctaaggtttatctttatgcaaaagtgtttggctctgcatggttcataattggcttgactttttccatggctgcttgtgtttagatgtttaaaagtgaattttaacactgtctgaccataaaataaaaacttgtatatattgattttctggggcattgttatacagctgaatttctcaattctttcaaggggtagggaggaggcagtgttaaaatttcaactatatttaatattatttcacatttgaaattcaaacacgaatatattcattctggggaaaaggtaacattttattttgaagttggctcccaagaaaacttttagggtaagtgagtttttctttcgacaattttgttacacatgaatggtttttattactgatacaaaagtcattctgtttatcattgttgggctgtgaagtaaactctgaaattgtcttttaacaacccccatcatcagatacagtggccgggaaacatacaggtatactgatacagtctcacactcatggaaactgaggcaggaaggtaacaagttagagaccagtcttggctatgtagtgagaccttgttgcagaaaataaataacaagtaagagtaataatagatatcctttaactgcaaagagatataatttgaatatgtaaaaaattaagctgtacaaaatatgcacaaacagaacatacacaaacaacaatgtgtttgggggttttgtgtgtgtgtgtgtgtgtgtgtgtgtgtgtgtgtgtaaaactgaagttgtcccaataaagagggtagattacaacaatattagtatttaaaatgcaattaaaatttaaaatttacctcaaagtaatgctgactaaaggaaagtaatgagacaaagataaattagaaaatgtgggtgctaacaatgaactgagttgccacttttgttgcatttactatttatagctaaaattataatacaaaaatctcaccatatactagtggtttgtggctgagaaaggcagcacctgtggatcacaagtagggtatggctttgctaagtgcctctgcccacctttcagaattttgcagctcacacagtagttaatagaaattttcggtttttattggataatttacttatttacatttcagatgttatcccctttcctggtttcccctccagaaaacccctatcccatcccccacccctgcttctatgggggtgttcccactcccacctccccaccctggcattctcctacactgaggcatcaagtcttcacaagaccaagggcctctcctcccattgatgccagataaggccccttcccttcggctccttcagtccttcccctaactcttccattgggttcccagtgctcagcccaaaggttggctgcgagcatccacatctggattggtcaggctctgacagaggctctcaggagacaactgtatcagactcctgtcagcaagcacttcttggcatcagtaatagtgtctgggtttggtgtctgtatatgggatagattcccaggacgggcagtctctggatggccttcaaagtgtggaatagaaaatttctaatcttcactggctgtgggcttgtcaacaaggctgttcacaacccatcagcttgctgccccaaataaatgactaaggggaaggcaggggttgttcctcattgttcccaagacaaggaacagttttttaaccttgcatcagaagtaacattctctatgctcaggccccatgccaggagaagtagttgtgtgataaacagcaggggactggatcttaggggttcagaggctaatgacatatccatgccggtgactataagaatggaaatcaatcaagcaattaatctattcttcccctccctccttcctctcccctttccctttttctctcttctatccttttttagtcagccacatctatcaccatatttgggaaggaacatcctatcggtcatacctaccagtctgtataaataacaatgcaaatgagcatttaaggctagcagaatattgtcaaaatactttgaaaaatggtgctcaaaaatgttactacttgtgcctagtggtgcacacctttaatcccagaactcaggaggcagagacaggtggatctctacaatttcaagtccaacctggtctacatagtgagttccaggacagacagagatcttgtctagtttattaaaagaaaaaaactaaaaaagaatattactacttggaaacagactattttaataaacataatgtcactagaattgtagcccttgtatgctgacaaaatgtatatgtagaattccttaagaaacttaagctaaatacatttttgaggtgcctgtgccataatctacacaacaagaatctaagacatttactatcatatccaagttttcacaactagaattggatatagtacacctgccagcgctcaaaatgcagtttccactgtgaggttcactgttgcttataacatgattgaaagcctgaatttgctttattttcatgcattggaaataaaagctgttggctaggggatggtggtgagaagaaacagactgcaggttgacaaggggggatattttttgagtgataacactgtacacttaaattggtaagtttaaattaataatgtatacttcagtaaggaaaaaaatgagaccaggtctctcactatgtagccctggctagcctgggattcactgtgtagtagaccaaactggctttcaactcagagatctacctttctctgtctcctgatgctggcattaaaggcatatgccaccacacctggaaagacaaattttttcagcattatattacttggctggggacagggttcccacctataatcacagctcccaaaggtggctgagacaggataatcataacttcaagagcagcctgagctgcataatgagaccctgcctcaggaaaggtatcatgttgcaagggagagtgcatgtgtagtggtgtagtggtgcattagtgagccactcgtgggataggcatagttctacatgtaaacaagaaatgcacgtggatcttccctgaaacaactgccaggtaaatgtgggagcaccaaagcccattaaatggtaaacttaacatgcgtgtactttgctgtatttgaattgtatctgagagaagaattgaaatcttcgctgaagtctctatgaggaagtgactggtgtcagccattctgccacttactgtaacaatgagaaatgtgatgaattgccagatggatagctggtgatacatgtgataaagcatacagtaagctgtggcctatgtggttgtcagactttctgcctgcttggaattgctcagagtttgctctgtgtggggaaaagggtttgagagagagcccacatcagcgctgagaacctcttagtttaaacagtattctgtttatttttctgtcgtccttttgggtttatttttacttggtaaaatttttttgtgagacttttccactcttataatgaaactgctctgtatcccaagctttgattggccttaaaaacatattcctctttaaataaatagacctaaaaaacatttttaaagtagttgatatatttatgctattttgactgttgtttcataatagtaagagaagacttttcagaaaacctttcttagaagtgagattctttggaaaaggataagtgtttaaaattcagttgtatagtttttcaatctgaatttttagaaacaagattgattattgaatgaacagtggaaaatgttaccctaagacaggtataattgcttttagtaaatttgccaatgaaaaagtttgggccaagtctgggccagcagattggtcagtggataacaaatattgctcttacagaggacacaagttctgttcccaggacccacatcgggtgattcataagagaattcataactccagctcatctcgctttcacaggcacatgtacacaggtatatatagccatgcacatactcacataaataataatttttttttaaaaggcaagtagtggtgacacatgcctttaatctcagcactcaggagacagatttctgagttcaaggccagcatgatctacagagtgatttttcaggatacccacggctacacagaaaaaccctgtcttgaaaaacaaatgataaaaataaaagtgtggcccaaatgctaaaaagaacctcatatggtaaatacaaattggaattaagaagaaaatagagttattgcaaagcacagcattactgaacacatgattcaggtgcattgctgaaggtaatctgtggtttgaggtaatagagaagagcactgcaacaggagtcccaggtgggtgctgggattcattcctctgctccctgtctgtttgtggcccttggataggttattgaaccctcataatatgcctctagtttttcaaatacaaaagcacttgcctacatagcaggttattgtaaagtcacataagatagcaaggataaaaacataaattgtcatatgtgtgttattatgaagataatttccattatgatttttttttctgtgcatggtagctcacacctgtaatcccatctcttgggaccacgagacaagaaaatcaggaacttgaggtcatcctgaactatatagtgagactctatgtccaaaaaaatatttttttcctatgggtaaaccatctattctaatccttacctctaaattcttaaaaatttgttcaggaaaaatcaaggaccctttgaagcatccttctcaaccagacattctaaaagtctagcccaaaacacaagagctgatagggtgtctgtggttatgccattagatagctatctcctagagaaagcttgtgaactacttaatggctgatttttgtaaggcagttagaatttactctagggttttatagggaaaacatcatcttcaatcttggaaaagaatgcctggttcctatatgacaatattgatctacagtgaatactagtaactgcttaaacgtgtgtgtctgtgtgtctgtgtgtctgtgtgtctgtgtgtgtctgtgtgtgtgattgccactacaacctgtttttaaaatctgaagcaacagcaatggggaagccctaccaaagtctttgtgtccattcattttttaaatttttttaattaggtattttcctcatttacatttcaaatgatattccaaaagtcccccataccctaccccccccccactcccatacccacctaccttcttggccctggcattcccctgtactgaggcatataaagtttgcaagaccaaagggcctctcttcccagtgatggcagactaggccatcttctgatacatatgcagctagagacacgagctcctgggggtactgattagttcatattgttgttccatctatagggttgcagatccctttagctcctttggtactttctctagctcctccactgggggccctgtgttccatcttatagatgactgtgagcatccacttctgtgtttgccaggcaccagcatagcctcacaagagacagctatatcagggtcctttcagcaaaatcttgctggcgtatgcaatggtgtcagcgtttggaggctgattatgggatggatccccgggtgtggcagtctctagatggtccatcctttcatctcagctccaaactttgtctctgtaacttcttccatgacctgaaaaagtgtccattcatttttattactttttttttcattgaaacatggtaggtcttttagatgggcttggtacatgattagagatacctgttgtacacatttgtcagacctaaaatgtgttttgtggttctgctggtcaaacccaaagaaagaaaaaacaagactgcaggacatggtggtacaagcagaggccggaggatctctcagtataagtcccaggccagccagggccacatagtgagtgactcgctgtctccaaaaggatgagagagagagagagagagagagagagagagagagagagagagagagagagagagagagagagagagaaaagaagaagaagaagaagaagaagaagaagaagaagaagaagaagaagaaggagaaggagaaggagaaggagaaggagaagaagaaggaggaggagaagaagaggaggaggagggagggagggagggagggagggggaggggagaaagccttgggttcaatccccagctctgcaaaaaataacaatagtggccaaaggtgaagaaagattttatgattggacaaaaacattcattcaatttaaaagatggaagggaaataaattaaaacaatagttctcctatataattgcaaaaacttgaagttagggaccttttgcagagctggaaataggtaacttgcatacaactgaagaaatgccccgctttgtccattaaatgaatcctgtttgtgtataagctatgactataataagtcacttcagaagtgacaggtaaggaggtttagtaggccactggagaccatgggaatgcaggctaatagatgtcttcgatgttttcagaaagataaccatccgctggccccatcagcagatacatcccttggttaagatgggggcttcctgctcatccccctccccagtcctatcccaggactattcacttcaaggtgtagtttgcctattgcctacaccaacctgagagtcccttgaggccttgagagcatatttctgttttccttgaagcccttacctagtacctggccaaaggaggaacattcagttcagtaaggaacctggtcattatctgacccagtagggtaaagttgtattggctagtaatagaaactaaagaattgggagttgttgttattgtgaattctcttttgataacctcagtatcattttattccactagccatgatgtggtttggagaaccaaagattcataaggacattggtgactacttttttttctacatgttctctttccaaatctttcaataagggaacaaaattgattttgtgctattttacaagggtttgttgttattattctttggggctcttgtttgttttgcttttgtttgtttgtttgtttgtttgttgctacactgagcaaggtaaaaaatccaaagaggaggattgtgtccttacatctttaggaataccagggacaatgggagctaattcctaccttgtatctttttattccatttgatatctccttaaggttcctggtgaaaaatctcaatagcctgataggcataaattatccaaaatttaaaagtaccaatagttacttcccaacaaataaatgattaaactggcatatctgtgccatggattatacaactaagcaatgaaggagaaactggatgactacagggacgtatgctagggttcaaaaataaagaagagccaatctccaaagatcatatgctatgtgatttcatttagatagcctccctaaaacagcaaaattagagaagtggaaaacaggttgttggttgtcaggaattaggaaagagcagaatgggaggcaaatgaatgggtctaaggcatcatgacaatgccttgtagggatggatgttttgtagcttattgtatatgtcattacatatgtcaccatattgtatattacatatgtcaccatcctgactgtgatatctactaagttctttttcagatggtattttcagagaaacttaaatctttgtgtcattttttacaagtacattacatctataactgtctcaaaataaagacagatttttaaaatagtcacagtagttttcatgtggaatgacacatgatttgtgacttaaacaccaaaatttaatgtaactaaatagcactacaaatataagtagcttatgcagcaatttgtttttgctgttgtagaaaccttggaacatatgagcaaaaaacagggtgaactatgtaagaaaatgataactactgttagacttctgctgtatttagatttattttttccactgtgtgtgtgtctatatgtctgtctgtcttgttttttttactataattagggaaatataagttccatggttttgtgtctacttttctaaattttatattataagaattctcctatgtctttaaatttttttcaaaaacaattttcattcatctatacatgtcattatgtaagcatcctaataatttacgtgatcattgtctattaaatttatctttcatttataagataaacatccttgtacagaatccttctatttttctctttagggtagatttttgcaaatgaaattagcacattgaaacacatagacatttaagggttttggtatatgttgcctggttaccttctggggaaataaccctgatttacattctcaccaataaacacattgtaatattagggtaggaactgagaagaagaagaactagaaacagttcctaaagaatattttatttttgtctgaatcagggtttttcatactgaatactgacattttgggtcaggtgattcttagttgtagggtcctgtcctagatactggagaatattcagtatcacccctcacctctactactacaggccaccctcccttcctgctgttgtcacaacccagagtcgccgcagaaactaagaaatatcccctaggagagcaaaatcaaaccgtcccacacagtcaaggaccactgatccgaagacttagctacaaatgaagcacttattttcagacttccttggtatatacaaatgcgctcaggcctcttgggattcttttcttatggagtgtatatttgcatattatgtgtagtgtaaaacagattggttctttaaggctgtgtaaatgactttaataatattcatgtttatctttcactaatgatacctgcctactgtgcactcccattttctttttcctacaaaagaactttctttaacatatcctgtggtaattggatgtatccactatgcacatgtctgttaacctaccagccctttgtcattgagtctgtataaggatctgagacagtgacagtgactttgcttctcttgactccatatgtaaaatttcaaaaaggaataaatagactgaggtctttgctaactaaaactaaaaaagcctccaagcttatattaagtaccaagagctcttagttgatggtctctgactcttatccatagtttcttatactgtcagtatgtaataaaatgtgtttataatattgcaaagagccttaggatcccaatacctttactgtctagctgatgtataacttgcagcacccagatcatctattatagtagcccagttctgttgacagagtgctttaattttaaaaaaaaatatttattttatgtatgtgagtacactgtcactgtcttcagacacaccaggagagggcatcgaattcccattacagatggttgtgagccaccatgtggttgctgagaattgaactcaggacctctggaagagcagacagtgctcttaactgctgagccatctctccagcccaagtgctttaacttaaacatacaagattaagttcactttaaaagcaaaaggcagaaatactttgttgaggacataaacacaaggtattctgcccttaaatgacatgaagcatttgagcttctccttcataagaacacaagccttctcagttctgatactcattgttattaagtgtaagcttagggttggaaaggttaatgtaacactgactatgcactagcagtttctttcccatttgtccccccaggagccgtctctcaggtgctggacagcctggaagagattcacgcacttacagactgcagtgaaaaggacctagattttctacacagtgttttccaggatcaacatcttcacacactgctggatgtaagtcttgtctttttttatttttcttgtttgaagaacatttagtatttagcagacctcttcatagagattcccagatcttacagcatagtactcccttttcaacttctttgtatctgtgaaaatggggaaaaccatctagtaccggttccaaactaaaataatcatatgcgcagtacaaatgcagtatagcctaaccagccacaacagggaaattgtgtgtacttataatttgtgcacacaagtgatgagcaagattgttagagtgtagcacaaccctaatttaccaaggtaatttttctactataacaaattattaatcttaacagtgatttctctctattgccttaaaacattatttctcaatcatgcatacagaagtgataaaaaactaagaggatactgtgcaatggagtaggtctacacacatacatatttaatatcactgggacaccaacatttgcaaatttggtatcttcaaatataaaagagtgtttcattattaaatttggcagcagattaggacccaaataacaacaaaaaaagcccagaagcataaccagatgtggtggcacatgcctccacactcagcactcagaagatagaggcaggcagatctctgagtttgtgaccatcctggtttacatagaaagttataggacagccaagactacatggtgagaccctgtctcaagaaaagaatagaaacagaaactgaccattcgtgtctgttttcagtatactctcagaaagcatagttgatttctacagtgaaaatcgtgggtggttctgatggtaatagtgcatttcaggtggtgtgcaggaaattctttcccttaagaagagaacataacttctttaggagacctagaactgtttggtgcttcttgattcacccaccgttgatgcagattgcactaaggcacagcaggatgtgctataaaacattctgctaggtaatgcggggcaggaaaggaaaaaggggctttaactgattggttatttgatgactaaataagtgtggggttcaggtgggcattgttaccagtgctaagatgtcctgacgaaaaggaacttttttgacacaggatctctcactaaacctgcagcttttgatttttctgggctgactggccaatgatctctaaggaccaccctacccccagcattgaagttacagacacaatgctgagcccagctctttatgtagattctggggctctgaaatcaagccctattgcttattacctggtgcacacttcactcacagatcatctacccctcccctggtttgttttatatatatataaatcaactcactaactgttataataaacagttctaaattatgggtataggagctggaaagagagcacacctggttatccagaggacccaagttcaattcccaccacccacattagacagctcacaactgcctgtaactataagagatccagtaccctcttttggcttctataggcaattctatatgcatttgcacataattaaaagtagtgtagagttggtaaagtggctcggcatatgaaggtgcttgctgccaagcttgatgacctgagttcaatcactgggtcccacatagtaggagataatcaactcttttttttttttaattgtatttgtaattcattttttacactccatattttattgcccccacccccatccaccctccgactgctccacatcccatatcacctccccaccccacctcatctccatgtagctaaccccacccccacccccaccccacctgacctctaaacttcctggagtctccagtctcttgagggttaagtgcatcatctctgaatgaacacagacccggaagtcctctactgtatgtgtgttgggggcctcatatcagctggtgtatgctgtctgtttggtggctcagtgtttgagtgatctcaggggtccagattgagacttctggtcctcctacaggatcacccttctcctcagcttctttcagccttccctaattcaacaacaggggtcagttgcttctgtccattggttgggtgcaaacagctgcatctgactctttcagctgcttgttgggtctttcagagggcagtcatgataggtccctttttgtgagcactccatagcctcagtaatagtgtcaggccttggggcttccccttgagctggatcccactttgggcctgttgctggaccatcttttcctcaggctcctcccaacctcctatttcctgaggttgcctgtttaaattctttctgctgaccctcagggcttcagtccttttccctcacccaataccagatcaggcttccctctcccccgactccccaccccatctgcttttcctctcaggtccttccctccttccctgcttttgattgttttcttctctctctcaagtaggactgagacatcttcacttggacacttcagcttgttgagctttttgagttctgtgggttttgtcctgggttctgtactttttttggctaatatccacttattagtgagtacataccatgtgtgtcctgagttatctcactcaggatgatatcaactcttatacattgtctttgacctctgactttagaaggtaggggacctagaaaatacaatttagacacaagcatagatttgacatgtaactcagtggtaaaacatttgtttagcacgtacaagatccttggtttgatcctcagcactcacgagactgaggcaggaagaacacaagctagaaaccagcctagtgtgcatagcaacagtgtttcaaaaaagagaatgtatggatgaatagctcttgggaagaaacttttcaaactttgcccatccatttattctccttctactactccacaccccatgcttaatatggatcgttttgtttgacaggggcctcaacagtgacaaccactgacagaactgattggtataagtatagatatatagactgatggaacaaaaatatttagaaataaactcacatttataactaagatgtcacagaagatgtcaaggcaattaaatggcaatgcaatagtctttagatgggaccaccactattgggcctccataaggaaaaatatgaacttggactcttataccacatacaaaaattatctcagaatgaaccataatctcaaagggaattatagattcattttaagagtttaaaattataaattttgttttgtttttgtggtgttgggagcaaacatgagataacatatctgttaggcaagtgctttgccactaaggtacctcactagtggcatggcccctaaaactttgaaaatacacacacgtatgagtaaatcttcattgcatgcaatgggcaaacacaagggaattgggagaaatgttctgaaactggattgagataattatgtaactattatttaaggttttctgcagtaacagaaccaatacaatgagcatatactaccaagggacttacacagtgtagtgcagaaatccaacagtgagtatttacacgctggaaaggctaagtactcagtagctgttcagtccatgaggttgaatacctcagcaattccaatattatactcaaggactggaggaatcctagacagctgctggtcttcactctatgttggaagaagctagattccagtgtcagcaaaatatggccaaagcagtatcggcaacaagatgcatttgccagcaaggaacaaaggcaggcaggcataaaaaacagcactgctttttccgtacactcctttccccctagactgtggggtgctgcctactctaggagaaggtctttcctcttgttcacccatccaggaagtcctttatggacctggccagaagttcatggttctaatttaatgccagatttaattcaagttgacaagcaagataaaccatcacagctatatgtttaccagccatcatcaatctattcacttatagtggccacgccgtgtacttgaacaaagccctcatagatgagagaaagcaatcaggtttttctttaaacttatcttagcatttttgtaacctttcaagataaggtgattttaagaactacaggtgtaatgcttacctagcatgccgaaagccctatattcagtcctcataagtcagatatgactgcctgtacatgcctgtaatccaagcactcaggagactgtggcaaaaggatcgtcccctggtcatcttctgctacagaaggagtagacaccagcctgagggacatgagacaatatctcaaaaaaaaatgaagaaaaggaagcagcagcttgttggaaaacactgagttatacagtattatacatcagtgaggagagcgcagcaggacagtgttcttgtgatcattccatctacattcaagtatgcatttgccacttcccacatttcaaagattttggcagatataatataatataatataatatcaacatttggacattttatggttatgatatgaacttaacatttaaattgaccattgcacattgtttttttttttggttttgattggcattctctaatcaaaccattttttaatgttcatttatgagagaaaattatcttaagattcagaacaaagttaaatcgaggctaatttgtcaaaaaattgtcatgattctgtagattagaatagtttcctatctttttttaaattttctgagatttatttttaattatgtatatgtgagtgcaggtacccacagaggccagaagagagtgtaaaatcccctggagttggagttataatagttgtgggtgacccagtatgcatgctgagccatctcttttttttaactttattattttattagatattttctttatatacatttcaagtgctatcccgaaagttccctataccctcccccccgccctgctcccctacccacccactcctgcttcttggccctggcattcccttgtactggggcatataaagtttgtaagaccaaggggcctctctccccagtgatggccaactaggccatcttctgatacatatgcagctagagacacgagctcttggggtactggttagttcatattgttatagggttgcagacctgggggtcctgtgttccatcttatagatgactgtgagcatccacttctgtatttgccaggcactggcatatacgagacctataacagggtcccttcagcaaaatctttctggcatatgcaatagtgtctgggtttggtgcctgattatgggatggattcccgggtggggtagtctctgggtagtccatcttttcgtcttagctccaaattttgtctctgtaactcctttcatgggtattttgttccctattctaaggaggaatgaagtatccacccattggtcttccctcttcttgattttcttgtgttttgcaaattgtatcttgggtattctaagttcctgggctaatatccacttattagtgagtgcatatctaatgacttcttttgtgattgggttacctcactaagtatgatatcctccagatacatccatttgttcaagaatttcatgaattcattctttttaatagctgaatagtactccattgtgtaaatgtaccacattttctgtatctattcctctgttgagggacatctgggttctttccagcttctggctattataaataaggctgctatgaacatagtggagcatgtgttcttatcaccagttggaacttcttctgggtatatacccaggagaggtattgctggatcttctggtagtattatgtccaattttctgaggaaccaccagactgatttccagagtggttgtacaagcttgcaatcccaccaacaatggaggagcgttcctctttctccacatcctcgccagcatctgctgtcacctgaatttttgatcttagccattctgactggtgtgaggtggaatctcagggttgttttgatttgcatttccctgataattaaggatgttgaacattttttcaggtgtttctccatgctgagtcatctctacagcactattttcagcactgtaaaatatacagttctatagggataagtgcatttacattgctgttcaactactgcaaccttctattttcatctttctcaactgaactaaaacataaaacaataccatcatcctctctcactcttggctcatgacagtcataattctacttactgtctctatcaatgttattattccaagaacatcagtgaatcacaaaaatttatctttttaatgtttttagttatgtgggtgtatgtgtatgggtatgtgtgggtgtgaatgtgtgtgtgtttgtgtgtcctgctacttaggtgcatatatgccatagtatttatgaggatcagaagtcactttttaggagttgactgcctccttccaccatgtgggttctgaagattaatttcaggttatcaggccttgggacaaacaactttacccacttagataccgcagtagtccagtatctgtctttttattactagcctattttatttagcatcatggtccttatggatcatccatgttgtattaaaatttcctctctttttaaggttgaatagtagtctattttgtgtgtgtatattgcatttttttctcccgctctcccactctccatgttatgtggtaaatatgtacaggaaaaaacagcttctcaaaatgccaatcacagagatttctaccttggttcattcatcacataattgcgctttctggatcccaagttggttcctatattctttctcatttttaaaagaatatactatcttctctgagtatgctatggattacaggggtttattgtggctcctgtttttgggggggttggagttttggggggttttggatggatttgcataaaccagagtttgaaattcactttgtaatactaaagtagatcctacaataataaattcaagttcaagctattcagtatgtgctgggccctacccaaggatatgctaaattccagagtaggactctaatcgctgctttactccagtcactagtttctgtggtataacatacttcttcagatgaaatacaaggttggtttaagatttctaaaaggtgctttgtttagtgatgctgttcaaagaaatggaagttcaattttctagtaatgcatggaatggagaatcatctgtatgactaatattttaatgtcttctttttaactactcaaaatagactgggagctagagagttgataaggtgattaagactacttactgttctcctgaggaccagaggtcagttcctagcacctatatcaaatagctcacaaccatctgtaacaccagctccaagggatctcacactatcttctggactctgtggatacctgaacatatgtagaatacattctgtcacatacagaaagaggtgagaaagaaaggagaaaaagggagagaaggaggaagaagagagagagagattttaattaaatagatttgaaaattctgtaatgcataagtttttagggagaaaatggtactgataggatagacaaatatttactccataaaagaaagatcacccagtgggtttttattggggggtatatacctcagcaaaattgaaatttatttttttatttacaatccagtcgttccccaccctaaccccctcagtcccctctcccagagttactcatcccatttcctcctcccccttgcctctgagagggtgctcccccgaccagaccttcccctttcctcaggcctcaagtctctcaaagattaagtgcatcttctcccactgaggccagaccaggcagacctctgcttatatttgtgccaggggcctcggaccagctcgtgtatgctcctggttgatggctcagtctctgggagcttcctgagggtctgggttagttgagactactggtcttctttgggatcacactccctttcagcttcttcaatctttcccctaattcaaccataggggtccctggttgggtgtaagtatctgcatctgtctcactcagctgctggtagggcctttcagaggacagccatgctgggctcctgtctgtaagcacatcatagcatcagtaatagtgtcaggccttggtgccttcccatgggatggatctcaagttaggccagttattatactgactttccttcagtctctcctccatttttgtccctgcagtttttttagacaggaacggttcattatgaattttgcaggcaaatggatggaactagaaaatatcatcctgaggtaactcagacccaaaaggacatgcatggtgtgtcctcactgataagtggatattagccaaaaagtacagaatacctagaatacaacccatagaccataagaagttgtaacaaacagaaaggcccaagtgagtagacttcaatcccacttagaacaggaaaggaaataatcatgagaggcagggggatggagggacctgagtaggagagggaacagggaggggaaagggggaacaggatcaggtatgtgggggaacaggagagaagcccagtgacaagagaatgaatagagataagcagcctcaggggttggggtgggagatgggggaccctctagaatgtacaggagacccacgaggtgagacactcttaagggctcaatgggggtgcccttagccaaaatgcccaacattggggagagggaactcaaagagtctacctccaatagatagacagggtctcaagggggagggacagggttattaacccacagtcaacatttctgacccaaaactcaccatggtggcttttataacattttgtaaattgtggaatcacaatgatgcataatcattcttagatgtgtaaaaaatttttctttcagtttataaatttatagttcctcaatttttctgaaaatgcaattttaagatgtacaatattcctttcagacctgtactatctcatttttaatgtctgaaagggactttcatttttggttttgtttatattaaagagttgggtttccccgggctatccaggaactatgcggtttaaacttcctgggtaggtatctaagctgaaaatctcaagttggtatgttaatttgggcaggaaaatatagtttagatctctgaaacttttctccagtttacaacttcgaaaaatcatcttcaaagtgatagctgcttgtcagttccctaaatattagtattaagtcacctgcctttccctaacattttgatggatttcaaatatataatatgtgaaaaaaaaaagtccttttgcctagcacttctcagttcactaaggcacgatattggaacttggttcctgttccctgagactgtgaagggagtctctgacaggctgtctctcatctcatggctgccatttcatatagtctttctcacactcttactatctgtctcactacagttgcgggcacatttcattattttggagctaaaaatgaacttgaattatcttccaacaaaaagttgcttcagtgtctttaaagtaactggccgctaatgaacttaactgttctttgaagctctagaaggaagctcttcatttattgatctatatttagagtcttgttccaaaagttacaatcttgtctcaagtggtacatattcttgtcctttataaggttttctctgtggaaaaagaaaaggttgatgagctacacaacccagggatagttatttcatagtatcttcccactaactttaattatagaatatttaaaatagatatggaacagatacctaaatgtggaatatgtgagcaattatttctatttgaggactaagaaatcaagagtgaaatgtaatgctgtgttaaaataggagctgcctttaatgctttacaagtaaagtaaaagtgattgacttcatctatctgttggaaagtgcatgcttaggagataggaactgggtattgccactgagtttactctgctttgtttgcaccatctgtagaatacagtttcccaatggagttgcagtgactccaaggcggaggtgaagtgtgtctgtgcagctgtgtgtggtcatatctgacccagtgccaaagactggcagggagcacgtctgtctaggagtgacacagtgtgagacagcctgtttcccttgcagctgttcacatttccttgtttttgccttgattctatgtctgtggtttgtgtgtgtgtgtgtgtgtgtgtgtgtgtgtgtgtgtgtgtagtgctgaacttgggtagctaatttctttagaaaaagaatgcaaacagccagagctcctcatctttgtcttccttctaggaataatctattaacatctttctatcccctctcccactcccttcagcatgccagccttataaatatgctttattatcttcagatttaaggaatgcaaatgacaaaaaaatctattttgatgttaccagtctaccttgaacttataagtctggagcagaagttgcaagttatcaccctcaagccaaatccagccaaccacttatttgatacatattttactgaaacacagtctattcattgttaacagctgcttttatacaacacaacaggctgtaatagtagtgacagagaccagatagcccctaaaacctaaaaagttcccttttggccaggagaagattaaggttacttaacgtgacaaaaccatgcagttacttaacatgacaaaaccagcaactgattaacttccagatcatatgtagtttatttttgccatgatctatgaatagcattttctgcaatttccccccaaaatattactaaaggcaccttcctagcacgagttgttagttgttatctatttctaaattctaacataacccagagaggtctggtgtgatccagaaggccatgctctcatgccctgctgctctgcttgtgtaaccctaagtgcagcatttcacatacctagacattagttttctcctctttgttgaacagctttcagttgctatgacaaaacacctgagataatcaccttaaaaggaagaaaaatattttggctcacggttttagaggtttccatttgttctccctattgctttgggcctatgggaaagcaaaacattatggcagaagaagctacccacttcatgacacacaaaaagcaaagagaagaagtgaatggaatactgccatctatttcaatggcacagtcccactgacctagcttttcctaccagaccccacttcctaaaggttccaccacctgccactagtgccacaagctggcaattatgccttttaatacatgggtgcttgggtgatatttgtccagactataggattctctttaaaatagagaaatagaattgtatttatatctaaggtcttctctatatttaaagaaaaacttgtttagtaagtcagacttgaaagacccacaaaaaaataaatatgtacaaaatgtctttgatttcaggggaaaaaattttagtatgcaagcaggatcaaatagaaattgtatctggttcccaaagaaacaagctaaaataagtattctgctgtgtttatttttgtgctactctattttttttacaaatatgtatttataatcgctacatacaagttcaaatttttattttttgaagaaaacaattatgaaacacacactgtgtcctgttaccttatattggaaaactcaagggtcatggagaagaaaaagaatcccttacacagcatgttctataatcaccaacattagacggccacttcctttttggttgttgatgcccttggtgtagcagacatgccagtgttggtgctgggttgcaaatttgcagccttggcatagttggcacagcgtacagctagcctcagcagcacactcttgtctcctgccccgtgatgttactcatagctcctatttctggttcttcttgctctgttcaggcagttctcttggacaggactccatcagaataaccttgctcaggttacctctcatacatttctttgacttataggaagcatgcattcttactttaagatgtgctgcaagtgtgggctatcccaggtgaggcagaaaaggaagccctcacatactaaaggaacagatacaagtcatttttcgcttaacctaaaataccacatgttgagcctccccaaggattctctgaacaaagctatctttcctagtgcaacagtgtaggactggactataacttgctgcaacttgacaagccctggccagagaccaaggcaagaagctccactctctggaacttccagttctgggacaagattttctggaggactccctacccttcactttttatagggggaagagtaggtccctctcctttccttctcaagaaggggaagggaaaatcaaatatgagctctccctaattctgtgactcctacacatgtcaggcttctgcctccgtaggcagaataaggcttaggctgagtgtggaaggaacactggctgctgtgcagcaagctctacaccagcactgtcagcttcctgttggccttagatgacattctttttttattattaaccaacgtgattttattgctcttgtacacaagagaatttatgccaccagagcagaggttgtggacaactcaatttccaattgggtggaagcacctgcttagtcttttagtgtcaagccaactggtaatttctgctctctatcagaatcaggtggaatttaccatccttatcctttctgttcctctcaagatgcttgtggacagcagctgctttcttaatcaaatggcagagattcttggggagatctgggacaaggccttgggattctcaagattttattaccagtgacacagctcccattcatgatggtggaggtctaatagcaaagacaacgtttatgtgtgtgtctgtctgtgtgtgtatgtacgtatgtacgtgtgcacgtgtgcacgtgtgcatgtgcgactgcagctgtatgtgtgcatgtgtcaggccataccaaaagcacagagttttatctgagcaccttccttacaatataggcatgaaaggtctgagattctaggaacctctatgccactcaggaagtcatcctaaagctagaactttactttaaagctagttctgacttcactgtcgtctgttttccccatctgtaaaatgggaatgacagaggcaccagccttgcaggagaagctgtggttaagtggatgcatttatattaaggtctttgactagtaattagcatctagtaagtgctcagtaaaagcactcatcattgttcctagtgtgcaggttaaatatctctaatctgaaatgcttgagatctgaagggttttatactgaggatttcttttccaacattaaatatttgagtacacataatgatattttggggttaggagcaaagtctaaacataaaattcagttacgttccatatatagcatgtacacacggcctgaaaagaattttatgcaacatttttagtgtgtctggaatttgggtacaacctctcatgtgaggttaaatgtggaattttccacttgagagtcagtatggtattttagaagtttcagatttgggggcatttcagatgttggagcatttctagttttaaagcatttcaaatttgtaattttttctttcattaaaaagtagattttgttcttacataatatatccataaactttcccctccctttaccccatccagtttctccccaccatctctcccatccagatccaacccctttttgttgcttattggaaaacagattcctatgggataatcatagtcagcagaagcagaagagctcaggaaaagacaggaaatattgcgtgagtgtggattttagaagacaacctttgagaattggttctctcctgccacccaggaatcgagttcatgttaacaggcttagctaaaggtgtctttacaaactgagccatctctcaggtctagtgtctttacatattgttttattttgctaagaatacaacatgggggctggagagatggctcaacagttaagagtaccgactgctcttccaaaggtcctgagttcagttcccagcaatgatatggtggctcacaaccatctgtaatggggtctgatgccctcttctggtgtgtctgaagactgctacagtatactcatatacataaaataaacaaatagatcttttaaaaaaaagaatacaacatggtatttactgtcaataaaaatgtaagcctgttatcgacagatgtaatgttataagattttttattcaattcttgtaattgtaatatatttaaatatttataattcagagtgtcttttgttttggattttgtagtagatggcattcacgttgatattttatatatgcagtaattcatttcatagattagtctgggaagctaatcgctacattatttctgtaagctgggcattgtggtataccctttaatcctaatactttagagtcagcacagatctaactctctgaattcaaagacaagtaggtatctacaaattagaggccagcctgttctacacgctaagttccaggccagccagggctacatagtgagtccctgcctatttctataagaaagtacttttttttttcattctaaattttagttagcaaaccactagagatggaaaccttaagaagacagagactatatctatagatagatagatagatagatagatagatagatagatagatagatagattgattctccaaggatttggtcaaaaagcatatcacctgtgccctaaaatgttaataaaatgtttgaatagcattttaccattctgctcaaactatttattcagccttcaattcagtagtactttcttaattaatggccctttctcttggtcgtttttgttacctcattggcctaaatatttacaagtcataaagatttatctcacatctagctataatttgaagaatgtttacagtcagtatttcacctctggaatagcattggtgtacagagggagaaaaaggtagggaacaaaaccatccccaaaatctcaaactgttttagagaagttaggaaatagaagccatcagacaaacagaggtcagttttaacattatacttttcagagcaggccagccactgactgtgagccattccatttgaggtagaactagtgttttaattacacttctagactgcagtgtattttctctgactaattaatgttctttatcaagttgctgtttgattctttcaggttggaggaattgtaaatatattcagatttttttcagtcttctcacactccttgaatttgcaaagccaatagaaaccaagtttctgtccatgactccctgttgaagtctccagcactgattctattaatgaatattcctactaagacgagcacaaacctctgtaagaacattccttcctagaaggagttacatttgccctttcccaagatcaaggcttctatgaaaattctttcagactcttcttggccagaatctgttcttcatttgactccacactcccgttagtgagcattgcttctgtctggaggaaaacactggggttgctgctatattgacaaatgtgaattgctaaggatagagttttggttcctctctttaaaaacatttactttaaaagatgtgcataaaacttatattctgaatgatgaacaattgcaaagaagactcacttatatcatctctctgactttttaggaggacaaatgttgttttctgaaacaataaaccaaaagctataaactgtagcaaaacacgatgtgtattgatcggattttcttctttgctttttagctgtatgacaaaattaacacaaagtcttcgccacaaatcaggaatcctccaagtgatgcagtacagagagccaaagaggtaagtggcatatttttctcaaagtacatagcattgtcacgtttgccacctttactgaagatgtctttgcatgttaagggcacactgtttaggatggcagcttgaagcatactcagattctggttgctaagtttatcattgaacatccatgtgggaaagaaaaagtctcagcaacaagagtccccaggcttctccttctggttctgctgtgcaaatgagcatattgtttggggtgggattgtctttttaaaatattattttactgtacatggaagaaatagacatgcttcaaattttttagttgccttttaaatgtggtactatgtagtggttaattgactttccagaacaattaaatatactgagttcaaagaagtcatttttttatgcatcatcaatatataaaagtatctcccacaagctttttttcatacttgcttatcatagaagcatggcattgcagagagcttggaaaacaaaattcacccagaatcatttgcatatagaatttgatgtattaccaatcgaaatatgttggtttgagcctagaattgtgtaataagcattttacacctttatttggtctttataactatagcacaatgactaattttttcctattactaaaatgatgtagaaattaccattagtaagtgccttattatttttactgtttgttttaaagtttttacgcaaataaacctttctttttaaaaatattttataaagtgtgattagtaaatgtgattactaaatgtactgaagacataattttatccctttcctagcagatattgttctgggttttgttttattaagatagaatctcaccatgtactcagtgttgggatgttaggtgtgtaccaccccatctagcttcttagcagaggttaaacatgacttttgataaaaatatacattgtatatgctcatatactcactgagaaattagaccatattggctgccaggcctgccctcttggtgagtctccggtaaaagaagtctgtcttagtttgctcagcaagcattctttgaaaggaattacactgtcaggcaggaatcatgagtcgctgcccaatcttaacaatacccaaacagacagaagcagagatactctgggcgggggtggggggacaatcctttgtcctaactttacagtggaagaatctcccctagctcaggaggtcagactcaatacttaagatcatgggctatgaaagtatcaagggaaaggagagagtttgtgctttcccctgttgtttcctagaagagaagctgaaaatacaccgaagaaaactatgttaatatcattaagcaatataaattagctgtataacctgcagccattaacagagcatttgaaaaaaaatactagtatgtatgtatatgagagtgtttgttttgttggttggtgtgtggggtgtgtgtgtgtgtgtgtgtgtgtgtgtgtttcattcattcattccttatgtgtgttttgtgtgttcatttatttcttcactcactcactcttccccatgcttaagtagcagagctcattacatgctagaatgctgaaatctgagactcaagcagagtgagagtgagcccctttctgaagtccttgaaggttaaggcaggagagtcctactggttgaggggatgtgtgccccttacaacccatggtgctaaggcaatactagataggctccatgattagaattcagttgagttcagtgtagaggtctctgtgagccatctgcagtaaaaacagtaacaggtgcctactcagagaaactccattcctgggtggaagggagaagtttttaagaactgtttacttgcaagcagcattttcaccaatgcagagaaaatgttaatgcctaattggcaatgaaaagttgctgctgaaggtgtttaaatttttaagtttggtcttttgtttgctggagtttcatcaaaggttcatttggtagaagcatgcttttctctgtgttgaaagataagcattttactcctgccaggctacaaggaaaatcacttacatgtgttcttagttaattatgctagttaattagcagtcttatgtatattgttttcattgaacctgtgtcatcttttaaggaactagcagtgttgttaaattttaaagggcaaattgatttggggagggaatttgtaaggcatattttccttaagctacttaagttacttaaacctgtaataagtatgtgttacaagcttcccattttgcttattagtttttttgttacctttggatcatagttgggtaatgaaggcaaactattattacccaaaacatttcattttattactatcaatattcttatacttcaataacctttgaactcaacaaatgttttgaaagtaattgactttcctgctacaaaaatatattcatggtttttaatttaaaggagttccatgctttgtacagctcattttgcattagtgtgtatcttatttgtttttctaggtattggaagaaatttcatgttaccctgagaataatgatgcgaaggaactaaagcgtattttaacacaacctcatttcatggtaagtaacacatcactagacatacaacaccatttcacaagtcatttttaataaccttcctaaaatattgctactgtcatcaaatgtcataaatatatccttgtacacctgctggtgtgcattttagagaatatgtcattaggcagtttgccattgaaagtacatcacagggtgtccttacaagagcctgggtgatagaggctactagtgtacaccaagctacagtgtgtatggcagagtcctgggaggtgcttagattcccatgcagaaccatatgaaatttaacaagcactagagagtgataaaatcaagagacaccataacacaagcttgtgaggctagtgccaggataacataacatacacttttacaggaaacatgttgtttctttattttcattttgcttttagttttggttttatttttgatgtaagatctcactaggtagctcagagtagcctcaacttcagaatcctgcattgaactcctattaagattataagcatgtgctaccatgataaacttttcctaagtagaaggggcagactgtgaaataatgatttaaggactggagagatggctcagcggttaagagcactgactgcacttccagaggccctgagttcaattcccagcaaccacatggtggctcacaaccatctgtaatggggtctgacaccctcttctggtgcgtctgaagacagcaacagtgtacttgatttataaaataaataaatcttttttaaaaaataatgatttaaaaaagtagtaactacctaagccagcagcatcacagctctcaagtctgatcggccattcataactgcatgcatcatgctctcatctgaactaactgcactagtttctttgcaccagcatcaacaccacaaccaagtaactaggcattgtgcatgaactcactaggccctaggaatattttgctttcgatataatcttgtttatgtagtgtctcattggctcaaatatcattttgtagttcatgactataatatcagactaagattataatcctaggtaataacacattgttttgtttcattattgttgttgcccttgtatcacagttgtaaacgtgccacttgtcaagtgctcatcaaggactatgtagaccccacataatgatctgcttccctgtgttctcacatcactcactgcaactctatgctacctaaaccacaaagagctgaaattgacgacaactttttaaatgaaaagctgtcttcagttttcacattatatttatttacggggcacatgtgccacaatgcatgcatggaggtcagagaacaagctgaaggagtctttcttccaccatgtggcttcaggaattaaactcaaagtgtctttgttttagacagtgcagaactcccatacttttttgttgatttctatgaaaatggaaatagcacttatgtttagccaattattagaagctctaagtcgttaagaaacatttttgtagaaaagaagttcacagatatctacttatctacaattcacaagtagaattacagggctgacaggacagctctgtggtggaaagggtctgctgctcttccaaaggacccaaggtcagtttccatctcccaagtcaggtggcttataactgctataactctagctccaagggagccaacatcttctgacctccaaggtcataaacacacagttgtatagacacagacgcataaatgaaaataggacagatttttttttgaaaaaaaagcacaattataggttaaaatccttgatgaatataatgtggaatatatgcaaagagttaaaaacccagctaacttccctctgggtggaaatgtgattttaaaaccttgttgttcttattacaactatttattttaagtgttagttttaaaatcatagctacaatgaaacatatgtatcatatcaatgcctgtaaggttttaagtatatgctatttctttgtacatgcagtgcttctaaaactttaccattgtccttctaggttattatctatcattttctatttcccttccctaatttttctaagttttagtggccaaactcaagcacatctctggaagtgtctaactctgttttatctgatggtagtgaattagaaatatacttcagtctgagcaagcacacttttacatgatatgtgtcaattcagagctcagttcgaatctcctttgctgtacttggcctggtttctgcctgacatatgcttaatgcctcctcagtgttagctaatgaggattattacctaccgcacagtatgtcatctgcctgtgcacagagcttatattgtaagctctagtaggcgctgagcatatttgacccatttgcaaggaggttcaccttactactcactgctctgtgcactgtgttctccacatttttgaacagactacgaattgctgtatagcctgagctacttcagagaattatataggaacatttcagactagtaaatcttttagatttgatgaagactacataaattagcatatccccaaataaggccttttttatcgggtaaatttttttccaggaaaaaaaatcattaaagctcatgcagaccagtgcctcacagctcaccttccttctaagccttgatctattttttatgtctaaacttagaagtgtgtgtgtgtgtgtgtgtgtgtgtgtgtccctatcaggaaacattttcagaaataattcctcaaattccttgaaaacatagctcagtacttaaaagacatctttattcatataccaaatatctaagtgcctactatgttccaggttctctatgctggccactaaggatctagttatgaataagaaaaacacagtctcaccctcaaagagtttcccatctcagtgaggctgaaggataggggtttctgattagaaatagactgaacacatcagataacacaataatttcatatagttacaataactatgaataagagattgtggtatagaggcagtagtacaagtgtgagctattttatatcctcaggggaaagccctctgaagagttagctaaacttgttctcagaagagctgggcccctgaacatccaagcgggaggaagaggcagaaggaagttgtgtaggtttagggaaccgagctaaagtccattaaagattggatttaggaaaagagaagaaagaggtacagaaatgcttacagagcttggcagaggccagaccaaggaggctcttccagaccatggtaaagagtctagagttttctcctggttaaagtagtgattgtattgagtgattgattgcaatcaagaaaatatgagctaagtcatgctttcatggttgctcctaggcatagttacacattcctgtagccccaacatttgataggctgagatagacgttccacaggtctgattcttttttttttttccgatcctcccatttttattgaacatttgatgtacatttcagccaccatcagggtgtacattgatatatataccccttaagacaaatgttaaaaaagggcataaggtaaatgaaatagaaatactacctccaattcaaaatacactagacataagagcaggcaaaaactaaatacttaaatatcagatgggctaacacacaggtctgattctaacctgaggtatatagtatgtatcaagccagccggtgctacagagcaaagcactgtctcaaaagtgagggggtagaagatgctggagctcacatgctgtgaatggactgtaggagaaagaccagttagaatactgaaaggaatgatggaggcttagagaaaaatggggatggtagcagatgggcaggttgggatttcatattggggatggtaggaagcaacaggacttgcttgtgattgggatgttaagttgtgtgactagccttagaagtagaaattgccctgtgaggtaggaatttgtttaaagtcatccacctagaataaagaaggcttccctaagactcaagccaaatctgactagctcttaaaaagcagactgttcataacacaaatgaatttccctgtaagcctatattaagcttattaataattcttgaacaagcatacatgtggatactgtctcttgaaagaaaattctaaaatatatattaaataggcttttaagtattaaagctcaaccctgctgtctcagaatggtaagacaggaaggttgtaaactctaggccaacctgggtatgttgcaggactgtgtctggaaaccctagtactaattgttcagtcatactctataggctatttaaaagaaaatgttcaaacttcaatttccttatttatatcttatgtattcttttttaaccatattatataagcattctgcacatgttccccttttctgtttgcatgtgaattagagctggggatttagttgtattttgtggcagcaatcactgaaagccgcaaattctggttaatatcaagtgtgaccttatttggcaacataatttaaactttttaaaaattcagcttggcactatttcgtgaatgaaggtttatttttccttataaataatacattaaatgcaagcacctgtttatataactttaaaggatttatagaaatcatctacaaaaagcaatgtaaacattttacccagttcataggacttgaaggctgacatcattcccatgaaaagcttgcctgtgtttagcaatcagacaaagcatcttgagtcataaaagacatctttgaacttagatgatgaacctgatcttaatagatgaacttctctacttggcccattcctgatttggcctctctgctctaaatcttagtttctttggtggctacagttaaaccacaaagaaggccttgcccatatagtccaaccttcatattttgtagccacatctcctggcccttcattgacctctgctttaaacctatatattggcacattgtcagtgccctaaagccaccctcacccaaatctgcagttgagaacagtggcctgggattgaggtagtgctgaccatttcaatcagaaacgagtaaattgattactcggagtacctgttgatgatgactcatcactgtcttccttccttctggttttggttggttggttggtcttggtttttcgagacagggtttctccatgtcgcactggagatcctggaactcactctgtagaccaagctggcctcaaattcagagagatccacttccctgcttcctttctaatttcaacacattattaccttatttttgcctttatgtgtgactttaaagtagctaagtcatggctccgataagccttttacaatatttcagatagcaaaatactatttaatcacatttcattatttgtgcatatctcattaccacacatattacagatgaaaatgagactaaatttagacttagcatatacatacttatctgtataaagttctaaaccgaacaataatcagttgtaaattctctttaactaaaatttctcatgtttattacaaagggtttgtgatgggaacaaagggtatcccttttaaaaaaataaaagagatttattgctgaagtttaccaagatgacatacagatgacaatataaaagaaatcatttttctttgttagtgcattttgcaaaatgaataagtaatcattttcaagttaggagtaggggtgtagctcagttgttaagagtgagcttacttcattcccaacatcacatgaaacaagtatggtggtgtactcctgtgattctggaacttgggaggtagaaacaaagtcatctttccctacatagtgacttcaaggccaatctgcaagacatgagaccctgtctcttaaaaagtaagaataatgatcagatttatgtcaaagccccccaagttaaaaattacaaaacatttcctttttgagatgaaatggctcatcaggtgaaggcacatttcaccaaatctaacaacctgagctccatccctgggactcccaaggtagaaggagagaactactcccacaggttgtcctgtgacctccacatgaacaccatgacacatgtatgtattcatgtgtgtgcacacacacacacaaacagtaaatatgtataaacaaatttaaaagttctaatttgagttctataatgtgtgtgatacttctaaaactttatgtcttaagtatatctatgcagttttcattttatttcttaaatcatgttataaattgtctttatcctttaggctatataaaaattgaaatcactatgtaattgtccattcaattgtaagaacctgaagattatagattctccttgatctatgcttctcccttatttccattacccaatctggtagtacgcaataccaatttcatcttttttattcatatacagaagatgcttattcagtacagtaattattacataatatcttttaaactttatatcagtttaaagccccagtgcaaatttgttggttctttttattattggctatttctgctaaattatttaaaatttcagtctgtcagccttgatttggacatgtgtgttaaatacagatttgtagcctaacaccagattgacaagcccatccattcattcttttgctctgtcacttgttcattctatttttaaaaagaaatccatctatctgccacaaagaaattgaggtctgatagtttggaggtgtacttcatttgtggtctcttcagataaaaaatacttttgagaagtggttatacatgtgtttatgtaacagatttctgctagaatggtaccataatattttccttctttcataaaaatgccaggccttacttcagactcatgatgtagtggcacatgaagtttacagtgatgaagcattaagggtcacacctcccccgacttccccctatttaaacggtgattctccagaaagtgcaaacggagacatggacatggagaatgtgaccagagttcggctggtacagttccaaaagaacacggatgagccaatggtaagtaggaagagcttcgaacttcaccctgtgcagactgctactcaaggagggagggaggatggagggacatggatggtcctaaagaaatcagtttccagccaggcagcggtggtgcccgcctttaatcccagcacttgggaggcagaggcagctgaatttctgagttcgaggccagcctggtctacagagtgagtgccagtacagccaggactacacagagaaaccctgtcccaaaaaaaaaaaaaaaactaaaaataaaaatcagtttccagatcatcaccagttctcctaccttttttgccaagaagtattctgcctaaaatcaggtcttagacatgctgatcatccacctctcctgtaccaattacttttcaactttccaagaacacggtcattactctggaatgttaaaaaaaaaaatctcatataacaaagaaagagggaattaagtaaaagagaaatttcaatactttgcatatcttttgctttcaccaaaaaatggaagaaaagtaattcaggaaatgttcagatctcatccattcacattgaactgtttgtctgttttcccgtgctggagaactgagactgtgtgtgtctgcactcattcttaggagcatcataggttgagatgatcaagaaagggctctggggtggccactgagcagacaagaactgaaaaacatgttagaggcttcaaagcagcaaaaggctgttgaatcattgtaagcatggagccggattgggttttcattttagaacaagcactttggaaactgttacagagtttagggagactagatactaaagcagaccctgccatggtatagggaagagatcatggtactcagaactggtagcatgtacatcaagatagaatgaaagagccagatttggtgaccatgcctgtaaccccagcactggggagacaggagaatcaattcaaggtcatcctcaactgcataacaaattcaatgccaacctgggctagttgatatcctgtctcagaaaggaaggaaggaaggaaagtaaaccagttaggcaaatagtaggttgcaatgagagacacaaaactcaaggatgaccctcaaacttcaagctcaaacaattgaatgcacaaggagatagtgagatggaacactgggcacatttcaagttgaaaaatgggagcacgtttccagggaagaaaacattcaaagatatgcacttatatcctttccttggagttcttaagagaagcgaaatacctacgtaagaaaagtttcaccagttgccttccagataaggaagaaatatagaagaacgggtctatgatcacaatttccagagagtcctcagatctagacactgcggtttgtattcttgttcactgttcttagtaagttgccttaccattatctggcagcacaaaggaggcatgcaaattggctatccattctggtattctcaggggtaagtgtaacacaacaagaatatatatttatactgaattatgttaacaatcatactaaatcttaataatgtaaattctcctattaaaaagcagaggttgacacacctttaattccagcactcaggaaacagatggatctcagagcttgaggctaacctggtccacaaaacgagtttcaggatagccaggactacacagagaaaccttatctggaaacacacaaatacacaaagcgattgtagtggcaaattcacacatgcatgcacatattaaacttgccaaattttacagtttgaaatatcttatgtgggttacaaaataaaacttattttgtggaagaaatataagggatacactaatataaagtatatacctttggtaggaataaaaacctttttaaaaataattagcaatataaaaaaacaaagtaaagtgaaaaataatcataattaaaatattaaaaggtagtagataaactgtattcttgctatttagcgatcaaaataccgacaagtagcatttctgtcatggaacaattttatatgtaaagtcttcattttctatatgttctcttctatttaaaattacctacaataaaaatcacaaatataagatagtgctttcatttaattgtatccttacgaactttgttttctttaacagggaatcactttgaaaatgaatgagctaaatcattgtattgtcgcaagaatcatgcatgggggtatgattcacaggcaaggtgagtcccaccagagactctttctttaccttccttaagtcttcctagacttctgatggaagtaggttttttatcattcacataaaagagctgtttgtcttttcagtttcagttattgtagaccttgttcctgaattccatccccaccaccagaaatgaaataaaacctccaagtactcttttatctgtatcccaccaattttgatatgtaataatttgttatgattcatttgtcattgtcttacatttccattatacttttattggcccaaaagttatttagaaggttggttttttttacagatttatttatttatttatttatttatttatttattttatatatgtgagtacaactgttgctgtcttcagacacaccagaagagggcatcagatcccattacagatggttgtgagccaccatgtggttgctgggaattgaactcaggacccctggaagagcagtcagtgctcttaaccactgagccatctctccagccctagaagtatttttatttaccatttttaaagagatttttttaattaggtattttcttcatttacatttccagtgctatcccaattttttttttagacatctttctgtaattcacttctgacttaatcgcattgtgctcagaaggtgtggtctgtatgacaccattactcacagctttgttaagaccttccctcctggaaagcactttcatcatttttatgcgtatatgtttatgaagagcctttatttttcaattgttgcatacagagttcccaactggcttggtgttgttaatctttctgttcaaatcttttatgtgttgattaattttttgtatgcttgacccacaaatacttcataaaatatccatttatcatagtaaagtatttcagtgtctatttataaatctctctttggacttaaatatttgactatatgaattaggtacatgggcctcaaactcactgtgcagccaagggtaaccttaaacttgtaatcctcctgcctctacctcctgagtgcttagattaaggtcatgcactattgtgaccagttctgattactatttttgatagagtacttcattaatattcaatgtaatgattctactgttttgctttcctggttcattttttggagatttttgttttattagcctctagcttctaatttcagcacctatttctgtgatactagtggttacctacaaattttaagtttccatatattaaagttaaacaatatctttttttttttgtttgttttttttttttctttttggtttttccagacagggtttctctgtgtaaccctggctgtcctggaactcactttgtagaccaggctggcctcgaactcagaaatctgcttgcctctgcctcccaagtgctgggattaaaggcatgcgccaccaccccccccccagcttaaacaatatctttatgtttatttatttctctgtacacacacacatgttctgtacacatgctgcagtgtgcacatagaggtcagggagcaatctgtgggaatcaattctctttctaccatatgggttccaaggattgaacatagattatcagacttgatgaaaaagccttttgcttctggcccagatttcttattttattaatcttatttttcctaggtctgtatagtaatgctttcatcagttcaataaaatattcatccaatcaaacattgccttttcttcattctctttgttctttctgaatttcagttagatgtacattaaacaatcctatgccatagctatttttatatttttttcttgtttcctggtttccctatatctttatttccatgaccttaagtgatcttttgttatatcttccagttcattgacactctcctcagtcatgtctgaattcttactcaatgtatccatttattatcttatgtcgccatttatggttttgtttagatgtagtagtcatttgttttgttttcagttctgtctgctcattcataatagtctcttattgggtggtcaacaagtttctttggccatccatcaaaactgtgctttctgtaagtaaatgtatctatttgaatggttttactacacaaaagtgaagtaattctatagctaaatgcagtcctatctctaaatcactggcttttagatctgtaatttatttttgtattacattgctacctttcccttttcattattctaaaaacagttactttgttcctgtttataattgtgtatgattttcttaggtacacttcatgttggtgatgaaatccgagaaatcaatggcatcagtgtcgctaaccaaacagtggaacagctacagaaaatgcttgtaagccaatggaagtttccccttctctaagattcatttttagttcattagcctagattttgatttttaattatatttatttaatgtgtattttggtgtggctgtggatgcatacacgcccatgtgcggtttggaggacagtttgaaagagttgcgtctctgcttcctccagttgggtcccaggcattgaactcaggtcatcaagcttggcggcaaatgccttcacatgctgagccatctttttttactattatatttttaattaaaatataattatatttccctccttctcctttctctctctaatctcttctatatagcactccgccaggtcagtcgctctagttcatggactctctttctttgtattgttgcatgcgtatagagatgtttatacatgtaaatccaacatgctgagtccattaagtgtcccttgggtgtaaatgctttcagagataaccacttagaatgggatgaccaagtgggaggcccatccctgggaacaactacttctccctctcaaccttccttagttgcctgtagttctttgtctaggggtaggtccccatgagatttccccttccacaacagcatgtcactggtccgctcaccgtataggtcctgttgctgagccatcttgacagctctattaacttattttatacaaaacacacacagaaggtatggaaagatggctcagtgggtagaagtacttgtcagagtacctgagtctggacgccacacccaggtaaaaggcagagcatggtctcacctgcctgtaaccccaactttatgtctggtagagacatgagggtagctggggcttgctagccaccagcctagctcaaggttcactgagagatcctatatcaaggaaagaaggtagagaataatggagcagaatatccaacattctcttctggcctctacaagcacatacacacaggtgctggcacctgtatacacacacgttcatacaccaaacatacatacagcgactgaggtatccccactcatacctaacacacacactaaataaacagatataaagaaaacacatctaatggttcttcaatcctagtcagaatacttcttgtaccatcatttacgtgaagctgaacttgcacactattcattaaaaactgacaactaggaaaatgcagtagctgcagtggactttgaaaccattttgcctgcctttagcagtgggagtctgcacactgttatccttccttggtttcttaccaaccagatatttacagaaaacctccccagtacatagtcgtgtgaactagtgtctcgctgacctcaaaaggttcctgattaaccccattagaaacctctttcctgtttagctgagtcatggccagctatagtgtatctctctacgacacaaagaagaggaaggccattattggctatactcgaaaaaatccatactgaaattagaccttcaataaaaagcattgacatctgctgacagacccccatctatgctgggttgtagcaaacagagggaagcatttgttttatgccttgagtcctccctgctatagtacagcagcttctcgtgcggtaaatacctcttaggcaggaagcaagcatcccgggcttgccgtaatcaaaaggaatgccagaattaataaagtataaaagcaattttatgttgatagcatctgagagtagcatattaaatagggattttatataagtacttattctcttcttcgggtcagtgtatagtcatttttgtaaagcatatcatttcgaccgttttgtattcatgtgtacaaaagataaccatcagagatcttggagaccattcattgctagatacaagatagtcagccttgactttgagggatctttcccagaaaactctaccagtaacctgagtgtttcctgctttataattaggggttttttagggctgagtgctgtcaggtggtgtggactgattacacccacacattttgagtggtttcttctgtgtttttgtgtgcaacatgtgtttgcatgagaactctcctcttttcttctcccagagggaaatgcgagggagtattaccttcaagattgtgccaagctaccgcactcagtcttcgtcctgtgaggtaataagtctaacaagcctctcctacccccaacctcccccatctcctctgagttcttaactaactgtctgctgatggctgaatgtttttgctttctgggaaattgtttctgcctgtgctgttagatcactgcacaccaattttacaacaaagataacggaacagaggaggtcccacccacctcctcagccctacttgcatgtagatatcttcagcctttttgcagcaaaatcaaagccaaatatagaaaagctaca

SEQ ID NO: 676 - DNA, 37288 bp, mus musculus
cgcagaggcttctgggatcgggccccgtgttgctactgccgctactgttgccgatgctcccggaggccatacggctggataggtcagtcccagggaagaggacaaggtgggatgtcgcggcggggtgtctccggctcaaggttagaaacctccagctgccaaaaggctcaaagagatgggaactgaagtgaggagattgggggctgggggttgggtgagaacggaccgaacacccggcgactgttgatgacgccacagcagcgcgtgtcgctgtttccggtgtgctggccgctgggtttgttttgttttattttaggttagggatcggcgagatacaaggatggaccctaaaagatgaagcaaagataagaattaggcaagaaactgttgctgcccagtcctcacacatatagatcgtgttcgtatgaaactgtctgggcccttctttggtttcagatccattctgtgtctgttgggatggttgttttgtgttacaccttaacgaatggtgctcttgccttgttcagtggattcggtagtccgctgtgagctgggggggggcggggggggagtaggtttagtacccttcacattctaacaactgtcatttacatttgaattggaacagttagagcacaaagagttagcgacccaggagctctggagaaagggttggaggagtgctctctttgatgggactgctttcacaccttttggatggataaataaataaataaataaagccaacttttcctccaggcattttttcctggggctgttagctcccggtgcagctatttggcccgagtgaggagtggaggcggacttaatgccaagatagtttattgctggtgagagaatttgctattcaagagcaggacccctgtgggaaaattaatcttaacctgaggccagaatctactcctgcactaggatccagtttgtaatctggttaggatgtcagagcactctgcatttgaaattcttgtgctacgtctttgttttgtaagctaagtcagttgacagcgtgcagtcccaaactcttcaaaaccttaagcagacttttaaagattctgaacggccagaaatcaagatgttttattaatgagagaagcaagggatgaagcatgctactgcttcttacattcttccactcgttctgtttctctgagggacttgtttagacacaggctgctggttcacttatatgagtttttttttccttcattattattttggggggaaggaaagcctcctagaatttaaatttttaacaatttgcaggaagcagcacctgtcacaggactgtccttggaaacctgttgaaccagcatccctagccaacctgtgtctcacaagtgtatcaggatagtgatgagtgtggcccggtacaatttctagaccacaacttgaagccacggtgccaaacatttgcacacagtttgccacagaggtgacatataaccttgaaagtgttactggagggcttcagttctaattaccaagtaatgtttttgctgaccaggattcaaatgctccctcacattaacaagaaaaagagttatggatacaggactgaattgcgtcaccttttcagtctgtctccaccttgcccatagcagggttacagatgatagaaaacacgatgcagatatcaggaagtgtatgcccataggttgtcttttagactcaggttacaagaactgggtaatgggtcttctacctaccctgtaccaaatcccaggtaccagggcctttgggttgatctgttcctcctacccatgtggtattgtgggaatcctaattcctggggacccatacgagtggggagctgtaggaaggccagaccactcccaaatggattttacttaaatgcgacgtgaaaaaaaatatgtgtttggtcatgcatactgatacctgtgtgtaataagagccaacattgtgtcattccttgagcaccatccactttaattttgttttcttgtttgtttttttgagacagggtcttattctgtagctctgactggtcttaaacttaaaagatctgcctgtctctgcctctactttaagcagggactaaaggtgtgcaccaccacaccccgggtcaccttgtttttggttcttggtttttttttttttttttgagatagggtcttctacaggcctgggatttcaccagttaagctaagctgactatccaggaagttccagggatttatatatctttgcccccccttcaccccgaaaagaggtaggacagttctgggggttgaactcaggttgtcttgcctgttgtggcaagcacttactgagtagtctagcttcctagcataatagaaacagcttgtcattgctagagactggtatcatatgcctgtaatttcagcacttgggaagcagagaaaggaagattaatttaaaggtaaaggagaccttgcctgaaacaaaaacaaacaaacaacacaaaaaatcaactatttataattctaccaactgtgataatgataacgaatgcagagaccaccagaggacacttttaaaactgaatagacagtctttcttgcgagttggtgactgcactaggaacttgcccaaatcatgcagccctgatccttacagccctttgtcttttatgcacaaaaaccacatcctgattgtcacacttcagatattaagaagtagaactacagaagccaccccccccaaaaaaaaaccaaacaaaccagtgttactacattttaggactttcttggaactacagacttagatctttgatggattaggtctctttgttcccatttcggcaggtgttagggcctgtttgttggctttgaaggtcagaatggtgcctctaacatggtgtcagttgtgctaaggtctgggggcctgttagaagtctattgaggttttctagtcatttcaaaaattgttttttttttccctactgaatatagagttgagttccttatactattatcaaacctcttaggtatatttcaacttccttcctttctggatgttgtgtctatattctcatttggtttgctttgttgtgcagaggtgccttcatttggaatagtcctgtttatccatggttacttttgttgctttggggtccaaatttaaaaatctttttagacaacgtcatgctgttttcttccttactggctaattgttttagaattgaggagtggggctctaaccagatggcttggcctatgatgtagaaaggcactgtgggtttgacggcaggcagggctacatgttgacttcctacctaaaaataaaacaacaacaacaaaaagcacaaatataatagaaggatattataattctgaggattctatagcagaaactaatatcatgaaacatctctgctgcttaggaatatgatgaaattcaagcaaaaaaagctgtagcgccaaggttaatacattgaatatagcacattgaaagcaggggttgattcagcagctaaaatggctcacaatatactgaggctcactgaagaggaaaatgaattcctccttcagtgatgatagagtgtacctcaaagacagatttggggaaatattaacaaataaaaatgggacacaccaggcattttttatgtttaagcataaaagatgcctgggttcaggaaccccacagggtcaaaccaaggttggaggttggaatggggaatgtatgatgtgatttcctggctgtttctggtgcaagcttctagttgattagcaactttccctgaggcctttgggcggagacaatgagaccagagctggcagtagaaaggatgtgacgagccacacccagctaccggagtgcagacacctgggagccaaagggaaaggtgactacaaggacaaaggggaagggacagaacctgtgatgcagtctcaaaaagtgacagcatatcaatgtgtttgtcctggtgtgtactggagcattttcaggttcttattggtgagcagctagcagggtcgggtggggggcagcagtggacagattaagggaagatcagcaaatcagtaagtgctggccagagtatatgtatctgctttgtttctaggtagaatgaatttagtgccttggtttctgagtgcctgactggctgctcttgtgaatactcggtttgaagctctgggtgagccaaaggagtaacactttatttttgctctttgcagcctgccagttgccatctctttgtaggaagacataagaataatggtttgtaggatgatgcatattgtgtcaggaagatttatcccggaggactctgggacaggaactttagtgtggggcataaacatatttcagtattaaagtacggtaaaattctcctttcgtcatatttctgacagttaggtttctgtgtactaactgggactggcgtaactctgacctacataatagcaggacccctgtgaaagaatctattttatttggtgataggatagcatttcctatttcatgtagagcctataatctctaatctgaaaagcaaagcaggaactcggggatgagcttagcgcacattcaaatttgtcattcacattttttcaaatttgtgactgtgaactgtgtgcctgccccaaactctaatcacaatttaaattccctggcaatgccactactattcttccgatttactatacacagctgacattggggaacctgaaagtgttagtagcccacaaccataaggcctgggctagatgagaatggtcttctacattacataaatgaattgctaaaactacattatgtgtgtgtgtgtgtgtgtgtgtgtgtgtgtgtgtgtgtgtgtatacacatacatagatacgaacatgaaattttttaaaggttgtttttaaaattataagtgttggtgtttgtgtctctgtgtggctatgtgcacatgagcgctagcacccttagaggccagaggggggtcggattctctggagctaaagttataggcagttgtgacccccctgatgtgggtgctggaaactgaactcaggtcctttgggaggtcagcaactgttcttaactactgagaattttagtgtacctatatttagctcctatgaattttagtgtacctatatttagctcctatgaattttagtgtacctatatttctgacagaatctggggtaccagaagttcctagtttgtctcacatcttagtttgtcttattttttcctcagtggtattaaaagaggaaaaaaaatggaaataaaattcaagaaatgggtatttgtgaaataagctgtggattcactagtcagaactaggaaattagtattgatcctcatgtcaggggaaaagggctattggccgtggttcatgttcactccgagaatgacatttcctttagtgatcctgattcctagctcctcttatacaggacccctgtagggaaggctagtcagatatgaatgatagcccactagagaggaaggcatttaaatatattttgttttcacagtgcacagaaacgtttgactttttcgcactattttcttgtacgttgaaaagttgtgtctgtagctgaggtcacagtatgatatatgcatggtatggaatgatgaaatcaagagaacgaacttatctgactcctaaaatactggtggtttctgatatgagcatttgaaatattcctctagcaattttgaaacatgtagcaccctgtcgttggtagtagtcccccatgcattgcagtgatctcaaacattcctcccatgtaattgaagattcagcctactttgattactgtctttcctttctccttaatctccattctccataccctgcaggtacagcattcagctctgctcccatgaatatggctggcttagagaacattgaaattttgtccttctgtgtaggcctggctgttttcacttcacacaagtttcttgtatgctgttgcaaatggaagtttccttcctttggtgtgtggcagggtaagtgcatatgtgcaggtgggtacgtgtccgcatgggatcccatacactgtaggcatatatgcaccttttgttttatgtggtggtttcctccaaaaggaaacatgtccaggagggtgtgggacgtctcgtgagccgcaaatgtctgagagaacaggaaattagaagatttttttttgagggcctccctagccgtatgaaaaggagtacacaagtctaggtgtggagactgggaaagccagcttcacagcgatgagacgtttggatgatgaagctatctgcaagccggccggcaagtgccccagggttagcagtagtagcctttgtgtggaggtgggctttggtgatggagctgctcttgagtcacttctgctccttgtaagcacctcctcactcatgttgctgtcagtaggtccggtaaaaactggttcaccaagtctgactttggtgtagtggttactctagactgttgtaagttccctttctgaggtgactagacctgtggttgtgcctccttagtaaaaaaaacctctggctgtaaaaaagtaaaagtctcaaaaaaaaaaagtaaaaagtctcccacatcaatcttcaggccatctataccattttgttctttagatagggtctctcattggcctggaacccttcctggaagcatgaccccaagggatctgtgcccatctttacctcaccagccctgagccaatattacaaagacttgttttatgtggatgaatgtcccataagtgttctgtgcactgtctgcgtgcctggacatcggggaggagggtttcagagttaccgacaattgtgagccaccatgtgctctgtactgtggaagcatctctccagccccatgggccgcatttctgtgtgtgtgtgtgtccatatccaagtgcatgtccactctagaggtggtggaacctggaagaatggaatcagtaaacgaggcagactaaagtcccatgcaaaagctaactttattcagagcaacaacttacgctctaagggttaagaagggtcacatgagtaaagttctcaagagttcaaaacacttacaatcactactacaagccatctgtggcaaagagccatgtctttctatagaggcatataaaggatagtttaaacatttaattgactaacagctgcaagtgctaatgagtaatctagtgtaaactcagccctatctgctacacctgggaggagcaagaccgcacattccaagaacaatttgttttcttggagtgttctcactagcactcagaattctcctcacatgactgcattcctggaccctgttcagaagtacgtgcgtatgcgtgtgtctgtgtgtgtgcatgtgtctgtgcgtgtgcatgtgtctgtgcgtgcgcatgtgtatgtatgtgaatgtgtgcctgtgtgtgttcgcatgcaccatatggaggtcagagattgattttgggtatcttcaatatctcattttttttttttttttttgcggcagaatcgcacactgaataaggaggtcatgattcacttagtctgactggccagtgccccctagagcttctgttgttttgcttctccaaggggggattacaagttacccctccaagagttttatgtggattttgggggttgaatttagatcaccatgcttactggacaagcactttacagattgagacctcgccatagtcctctgacccagtcttttgtcttgggttctggggaagagcattaagttccttgttcttgcagagcagttgttttatggcctttatcacttcagcagctgagcaactcagtctcagaatctacttctttttgaaggctatcaggtgttctggtttgtgtgtgtaatacacacgcacaattttctttgtccatccatcagctgacatatgattaattttgccctttttgtaatgcttaagtcagtattggcatatatcccttcccatccagttaccaatttcatatcatttgcatatgaaacatttcaggctgggggtatagctcagtggtagaactcctacctggcatgtgcctggattcagactctattcataaaaagcacaatgaaaatggaatttacatacatataatgcagtaatattttccttttattttagtttttttaaataacataattagtaagagaagttctaattttccctataatctgcatgagttccctactccataaattctccagcgcttatctgtgtctctgaatttttttttctctcaaactctttagctaccccatgttcacctatccagaggagtctgatggagtcccatagattgatgtgtgcacttatgccttctggggtaaggccaaagcaactccttacagtgacaagggatctataagtttctgactctgtttatgtctagcatttttacattgtttgtcttatgtaacaaagtgaatttgttcatgttcattattgtatgctttggattgtagtgctaagatggtctttcgaaattaagaaaaagtgatttttctgccattatggatttctttagtggtttgtgcttaaatcgaagaacacaaaatacctggtttgtattaaaatccccagtgagtttctatttaccgtagaactcacagtcatacttaacccattgtcaagaacaaagggtgtggtctactttctggtaatcagctgtatgtaaagtaagaatcagaaagacagactaattggccaagaaaccgtattaggagtcagtatttagaaaaccatgtagggagttttgttttcagccctgctaaagatctccccaccatagaagacaaaatcgctgtaaggagtcaaaagcagatcagaagtattgctgtggccaaccttcatttaaagcctccttttagagactggctcttaatagtcttccggaaaatgacagataattacatctgcctttgacaccctcttgccaacctgaaaatggtcagaacaaattatcagaaatttcattaagctgccttcttttcaggctgccttccagatcattgtccaggcaagttataaaacaaagggaagcccaaatcaaacagacagacagcaaataaaagcaaaaacatccctggaaccaggcacaatggtacagtaatctaagcactcggaaggagcaggcctccgtgtgctacctaacagttcccagttcagtgagaagcatgtggtgctaatgtgtaaaacttaaaaagaaaggagacaacgtaaaaagagaaaagccagttaatcaacaaaacaataaagccaaagcaattaaaaagggctgcagtggcatacacctgctgtctcagtacttggactacctgctttgagtccagtctcggataaagagtgaattttagggttgctagagctacgaagtgagttgctagatagcaaatactctcctcctctcaattcacatgcttacgtagggacaggttggccagtcagttccagaatctgtggtttaatatgtctgtgcttccaaggtatgcagcgaaaatctggtagtgacctgaagagactcctgatttagatagggatattgccgtttacagtgtcctggttgtcatttcattaaacaggcaatgggaacacaaagaggaagaataaatatgttacttattatttggatggtaattcttctgttctaccgagatcccaaacttggtgacaaggagagtgatctcaaagactgccatctggcatttggtacttagcagtggctgctgtggcaggtgggagcatcagttcttggctacctagtttgctaacccaataagtgctatatagctcttaagtggtcaaagaaagtaggattctttgttcctggttccaaagatgtgtgtgttcaggtgcatgccatggtatactggtagaggtcagaggtcaggttgctggacttgattttttttctttcatttcgaaccttggggattgaacttaggttgtcaggttgccacatcactggccttctgcagaatctactgcagctcttttgtaggcccgctatgttgggtttccttaacctttaactcaggcccatgtcatagctcttaacagaggatctgattcctttggctgtaagtttttcacagccctttgaaactctcctggtgactaggacttgcctttctggctttttagaggcctttgtgtttcttcagcattaactcttcgccctgatttctcattctgcagccttaagtcctgctctggccactctagagcgcttcaccttcttcatcttcagctgttaacagccagccatcattcttggcatgccagcttccacgtggatgcacttgtccgtcactctctgttgatgctttgtgtgatcagctcaggctgcgctcctaaatataggtaagaaaagaccacttgagagaagttgtttattgggcctgatgttacaacatcataagaaagcacagtagaacttatctaagctctcaaccttcctaatgctgagcccctttaatacagttcctcatgttgtggtgaccccaatcataaaaatattttcatggctacttcataactgtaatttgctactgttttgaatttgaatgtaaatatgccgaatatctgatatgtgaccacaaaggtgttgtgacccatagattgataactgctgatgtaaaccaattcattgagaccaagcaacctcttgacacatacagagccactgagacttgtgttttggatcattcatagctagaacttaaaactagtgacagaagtcctctttctttatcatcaagggaagggcacccccccaccccccgtagtctaggtagaaatagtttcagagccatctaaggttcaccatggcttatgatagcaaaacaactggtacagtttcagacaactttagatacattcaagatcagggaaatgagctgggactatcatatacttttttaagggatccctggaatgctccaaaggtctgttgctggcataagagtagtccagctaggagactgacagtccttttgttcaagataatcaaggcagcaagagagaattgaacagctggcaattagagatctcattcccgtatctgctgttgtcttatttacagaaaaattaaaatcagacagtcctcacactgtcaacttaatcatttgtcattagtattgacagtgacttttccagtgattaacatgtttctcagtcagggtctcaggtcaattcttgttattggcctcagatatatttcctgtaagaaaacctagtaaggaccgtcagactacctcagggacaaggtctagcacagttccttgaaactgtcatttaacaggttttaaaaacagaataaagacaaaaatatcctccaggaaattttcctccaggcctcgcgtgttcctagttttataccaatgtgcagccccttggaggaactgagcagcatgtaaagtagtttttggtcggtcggtcggtcggttggtcgagaatgtttggaagaattttaagtaaggggccctgccttacccggccaccaaggtctctgctcaaaggtgcagcctgtgatactgacttaggtcagcacaatacagaactcttaaatttgctggtctgacaatttgacatatttgtgtgtacttcacttttgcaaagaattcatttcacatcagggaattgtgtatctaccaaaaattttaattctgatttatacagcctagtgctttataagccagaaaagcagtactattgcaagcattctaagtcagtgattctaaattctccatgcttctacaaagccaattaaaacataggccactgggttccctatagagggaaatgcgaatactaccaagtttaggatcatactaaaaaatgttatctaaaccaaccggaactaacttatttattttcttgatatctagtttcttgaattcttttggatattagcccactgtcagatgtggagttggtgaaaatcttttttctataggctgctgttttgtcttatcaaagatgtcatttgccttatagagtcttttcagtgtcagaaggttccatttattaactgttgatcctagttcctatgctactgatgttctgttcaggaagttgtctcctgtgccaaactgttcaaggctattgcccactttctcttctatcagattagtttatctggttttatattgagaccattgaactgtttggaggtgagctttgtgcatagtataagtatggatctatttgcattcttctatatgttgacatctagttagaccagcaccttttgttgaagatgctgtcttttttttccagtatgtttttctgtcatctttataaaagaaagatcaggtgtctatataagtgtgtagatttatgtctgactcttcaattgaattcacaatggctatctttaaagaatggaatttacaacaaggtttaaagattaagtaggtcttaaaattaaattaaaagttcctttgggtttttgaaacagggtctcgtgtagactaggctggctagtagctccatatacagctgaaaatatccttgacttcttattcttctgtctccacctcccaagtgttagggctacaagcatgtaccacaagttaaaaatatataaacttcttttattatacaacatttctgttgataaatgaatttgtaaggttgttatagtgcattattttgatttaaggattatagaaaagtgctatatagtaaaactcaaggctacaagaattatggccctaataaataccatttatttattgtttttaacagtgaatctttattggatgactttatgaaaaactactgagagaattctctgtaggccattttgtctttagcagttgtgttgaaatttcttgactctcattcagcaggaaaggcaaactagatcctaggatatggccttcattccctgtaaaaaggattttctgtgcatggatgttttgtctgtatgtttgtataccatgtgcatgccttattcccctggaagctgggatagggagtcagcaccctttataattgaagttgcagacagttgggatccaccatgtggttactaggaattaaacttaaggtccctggaaggtcaataagtgctcttagccgttggctcatctctccagccccttctttgcctttttgtgtccccataatttccatgtctttttatcctgtgtcaaactcaagttaccaaacaggtctttctcctagcaccaagcaggaggattcttgccctggatcatttcattgacaagtctggcacttcttggggctccttactaaaggatatctctggatggttaggtacattgccaacagtcagacctgatcgaaattgtcccagagaaaaaggcagatggattttgttgtgtactgcataaaaaaaatgtatttactttcatttacatctctacggatgtgaacaaattccatgttaatgaggttcaatttaatgttatgttacacgtgtacgatgtggaattgtcagtgcgggcagtgagcttcatcccagatacttgattatgcccctgaaaactacttcaggatgagctttactaaagcttgctagagagcttttgaagtagggagactgatttagcacatactgaaaatttaatgggggcattcaaaggagccatatatgcataaactgcccagaggatataatttatgagttccaggactaagtaacatttaagagctaggcataaaattaaatgagaaaacaatgagctagttttcttattttactgaaattaattccttttccagttgtaattgttaaagtgtttcatcagctgtactacctggggtatatagcaacaagtgcttgtctggttatattcacgatcacaaccagcaaggctgcaggtaaccagttcctttgttgtttttaccaaccttgtttgagcggtctttgggaaagagggcattatttctgcaggcagcttatatttcatcagtgtgctgagtcgtctcatttattctcaggttctggggtgaagtgcttcttccctcatcatctccatacttttctctgatttttaagcttgtcttggaatgattcagtcaagcaaattaatataactattatctgacgtatttagtttatcagatatgaacattagaaatagactcacagaattttcaaagctcaatactctcttattaccatagtgattatactgatatgagagctcaaaaatctttcctctggggctggagagatggctcagcagttaaaacactgaatggtcctgaagaggacccaggttcaatttcgcagctgccataagggaactcacaagtgtctggattcctgttgcagggggtccgctgctctcctttgacctttgcaggtaccaggtacacatgcactgcgggcagccagagcacccacacacagaagaattaggtgaaactgatttttaaaaatcatttctcccatccaattgaaagttttcttattttgaccaccacctctccaccaccccacgcccaccttctacttcctagtcaccctagcttctgtctctgactgtaatggaattagatttcacaaaggcaagaacatgtagtatttgcatttctctaaaagcctggcttggttcacttcatataggaagtatctgtaaatgttgtaccttgtgtcaggtcctttttcctttgagacacagtcccactatgtggtcctgaaatgacgtgaaattgactgtagagaccaggtttgcctataactcaccagtagcctgctgctgctgcttcgcaagggctaggattgaaggcctgcacaaccacaccctctgtctcagctctagaagtggaaactttgagttcaaaacaaggagaaagttttacaccactggttcagactttttaattaattaaattttttaaattaaaaaaaattaaatcaattaattatatttaatttaaaaaacacaaacaagtgggagagtgtacttaacaattacctaaatgttgttgggggttaaatgaaagataaatgtgtaagcactgttccattgtctacagcccctagattacttctaatcatttattatttactccaacaatatatattctgtgagataatcctgtcatttttatgaattacaatttctagttcagctcattgcttctttcctcattagcacatgagaggtatatatcgctactatgcccacgcttcagaagatgaagcaatggaataaatagcaggcttcagagttttgctcacaatgtcctggttctgatccaaaaataagtagagagtccaacctagaaattctggccctgtgcttcaggcatgcagggagagttaggtatgagacacaaaagtgggaaacagtagaacgttacagattcagaaatggcacgttgaaagtcaggattggcccagcagcttaaaagaatcacaataaactgttcttataagaaaattcattctcacatcagaatgattggtacgcttccaatcagcttagactagaaattgggggaaaggttcaacagatgagaaagggacaggcccagctcttgttttagcagaaaaaattccaagtacaagaacaagttggccaatgctctggccctatagcaaattccaggtcatttcaatgccctgcaactcccagggttgacccctggctagagtttggagatggctggagaactgggaggtggctccctcaagctgtgtctgaagcaaacttctagctacacctctggaagggatcagaggcctttttctttctctcaaggccacattgagaagggaccactgaatggaggaagtaagagatgggcctaactcttggcttctgcagaggacacatcactgttctgggggcttggatccaaagcatcactcagttgttcttgataagagaagggaggcacacggttgaaaggagccttgagattctggagaaggttgttgctgcccagagtccatccgtactctggggatcccattcggatgaattttacgcagtgttctaggccactggttgcacatttccactactggtgggaagattcttctgagcgccaagcctgtgctgagtgttgtattcggggctctggggagcagaggaagtaaagcttcattttctctccctctacagcctgctagttgccatctaatttggagctcaggaactgacaaactttagagggcgatctgtcttctgttagtggcgcatgcctttgatcccagcacttgggaggcagaggcaggcggatttctgagttagagaccagcacggtctacagagtgagttccaggacagccagggctacacagggaaaccctgtctcgaaaaaaaaaaaacacaaaaaacaaaaaaagaaagaaaaaaaaaagaaaaacctactgtggacaggacaccaaactaccccaggaatgggtctgagtggactcattgatatagtgctttaagatacttggaggagggtttggggagttagcttgttatagaaacaatatgccttcacagtgagaaatatcaccctgcacacttaagagattgttaaaggaaaatctctttactggaaaagtctggccagctgttgctagtgcccaaagaagaacaggcccctgatagaagattttactaacttatatacaccttaggcttattcattttatagtctctgtagtcctcaaattcctttcatgtccaggacccagcttacgctttgagcaatttaagaggcaggagcctgcaagtctggccacctgggcagatgggtgattcacacagcaaggattttgccagagttttaaagtatgctagtgttcttttcagcttgcccacctggctgaatcacacttttcctgataagaccgcagggagtgcaattacagcccaggacttaagggcagctgtgaccctgtagctatgcagggacagatcctaaaaatagatccctgttgaagataccttcttggggatgcacctaatggccgctcaatcttggtaaacggagatgcacatcctagcacagcaattttgcttatctcaaacaggcctgcatagaacactactcatctctgaggtattttggaggaatccatcgctgagctaagttctgctctctggtttaatgtctcctgagcaaagaggttagtgaggcctttataacatccaggctatcagtttgaatttcttctgcatcagtctctggaataagaatcattggtggggctggagagatggctcagtggttaagagcactgactgttcttccaaaggctatgagttcaaatcccagcaacacatggtggctcacaaccatctgtaatgggatctgacgcccccttctggtgtgtctgaagacagcaacaatgtactcacagatataaaataaataaatctttttttttttttaaagaattgtcggtgtgcaaatatgaggaccctagttcaaaaccctagcacccaacaggaggatccttggagacctgctgccagccagcctagccccaggtttagtgagactccctcatctcaagggaataatgtccaaagtgaagagcaggacattcaaagccctcctctggcctccatgacagctccccacccaacccctacatgaatggagtttatcttcagaatctctttaaaaactttgtgttggggtagaggctaggggagggttttgaatgtcctgctcttcactttagacattaatcccttgagatgagggagtctcactaaacctggggctaggctggctggcagcaggtctccaaggatcctcctgttgggtgctagggttttgaactagggtcctcatatttgctttttttttttttttttttttttttgggttttcgagacagggtttctctgtatagccctggctgtcctggagctcacttggtagaccaggctgggctcgaactcagaaatccgcctgcctctgcctcccgagtgctgggattaaaggcatgcgccaccacgcctggctgggtcctcatatttgcacaccgacaattctttaaaaaaaaaatttatttattttatatctgtgagtacattgttgctgtcttcagacacaccagaagggggcgtcagatcccattacagatggttgtgagccaccatgtgttgctgggatttgaactcatagcctttggaagaacagtcagtgctcttaaccactgagccatctctccagccccaccaatgattcttattccagagactgatgcagaagaaattcaaactgatagcctggatgttataaaggcctcactaacctctttgctcaggagacattaaaccagagagcagaacttagctcagcgatggattcctccaaaatacctcagagatgagtagtgttctatgcaggcctgtttgagataagcaaaattgctgtgctaggatgtgcatctccgtttatcaagattgagcggccattaggtgcatccccaagaaggtatcttcaatagggatctatcttgaggatctgtccctgcatagctacagggtcacagctgccgttaagcccagctctgtaattacgttccccgtaggcaggaagaactgggtcctggaagtcaggagggtggaggggctgagccggaagaaagattaaaagccctggttggttgaagagttccacagagctggcaagcctcaaacattctaaggcttgaattggaacactggtcgatgtcaaggtctaagtagtgccagtacatgggtctgataaaaacctgcaacacaagctgatgccaagagctaaggaattccttgattcccaggtccaaacaaaagtgcagggtaaaggtccccaatactgtctttaacactagtccaagcaggtcctagctaggccaccagagggagcacttctcccttataaggtagaagtggttccaagccatggagagttcactgcaaatcataattctcccaagtttgctttatctcctcacatagacagtctgtggaactaggtgtgcattaggcagaggactagtgcacagaggagaaacagcaccagaggaaatgggagatcactcacagtgtcacaggctaacacaacagcaaaagccccgccccaccccaccccccacactaaaactgtcttgactggggctatgccttccttcagaagccagagcagtcacctagaatcgctgtgtagtttccgcagtgcatcggtagaatgtgcaggatagcagttctggtatataggtagcctaccaggcttaagccatcaagttttctgtaaaggcacgtggggaacacagaagaaaaaggagttcaacaacttccagtgaaaggctcggtggtcttgcccctgatgtctttgcttatcgaagggaaatggatcccaggaggagtgcttataattgggacttactataacctggtgtgatgacacaaacctttcagccccgaactcctgggacggaggtgatagatccatgagctcttgaacagacaggggaggcatggaatcctccctatcagtatcatttacgagcaattcttcatgtatctattgaccatatgtatgtatgtctttcttcaagaaatgtctattgaagtctatattattaagttgagtcattgttttattgcaactgagttcgctgtttgagacagggtttctccgtgcagccctggctatcctggaccgcacttggtagaccaggttggcctcagactcagagacctacctgcctctgcctcctgagtgctgggattaaaggcgtgcgccaccactgccacctagtgcaaccaagttctttatagattttagaactagccttttattccatgtggcttgtagagacttccttgtgcccccgaggttgactccttgcgcagctctctgggctgttcactcccatttgtttatgctgctccttgtctcctcattgattttttttttttttgttaaatctcctcctcaaattaattatacagaccagtgtcatttttttctccactacttttttaggtctgtttttcagttgttggtgttgtttgactgtactaaaacgggaccattcctgttgtcctttaatgcacgtttcaatgggggaacaaagatactcttcttaaattaaacaaagaagatttccttcaactttgcctaaaaccatacacgcttaaaatgatacattacctattttcaatgaaactccctagctgagttatatactcaagtggtagtcatttacaatgggactcttgttcccacttatggcatcaataacatgaaaggggtatttctaatttctggtaaattatgtcaataatacaattgtgacaatacttgacagagaaagattaattgtaagattaattatcatcagaagttatagtcattttttcaaactcagggccacacagtcaggaatgcaattgcagcagatctttgtttcaggtttcctttcacagagtagccttaaacagtttctagaaggaagcaacccacagttccagcaacttgtgaaaccctcccaccaaccgaaaaggaagttaaggtcaggacacattgattagaggctcccatctggctccctgctagatctctccccagattgcagcacaaattaaatccagcccccaggacacaaataacaacaggccattccaactggcctaggtaggtctgttctgcctttgtcctggaaccaggaagatgctaagattaaagccattctttgagaactaaagacccttccagaaaggccaggttgggggtggagagtctctgtagaagagctctggtatttaacactaggaggaagactgactttcctgttcaggtaagtaggctcctgaggcctatggctaaatcttcaagtgtatagttcctgattttttgcttcatctttttaaaatgtttttttttaaagatgacttgtgtttaacttagggtctcatacatgctaggtaagcattctaccattaagctgtacctccaccccttgattattcttttttgtaagttgtaacatagctaagggtgaggcagaggcatcgagaatttctcttcagctttggccaaaattctgtatacattaatttgcctgttttatacagatgggtttttgtattaataatacatgcaagcatttaggcccaaagccaggccttatagctggaggatctataaactgggtggacagtgtgttagaggttttagatttctaaggtgtgtaataacctcattacaagaccgtcagtaggagactctctctctctctctctctctctctctctctcttgaaaggtaatcaatccaatgcccgtcatgagtgatgtctttttctcctctgtgcactagtcctctgcctaatgcacacctactcccatagactggctgggtgaggagggaaagcaaacttgggagaagttttgactttgtagccctttcactggaaattggctgtgaggtcggaatggtgcagtctcatgggaagagtctgggggacataacttacattttcattagtcacagtgtttatttactagatgttacaaggctgggtttgctttctttttaatcattacttgagagggaaatataatatttccaataacatgtatggacattttattctcttaatgtggtagaatttagattgcaggcgtgtgtgtgtatgtgtgtgtgtgtgtgtgtgttggaggcaagacctttcagtgtagccagactggcctgtactcactgtatccctgattctgcctctccaatgctagaattataccaccatacttgacttcagttcacttttaaattattttataatttgcatatgtcaatagcttttatgggtgcttcattatttctgttatcaagaatagattcctagtacattgttggattattttgttagcgagcactcaaagatatttgctatagaatactactaccaatagacctcgtgatgataagccacatagtgtctcttgtttcatttattgtaaaagttcatgtcttaaagttcatgttctaagcttacagagatttataattgtgctttcttcttttctaggtagatgcccagtgacgtcaacatgtagtttccacaacgtgtaaggtttttcgagagtggccaggggatggaaatattggactaaggaatggtaaaaggctacaaatatcagtgttttaaccattatttaattgctttcttgatcattacatgattgtaagcttgtgtgtgtgcatgcgtgtgtgtctgtactatcattcagtgtagaaattggcctagcccatagcacctgctaggcaagtccgtcattaccaatatatctctccaactctatcattgctgttttgggaaggttattattttgccatttggaaagcacctgtgcataggctttatcctgtttggggtacaatagatttgtatatgaaaaaataatcttgttatgtatgggtgctgagtcagaacttcttagcagtagtcaggatttaaactaataaaaaatgctcaatgtggtttcttcttatgtcttgagaatttagctgaggctaaattggatgagtaccattggcaccaagtaagatcatgtgttttgcacttaacagataatttctttgtctgtggatatgggagtacagctgaggcatcccataaatcctatagataaacagtttccaccctcaattataagtattttttttgatccccaggaaactaggtaagatatgaggaagaatgtgattaacttaaatgcctcatttaaaatttcactcagaggctttgtgcccttctagaattttctaagtatggccagagttctcagaataaaatgtagagacaccgaatgaaataatgccaagtagccaccaggtggcgaaattgcatatggatttaagcagcacaggcaaaccagcctcggtatctagcctagaggccatgtttatgtctgtatctggttttctgtcaaggctacaaaagatcaagtggtgattttatttctctttattcccttggttttagaacacttccattcctgcccaaggcttctgtgggagccatgtgccgctgtacctgctgtgggagccatgtgccgctgtacctgctgtgggagccatgtactgcttgctgtacctgctgggttaccaggtagaagaaagaaatgatgcacagtgtacttctagttcttcagctgttaggattctagttcccgcatccctgatcatccctggatttgctaccatgagaatggacttaaaggatgaggaggaaagcaaaattaacatttttgagtcaccagatactctagttagaagtagagtattataacttaccttaattactataaaaatatgagaccctgaaagattaatttgttgttttatctatcactttaatttagcaattttttactaggctttgccagtattacttcaagtataagtgctgtaggtcctcagctctgtattattttcaggcaacttgaaggtaacattcattttagaatactttcttccatagtgttagaagatgcagacatttaaaatggcaatcctgataggaaatttaaaatccggaataataatccaatatctggccagtgttcaggcttacttggttgtgtcattaaaaaaacagtttgcagttgctgtatttaaatcacggtccagacaaggtttatatgttggattcacttgaagtgtgaactacgaggcattttctgtagaggaaagcagagtattaaatcagttagtcctcctgtttaggaagtcataatctttgtcctcaacgagttctgttttgtggtttggctacctgctccaatagattaaacctatggctttccacaagtcctctgttactgaccttaccttcagccctgctttattctttttatttttagaaaagatctcactgactatcataggttgactttgaatttgttctgtaacttcagcaggccttcaacttgctagcctcctgcctcagtcctccaagtagctgaaattagtgggctatgcttccaggtctgattcgctgtgggaaataagatattatgatttaacaggctcaggtataagttgtcagataaccaaattacaatgggtcaaacaggatgagaattcatctcccatttcttttttatttttaagatttatttatttattctatgtaagtacactgtagctgttctcagacacaccagaagagggcatcagatcttgttacggatggttgtgagccaccatgtggctgctgggatttgaacttagaacctttggaagagcagtaagtgctcttaactgcggggccatctctccagcccttgtttctcatttcttaagggtttactgtcctatcatctccacaaatgtgctatttgtcctcagggtactagaaacacctacagcgtgtacattcacactgaaaccatcaaaatgtagcatggggaaagagaacaacatgggagataaccagctgtctctgctgtaaaaaaaaaaaaaaaagtaattcaggactcttatattacctagaacattgcccggagcatgtaattgccaccacttaaagtcgaaaacacaggaaacctgttagacttgtgtgtacataggtagaggtaggggacaacttgtggaagtcagttctccccctttaccattacagtgtgttctccccttccaccatgtgggtcctggagattgaagtccagtggtcaggcttggggtcataccttgccaccgtgagctatcgcttggcctggaaatgagttaaagttccactgttttttgtaatagcactcttgtgtccagctctgcaattccagtggtgttttccaatcatagtgtcttgtctccctaaccatagttggttaacatatgcctatgctatctaggtcagactgtcagaagtcatctttttgattgtctttctgaggtttaattggagaaaaatagtgtgttctagtttgtattaggcacctaagtattctctctctctctctctctctctctctctctctctctctttctctctctctcttgtatggcccagctatggggtgtatgtttggaaatttctggtggcctttttacagctataggaaagaaacttgtctaaaagaatgtcatttttgggctgagcaactggagcttcccattggtgttcaaacctccagtcatgcttgtacttgagtcccatccatctatgatggataacctatgagacatccaatagattctttcttttgcctgagtttaagttgtgttttttgtcacttacaatcaacaaagttctgattaaagcgctattttacaggacagttctggaatcagtatagctgtgtttagcatttatgtgtcagagggtaatagatttagtaactagaagcaagaagacaatttgcagatctattagtctacctgaaaagtgacagccccgagagccacaacatcaggggctgctgtagctctggctggtttgttttgtcttcttctagatagttaaatagttacccgcatcttcagactggtcatccttatatggttgcaggattactttttactattcagatgagcatatttccctctataccttttggcattgtttacaaagctgcttagaaatccttgtctgctaatctggcatgttggtcatcttgtgatctggctttttgagtgccttgatttttcaatactagtcacagtttccagtttcctgtgtaaatccaatcattctggcttgtctcatggatacgaagactgtttgaaatggatacccttatgtccataggaagagcattgatatttgtttatgttttagtagggagtcaagtagaccgaacttagacactacactccgcttctgtgaaaacaaaaacaaaaacaaaaacaaaaaaacctgcaaatgagttcacttagctttatctgggctatttagagatgttactatgtgtgcataattcagaggtcagcaagaaacctgggtggtttctatgcagcatttgggccctccttctcaggctccctccactgtaggattttatcttccacacttctcagcttgtatgaaaaccctgaactctgtcctccagtcttcaggtcagtaaggtccagtttaaggcaccagtgaggaatgtgacttggggctatgttgtggctaaaatgccttaaaagagggggcattgtccagttctgaccttttctttgaagtgccatttttttctgtcactttcttactgttttaggttacttgacaatacttgcatgtagcctttttaaaaaatatatatttttctccaaagtatacagttgttgtatctgaacaaaagtcaatttcatagcagcactgagtggaaattacaacctgtgtgggctgtgttatataacttgaggcacacagcacaaatactctggaggcacagtaaaaatgtatactagtgtgctgactggtattatgtcaacctgacccaaagctagagtcatcagagagaaaggagcctcaatttagaaaatatttccataagatacagctgtaagtcattttcttaattagtgattgaggtgggaggacccagccctgggctggtagtcatttgttctataagaaagtaggctgagcaagccatggagaataagccagttagtagcactcttccatggtctctgcatcagctcctgcctccaggttcctacccagttgtagagttcttgtcctgacttccttcagtgatgaacacgtaagccaaataaacccttttctccccacttgctttcttggtcatagtattttatcacaatagccaccctaactaagacatccgggatctacgtgtttgattcagctaatgtgacttgatacagacagggtttataagcatgtaaggtaaaggtgatgatattgtcagttggcatacttggaggaatgagaagcttggtaactgtccgcttgggggttctcatgaattcagattgtctcaccataaacaggtaaattccatagcaggtaatctaatacctcttccatgaggacctccaaggaccaagtatccctgaccctaatattgctgaatttttaaaggtgatgttaagttagctgtagtaaactgtaatttctatgcagctgtaggtcagatggacagagcaagactcccatacaaccctctgccagacctggtgtctgagatagatagaaggaggagataaatagataagttatttaaagcttgaatagggatgagtgacatagcttatagggaaaggactgttaaggaaacccaaatgtctccttggggcacaccaacatatggtaaatatagggttaaaaagataagacaaaaacaagtttaaggaagaagaggttacggctttggccctgtttgaaatatctgtgaggcatctaggtaaatgcacaggaatttggaaaactggagagaactctggaatagagatctgtattgaagaatgcccagtagagaagtggtagatgaagctgtggctatgaatgagatggccagatagaatgtgccaagggagaggagaattgatgagagagaggggagagactaataagtaggtcagtttgagaaattgtgaagtagctataaaagtaaaaggggagttagaaaaggttgtatgtagaagtaaaggagacgtccaacccgttggtgttcagtagagccgaatgctataaaagcaagcattgtacacggaacatagcagctctaacagcagaaggtttattttcatctcacggttgtagttggagttcagtgtccaggagcacagccattttgcaacagcttatgggtttcatagggtggtaaactgcatcatgtagcccctgctaaccattcttcccaatagccatccccctgtgttgccccttgctctcaaatttggtgggttctataagtagtttaactggtagtatgtctggaagtgatgctgcttgtttgcttgtttacagataagtgtagctcacagccctcatcaaagagccctgtagccacgtgtagtggtgcatttctttaatccagcacttgggaggcaaaggcaggtggatctctattagattaggccagttatgtctacctacctattgaattctaggccaactagtgctacataatgagaccctgtatatataggaatgtgtgtgcacacatacacataaacaaacaaacaaacaaacatatataaaaagaagcttccttttacaacagataaagtttaatatagagttatacagatcgacaactggtcagaatgcatagagtaagtgactgtgggatgcccagctccatcagatatatcttttttgtttgtttgttttttgtttttcgagacagggtttctctgtgcagtccttgctgtcctggaactcactctgtagaccaggctggccctgaactcagaaatccacctgcttctgcctcccaagttctgggattaaagttgtgtgccaccaccgccgggccaacagatatatcttaaatggaaccctatacctaaggataagggaacatgaagatgaggtaggaagtaagaaccacaggaccaggatatctgttgttttatagtgtcccatacacatgtgtacacacagaggaaaatgtaaccgtgaactcttagcaatatgtttgcctaaacaagatcagcataaggacagcacagttgacatgtcactaggggaaatctcacatggtcccacccctagatcacaaggtgcaagtgacaatggctgatgaaatagggtgaatcagtttcctttagggacgggctttcacagaggtggtaagtcataattaaaagagaggctgtcatttggggagggggaacagggagaggagagagagaatacccttgtatgaagtttccccctaaacacttaaaaaacaggaggtcgtaatctccctcacaactttcactgtggccttttggtgccttgagcaaccatataagaagtctatcttgctaattaggacaagtgaaggagacttgagatgacgtggaaagggagcaccctggctaagcccagatctctagatctgaacaggcatgtgaaagagaccatccgggcccctccagaccaattaccaaccagctgggtaccatggagtggcctagtagataggaagcagagtaaatttacaacctaagggaatggcctgttagcatctggaagctcacatgcaattgtgggagtatttttcctaattagtagtttggaataatgtatttatatccttatttttattttaatgtacaggtgttttgcttaaatatatgtttgggcaccacatgcatgcctggtaccactagaggccaaaagagggtgttgagtcctctggtactgcaattacagatattagtgggccatcatgtggttgctaggaatagaacctagatcctcaggaagagcagtctgtttttttttttttttttttttttagatttatttatttattatatgtaagtacactgtagctgtcttcagacactccagaagagggagtcagatctcgttacggatggttgtgagccaccatgtggttgctgggatttgaactcctgaccttcggaagagcagtcgggtgctcttacccgctgagccatctcaccagcccccgagcagtctgtttttaactgctgagccatctccccagcccctgaggggattttttagaaataatagtgatagatactttggaatgtgtacatattaatagaggacttttctataatgatggtatgtgcttggaaatgtgcgtgtacaaatagggaaaagctaggaggaagaagaatggagatgcaaaagagggagagatagctgacgccatatgagatatctaagaagggaagatgagatcccaactctggtgatgagttttaaatcaagagacgcttgctttccaatggatctttaaaaatatgtctcatgtactagagtcaaaagaatatataaatgttaggtaggaattaattggtttcccaagaatggttgacatgttccttatcaggattgcttagaagccaggaagtaattggtatctgtacctgtgggttaacaactagacacccttttaataaagctgtttctgtacataagccatacctccacagagtcaagctagtctgggctctgtgggttttcagaatggtagaggcttcaagttcggttgtagtagataactaacataaaaaggccttgactgatatctgcagacttccacatgctaatgaggaaaaaaatgtatcaaggtgtcttagtcagggtttctattcctgcacaaacatcatgaccaagaagcaagttggggaggaaagggtttattcagcttacacttccatatcactgttcatcaccaaggaagtcaggactgaaactcaagcaggtcagaaagcaggagctgatgcagaggtcatggagggatgttctttactggcttgcttcccctggcttgctcagcctgctctcttatagaacccaagacgaccagcccagagatggtcccacccacaaggggccttttccccttgatcactaattgagaaaatgccttacagctggatctcatggaggcatttcctcaactgaagctcctttctctgtgataactccagctgtgtcaagttgacacaaaactagccagtacacaagggaaagtagaaaagcaactcagtataacaataagcctctgtaaaaaacatctattatggaaaattgtaatcacacataaaattacacagaccagcacaatgaacctacatgtattactaattttgttaaaaatacaaaatatgatatggatgctaagatctgtaaattagcaggtaaattagggagggtgaggcaggataattgcaatgccagcctgcattacatagtgagtttcagtctagcataagacacaggaaggatctgtctataaaaattaaaaagaaataattagcaatttttgctcatagttttaatggtacatattttattttatagagagttgatcctcattgtttaataatttcatatttatagcttggactatttactaaaatttatctgtacttctctggttagtacttgcagtgctttcatggtaattcatggacctgcacagagagccaggcactagatgttcccagctaaagttgaatagagaacacactttttttcccatatctgttatcacactgtaagtgtcctttccatggtcattttaatgttactttttgcttcttttgttggtgacttcactgtttaaagtgccactaacaataatgttaatgccagaaagttgtggtatgtcttaaggagaccgtatatgttagataagcttcattttggcatgagctataatgctattgtctaggatattagaggtaatgaatcttgcaaatctagaaaaagaaagaagaaagttggcagcctatggatgctcagaaaaatgatgaaatatttattttggggtatgtgtgatgtatgtatgtgtatttcaatgtgtatgcaagaacatgccatttgtgtgtgtgagtatctaagtctctttatctctgtctctgtctccccctttctctgtctctctatctctgtctctccagtgtgtgtgtgtgtgtgtgtgtgtgtgtaggccttgttgacattgggtgatttcttagttactgaggtactgttagttactattgctgtgaagagacaccaggagcaaggcaacttattaaataaaggggacttgcttacagtttcaaaaggtgagctcatagccaacatggtgggagcaaggcagcaggcaggcatggcactggagctaagagcttacatattatctacaaggtgcatggggaaagaggagggaaagggaccaggcatgggcttctgaaacctcaaagcccaccctcagtgacacacctcctccattaaagccacacttcctaattctccccagaactcttccactgactagtaatcaagcatttggataatatgagcctgtggggactattctcattccaaccatcatattcttcattgtagtttttgagagaggaactctcagtgagcctcctagctctgccttcacagagctctgagactgtaagcacatacctctgtactggttcttttatatgggttccaagggatgtagcatccactttactgactgaagtatcacctcaacctcaatacaagtctaattggcctttctttcattctaaggataatgaactttttgtttgtttttcgagacagggtttctctgtgtgtagctctggctaacctgcaactcactctgtagaccaggctagcctcagattcacagaggtccacttgtctctgtctcctgagtgctgggatataaaaggtgtgtgctggcattgcctggcaagaatattgaactttcaaattaatgagtttttaaattgtgttgattaatttatttgtatatttgtacactatttgtctgagcttgtgtatgcatacatatggagataagagagtaacttactggaatcagttctctcctaatttgggtcctagacattaaattcagatcattagacttggtagcaagtgctttgacccgctgagccatcttgctggccccttgatttaggtttttaatgaacgtataaagtgataattttctttagggtgttttagaacagcttgttttcattgatattccctgaccaatcttctccctcattcccaccttgcacatgccatccattattccatttccaactctcatgtcttacatattttattatcctcctcatcttcctttcttcaaacctttttctcatccatggtctctttttaaagtgttatcatcatatattacttacgcatagtaatggatttcagtgtgaccattttcgtacatgtacatagtgtctttaccctgttaccttctttgccccactcctactcgtgctcatccccttcctagctagctgctttgctactttcatatgtaagtcactgtgtttcactagggttctttagaggagcatccttcggcgagtgtttgtttgggggtcggggggccatgaataccttgccagtagctacatgactgagaaaaatatctccttcctccatcagcattaacgacacataagtccttagggagggttagagccatggccctgttcaacaaaaatgatctttcttcttttggtagtcgtctgttcaattcatttgccttatatttctggaatttgatttttggaactctgtagattctagataatcaatcacctcttgtacgtatagctggtaacaattttctttcatcctatcggctgtctatacagtttttcctttgttctataacagctttataatttcatgacatctcacttgtggatttttgggattatttcctgtgacagtttaggccctttcaaaaagttttcacctgtgcctaatcttagaaaacaaaaccaaaagtctgagaacagtaagtactattattatatgagctacagtgatgacttacttgcttttctgggctttgattttcctcagttacaactccagcatctcgctgaatactacataactatctcctctaccacactgagcccctcctgatgaaatagaggcaaggtgcttaccctgctggaatttatggactcttgaaatatgtcccctgtgattttctgtagtaccatcagaatttgatccacgctgaattcatttttgtccagagtgagagacatgaatatagtttctttaatttagttttctcagcactatctcttgtatgtgttttgcacctttgttgaaaatcaagtggttgtagctccatgggtttatatatggtcctttcttctagtccacaccggtgttcggatatttttgttcctgtgatcttgtaacataatttgagattagatattgggatacttccagcactattctttctgatcaagattgctttggctaattcaaggtctttggtgcttccattggaagtttaggatttttttttctaaaacaatttctatagagaacattgttggaattttatgggaattgtattgactctgtgtggaagaataatactttaaaaaaaccaatatgttgttatatattttcaaatatgttctcccattctatagatttggtttttgttctgagtcttttataaaacaaggagttttaaatttggctaggttagttctaattaaaaaaaaaatgtatgtgtgctatatggctttaatttgccaatgccagagaacttgagtaaagccgaattcaaaagtaatggacaaaaagtgatgaactagtttgttcagcagagggaaatttaagacaagatggcattcaggctgggattccatgctagtgagaaggagcaacaagtaaagcagaaagataagaaaaatgtacagtttggcaaggagaagagagcctaaactaagccatcacagtggctccttgctccagaatggatgccgggaaacatttcctcaaggtcagcagtgaaggcacacgaaggcctccgacactgtgatctgataggaccaggctacatagcaagctggaagcaggattcagcataggcattcactgcggttctgcttttgcaggtatagaagaagcaagtgggagtgacgcaggaagacttgtttcaaggctacagaaagcctgtgaatccagtactgggtataattgttggattccctggaagaagacccagagaagccattgaatggagctggaaagatgaagcccaagttacagtggagggaccaggatattggagattctagaattgtacttatccactgaggaaagctgcaagaacacagtggaacacgtctaagacagaagtctcatgttctggaggtggcagaagtggagtgctggcactacccaaatctagaccttagatgatcccatccggagtgctccatgctagccagggagctataggactaggcgttagttctaactgggcttttgtttttgctttactccatcctttcctcgctgttctcccattagttgccatttagggtggggatacttcttgttttgtatattagaagtgttcaacttgtattttgatttcataggtgctcaaaataaaagagaaggtctgaagtctcagaggagactttaattttctgaagagagctgtaactgttaaagactatgagagcttttagagagagaccaaatgcattctgagatgtacatagactgggaaccagggtagaatactaaggtgatatgtttggtgttgggttggcaggaagtggaattataatgattaattttcgttgccaatttaacaggatttagaatcacctaggagacagttctgtgcttgtatgtaagtgcagacctagatagatttaccttagaagggaaaatttcccttaaataaatgtggcatctatgaactgggatcctagacagagtaaaaacgagaactgaaaggagcaccaatattcatcttcatttcattccttctgctatttaccaagtatcaggtgcgtgtatttctgtttgtctgtttatgggtgctccattcatttctggtttgtgtcttatgctaccccagtagcaaacctcaatagcttttgtctgtataataaactttaatatctgatagagagattatccctagtttattcatttaaaggtgttttgtctattctaattacttttccttatttgttctagagtaagcttgtattcatctatgagaaatcttagcaagattttgatagtaactattattaaactacatatacatatataattatgcaaaactcattttgagaaaaaaataacactaactatgttatatgttctcttttgagacatattctaactaagaagtaagctgtcttcttttttaatgttattttttaacttactcattttacatcctgttcatgccttcttcccagtcaccccccctcccacaatccttcccctatctccccatcctattctcttctgagtgggtggggggccgctaggcattccccctccctggcacagcaaatctctgcgaggctaggtgcatcctctcccgctgaggccaaacatgacaggccagctagaagaacatagcccacatacaggcaacagcttttgggataaccccctttccaattgttcaggacccatatgaagaccaagctgcacatcggctacatatgtgtggagaggactaggtccagcccctatatgttctttggttggtggttcagactcggaaagccccaaggattcaggttagttgactctgttggtcttcctgtggagtgcctaccctttcgggacctgcaatctttcttcctattcttccataagagtgtgcaagctccatccgctgtttggctgtgggtgtctgcatctgtgtgagtcagctgctgggtggagcctctcagaagacagccatgctagactcctgtctgcaatcataacagagtatcataaatagtgtcagggattggtgcttgcccatgggatgggtctcaggttgggctggttattggttaactattcccttagtttctgttctttcccctgtgcctgcatttcttgtagacaggatacattttgggtcgaaagttttcacaggcagtttttgggtttttttgtttttttgtttttgtttttaaaaggtatcagggagatgccaaagaatcaatgggggtgaccgtagctgtgactcagcactggggatgtggaacctgcagaggccaactcctgtaaccaggcaggaacaccagtggagtgatagggacagcaactgacccacaaaactttcaacctaaatttatcctgtctataagcaatgcagggacgggggatagagcacagacttgtctttgatgtgctatgtgaccctggtgaccttgagttcatggcaaacctgtctcagtttcccgaatgctggaattataggtgtgtgccatcgtgctatacgaaagcagggttcaagtgtggcatctttgccttcattttgcatctgtctcctttactttgagttattgagtattctaatcaatggacagtgtgtgtatcttcatgaaaattgttgcttatttcctttcatcaaggttgtactaagtatcttcatcttagaatagagcaaatgtgcttggcctgggaatgctgcagccgctcttttgctcacttgtgatgatagcgcccttataaagtcactgtggaaattcagagagaccgtgcagctttgaaccctgcctctgacatgtttactttgtccttaaccttttcactcatatttacttgttgggctcttgagctcttatctgtgaacccacaataatagagggatgcattaaaaattattgtgaagacagaatgtgagagtttaaattaaaaaaaaatcaagcag

SEQ ID NO: 677 - DNA, 37248 bp, mus musculus
agaggcttctgggatcgggccccgtgttgctactgccgctactgttgccgatgctcccggaggccatacggctggataggtcagtcccagggaagaggacaaggtgggatgtcgcggcggggtgtctccggctcaaggttagaaacctccagctgccaaaaggctcaaagagatgggaactgaagtgaggagattgggggctgggggttgggtgagaacggaccgaacacccggcgactgttgatgacgccacagcagcgcgtgtcgctgtttccggtgtgctggccgctgggtttgttttgttttattttaggttagggatcggcgagatacaaggatggaccctaaaagatgaagcaaagataagaattaggcaagaaactgttgctgcccagtcctcacacatatagatcgtgttcgtatgaaactgtctgggcccttctttggtttcagatccattctgtgtctgttgggatggttgttttgtgttacaccttaacgaatggtgctcttgccttgttcagtggattcggtagtccgctgtgagctgggggggggcggggggggagtaggtttagtacccttcacattctaacaactgtcatttacatttgaattggaacagttagagcacaaagagttagcgacccaggagctctggagaaagggttggaggagtgctctctttgatgggactgctttcacaccttttggatggataaataaataaataaataaagccaacttttcctccaggcattttttcctggggctgttagctcccggtgcagctatttggcccgagtgaggagtggaggcggacttaatgccaagatagtttattgctggtgagagaatttgctattcaagagcaggacccctgtgggaaaattaatcttaacctgaggccagaatctactcctgcactaggatccagtttgtaatctggttaggatgtcagagcactctgcatttgaaattcttgtgctacgtctttgttttgtaagctaagtcagttgacagcgtgcagtcccaaactcttcaaaaccttaagcagacttttaaagattctgaacggccagaaatcaagatgttttattaatgagagaagcaagggatgaagcatgctactgcttcttacattcttccactcgttctgtttctctgagggacttgtttagacacaggctgctggttcacttatatgagtttttttttccttcattattattttggggggaaggaaagcctcctagaatttaaatttttaacaatttgcaggaagcagcacctgtcacaggactgtccttggaaacctgttgaaccagcatccctagccaacctgtgtctcacaagtgtatcaggatagtgatgagtgtggcccggtacaatttctagaccacaacttgaagccacggtgccaaacatttgcacacagtttgccacagaggtgacatataaccttgaaagtgttactggagggcttcagttctaattaccaagtaatgtttttgctgaccaggattcaaatgctccctcacattaacaagaaaaagagttatggatacaggactgaattgcgtcaccttttcagtctgtctccaccttgcccatagcagggttacagatgatagaaaacacgatgcagatatcaggaagtgtatgcccataggttgtcttttagactcaggttacaagaactgggtaatgggtcttctacctaccctgtaccaaatcccaggtaccagggcctttgggttgatctgttcctcctacccatgtggtattgtgggaatcctaattcctggggacccatacgagtggggagctgtaggaaggccagaccactcccaaatggattttacttaaatgcgacgtgaaaaaaaatatgtgtttggtcatgcatactgatacctgtgtgtaataagagccaacattgtgtcattccttgagcaccatccactttaattttgttttcttgtttgtttttttgagacagggtcttattctgtagctctgactggtcttaaacttaaaagatctgcctgtctctgcctctactttaagcagggactaaaggtgtgcaccaccacaccccgggtcaccttgtttttggttcttggtttttttttttttttttgagatagggtcttctacaggcctgggatttcaccagttaagctaagctgactatccaggaagttccagggatttatatatctttgcccccccttcaccccgaaaagaggtaggacagttctgggggttgaactcaggttgtcttgcctgttgtggcaagcacttactgagtagtctagcttcctagcataatagaaacagcttgtcattgctagagactggtatcatatgcctgtaatttcagcacttgggaagcagagaaaggaagattaatttaaaggtaaaggagaccttgcctgaaacaaaaacaaacaaacaacacaaaaaatcaactatttataattctaccaactgtgataatgataacgaatgcagagaccaccagaggacacttttaaaactgaatagacagtctttcttgcgagttggtgactgcactaggaacttgcccaaatcatgcagccctgatccttacagccctttgtcttttatgcacaaaaaccacatcctgattgtcacacttcagatattaagaagtagaactacagaagccaccccccccaaaaaaaaaccaaacaaaccagtgttactacattttaggactttcttggaactacagacttagatctttgatggattaggtctctttgttcccatttcggcaggtgttagggcctgtttgttggctttgaaggtcagaatggtgcctctaacatggtgtcagttgtgctaaggtctgggggcctgttagaagtctattgaggttttctagtcatttcaaaaattgttttttttttccctactgaatatagagttgagttccttatactattatcaaacctcttaggtatatttcaacttccttcctttctggatgttgtgtctatattctcatttggtttgctttgttgtgcagaggtgccttcatttggaatagtcctgtttatccatggttacttttgttgctttggggtccaaatttaaaaatctttttagacaacgtcatgctgttttcttccttactggctaattgttttagaattgaggagtggggctctaaccagatggcttggcctatgatgtagaaaggcactgtgggtttgacggcaggcagggctacatgttgacttcctacctaaaaataaaacaacaacaacaaaaagcacaaatataatagaaggatattataattctgaggattctatagcagaaactaatatcatgaaacatctctgctgcttaggaatatgatgaaattcaagcaaaaaaagctgtagcgccaaggttaatacattgaatatagcacattgaaagcaggggttgattcagcagctaaaatggctcacaatatactgaggctcactgaagaggaaaatgaattcctccttcagtgatgatagagtgtacctcaaagacagatttggggaaatattaacaaataaaaatgggacacaccaggcattttttatgtttaagcataaaagatgcctgggttcaggaaccccacagggtcaaaccaaggttggaggttggaatggggaatgtatgatgtgatttcctggctgtttctggtgcaagcttctagttgattagcaactttccctgaggcctttgggcggagacaatgagaccagagctggcagtagaaaggatgtgacgagccacacccagctaccggagtgcagacacctgggagccaaagggaaaggtgactacaaggacaaaggggaagggacagaacctgtgatgcagtctcaaaaagtgacagcatatcaatgtgtttgtcctggtgtgtactggagcattttcaggttcttattggtgagcagctagcagggtcgggtggggggcagcagtggacagattaagggaagatcagcaaatcagtaagtgctggccagagtatatgtatctgctttgtttctaggtagaatgaatttagtgccttggtttctgagtgcctgactggctgctcttgtgaatactcggtttgaagctctgggtgagccaaaggagtaacactttatttttgctctttgcagcctgccagttgccatctctttgtaggaagacataagaataatggtttgtaggatgatgcatattgtgtcaggaagatttatcccggaggactctgggacaggaactttagtgtggggcataaacatatttcagtattaaagtacggtaaaattctcctttcgtcatatttctgacagttaggtttctgtgtactaactgggactggcgtaactctgacctacataatagcaggacccctgtgaaagaatctattttatttggtgataggatagcatttcctatttcatgtagagcctataatctctaatctgaaaagcaaagcaggaactcggggatgagcttagcgcacattcaaatttgtcattcacattttttcaaatttgtgactgtgaactgtgtgcctgccccaaactctaatcacaatttaaattccctggcaatgccactactattcttccgatttactatacacagctgacattggggaacctgaaagtgttagtagcccacaaccataaggcctgggctagatgagaatggtcttctacattacataaatgaattgctaaaactacattatgtgtgtgtgtgtgtgtgtgtgtgtgtgtgtgtgtgtgtgtgtatacacatacatagatacgaacatgaaattttttaaaggttgtttttaaaattataagtgttggtgtttgtgtctctgtgtggctatgtgcacatgagcgctagcacccttagaggccagaggggggtcggattctctggagctaaagttataggcagttgtgacccccctgatgtgggtgctggaaactgaactcaggtcctttgggaggtcagcaactgttcttaactactgagaattttagtgtacctatatttagctcctatgaattttagtgtacctatatttagctcctatgaattttagtgtacctatatttctgacagaatctggggtaccagaagttcctagtttgtctcacatcttagtttgtcttattttttcctcagtggtattaaaagaggaaaaaaaatggaaataaaattcaagaaatgggtatttgtgaaataagctgtggattcactagtcagaactaggaaattagtattgatcctcatgtcaggggaaaagggctattggccgtggttcatgttcactccgagaatgacatttcctttagtgatcctgattcctagctcctcttatacaggacccctgtagggaaggctagtcagatatgaatgatagcccactagagaggaaggcatttaaatatattttgttttcacagtgcacagaaacgtttgactttttcgcactattttcttgtacgttgaaaagttgtgtctgtagctgaggtcacagtatgatatatgcatggtatggaatgatgaaatcaagagaacgaacttatctgactcctaaaatactggtggtttctgatatgagcatttgaaatattcctctagcaattttgaaacatgtagcaccctgtcgttggtagtagtcccccatgcattgcagtgatctcaaacattcctcccatgtaattgaagattcagcctactttgattactgtctttcctttctccttaatctccattctccataccctgcaggtacagcattcagctctgctcccatgaatatggctggcttagagaacattgaaattttgtccttctgtgtaggcctggctgttttcacttcacacaagtttcttgtatgctgttgcaaatggaagtttccttcctttggtgtgtggcagggtaagtgcatatgtgcaggtgggtacgtgtccgcatgggatcccatacactgtaggcatatatgcaccttttgttttatgtggtggtttcctccaaaaggaaacatgtccaggagggtgtgggacgtctcgtgagccgcaaatgtctgagagaacaggaaattagaagatttttttttgagggcctccctagccgtatgaaaaggagtacacaagtctaggtgtggagactgggaaagccagcttcacagcgatgagacgtttggatgatgaagctatctgcaagccggccggcaagtgccccagggttagcagtagtagcctttgtgtggaggtgggctttggtgatggagctgctcttgagtcacttctgctccttgtaagcacctcctcactcatgttgctgtcagtaggtccggtaaaaactggttcaccaagtctgactttggtgtagtggttactctagactgttgtaagttccctttctgaggtgactagacctgtggttgtgcctccttagtaaaaaaaacctctggctgtaaaaaagtaaaagtctcaaaaaaaaaaagtaaaaagtctcccacatcaatcttcaggccatctataccattttgttctttagatagggtctctcattggcctggaacccttcctggaagcatgaccccaagggatctgtgcccatctttacctcaccagccctgagccaatattacaaagacttgttttatgtggatgaatgtcccataagtgttctgtgcactgtctgcgtgcctggacatcggggaggagggtttcagagttaccgacaattgtgagccaccatgtgctctgtactgtggaagcatctctccagccccatgggccgcatttctgtgtgtgtgtgtgtccatatccaagtgcatgtccactctagaggtggtggaacctggaagaatggaatcagtaaacgaggcagactaaagtcccatgcaaaagctaactttattcagagcaacaacttacgctctaagggttaagaagggtcacatgagtaaagttctcaagagttcaaaacacttacaatcactactacaagccatctgtggcaaagagccatgtctttctatagaggcatataaaggatagtttaaacatttaattgactaacagctgcaagtgctaatgagtaatctagtgtaaactcagccctatctgctacacctgggaggagcaagaccgcacattccaagaacaatttgttttcttggagtgttctcactagcactcagaattctcctcacatgactgcattcctggaccctgttcagaagtacgtgcgtatgcgtgtgtctgtgtgtgtgcatgtgtctgtgcgtgtgcatgtgtctgtgcgtgcgcatgtgtatgtatgtgaatgtgtgcctgtgtgtgttcgcatgcaccatatggaggtcagagattgattttgggtatcttcaatatctcattttttttttttttttttgcggcagaatcgcacactgaataaggaggtcatgattcacttagtctgactggccagtgccccctagagcttctgttgttttgcttctccaaggggggattacaagttacccctccaagagttttatgtggattttgggggttgaatttagatcaccatgcttactggacaagcactttacagattgagacctcgccatagtcctctgacccagtcttttgtcttgggttctggggaagagcattaagttccttgttcttgcagagcagttgttttatggcctttatcacttcagcagctgagcaactcagtctcagaatctacttctttttgaaggctatcaggtgttctggtttgtgtgtgtaatacacacgcacaattttctttgtccatccatcagctgacatatgattaattttgccctttttgtaatgcttaagtcagtattggcatatatcccttcccatccagttaccaatttcatatcatttgcatatgaaacatttcaggctgggggtatagctcagtggtagaactcctacctggcatgtgcctggattcagactctattcataaaaagcacaatgaaaatggaatttacatacatataatgcagtaatattttccttttattttagtttttttaaataacataattagtaagagaagttctaattttccctataatctgcatgagttccctactccataaattctccagcgcttatctgtgtctctgaatttttttttctctcaaactctttagctaccccatgttcacctatccagaggagtctgatggagtcccatagattgatgtgtgcacttatgccttctggggtaaggccaaagcaactccttacagtgacaagggatctataagtttctgactctgtttatgtctagcatttttacattgtttgtcttatgtaacaaagtgaatttgttcatgttcattattgtatgctttggattgtagtgctaagatggtctttcgaaattaagaaaaagtgatttttctgccattatggatttctttagtggtttgtgcttaaatcgaagaacacaaaatacctggtttgtattaaaatccccagtgagtttctatttaccgtagaactcacagtcatacttaacccattgtcaagaacaaagggtgtggtctactttctggtaatcagctgtatgtaaagtaagaatcagaaagacagactaattggccaagaaaccgtattaggagtcagtatttagaaaaccatgtagggagttttgttttcagccctgctaaagatctccccaccatagaagacaaaatcgctgtaaggagtcaaaagcagatcagaagtattgctgtggccaaccttcatttaaagcctccttttagagactggctcttaatagtcttccggaaaatgacagataattacatctgcctttgacaccctcttgccaacctgaaaatggtcagaacaaattatcagaaatttcattaagctgccttcttttcaggctgccttccagatcattgtccaggcaagttataaaacaaagggaagcccaaatcaaacagacagacagcaaataaaagcaaaaacatccctggaaccaggcacaatggtacagtaatctaagcactcggaaggagcaggcctccgtgtgctacctaacagttcccagttcagtgagaagcatgtggtgctaatgtgtaaaacttaaaaagaaaggagacaacgtaaaaagagaaaagccagttaatcaacaaaacaataaagccaaagcaattaaaaagggctgcagtggcatacacctgctgtctcagtacttggactacctgctttgagtccagtctcggataaagagtgaattttagggttgctagagctacgaagtgagttgctagatagcaaatactctcctcctctcaattcacatgcttacgtagggacaggttggccagtcagttccagaatctgtggtttaatatgtctgtgcttccaaggtatgcagcgaaaatctggtagtgacctgaagagactcctgatttagatagggatattgccgtttacagtgtcctggttgtcatttcattaaacaggcaatgggaacacaaagaggaagaataaatatgttacttattatttggatggtaattcttctgttctaccgagatcccaaacttggtgacaaggagagtgatctcaaagactgccatctggcatttggtacttagcagtggctgctgtggcaggtgggagcatcagttcttggctacctagtttgctaacccaataagtgctatatagctcttaagtggtcaaagaaagtaggattctttgttcctggttccaaagatgtgtgtgttcaggtgcatgccatggtatactggtagaggtcagaggtcaggttgctggacttgattttttttctttcatttcgaaccttggggattgaacttaggttgtcaggttgccacatcactggccttctgcagaatctactgcagctcttttgtaggcccgctatgttgggtttccttaacctttaactcaggcccatgtcatagctcttaacagaggatctgattcctttggctgtaagtttttcacagccctttgaaactctcctggtgactaggacttgcctttctggctttttagaggcctttgtgtttcttcagcattaactcttcgccctgatttctcattctgcagccttaagtcctgctctggccactctagagcgcttcaccttcttcatcttcagctgttaacagccagccatcattcttggcatgccagcttccacgtggatgcacttgtccgtcactctctgttgatgctttgtgtgatcagctcaggctgcgctcctaaatataggtaagaaaagaccacttgagagaagttgtttattgggcctgatgttacaacatcataagaaagcacagtagaacttatctaagctctcaaccttcctaatgctgagcccctttaatacagttcctcatgttgtggtgaccccaatcataaaaatattttcatggctacttcataactgtaatttgctactgttttgaatttgaatgtaaatatgccgaatatctgatatgtgaccacaaaggtgttgtgacccatagattgataactgctgatgtaaaccaattcattgagaccaagcaacctcttgacacatacagagccactgagacttgtgttttggatcattcatagctagaacttaaaactagtgacagaagtcctctttctttatcatcaagggaagggcacccccccaccccccgtagtctaggtagaaatagtttcagagccatctaaggttcaccatggcttatgatagcaaaacaactggtacagtttcagacaactttagatacattcaagatcagggaaatgagctgggactatcatatacttttttaagggatccctggaatgctccaaaggtctgttgctggcataagagtagtccagctaggagactgacagtccttttgttcaagataatcaaggcagcaagagagaattgaacagctggcaattagagatctcattcccgtatctgctgttgtcttatttacagaaaaattaaaatcagacagtcctcacactgtcaacttaatcatttgtcattagtattgacagtgacttttccagtgattaacatgtttctcagtcagggtctcaggtcaattcttgttattggcctcagatatatttcctgtaagaaaacctagtaaggaccgtcagactacctcagggacaaggtctagcacagttccttgaaactgtcatttaacaggttttaaaaacagaataaagacaaaaatatcctccaggaaattttcctccaggcctcgcgtgttcctagttttataccaatgtgcagccccttggaggaactgagcagcatgtaaagtagtttttggtcggtcggtcggtcggttggtcgagaatgtttggaagaattttaagtaaggggccctgccttacccggccaccaaggtctctgctcaaaggtgcagcctgtgatactgacttaggtcagcacaatacagaactcttaaatttgctggtctgacaatttgacatatttgtgtgtacttcacttttgcaaagaattcatttcacatcagggaattgtgtatctaccaaaaattttaattctgatttatacagcctagtgctttataagccagaaaagcagtactattgcaagcattctaagtcagtgattctaaattctccatgcttctacaaagccaattaaaacataggccactgggttccctatagagggaaatgcgaatactaccaagtttaggatcatactaaaaaatgttatctaaaccaaccggaactaacttatttattttcttgatatctagtttcttgaattcttttggatattagcccactgtcagatgtggagttggtgaaaatcttttttctataggctgctgttttgtcttatcaaagatgtcatttgccttatagagtcttttcagtgtcagaaggttccatttattaactgttgatcctagttcctatgctactgatgttctgttcaggaagttgtctcctgtgccaaactgttcaaggctattgcccactttctcttctatcagattagtttatctggttttatattgagaccattgaactgtttggaggtgagctttgtgcatagtataagtatggatctatttgcattcttctatatgttgacatctagttagaccagcaccttttgttgaagatgctgtcttttttttccagtatgtttttctgtcatctttataaaagaaagatcaggtgtctatataagtgtgtagatttatgtctgactcttcaattgaattcacaatggctatctttaaagaatggaatttacaacaaggtttaaagattaagtaggtcttaaaattaaattaaaagttcctttgggtttttgaaacagggtctcgtgtagactaggctggctagtagctccatatacagctgaaaatatccttgacttcttattcttctgtctccacctcccaagtgttagggctacaagcatgtaccacaagttaaaaatatataaacttcttttattatacaacatttctgttgataaatgaatttgtaaggttgttatagtgcattattttgatttaaggattatagaaaagtgctatatagtaaaactcaaggctacaagaattatggccctaataaataccatttatttattgtttttaacagtgaatctttattggatgactttatgaaaaactactgagagaattctctgtaggccattttgtctttagcagttgtgttgaaatttcttgactctcattcagcaggaaaggcaaactagatcctaggatatggccttcattccctgtaaaaaggattttctgtgcatggatgttttgtctgtatgtttgtataccatgtgcatgccttattcccctggaagctgggatagggagtcagcaccctttataattgaagttgcagacagttgggatccaccatgtggttactaggaattaaacttaaggtccctggaaggtcaataagtgctcttagccgttggctcatctctccagccccttctttgcctttttgtgtccccataatttccatgtctttttatcctgtgtcaaactcaagttaccaaacaggtctttctcctagcaccaagcaggaggattcttgccctggatcatttcattgacaagtctggcacttcttggggctccttactaaaggatatctctggatggttaggtacattgccaacagtcagacctgatcgaaattgtcccagagaaaaaggcagatggattttgttgtgtactgcataaaaaaaatgtatttactttcatttacatctctacggatgtgaacaaattccatgttaatgaggttcaatttaatgttatgttacacgtgtacgatgtggaattgtcagtgcgggcagtgagcttcatcccagatacttgattatgcccctgaaaactacttcaggatgagctttactaaagcttgctagagagcttttgaagtagggagactgatttagcacatactgaaaatttaatgggggcattcaaaggagccatatatgcataaactgcccagaggatataatttatgagttccaggactaagtaacatttaagagctaggcataaaattaaatgagaaaacaatgagctagttttcttattttactgaaattaattccttttccagttgtaattgttaaagtgtttcatcagctgtactacctggggtatatagcaacaagtgcttgtctggttatattcacgatcacaaccagcaaggctgcaggtaaccagttcctttgttgtttttaccaaccttgtttgagcggtctttgggaaagagggcattatttctgcaggcagcttatatttcatcagtgtgctgagtcgtctcatttattctcaggttctggggtgaagtgcttcttccctcatcatctccatacttttctctgatttttaagcttgtcttggaatgattcagtcaagcaaattaatataactattatctgacgtatttagtttatcagatatgaacattagaaatagactcacagaattttcaaagctcaatactctcttattaccatagtgattatactgatatgagagctcaaaaatctttcctctggggctggagagatggctcagcagttaaaacactgaatggtcctgaagaggacccaggttcaatttcgcagctgccataagggaactcacaagtgtctggattcctgttgcagggggtccgctgctctcctttgacctttgcaggtaccaggtacacatgcactgcgggcagccagagcacccacacacagaagaattaggtgaaactgatttttaaaaatcatttctcccatccaattgaaagttttcttattttgaccaccacctctccaccaccccacgcccaccttctacttcctagtcaccctagcttctgtctctgactgtaatggaattagatttcacaaaggcaagaacatgtagtatttgcatttctctaaaagcctggcttggttcacttcatataggaagtatctgtaaatgttgtaccttgtgtcaggtcctttttcctttgagacacagtcccactatgtggtcctgaaatgacgtgaaattgactgtagagaccaggtttgcctataactcaccagtagcctgctgctgctgcttcgcaagggctaggattgaaggcctgcacaaccacaccctctgtctcagctctagaagtggaaactttgagttcaaaacaaggagaaagttttacaccactggttcagactttttaattaattaaattttttaaattaaaaaaaattaaatcaattaattatatttaatttaaaaaacacaaacaagtgggagagtgtacttaacaattacctaaatgttgttgggggttaaatgaaagataaatgtgtaagcactgttccattgtctacagcccctagattacttctaatcatttattatttactccaacaatatatattctgtgagataatcctgtcatttttatgaattacaatttctagttcagctcattgcttctttcctcattagcacatgagaggtatatatcgctactatgcccacgcttcagaagatgaagcaatggaataaatagcaggcttcagagttttgctcacaatgtcctggttctgatccaaaaataagtagagagtccaacctagaaattctggccctgtgcttcaggcatgcagggagagttaggtatgagacacaaaagtgggaaacagtagaacgttacagattcagaaatggcacgttgaaagtcaggattggcccagcagcttaaaagaatcacaataaactgttcttataagaaaattcattctcacatcagaatgattggtacgcttccaatcagcttagactagaaattgggggaaaggttcaacagatgagaaagggacaggcccagctcttgttttagcagaaaaaattccaagtacaagaacaagttggccaatgctctggccctatagcaaattccaggtcatttcaatgccctgcaactcccagggttgacccctggctagagtttggagatggctggagaactgggaggtggctccctcaagctgtgtctgaagcaaacttctagctacacctctggaagggatcagaggcctttttctttctctcaaggccacattgagaagggaccactgaatggaggaagtaagagatgggcctaactcttggcttctgcagaggacacatcactgttctgggggcttggatccaaagcatcactcagttgttcttgataagagaagggaggcacacggttgaaaggagccttgagattctggagaaggttgttgctgcccagagtccatccgtactctggggatcccattcggatgaattttacgcagtgttctaggccactggttgcacatttccactactggtgggaagattcttctgagcgccaagcctgtgctgagtgttgtattcggggctctggggagcagaggaagtaaagcttcattttctctccctctacagcctgctagttgccatctaatttggagctcaggaactgacaaactttagagggcgatctgtcttctgttagtggcgcatgcctttgatcccagcacttgggaggcagaggcaggcggatttctgagttagagaccagcacggtctacagagtgagttccaggacagccagggctacacagggaaaccctgtctcgaaaaaaaaaaaacacaaaaaacaaaaaaagaaagaaaaaaaaaagaaaaacctactgtggacaggacaccaaactaccccaggaatgggtctgagtggactcattgatatagtgctttaagatacttggaggagggtttggggagttagcttgttatagaaacaatatgccttcacagtgagaaatatcaccctgcacacttaagagattgttaaaggaaaatctctttactggaaaagtctggccagctgttgctagtgcccaaagaagaacaggcccctgatagaagattttactaacttatatacaccttaggcttattcattttatagtctctgtagtcctcaaattcctttcatgtccaggacccagcttacgctttgagcaatttaagaggcaggagcctgcaagtctggccacctgggcagatgggtgattcacacagcaaggattttgccagagttttaaagtatgctagtgttcttttcagcttgcccacctggctgaatcacacttttcctgataagaccgcagggagtgcaattacagcccaggacttaagggcagctgtgaccctgtagctatgcagggacagatcctaaaaatagatccctgttgaagataccttcttggggatgcacctaatggccgctcaatcttggtaaacggagatgcacatcctagcacagcaattttgcttatctcaaacaggcctgcatagaacactactcatctctgaggtattttggaggaatccatcgctgagctaagttctgctctctggtttaatgtctcctgagcaaagaggttagtgaggcctttataacatccaggctatcagtttgaatttcttctgcatcagtctctggaataagaatcattggtggggctggagagatggctcagtggttaagagcactgactgttcttccaaaggctatgagttcaaatcccagcaacacatggtggctcacaaccatctgtaatgggatctgacgcccccttctggtgtgtctgaagacagcaacaatgtactcacagatataaaataaataaatctttttttttttttaaagaattgtcggtgtgcaaatatgaggaccctagttcaaaaccctagcacccaacaggaggatccttggagacctgctgccagccagcctagccccaggtttagtgagactccctcatctcaagggaataatgtccaaagtgaagagcaggacattcaaagccctcctctggcctccatgacagctccccacccaacccctacatgaatggagtttatcttcagaatctctttaaaaactttgtgttggggtagaggctaggggagggttttgaatgtcctgctcttcactttagacattaatcccttgagatgagggagtctcactaaacctggggctaggctggctggcagcaggtctccaaggatcctcctgttgggtgctagggttttgaactagggtcctcatatttgctttttttttttttttttttttttttgggttttcgagacagggtttctctgtatagccctggctgtcctggagctcacttggtagaccaggctgggctcgaactcagaaatccgcctgcctctgcctcccgagtgctgggattaaaggcatgcgccaccacgcctggctgggtcctcatatttgcacaccgacaattctttaaaaaaaaaatttatttattttatatctgtgagtacattgttgctgtcttcagacacaccagaagggggcgtcagatcccattacagatggttgtgagccaccatgtgttgctgggatttgaactcatagcctttggaagaacagtcagtgctcttaaccactgagccatctctccagccccaccaatgattcttattccagagactgatgcagaagaaattcaaactgatagcctggatgttataaaggcctcactaacctctttgctcaggagacattaaaccagagagcagaacttagctcagcgatggattcctccaaaatacctcagagatgagtagtgttctatgcaggcctgtttgagataagcaaaattgctgtgctaggatgtgcatctccgtttatcaagattgagcggccattaggtgcatccccaagaaggtatcttcaatagggatctatcttgaggatctgtccctgcatagctacagggtcacagctgccgttaagcccagctctgtaattacgttccccgtaggcaggaagaactgggtcctggaagtcaggagggtggaggggctgagccggaagaaagattaaaagccctggttggttgaagagttccacagagctggcaagcctcaaacattctaaggcttgaattggaacactggtcgatgtcaaggtctaagtagtgccagtacatgggtctgataaaaacctgcaacacaagctgatgccaagagctaaggaattccttgattcccaggtccaaacaaaagtgcagggtaaaggtccccaatactgtctttaacactagtccaagcaggtcctagctaggccaccagagggagcacttctcccttataaggtagaagtggttccaagccatggagagttcactgcaaatcataattctcccaagtttgctttatctcctcacatagacagtctgtggaactaggtgtgcattaggcagaggactagtgcacagaggagaaacagcaccagaggaaatgggagatcactcacagtgtcacaggctaacacaacagcaaaagccccgccccaccccaccccccacactaaaactgtcttgactggggctatgccttccttcagaagccagagcagtcacctagaatcgctgtgtagtttccgcagtgcatcggtagaatgtgcaggatagcagttctggtatataggtagcctaccaggcttaagccatcaagttttctgtaaaggcacgtggggaacacagaagaaaaaggagttcaacaacttccagtgaaaggctcggtggtcttgcccctgatgtctttgcttatcgaagggaaatggatcccaggaggagtgcttataattgggacttactataacctggtgtgatgacacaaacctttcagccccgaactcctgggacggaggtgatagatccatgagctcttgaacagacaggggaggcatggaatcctccctatcagtatcatttacgagcaattcttcatgtatctattgaccatatgtatgtatgtctttcttcaagaaatgtctattgaagtctatattattaagttgagtcattgttttattgcaactgagttcgctgtttgagacagggtttctccgtgcagccctggctatcctggaccgcacttggtagaccaggttggcctcagactcagagacctacctgcctctgcctcctgagtgctgggattaaaggcgtgcgccaccactgccacctagtgcaaccaagttctttatagattttagaactagccttttattccatgtggcttgtagagacttccttgtgcccccgaggttgactccttgcgcagctctctgggctgttcactcccatttgtttatgctgctccttgtctcctcattgattttttttttttttgttaaatctcctcctcaaattaattatacagaccagtgtcatttttttctccactacttttttaggtctgtttttcagttgttggtgttgtttgactgtactaaaacgggaccattcctgttgtcctttaatgcacgtttcaatgggggaacaaagatactcttcttaaattaaacaaagaagatttccttcaactttgcctaaaaccatacacgcttaaaatgatacattacctattttcaatgaaactccctagctgagttatatactcaagtggtagtcatttacaatgggactcttgttcccacttatggcatcaataacatgaaaggggtatttctaatttctggtaaattatgtcaataatacaattgtgacaatacttgacagagaaagattaattgtaagattaattatcatcagaagttatagtcattttttcaaactcagggccacacagtcaggaatgcaattgcagcagatctttgtttcaggtttcctttcacagagtagccttaaacagtttctagaaggaagcaacccacagttccagcaacttgtgaaaccctcccaccaaccgaaaaggaagttaaggtcaggacacattgattagaggctcccatctggctccctgctagatctctccccagattgcagcacaaattaaatccagcccccaggacacaaataacaacaggccattccaactggcctaggtaggtctgttctgcctttgtcctggaaccaggaagatgctaagattaaagccattctttgagaactaaagacccttccagaaaggccaggttgggggtggagagtctctgtagaagagctctggtatttaacactaggaggaagactgactttcctgttcaggtaagtaggctcctgaggcctatggctaaatcttcaagtgtatagttcctgattttttgcttcatctttttaaaatgtttttttttaaagatgacttgtgtttaacttagggtctcatacatgctaggtaagcattctaccattaagctgtacctccaccccttgattattcttttttgtaagttgtaacatagctaagggtgaggcagaggcatcgagaatttctcttcagctttggccaaaattctgtatacattaatttgcctgttttatacagatgggtttttgtattaataatacatgcaagcatttaggcccaaagccaggccttatagctggaggatctataaactgggtggacagtgtgttagaggttttagatttctaaggtgtgtaataacctcattacaagaccgtcagtaggagactctctctctctctctctctctctctctctctcttgaaaggtaatcaatccaatgcccgtcatgagtgatgtctttttctcctctgtgcactagtcctctgcctaatgcacacctactcccatagactggctgggtgaggagggaaagcaaacttgggagaagttttgactttgtagccctttcactggaaattggctgtgaggtcggaatggtgcagtctcatgggaagagtctgggggacataacttacattttcattagtcacagtgtttatttactagatgttacaaggctgggtttgctttctttttaatcattacttgagagggaaatataatatttccaataacatgtatggacattttattctcttaatgtggtagaatttagattgcaggcgtgtgtgtgtatgtgtgtgtgtgtgtgtgtgttggaggcaagacctttcagtgtagccagactggcctgtactcactgtatccctgattctgcctctccaatgctagaattataccaccatacttgacttcagttcacttttaaattattttataatttgcatatgtcaatagcttttatgggtgcttcattatttctgttatcaagaatagattcctagtacattgttggattattttgttagcgagcactcaaagatatttgctatagaatactactaccaatagacctcgtgatgataagccacatagtgtctcttgtttcatttattgtaaaagttcatgtcttaaagttcatgttctaagcttacagagatttataattgtgctttcttcttttctaggtagatgcccagtgacgtcaacatgtagtttccacaacgtgtaaggtttttcgagagtggccaggggatggaaatattggactaaggaatggtaaaaggctacaaatatcagtgttttaaccattatttaattgctttcttgatcattacatgattgtaagcttgtgtgtgtgcatgcgtgtgtgtctgtactatcattcagtgtagaaattggcctagcccatagcacctgctaggcaagtccgtcattaccaatatatctctccaactctatcattgctgttttgggaaggttattattttgccatttggaaagcacctgtgcataggctttatcctgtttggggtacaatagatttgtatatgaaaaaataatcttgttatgtatgggtgctgagtcagaacttcttagcagtagtcaggatttaaactaataaaaaatgctcaatgtggtttcttcttatgtcttgagaatttagctgaggctaaattggatgagtaccattggcaccaagtaagatcatgtgttttgcacttaacagataatttctttgtctgtggatatgggagtacagctgaggcatcccataaatcctatagataaacagtttccaccctcaattataagtattttttttgatccccaggaaactaggtaagatatgaggaagaatgtgattaacttaaatgcctcatttaaaatttcactcagaggctttgtgcccttctagaattttctaagtatggccagagttctcagaataaaatgtagagacaccgaatgaaataatgccaagtagccaccaggtggcgaaattgcatatggatttaagcagcacaggcaaaccagcctcggtatctagcctagaggccatgtttatgtctgtatctggttttctgtcaaggctacaaaagatcaagtggtgattttatttctctttattcccttggttttagaacacttccattcctgcccaaggcttctgtgggagccatgtgccgctgtacctgctgtgggagccatgtgccgctgtacctgctgtgggagccatgtactgcttgctgtacctgctgggttaccaggtagaagaaagaaatgatgcacagtgtacttctagttcttcagctgttaggattctagttcccgcatccctgatcatccctggatttgctaccatgagaatggacttaaaggatgaggaggaaagcaaaattaacatttttgagtcaccagatactctagttagaagtagagtattataacttaccttaattactataaaaatatgagaccctgaaagattaatttgttgttttatctatcactttaatttagcaattttttactaggctttgccagtattacttcaagtataagtgctgtaggtcctcagctctgtattattttcaggcaacttgaaggtaacattcattttagaatactttcttccatagtgttagaagatgcagacatttaaaatggcaatcctgataggaaatttaaaatccggaataataatccaatatctggccagtgttcaggcttacttggttgtgtcattaaaaaaacagtttgcagttgctgtatttaaatcacggtccagacaaggtttatatgttggattcacttgaagtgtgaactacgaggcattttctgtagaggaaagcagagtattaaatcagttagtcctcctgtttaggaagtcataatctttgtcctcaacgagttctgttttgtggtttggctacctgctccaatagattaaacctatggctttccacaagtcctctgttactgaccttaccttcagccctgctttattctttttatttttagaaaagatctcactgactatcataggttgactttgaatttgttctgtaacttcagcaggccttcaacttgctagcctcctgcctcagtcctccaagtagctgaaattagtgggctatgcttccaggtctgattcgctgtgggaaataagatattatgatttaacaggctcaggtataagttgtcagataaccaaattacaatgggtcaaacaggatgagaattcatctcccatttcttttttatttttaagatttatttatttattctatgtaagtacactgtagctgttctcagacacaccagaagagggcatcagatcttgttacggatggttgtgagccaccatgtggctgctgggatttgaacttagaacctttggaagagcagtaagtgctcttaactgcggggccatctctccagcccttgtttctcatttcttaagggtttactgtcctatcatctccacaaatgtgctatttgtcctcagggtactagaaacacctacagcgtgtacattcacactgaaaccatcaaaatgtagcatggggaaagagaacaacatgggagataaccagctgtctctgctgtaaaaaaaaaaaaaaaagtaattcaggactcttatattacctagaacattgcccggagcatgtaattgccaccacttaaagtcgaaaacacaggaaacctgttagacttgtgtgtacataggtagaggtaggggacaacttgtggaagtcagttctccccctttaccattacagtgtgttctccccttccaccatgtgggtcctggagattgaagtccagtggtcaggcttggggtcataccttgccaccgtgagctatcgcttggcctggaaatgagttaaagttccactgttttttgtaatagcactcttgtgtccagctctgcaattccagtggtgttttccaatcatagtgtcttgtctccctaaccatagttggttaacatatgcctatgctatctaggtcagactgtcagaagtcatctttttgattgtctttctgaggtttaattggagaaaaatagtgtgttctagtttgtattaggcacctaagtattctctctctctctctctctctctctctctctctctctctttctctctctctcttgtatggcccagctatggggtgtatgtttggaaatttctggtggcctttttacagctataggaaagaaacttgtctaaaagaatgtcatttttgggctgagcaactggagcttcccattggtgttcaaacctccagtcatgcttgtacttgagtcccatccatctatgatggataacctatgagacatccaatagattctttcttttgcctgagtttaagttgtgttttttgtcacttacaatcaacaaagttctgattaaagcgctattttacaggacagttctggaatcagtatagctgtgtttagcatttatgtgtcagagggtaatagatttagtaactagaagcaagaagacaatttgcagatctattagtctacctgaaaagtgacagccccgagagccacaacatcaggggctgctgtagctctggctggtttgttttgtcttcttctagatagttaaatagttacccgcatcttcagactggtcatccttatatggttgcaggattactttttactattcagatgagcatatttccctctataccttttggcattgtttacaaagctgcttagaaatccttgtctgctaatctggcatgttggtcatcttgtgatctggctttttgagtgccttgatttttcaatactagtcacagtttccagtttcctgtgtaaatccaatcattctggcttgtctcatggatacgaagactgtttgaaatggatacccttatgtccataggaagagcattgatatttgtttatgttttagtagggagtcaagtagaccgaacttagacactacactccgcttctgtgaaaacaaaaacaaaaacaaaaacaaaaaaacctgcaaatgagttcacttagctttatctgggctatttagagatgttactatgtgtgcataattcagaggtcagcaagaaacctgggtggtttctatgcagcatttgggccctccttctcaggctccctccactgtaggattttatcttccacacttctcagcttgtatgaaaaccctgaactctgtcctccagtcttcaggtcagtaaggtccagtttaaggcaccagtgaggaatgtgacttggggctatgttgtggctaaaatgccttaaaagagggggcattgtccagttctgaccttttctttgaagtgccatttttttctgtcactttcttactgttttaggttacttgacaatacttgcatgtagcctttttaaaaaatatatatttttctccaaagtatacagttgttgtatctgaacaaaagtcaatttcatagcagcactgagtggaaattacaacctgtgtgggctgtgttatataacttgaggcacacagcacaaatactctggaggcacagtaaaaatgtatactagtgtgctgactggtattatgtcaacctgacccaaagctagagtcatcagagagaaaggagcctcaatttagaaaatatttccataagatacagctgtaagtcattttcttaattagtgattgaggtgggaggacccagccctgggctggtagtcatttgttctataagaaagtaggctgagcaagccatggagaataagccagttagtagcactcttccatggtctctgcatcagctcctgcctccaggttcctacccagttgtagagttcttgtcctgacttccttcagtgatgaacacgtaagccaaataaacccttttctccccacttgctttcttggtcatagtattttatcacaatagccaccctaactaagacatccgggatctacgtgtttgattcagctaatgtgacttgatacagacagggtttataagcatgtaaggtaaaggtgatgatattgtcagttggcatacttggaggaatgagaagcttggtaactgtccgcttgggggttctcatgaattcagattgtctcaccataaacaggtaaattccatagcaggtaatctaatacctcttccatgaggacctccaaggaccaagtatccctgaccctaatattgctgaatttttaaaggtgatgttaagttagctgtagtaaactgtaatttctatgcagctgtaggtcagatggacagagcaagactcccatacaaccctctgccagacctggtgtctgagatagatagaaggaggagataaatagataagttatttaaagcttgaatagggatgagtgacatagcttatagggaaaggactgttaaggaaacccaaatgtctccttggggcacaccaacatatggtaaatatagggttaaaaagataagacaaaaacaagtttaaggaagaagaggttacggctttggccctgtttgaaatatctgtgaggcatctaggtaaatgcacaggaatttggaaaactggagagaactctggaatagagatctgtattgaagaatgcccagtagagaagtggtagatgaagctgtggctatgaatgagatggccagatagaatgtgccaagggagaggagaattgatgagagagaggggagagactaataagtaggtcagtttgagaaattgtgaagtagctataaaagtaaaaggggagttagaaaaggttgtatgtagaagtaaaggagacgtccaacccgttggtgttcagtagagccgaatgctataaaagcaagcattgtacacggaacatagcagctctaacagcagaaggtttattttcatctcacggttgtagttggagttcagtgtccaggagcacagccattttgcaacagcttatgggtttcatagggtggtaaactgcatcatgtagcccctgctaaccattcttcccaatagccatccccctgtgttgccccttgctctcaaatttggtgggttctataagtagtttaactggtagtatgtctggaagtgatgctgcttgtttgcttgtttacagataagtgtagctcacagccctcatcaaagagccctgtagccacgtgtagtggtgcatttctttaatccagcacttgggaggcaaaggcaggtggatctctattagattaggccagttatgtctacctacctattgaattctaggccaactagtgctacataatgagaccctgtatatataggaatgtgtgtgcacacatacacataaacaaacaaacaaacaaacatatataaaaagaagcttccttttacaacagataaagtttaatatagagttatacagatcgacaactggtcagaatgcatagagtaagtgactgtgggatgcccagctccatcagatatatcttttttgtttgtttgttttttgtttttcgagacagggtttctctgtgcagtccttgctgtcctggaactcactctgtagaccaggctggccctgaactcagaaatccacctgcttctgcctcccaagttctgggattaaagttgtgtgccaccaccgccgggccaacagatatatcttaaatggaaccctatacctaaggataagggaacatgaagatgaggtaggaagtaagaaccacaggaccaggatatctgttgttttatagtgtcccatacacatgtgtacacacagaggaaaatgtaaccgtgaactcttagcaatatgtttgcctaaacaagatcagcataaggacagcacagttgacatgtcactaggggaaatctcacatggtcccacccctagatcacaaggtgcaagtgacaatggctgatgaaatagggtgaatcagtttcctttagggacgggctttcacagaggtggtaagtcataattaaaagagaggctgtcatttggggagggggaacagggagaggagagagagaatacccttgtatgaagtttccccctaaacacttaaaaaacaggaggtcgtaatctccctcacaactttcactgtggccttttggtgccttgagcaaccatataagaagtctatcttgctaattaggacaagtgaaggagacttgagatgacgtggaaagggagcaccctggctaagcccagatctctagatctgaacaggcatgtgaaagagaccatccgggcccctccagaccaattaccaaccagctgggtaccatggagtggcctagtagataggaagcagagtaaatttacaacctaagggaatggcctgttagcatctggaagctcacatgcaattgtgggagtatttttcctaattagtagtttggaataatgtatttatatccttatttttattttaatgtacaggtgttttgcttaaatatatgtttgggcaccacatgcatgcctggtaccactagaggccaaaagagggtgttgagtcctctggtactgcaattacagatattagtgggccatcatgtggttgctaggaatagaacctagatcctcaggaagagcagtctgtttttttttttttttttttttttagatttatttatttattatatgtaagtacactgtagctgtcttcagacactccagaagagggagtcagatctcgttacggatggttgtgagccaccatgtggttgctgggatttgaactcctgaccttcggaagagcagtcgggtgctcttacccgctgagccatctcaccagcccccgagcagtctgtttttaactgctgagccatctccccagcccctgaggggattttttagaaataatagtgatagatactttggaatgtgtacatattaatagaggacttttctataatgatggtatgtgcttggaaatgtgcgtgtacaaatagggaaaagctaggaggaagaagaatggagatgcaaaagagggagagatagctgacgccatatgagatatctaagaagggaagatgagatcccaactctggtgatgagttttaaatcaagagacgcttgctttccaatggatctttaaaaatatgtctcatgtactagagtcaaaagaatatataaatgttaggtaggaattaattggtttcccaagaatggttgacatgttccttatcaggattgcttagaagccaggaagtaattggtatctgtacctgtgggttaacaactagacacccttttaataaagctgtttctgtacataagccatacctccacagagtcaagctagtctgggctctgtgggttttcagaatggtagaggcttcaagttcggttgtagtagataactaacataaaaaggccttgactgatatctgcagacttccacatgctaatgaggaaaaaaatgtatcaaggtgtcttagtcagggtttctattcctgcacaaacatcatgaccaagaagcaagttggggaggaaagggtttattcagcttacacttccatatcactgttcatcaccaaggaagtcaggactgaaactcaagcaggtcagaaagcaggagctgatgcagaggtcatggagggatgttctttactggcttgcttcccctggcttgctcagcctgctctcttatagaacccaagacgaccagcccagagatggtcccacccacaaggggccttttccccttgatcactaattgagaaaatgccttacagctggatctcatggaggcatttcctcaactgaagctcctttctctgtgataactccagctgtgtcaagttgacacaaaactagccagtacacaagggaaagtagaaaagcaactcagtataacaataagcctctgtaaaaaacatctattatggaaaattgtaatcacacataaaattacacagaccagcacaatgaacctacatgtattactaattttgttaaaaatacaaaatatgatatggatgctaagatctgtaaattagcaggtaaattagggagggtgaggcaggataattgcaatgccagcctgcattacatagtgagtttcagtctagcataagacacaggaaggatctgtctataaaaattaaaaagaaataattagcaatttttgctcatagttttaatggtacatattttattttatagagagttgatcctcattgtttaataatttcatatttatagcttggactatttactaaaatttatctgtacttctctggttagtacttgcagtgctttcatggtaattcatggacctgcacagagagccaggcactagatgttcccagctaaagttgaatagagaacacactttttttcccatatctgttatcacactgtaagtgtcctttccatggtcattttaatgttactttttgcttcttttgttggtgacttcactgtttaaagtgccactaacaataatgttaatgccagaaagttgtggtatgtcttaaggagaccgtatatgttagataagcttcattttggcatgagctataatgctattgtctaggatattagaggtaatgaatcttgcaaatctagaaaaagaaagaagaaagttggcagcctatggatgctcagaaaaatgatgaaatatttattttggggtatgtgtgatgtatgtatgtgtatttcaatgtgtatgcaagaacatgccatttgtgtgtgtgagtatctaagtctctttatctctgtctctgtctccccctttctctgtctctctatctctgtctctccagtgtgtgtgtgtgtgtgtgtgtgtgtgtaggccttgttgacattgggtgatttcttagttactgaggtactgttagttactattgctgtgaagagacaccaggagcaaggcaacttattaaataaaggggacttgcttacagtttcaaaaggtgagctcatagccaacatggtgggagcaaggcagcaggcaggcatggcactggagctaagagcttacatattatctacaaggtgcatggggaaagaggagggaaagggaccaggcatgggcttctgaaacctcaaagcccaccctcagtgacacacctcctccattaaagccacacttcctaattctccccagaactcttccactgactagtaatcaagcatttggataatatgagcctgtggggactattctcattccaaccatcatattcttcattgtagtttttgagagaggaactctcagtgagcctcctagctctgccttcacagagctctgagactgtaagcacatacctctgtactggttcttttatatgggttccaagggatgtagcatccactttactgactgaagtatcacctcaacctcaatacaagtctaattggcctttctttcattctaaggataatgaactttttgtttgtttttcgagacagggtttctctgtgtgtagctctggctaacctgcaactcactctgtagaccaggctagcctcagattcacagaggtccacttgtctctgtctcctgagtgctgggatataaaaggtgtgtgctggcattgcctggcaagaatattgaactttcaaattaatgagtttttaaattgtgttgattaatttatttgtatatttgtacactatttgtctgagcttgtgtatgcatacatatggagataagagagtaacttactggaatcagttctctcctaatttgggtcctagacattaaattcagatcattagacttggtagcaagtgctttgacccgctgagccatcttgctggccccttgatttaggtttttaatgaacgtataaagtgataattttctttagggtgttttagaacagcttgttttcattgatattccctgaccaatcttctccctcattcccaccttgcacatgccatccattattccatttccaactctcatgtcttacatattttattatcctcctcatcttcctttcttcaaacctttttctcatccatggtctctttttaaagtgttatcatcatatattacttacgcatagtaatggatttcagtgtgaccattttcgtacatgtacatagtgtctttaccctgttaccttctttgccccactcctactcgtgctcatccccttcctagctagctgctttgctactttcatatgtaagtcactgtgtttcactagggttctttagaggagcatccttcggcgagtgtttgtttgggggtcggggggccatgaataccttgccagtagctacatgactgagaaaaatatctccttcctccatcagcattaacgacacataagtccttagggagggttagagccatggccctgttcaacaaaaatgatctttcttcttttggtagtcgtctgttcaattcatttgccttatatttctggaatttgatttttggaactctgtagattctagataatcaatcacctcttgtacgtatagctggtaacaattttctttcatcctatcggctgtctatacagtttttcctttgttctataacagctttataatttcatgacatctcacttgtggatttttgggattatttcctgtgacagtttaggccctttcaaaaagttttcacctgtgcctaatcttagaaaacaaaaccaaaagtctgagaacagtaagtactattattatatgagctacagtgatgacttacttgcttttctgggctttgattttcctcagttacaactccagcatctcgctgaatactacataactatctcctctaccacactgagcccctcctgatgaaatagaggcaaggtgcttaccctgctggaatttatggactcttgaaatatgtcccctgtgattttctgtagtaccatcagaatttgatccacgctgaattcatttttgtccagagtgagagacatgaatatagtttctttaatttagttttctcagcactatctcttgtatgtgttttgcacctttgttgaaaatcaagtggttgtagctccatgggtttatatatggtcctttcttctagtccacaccggtgttcggatatttttgttcctgtgatcttgtaacataatttgagattagatattgggatacttccagcactattctttctgatcaagattgctttggctaattcaaggtctttggtgcttccattggaagtttaggatttttttttctaaaacaatttctatagagaacattgttggaattttatgggaattgtattgactctgtgtggaagaataatactttaaaaaaaccaatatgttgttatatattttcaaatatgttctcccattctatagatttggtttttgttctgagtcttttataaaacaaggagttttaaatttggctaggttagttctaattaaaaaaaaaatgtatgtgtgctatatggctttaatttgccaatgccagagaacttgagtaaagccgaattcaaaagtaatggacaaaaagtgatgaactagtttgttcagcagagggaaatttaagacaagatggcattcaggctgggattccatgctagtgagaaggagcaacaagtaaagcagaaagataagaaaaatgtacagtttggcaaggagaagagagcctaaactaagccatcacagtggctccttgctccagaatggatgccgggaaacatttcctcaaggtcagcagtgaaggcacacgaaggcctccgacactgtgatctgataggaccaggctacatagcaagctggaagcaggattcagcataggcattcactgcggttctgcttttgcaggtatagaagaagcaagtgggagtgacgcaggaagacttgtttcaaggctacagaaagcctgtgaatccagtactgggtataattgttggattccctggaagaagacccagagaagccattgaatggagctggaaagatgaagcccaagttacagtggagggaccaggatattggagattctagaattgtacttatccactgaggaaagctgcaagaacacagtggaacacgtctaagacagaagtctcatgttctggaggtggcagaagtggagtgctggcactacccaaatctagaccttagatgatcccatccggagtgctccatgctagccagggagctataggactaggcgttagttctaactgggcttttgtttttgctttactccatcctttcctcgctgttctcccattagttgccatttagggtggggatacttcttgttttgtatattagaagtgttcaacttgtattttgatttcataggtgctcaaaataaaagagaaggtctgaagtctcagaggagactttaattttctgaagagagctgtaactgttaaagactatgagagcttttagagagagaccaaatgcattctgagatgtacatagactgggaaccagggtagaatactaaggtgatatgtttggtgttgggttggcaggaagtggaattataatgattaattttcgttgccaatttaacaggatttagaatcacctaggagacagttctgtgcttgtatgtaagtgcagacctagatagatttaccttagaagggaaaatttcccttaaataaatgtggcatctatgaactgggatcctagacagagtaaaaacgagaactgaaaggagcaccaatattcatcttcatttcattccttctgctatttaccaagtatcaggtgcgtgtatttctgtttgtctgtttatgggtgctccattcatttctggtttgtgtcttatgctaccccagtagcaaacctcaatagcttttgtctgtataataaactttaatatctgatagagagattatccctagtttattcatttaaaggtgttttgtctattctaattacttttccttatttgttctagagtaagcttgtattcatctatgagaaatcttagcaagattttgatagtaactattattaaactacatatacatatataattatgcaaaactcattttgagaaaaaaataacactaactatgttatatgttctcttttgagacatattctaactaagaagtaagctgtcttcttttttaatgttattttttaacttactcattttacatcctgttcatgccttcttcccagtcaccccccctcccacaatccttcccctatctccccatcctattctcttctgagtgggtggggggccgctaggcattccccctccctggcacagcaaatctctgcgaggctaggtgcatcctctcccgctgaggccaaacatgacaggccagctagaagaacatagcccacatacaggcaacagcttttgggataaccccctttccaattgttcaggacccatatgaagaccaagctgcacatcggctacatatgtgtggagaggactaggtccagcccctatatgttctttggttggtggttcagactcggaaagccccaaggattcaggttagttgactctgttggtcttcctgtggagtgcctaccctttcgggacctgcaatctttcttcctattcttccataagagtgtgcaagctccatccgctgtttggctgtgggtgtctgcatctgtgtgagtcagctgctgggtggagcctctcagaagacagccatgctagactcctgtctgcaatcataacagagtatcataaatagtgtcagggattggtgcttgcccatgggatgggtctcaggttgggctggttattggttaactattcccttagtttctgttctttcccctgtgcctgcatttcttgtagacaggatacattttgggtcgaaagttttcacaggcagtttttgggtttttttgtttttttgtttttgtttttaaaaggtatcagggagatgccaaagaatcaatgggggtgaccgtagctgtgactcagcactggggatgtggaacctgcagaggccaactcctgtaaccaggcaggaacaccagtggagtgatagggacagcaactgacccacaaaactttcaacctaaatttatcctgtctataagcaatgcagggacgggggatagagcacagacttgtctttgatgtgctatgtgaccctggtgaccttgagttcatggcaaacctgtctcagtttcccgaatgctggaattataggtgtgtgccatcgtgctatacgaaagcagggttcaagtgtggcatctttgccttcattttgcatctgtctcctttactttgagttattgagtattctaatcaatggacagtgtgtgtatcttcatgaaaattgttgcttatttcctttcatcaaggttgtactaagtatcttcatcttagaatagagcaaatgtgcttggcctgggaatgctgcagccgctcttttgctcacttgtgatgatagcgcccttataaagtcactgtggaaattcagagagaccgtgcagctttgaaccctgcctctgacatgtttactttgtccttaaccttttcactcatatttacttgttgggctcttgagctcttatctgtgaacccacaataatagagggatgcattaaaaattattgtgaagac

SEQ ID NO: 678 - DNA, 23028 bp, mus musculus
ggcttctgggatcgggccccgtgttgctactgccgctactgttgccgatgctcccggaggccatacggctggataggtcagtcccagggaagaggacaaggtgggatgtcgcggcggggtgtctccggctcaaggttagaaacctccagctgccaaaaggctcaaagagatgggaactgaagtgaggagattgggggctgggggttgggtgagaacggaccgaacacccggcgactgttgatgacgccacagcagcgcgtgtcgctgtttccggtgtgctggccgctgggtttgttttgttttattttaggttagggatcggcgagatacaaggatggaccctaaaagatgaagcaaagataagaattaggcaagaaactgttgctgcccagtcctcacacatatagatcgtgttcgtatgaaactgtctgggcccttctttggtttcagatccattctgtgtctgttgggatggttgttttgtgttacaccttaacgaatggtgctcttgccttgttcagtggattcggtagtccgctgtgagctgggggggggcggggggggagtaggtttagtacccttcacattctaacaactgtcatttacatttgaattggaacagttagagcacaaagagttagcgacccaggagctctggagaaagggttggaggagtgctctctttgatgggactgctttcacaccttttggatggataaataaataaataaataaagccaacttttcctccaggcattttttcctggggctgttagctcccggtgcagctatttggcccgagtgaggagtggaggcggacttaatgccaagatagtttattgctggtgagagaatttgctattcaagagcaggacccctgtgggaaaattaatcttaacctgaggccagaatctactcctgcactaggatccagtttgtaatctggttaggatgtcagagcactctgcatttgaaattcttgtgctacgtctttgttttgtaagctaagtcagttgacagcgtgcagtcccaaactcttcaaaaccttaagcagacttttaaagattctgaacggccagaaatcaagatgttttattaatgagagaagcaagggatgaagcatgctactgcttcttacattcttccactcgttctgtttctctgagggacttgtttagacacaggctgctggttcacttatatgagtttttttttccttcattattattttggggggaaggaaagcctcctagaatttaaatttttaacaatttgcaggaagcagcacctgtcacaggactgtccttggaaacctgttgaaccagcatccctagccaacctgtgtctcacaagtgtatcaggatagtgatgagtgtggcccggtacaatttctagaccacaacttgaagccacggtgccaaacatttgcacacagtttgccacagaggtgacatataaccttgaaagtgttactggagggcttcagttctaattaccaagtaatgtttttgctgaccaggattcaaatgctccctcacattaacaagaaaaagagttatggatacaggactgaattgcgtcaccttttcagtctgtctccaccttgcccatagcagggttacagatgatagaaaacacgatgcagatatcaggaagtgtatgcccataggttgtcttttagactcaggttacaagaactgggtaatgggtcttctacctaccctgtaccaaatcccaggtaccagggcctttgggttgatctgttcctcctacccatgtggtattgtgggaatcctaattcctggggacccatacgagtggggagctgtaggaaggccagaccactcccaaatggattttacttaaatgcgacgtgaaaaaaaatatgtgtttggtcatgcatactgatacctgtgtgtaataagagccaacattgtgtcattccttgagcaccatccactttaattttgttttcttgtttgtttttttgagacagggtcttattctgtagctctgactggtcttaaacttaaaagatctgcctgtctctgcctctactttaagcagggactaaaggtgtgcaccaccacaccccgggtcaccttgtttttggttcttggtttttttttttttttttgagatagggtcttctacaggcctgggatttcaccagttaagctaagctgactatccaggaagttccagggatttatatatctttgcccccccttcaccccgaaaagaggtaggacagttctgggggttgaactcaggttgtcttgcctgttgtggcaagcacttactgagtagtctagcttcctagcataatagaaacagcttgtcattgctagagactggtatcatatgcctgtaatttcagcacttgggaagcagagaaaggaagattaatttaaaggtaaaggagaccttgcctgaaacaaaaacaaacaaacaacacaaaaaatcaactatttataattctaccaactgtgataatgataacgaatgcagagaccaccagaggacacttttaaaactgaatagacagtctttcttgcgagttggtgactgcactaggaacttgcccaaatcatgcagccctgatccttacagccctttgtcttttatgcacaaaaaccacatcctgattgtcacacttcagatattaagaagtagaactacagaagccaccccccccaaaaaaaaaccaaacaaaccagtgttactacattttaggactttcttggaactacagacttagatctttgatggattaggtctctttgttcccatttcggcaggtgttagggcctgtttgttggctttgaaggtcagaatggtgcctctaacatggtgtcagttgtgctaaggtctgggggcctgttagaagtctattgaggttttctagtcatttcaaaaattgttttttttttccctactgaatatagagttgagttccttatactattatcaaacctcttaggtatatttcaacttccttcctttctggatgttgtgtctatattctcatttggtttgctttgttgtgcagaggtgccttcatttggaatagtcctgtttatccatggttacttttgttgctttggggtccaaatttaaaaatctttttagacaacgtcatgctgttttcttccttactggctaattgttttagaattgaggagtggggctctaaccagatggcttggcctatgatgtagaaaggcactgtgggtttgacggcaggcagggctacatgttgacttcctacctaaaaataaaacaacaacaacaaaaagcacaaatataatagaaggatattataattctgaggattctatagcagaaactaatatcatgaaacatctctgctgcttaggaatatgatgaaattcaagcaaaaaaagctgtagcgccaaggttaatacattgaatatagcacattgaaagcaggggttgattcagcagctaaaatggctcacaatatactgaggctcactgaagaggaaaatgaattcctccttcagtgatgatagagtgtacctcaaagacagatttggggaaatattaacaaataaaaatgggacacaccaggcattttttatgtttaagcataaaagatgcctgggttcaggaaccccacagggtcaaaccaaggttggaggttggaatggggaatgtatgatgtgatttcctggctgtttctggtgcaagcttctagttgattagcaactttccctgaggcctttgggcggagacaatgagaccagagctggcagtagaaaggatgtgacgagccacacccagctaccggagtgcagacacctgggagccaaagggaaaggtgactacaaggacaaaggggaagggacagaacctgtgatgcagtctcaaaaagtgacagcatatcaatgtgtttgtcctggtgtgtactggagcattttcaggttcttattggtgagcagctagcagggtcgggtggggggcagcagtggacagattaagggaagatcagcaaatcagtaagtgctggccagagtatatgtatctgctttgtttctaggtagaatgaatttagtgccttggtttctgagtgcctgactggctgctcttgtgaatactcggtttgaagctctgggtgagccaaaggagtaacactttatttttgctctttgcagcctgccagttgccatctctttgtaggaagacataagaataatggtttgtaggatgatgcatattgtgtcaggaagatttatcccggaggactctgggacaggaactttagtgtggggcataaacatatttcagtattaaagtacggtaaaattctcctttcgtcatatttctgacagttaggtttctgtgtactaactgggactggcgtaactctgacctacataatagcaggacccctgtgaaagaatctattttatttggtgataggatagcatttcctatttcatgtagagcctataatctctaatctgaaaagcaaagcaggaactcggggatgagcttagcgcacattcaaatttgtcattcacattttttcaaatttgtgactgtgaactgtgtgcctgccccaaactctaatcacaatttaaattccctggcaatgccactactattcttccgatttactatacacagctgacattggggaacctgaaagtgttagtagcccacaaccataaggcctgggctagatgagaatggtcttctacattacataaatgaattgctaaaactacattatgtgtgtgtgtgtgtgtgtgtgtgtgtgtgtgtgtgtgtgtgtatacacatacatagatacgaacatgaaattttttaaaggttgtttttaaaattataagtgttggtgtttgtgtctctgtgtggctatgtgcacatgagcgctagcacccttagaggccagaggggggtcggattctctggagctaaagttataggcagttgtgacccccctgatgtgggtgctggaaactgaactcaggtcctttgggaggtcagcaactgttcttaactactgagaattttagtgtacctatatttagctcctatgaattttagtgtacctatatttagctcctatgaattttagtgtacctatatttctgacagaatctggggtaccagaagttcctagtttgtctcacatcttagtttgtcttattttttcctcagtggtattaaaagaggaaaaaaaatggaaataaaattcaagaaatgggtatttgtgaaataagctgtggattcactagtcagaactaggaaattagtattgatcctcatgtcaggggaaaagggctattggccgtggttcatgttcactccgagaatgacatttcctttagtgatcctgattcctagctcctcttatacaggacccctgtagggaaggctagtcagatatgaatgatagcccactagagaggaaggcatttaaatatattttgttttcacagtgcacagaaacgtttgactttttcgcactattttcttgtacgttgaaaagttgtgtctgtagctgaggtcacagtatgatatatgcatggtatggaatgatgaaatcaagagaacgaacttatctgactcctaaaatactggtggtttctgatatgagcatttgaaatattcctctagcaattttgaaacatgtagcaccctgtcgttggtagtagtcccccatgcattgcagtgatctcaaacattcctcccatgtaattgaagattcagcctactttgattactgtctttcctttctccttaatctccattctccataccctgcaggtacagcattcagctctgctcccatgaatatggctggcttagagaacattgaaattttgtccttctgtgtaggcctggctgttttcacttcacacaagtttcttgtatgctgttgcaaatggaagtttccttcctttggtgtgtggcagggtaagtgcatatgtgcaggtgggtacgtgtccgcatgggatcccatacactgtaggcatatatgcaccttttgttttatgtggtggtttcctccaaaaggaaacatgtccaggagggtgtgggacgtctcgtgagccgcaaatgtctgagagaacaggaaattagaagatttttttttgagggcctccctagccgtatgaaaaggagtacacaagtctaggtgtggagactgggaaagccagcttcacagcgatgagacgtttggatgatgaagctatctgcaagccggccggcaagtgccccagggttagcagtagtagcctttgtgtggaggtgggctttggtgatggagctgctcttgagtcacttctgctccttgtaagcacctcctcactcatgttgctgtcagtaggtccggtaaaaactggttcaccaagtctgactttggtgtagtggttactctagactgttgtaagttccctttctgaggtgactagacctgtggttgtgcctccttagtaaaaaaaacctctggctgtaaaaaagtaaaagtctcaaaaaaaaaaagtaaaaagtctcccacatcaatcttcaggccatctataccattttgttctttagatagggtctctcattggcctggaacccttcctggaagcatgaccccaagggatctgtgcccatctttacctcaccagccctgagccaatattacaaagacttgttttatgtggatgaatgtcccataagtgttctgtgcactgtctgcgtgcctggacatcggggaggagggtttcagagttaccgacaattgtgagccaccatgtgctctgtactgtggaagcatctctccagccccatgggccgcatttctgtgtgtgtgtgtgtccatatccaagtgcatgtccactctagaggtggtggaacctggaagaatggaatcagtaaacgaggcagactaaagtcccatgcaaaagctaactttattcagagcaacaacttacgctctaagggttaagaagggtcacatgagtaaagttctcaagagttcaaaacacttacaatcactactacaagccatctgtggcaaagagccatgtctttctatagaggcatataaaggatagtttaaacatttaattgactaacagctgcaagtgctaatgagtaatctagtgtaaactcagccctatctgctacacctgggaggagcaagaccgcacattccaagaacaatttgttttcttggagtgttctcactagcactcagaattctcctcacatgactgcattcctggaccctgttcagaagtacgtgcgtatgcgtgtgtctgtgtgtgtgcatgtgtctgtgcgtgtgcatgtgtctgtgcgtgcgcatgtgtatgtatgtgaatgtgtgcctgtgtgtgttcgcatgcaccatatggaggtcagagattgattttgggtatcttcaatatctcattttttttttttttttttgcggcagaatcgcacactgaataaggaggtcatgattcacttagtctgactggccagtgccccctagagcttctgttgttttgcttctccaaggggggattacaagttacccctccaagagttttatgtggattttgggggttgaatttagatcaccatgcttactggacaagcactttacagattgagacctcgccatagtcctctgacccagtcttttgtcttgggttctggggaagagcattaagttccttgttcttgcagagcagttgttttatggcctttatcacttcagcagctgagcaactcagtctcagaatctacttctttttgaaggctatcaggtgttctggtttgtgtgtgtaatacacacgcacaattttctttgtccatccatcagctgacatatgattaattttgccctttttgtaatgcttaagtcagtattggcatatatcccttcccatccagttaccaatttcatatcatttgcatatgaaacatttcaggctgggggtatagctcagtggtagaactcctacctggcatgtgcctggattcagactctattcataaaaagcacaatgaaaatggaatttacatacatataatgcagtaatattttccttttattttagtttttttaaataacataattagtaagagaagttctaattttccctataatctgcatgagttccctactccataaattctccagcgcttatctgtgtctctgaatttttttttctctcaaactctttagctaccccatgttcacctatccagaggagtctgatggagtcccatagattgatgtgtgcacttatgccttctggggtaaggccaaagcaactccttacagtgacaagggatctataagtttctgactctgtttatgtctagcatttttacattgtttgtcttatgtaacaaagtgaatttgttcatgttcattattgtatgctttggattgtagtgctaagatggtctttcgaaattaagaaaaagtgatttttctgccattatggatttctttagtggtttgtgcttaaatcgaagaacacaaaatacctggtttgtattaaaatccccagtgagtttctatttaccgtagaactcacagtcatacttaacccattgtcaagaacaaagggtgtggtctactttctggtaatcagctgtatgtaaagtaagaatcagaaagacagactaattggccaagaaaccgtattaggagtcagtatttagaaaaccatgtagggagttttgttttcagccctgctaaagatctccccaccatagaagacaaaatcgctgtaaggagtcaaaagcagatcagaagtattgctgtggccaaccttcatttaaagcctccttttagagactggctcttaatagtcttccggaaaatgacagataattacatctgcctttgacaccctcttgccaacctgaaaatggtcagaacaaattatcagaaatttcattaagctgccttcttttcaggctgccttccagatcattgtccaggcaagttataaaacaaagggaagcccaaatcaaacagacagacagcaaataaaagcaaaaacatccctggaaccaggcacaatggtacagtaatctaagcactcggaaggagcaggcctccgtgtgctacctaacagttcccagttcagtgagaagcatgtggtgctaatgtgtaaaacttaaaaagaaaggagacaacgtaaaaagagaaaagccagttaatcaacaaaacaataaagccaaagcaattaaaaagggctgcagtggcatacacctgctgtctcagtacttggactacctgctttgagtccagtctcggataaagagtgaattttagggttgctagagctacgaagtgagttgctagatagcaaatactctcctcctctcaattcacatgcttacgtagggacaggttggccagtcagttccagaatctgtggtttaatatgtctgtgcttccaaggtatgcagcgaaaatctggtagtgacctgaagagactcctgatttagatagggatattgccgtttacagtgtcctggttgtcatttcattaaacaggcaatgggaacacaaagaggaagaataaatatgttacttattatttggatggtaattcttctgttctaccgagatcccaaacttggtgacaaggagagtgatctcaaagactgccatctggcatttggtacttagcagtggctgctgtggcaggtgggagcatcagttcttggctacctagtttgctaacccaataagtgctatatagctcttaagtggtcaaagaaagtaggattctttgttcctggttccaaagatgtgtgtgttcaggtgcatgccatggtatactggtagaggtcagaggtcaggttgctggacttgattttttttctttcatttcgaaccttggggattgaacttaggttgtcaggttgccacatcactggccttctgcagaatctactgcagctcttttgtaggcccgctatgttgggtttccttaacctttaactcaggcccatgtcatagctcttaacagaggatctgattcctttggctgtaagtttttcacagccctttgaaactctcctggtgactaggacttgcctttctggctttttagaggcctttgtgtttcttcagcattaactcttcgccctgatttctcattctgcagccttaagtcctgctctggccactctagagcgcttcaccttcttcatcttcagctgttaacagccagccatcattcttggcatgccagcttccacgtggatgcacttgtccgtcactctctgttgatgctttgtgtgatcagctcaggctgcgctcctaaatataggtaagaaaagaccacttgagagaagttgtttattgggcctgatgttacaacatcataagaaagcacagtagaacttatctaagctctcaaccttcctaatgctgagcccctttaatacagttcctcatgttgtggtgaccccaatcataaaaatattttcatggctacttcataactgtaatttgctactgttttgaatttgaatgtaaatatgccgaatatctgatatgtgaccacaaaggtgttgtgacccatagattgataactgctgatgtaaaccaattcattgagaccaagcaacctcttgacacatacagagccactgagacttgtgttttggatcattcatagctagaacttaaaactagtgacagaagtcctctttctttatcatcaagggaagggcacccccccaccccccgtagtctaggtagaaatagtttcagagccatctaaggttcaccatggcttatgatagcaaaacaactggtacagtttcagacaactttagatacattcaagatcagggaaatgagctgggactatcatatacttttttaagggatccctggaatgctccaaaggtctgttgctggcataagagtagtccagctaggagactgacagtccttttgttcaagataatcaaggcagcaagagagaattgaacagctggcaattagagatctcattcccgtatctgctgttgtcttatttacagaaaaattaaaatcagacagtcctcacactgtcaacttaatcatttgtcattagtattgacagtgacttttccagtgattaacatgtttctcagtcagggtctcaggtcaattcttgttattggcctcagatatatttcctgtaagaaaacctagtaaggaccgtcagactacctcagggacaaggtctagcacagttccttgaaactgtcatttaacaggttttaaaaacagaataaagacaaaaatatcctccaggaaattttcctccaggcctcgcgtgttcctagttttataccaatgtgcagccccttggaggaactgagcagcatgtaaagtagtttttggtcggtcggtcggtcggttggtcgagaatgtttggaagaattttaagtaaggggccctgccttacccggccaccaaggtctctgctcaaaggtgcagcctgtgatactgacttaggtcagcacaatacagaactcttaaatttgctggtctgacaatttgacatatttgtgtgtacttcacttttgcaaagaattcatttcacatcagggaattgtgtatctaccaaaaattttaattctgatttatacagcctagtgctttataagccagaaaagcagtactattgcaagcattctaagtcagtgattctaaattctccatgcttctacaaagccaattaaaacataggccactgggttccctatagagggaaatgcgaatactaccaagtttaggatcatactaaaaaatgttatctaaaccaaccggaactaacttatttattttcttgatatctagtttcttgaattcttttggatattagcccactgtcagatgtggagttggtgaaaatcttttttctataggctgctgttttgtcttatcaaagatgtcatttgccttatagagtcttttcagtgtcagaaggttccatttattaactgttgatcctagttcctatgctactgatgttctgttcaggaagttgtctcctgtgccaaactgttcaaggctattgcccactttctcttctatcagattagtttatctggttttatattgagaccattgaactgtttggaggtgagctttgtgcatagtataagtatggatctatttgcattcttctatatgttgacatctagttagaccagcaccttttgttgaagatgctgtcttttttttccagtatgtttttctgtcatctttataaaagaaagatcaggtgtctatataagtgtgtagatttatgtctgactcttcaattgaattcacaatggctatctttaaagaatggaatttacaacaaggtttaaagattaagtaggtcttaaaattaaattaaaagttcctttgggtttttgaaacagggtctcgtgtagactaggctggctagtagctccatatacagctgaaaatatccttgacttcttattcttctgtctccacctcccaagtgttagggctacaagcatgtaccacaagttaaaaatatataaacttcttttattatacaacatttctgttgataaatgaatttgtaaggttgttatagtgcattattttgatttaaggattatagaaaagtgctatatagtaaaactcaaggctacaagaattatggccctaataaataccatttatttattgtttttaacagtgaatctttattggatgactttatgaaaaactactgagagaattctctgtaggccattttgtctttagcagttgtgttgaaatttcttgactctcattcagcaggaaaggcaaactagatcctaggatatggccttcattccctgtaaaaaggattttctgtgcatggatgttttgtctgtatgtttgtataccatgtgcatgccttattcccctggaagctgggatagggagtcagcaccctttataattgaagttgcagacagttgggatccaccatgtggttactaggaattaaacttaaggtccctggaaggtcaataagtgctcttagccgttggctcatctctccagccccttctttgcctttttgtgtccccataatttccatgtctttttatcctgtgtcaaactcaagttaccaaacaggtctttctcctagcaccaagcaggaggattcttgccctggatcatttcattgacaagtctggcacttcttggggctccttactaaaggatatctctggatggttaggtacattgccaacagtcagacctgatcgaaattgtcccagagaaaaaggcagatggattttgttgtgtactgcataaaaaaaatgtatttactttcatttacatctctacggatgtgaacaaattccatgttaatgaggttcaatttaatgttatgttacacgtgtacgatgtggaattgtcagtgcgggcagtgagcttcatcccagatacttgattatgcccctgaaaactacttcaggatgagctttactaaagcttgctagagagcttttgaagtagggagactgatttagcacatactgaaaatttaatgggggcattcaaaggagccatatatgcataaactgcccagaggatataatttatgagttccaggactaagtaacatttaagagctaggcataaaattaaatgagaaaacaatgagctagttttcttattttactgaaattaattccttttccagttgtaattgttaaagtgtttcatcagctgtactacctggggtatatagcaacaagtgcttgtctggttatattcacgatcacaaccagcaaggctgcaggtaaccagttcctttgttgtttttaccaaccttgtttgagcggtctttgggaaagagggcattatttctgcaggcagcttatatttcatcagtgtgctgagtcgtctcatttattctcaggttctggggtgaagtgcttcttccctcatcatctccatacttttctctgatttttaagcttgtcttggaatgattcagtcaagcaaattaatataactattatctgacgtatttagtttatcagatatgaacattagaaatagactcacagaattttcaaagctcaatactctcttattaccatagtgattatactgatatgagagctcaaaaatctttcctctggggctggagagatggctcagcagttaaaacactgaatggtcctgaagaggacccaggttcaatttcgcagctgccataagggaactcacaagtgtctggattcctgttgcagggggtccgctgctctcctttgacctttgcaggtaccaggtacacatgcactgcgggcagccagagcacccacacacagaagaattaggtgaaactgatttttaaaaatcatttctcccatccaattgaaagttttcttattttgaccaccacctctccaccaccccacgcccaccttctacttcctagtcaccctagcttctgtctctgactgtaatggaattagatttcacaaaggcaagaacatgtagtatttgcatttctctaaaagcctggcttggttcacttcatataggaagtatctgtaaatgttgtaccttgtgtcaggtcctttttcctttgagacacagtcccactatgtggtcctgaaatgacgtgaaattgactgtagagaccaggtttgcctataactcaccagtagcctgctgctgctgcttcgcaagggctaggattgaaggcctgcacaaccacaccctctgtctcagctctagaagtggaaactttgagttcaaaacaaggagaaagttttacaccactggttcagactttttaattaattaaattttttaaattaaaaaaaattaaatcaattaattatatttaatttaaaaaacacaaacaagtgggagagtgtacttaacaattacctaaatgttgttgggggttaaatgaaagataaatgtgtaagcactgttccattgtctacagcccctagattacttctaatcatttattatttactccaacaatatatattctgtgagataatcctgtcatttttatgaattacaatttctagttcagctcattgcttctttcctcattagcacatgagaggtatatatcgctactatgcccacgcttcagaagatgaagcaatggaataaatagcaggcttcagagttttgctcacaatgtcctggttctgatccaaaaataagtagagagtccaacctagaaattctggccctgtgcttcaggcatgcagggagagttaggtatgagacacaaaagtgggaaacagtagaacgttacagattcagaaatggcacgttgaaagtcaggattggcccagcagcttaaaagaatcacaataaactgttcttataagaaaattcattctcacatcagaatgattggtacgcttccaatcagcttagactagaaattgggggaaaggttcaacagatgagaaagggacaggcccagctcttgttttagcagaaaaaattccaagtacaagaacaagttggccaatgctctggccctatagcaaattccaggtcatttcaatgccctgcaactcccagggttgacccctggctagagtttggagatggctggagaactgggaggtggctccctcaagctgtgtctgaagcaaacttctagctacacctctggaagggatcagaggcctttttctttctctcaaggccacattgagaagggaccactgaatggaggaagtaagagatgggcctaactcttggcttctgcagaggacacatcactgttctgggggcttggatccaaagcatcactcagttgttcttgataagagaagggaggcacacggttgaaaggagccttgagattctggagaaggttgttgctgcccagagtccatccgtactctggggatcccattcggatgaattttacgcagtgttctaggccactggttgcacatttccactactggtgggaagattcttctgagcgccaagcctgtgctgagtgttgtattcggggctctggggagcagaggaagtaaagcttcattttctctccctctacagcctgctagttgccatctaatttggagctcaggaactgacaaactttagagggcgatctgtcttctgttagtggcgcatgcctttgatcccagcacttgggaggcagaggcaggcggatttctgagttagagaccagcacggtctacagagtgagttccaggacagccagggctacacagggaaaccctgtctcgaaaaaaaaaaaacacaaaaaacaaaaaaagaaagaaaaaaaaaagaaaaacctactgtggacaggacaccaaactaccccaggaatgggtctgagtggactcattgatatagtgctttaagatacttggaggagggtttggggagttagcttgttatagaaacaatatgccttcacagtgagaaatatcaccctgcacacttaagagattgttaaaggaaaatctctttactggaaaagtctggccagctgttgctagtgcccaaagaagaacaggcccctgatagaagattttactaacttatatacaccttaggcttattcattttatagtctctgtagtcctcaaattcctttcatgtccaggacccagcttacgctttgagcaatttaagaggcaggagcctgcaagtctggccacctgggcagatgggtgattcacacagcaaggattttgccagagttttaaagtatgctagtgttcttttcagcttgcccacctggctgaatcacacttttcctgataagaccgcagggagtgcaattacagcccaggacttaagggcagctgtgaccctgtagctatgcagggacagatcctaaaaatagatccctgttgaagataccttcttggggatgcacctaatggccgctcaatcttggtaaacggagatgcacatcctagcacagcaattttgcttatctcaaacaggcctgcatagaacactactcatctctgaggtattttggaggaatccatcgctgagctaagttctgctctctggtttaatgtctcctgagcaaagaggttagtgaggcctttataacatccaggctatcagtttgaatttcttctgcatcagtctctggaataagaatcattggtggggctggagagatggctcagtggttaagagcactgactgttcttccaaaggctatgagttcaaatcccagcaacacatggtggctcacaaccatctgtaatgggatctgacgcccccttctggtgtgtctgaagacagcaacaatgtactcacagatataaaataaataaatctttttttttttttaaagaattgtcggtgtgcaaatatgaggaccctagttcaaaaccctagcacccaacaggaggatccttggagacctgctgccagccagcctagccccaggtttagtgagactccctcatctcaagggaataatgtccaaagtgaagagcaggacattcaaagccctcctctggcctccatgacagctccccacccaacccctacatgaatggagtttatcttcagaatctctttaaaaactttgtgttggggtagaggctaggggagggttttgaatgtcctgctcttcactttagacattaatcccttgagatgagggagtctcactaaacctggggctaggctggctggcagcaggtctccaaggatcctcctgttgggtgctagggttttgaactagggtcctcatatttgctttttttttttttttttttttttttgggttttcgagacagggtttctctgtatagccctggctgtcctggagctcacttggtagaccaggctgggctcgaactcagaaatccgcctgcctctgcctcccgagtgctgggattaaaggcatgcgccaccacgcctggctgggtcctcatatttgcacaccgacaattctttaaaaaaaaaatttatttattttatatctgtgagtacattgttgctgtcttcagacacaccagaagggggcgtcagatcccattacagatggttgtgagccaccatgtgttgctgggatttgaactcatagcctttggaagaacagtcagtgctcttaaccactgagccatctctccagccccaccaatgattcttattccagagactgatgcagaagaaattcaaactgatagcctggatgttataaaggcctcactaacctctttgctcaggagacattaaaccagagagcagaacttagctcagcgatggattcctccaaaatacctcagagatgagtagtgttctatgcaggcctgtttgagataagcaaaattgctgtgctaggatgtgcatctccgtttatcaagattgagcggccattaggtgcatccccaagaaggtatcttcaatagggatctatcttgaggatctgtccctgcatagctacagggtcacagctgccgttaagcccagctctgtaattacgttccccgtaggcaggaagaactgggtcctggaagtcaggagggtggaggggctgagccggaagaaagattaaaagccctggttggttgaagagttccacagagctggcaagcctcaaacattctaaggcttgaattggaacactggtcgatgtcaaggtctaagtagtgccagtacatgggtctgataaaaacctgcaacacaagctgatgccaagagctaaggaattccttgattcccaggtccaaacaaaagtgcagggtaaaggtccccaatactgtctttaacactagtccaagcaggtcctagctaggccaccagagggagcacttctcccttataaggtagaagtggttccaagccatggagagttcactgcaaatcataattctcccaagtttgctttatctcctcacatagacagtctgtggaactaggtgtgcattaggcagaggactagtgcacagaggagaaacagcaccagaggaaatgggagatcactcacagtgtcacaggctaacacaacagcaaaagccccgccccaccccaccccccacactaaaactgtcttgactggggctatgccttccttcagaagccagagcagtcacctagaatcgctgtgtagtttccgcagtgcatcggtagaatgtgcaggatagcagttctggtatataggtagcctaccaggcttaagccatcaagttttctgtaaaggcacgtggggaacacagaagaaaaaggagttcaacaacttccagtgaaaggctcggtggtcttgcccctgatgtctttgcttatcgaagggaaatggatcccaggaggagtgcttataattgggacttactataacctggtgtgatgacacaaacctttcagccccgaactcctgggacggaggtgatagatccatgagctcttgaacagacaggggaggcatggaatcctccctatcagtatcatttacgagcaattcttcatgtatctattgaccatatgtatgtatgtctttcttcaagaaatgtctattgaagtctatattattaagttgagtcattgttttattgcaactgagttcgctgtttgagacagggtttctccgtgcagccctggctatcctggaccgcacttggtagaccaggttggcctcagactcagagacctacctgcctctgcctcctgagtgctgggattaaaggcgtgcgccaccactgccacctagtgcaaccaagttctttatagattttagaactagccttttattccatgtggcttgtagagacttccttgtgcccccgaggttgactccttgcgcagctctctgggctgttcactcccatttgtttatgctgctccttgtctcctcattgattttttttttttttgttaaatctcctcctcaaattaattatacagaccagtgtcatttttttctccactacttttttaggtctgtttttcagttgttggtgttgtttgactgtactaaaacgggaccattcctgttgtcctttaatgcacgtttcaatgggggaacaaagatactcttcttaaattaaacaaagaagatttccttcaactttgcctaaaaccatacacgcttaaaatgatacattacctattttcaatgaaactccctagctgagttatatactcaagtggtagtcatttacaatgggactcttgttcccacttatggcatcaataacatgaaaggggtatttctaatttctggtaaattatgtcaataatacaattgtgacaatacttgacagagaaagattaattgtaagattaattatcatcagaagttatagtcattttttcaaactcagggccacacagtcaggaatgcaattgcagcagatctttgtttcaggtttcctttcacagagtagccttaaacagtttctagaaggaagcaacccacagttccagcaacttgtgaaaccctcccaccaaccgaaaaggaagttaaggtcaggacacattgattagaggctcccatctggctccctgctagatctctccccagattgcagcacaaattaaatccagcccccaggacacaaataacaacaggccattccaactggcctaggtaggtctgttctgcctttgtcctggaaccaggaagatgctaagattaaagccattctttgagaactaaagacccttccagaaaggccaggttgggggtggagagtctctgtagaagagctctggtatttaacactaggaggaagactgactttcctgttcaggtaagtaggctcctgaggcctatggctaaatcttcaagtgtatagttcctgattttttgcttcatctttttaaaatgtttttttttaaagatgacttgtgtttaacttagggtctcatacatgctaggtaagcattctaccattaagctgtacctccaccccttgattattcttttttgtaagttgtaacatagctaagggtgaggcagaggcatcgagaatttctcttcagctttggccaaaattctgtatacattaatttgcctgttttatacagatgggtttttgtattaataatacatgcaagcatttaggcccaaagccaggccttatagctggaggatctataaactgggtggacagtgtgttagaggttttagatttctaaggtgtgtaataacctcattacaagaccgtcagtaggagactctctctctctctctctctctctctctctctcttgaaaggtaatcaatccaatgcccgtcatgagtgatgtctttttctcctctgtgcactagtcctctgcctaatgcacacctactcccatagactggctgggtgaggagggaaagcaaacttgggagaagttttgactttgtagccctttcactggaaattggctgtgaggtcggaatggtgcagtctcatgggaagagtctgggggacataacttacattttcattagtcacagtgtttatttactagatgttacaaggctgggtttgctttctttttaatcattacttgagagggaaatataatatttccaataacatgtatggacattttattctcttaatgtggtagaatttagattgcaggcgtgtgtgtgtatgtgtgtgtgtgtgtgtgtgttggaggcaagacctttcagtgtagccagactggcctgtactcactgtatccctgattctgcctctccaatgctagaattataccaccatacttgacttcagttcacttttaaattattttataatttgcatatgtcaatagcttttatgggtgcttcattatttctgttatcaagaatagattcctagtacattgttggattattttgttagcgagcactcaaagatatttgctatagaatactactaccaatagacctcgtgatgataagccacatagtgtctcttgtttcatttattgtaaaagttcatgtcttaaagttcatgttctaagcttacagagatttataattgtgctttcttcttttctaggtagatgcccagtgacgtcaacatgtagtttccacaacgtgtaaggtttttcgagagtggccaggggatggaaatattggactaaggaatggtaaaaggctacaaatatcagtgttttaaccattatttaattgctttcttgatcattacatgattgtaagcttgtgtgtgtgcatgcgtgtgtgtctgtactatcattcagtgtagaaattggcctagcccatagcacctgctaggcaagtccgtcattaccaatatatctctccaactctatcattgctgttttgggaaggttattattttgccatttggaaagcacctgtgcataggctttatcctgtttggggtacaatagatttgtatatgaaaaaataatcttgttatgtatgggtgctgagtcagaacttcttagcagtagtcaggatttaaactaataaaaaatgctcaatgtggtttcttcttatgtcttgagaatttagctgaggctaaattggatgagtaccattggcaccaagtaagatcatgtgttttgcacttaacagataatttctttgtctgtggatatgggagtacagctgaggcatcccataaatcctatagataaacagtttccaccctcaattataagtattttttttgatccccaggaaactaggtaagatatgaggaagaatgtgattaacttaaatgcctcatttaaaatttcactcagaggctttgtgcccttctagaattttctaagtatggccagagttctcagaataaaatgtagagacaccgaatgaaataatgccaagtagccaccaggtggcgaaattgcatatggatttaagcagcacaggcaaaccagcctcggtatctagcctagaggccatgtttatgtctgtatctggttttctgtcaaggctacaaaagatcaagtggtgattttatttctctttattcccttggttttagaacacttccattcctgcccaaggcttctgtgggagccatgtgccgctgtacctgctgtgggagccatgtgccgctgtacctgctgtgggagccatgtactgcttgctgtac

SEQ ID NO: 679 - DNA, 6508 bp, mus musculus
agaggcttctgggatcgggccccgtgttgctactgccgctactgttgccgatgctcccggaggccatacggctggataggtcagtcccagggaagaggacaaggtgggatgtcgcggcggggtgtctccggctcaaggttagaaacctccagctgccaaaaggctcaaagagatgggaactgaagtgaggagattgggggctgggggttgggtgagaacggaccgaacacccggcgactgttgatgacgccacagcagcgcgtgtcgctgtttccggtgtgctggccgctgggtttgttttgttttattttaggttagggatcggcgagatacaaggatggaccctaaaagatgaagcaaagataagaattaggcaagaaactgttgctgcccagtcctcacacatatagatcgtgttcgtatgaaactgtctgggcccttctttggtttcagatccattctgtgtctgttgggatggttgttttgtgttacaccttaacgaatggtgctcttgccttgttcagtggattcggtagtccgctgtgagctgggggggggcggggggggagtaggtttagtacccttcacattctaacaactgtcatttacatttgaattggaacagttagagcacaaagagttagcgacccaggagctctggagaaagggttggaggagtgctctctttgatgggactgctttcacaccttttggatggataaataaataaataaataaagccaacttttcctccaggcattttttcctggggctgttagctcccggtgcagctatttggcccgagtgaggagtggaggcggacttaatgccaagatagtttattgctggtgagagaatttgctattcaagagcaggacccctgtgggaaaattaatcttaacctgaggccagaatctactcctgcactaggatccagtttgtaatctggttaggatgtcagagcactctgcatttgaaattcttgtgctacgtctttgttttgtaagctaagtcagttgacagcgtgcagtcccaaactcttcaaaaccttaagcagacttttaaagattctgaacggccagaaatcaagatgttttattaatgagagaagcaagggatgaagcatgctactgcttcttacattcttccactcgttctgtttctctgagggacttgtttagacacaggctgctggttcacttatatgagtttttttttccttcattattattttggggggaaggaaagcctcctagaatttaaatttttaacaatttgcaggaagcagcacctgtcacaggactgtccttggaaacctgttgaaccagcatccctagccaacctgtgtctcacaagtgtatcaggatagtgatgagtgtggcccggtacaatttctagaccacaacttgaagccacggtgccaaacatttgcacacagtttgccacagaggtgacatataaccttgaaagtgttactggagggcttcagttctaattaccaagtaatgtttttgctgaccaggattcaaatgctccctcacattaacaagaaaaagagttatggatacaggactgaattgcgtcaccttttcagtctgtctccaccttgcccatagcagggttacagatgatagaaaacacgatgcagatatcaggaagtgtatgcccataggttgtcttttagactcaggttacaagaactgggtaatgggtcttctacctaccctgtaccaaatcccaggtaccagggcctttgggttgatctgttcctcctacccatgtggtattgtgggaatcctaattcctggggacccatacgagtggggagctgtaggaaggccagaccactcccaaatggattttacttaaatgcgacgtgaaaaaaaatatgtgtttggtcatgcatactgatacctgtgtgtaataagagccaacattgtgtcattccttgagcaccatccactttaattttgttttcttgtttgtttttttgagacagggtcttattctgtagctctgactggtcttaaacttaaaagatctgcctgtctctgcctctactttaagcagggactaaaggtgtgcaccaccacaccccgggtcaccttgtttttggttcttggtttttttttttttttttgagatagggtcttctacaggcctgggatttcaccagttaagctaagctgactatccaggaagttccagggatttatatatctttgcccccccttcaccccgaaaagaggtaggacagttctgggggttgaactcaggttgtcttgcctgttgtggcaagcacttactgagtagtctagcttcctagcataatagaaacagcttgtcattgctagagactggtatcatatgcctgtaatttcagcacttgggaagcagagaaaggaagattaatttaaaggtaaaggagaccttgcctgaaacaaaaacaaacaaacaacacaaaaaatcaactatttataattctaccaactgtgataatgataacgaatgcagagaccaccagaggacacttttaaaactgaatagacagtctttcttgcgagttggtgactgcactaggaacttgcccaaatcatgcagccctgatccttacagccctttgtcttttatgcacaaaaaccacatcctgattgtcacacttcagatattaagaagtagaactacagaagccaccccccccaaaaaaaaaccaaacaaaccagtgttactacattttaggactttcttggaactacagacttagatctttgatggattaggtctctttgttcccatttcggcaggtgttagggcctgtttgttggctttgaaggtcagaatggtgcctctaacatggtgtcagttgtgctaaggtctgggggcctgttagaagtctattgaggttttctagtcatttcaaaaattgttttttttttccctactgaatatagagttgagttccttatactattatcaaacctcttaggtatatttcaacttccttcctttctggatgttgtgtctatattctcatttggtttgctttgttgtgcagaggtgccttcatttggaatagtcctgtttatccatggttacttttgttgctttggggtccaaatttaaaaatctttttagacaacgtcatgctgttttcttccttactggctaattgttttagaattgaggagtggggctctaaccagatggcttggcctatgatgtagaaaggcactgtgggtttgacggcaggcagggctacatgttgacttcctacctaaaaataaaacaacaacaacaaaaagcacaaatataatagaaggatattataattctgaggattctatagcagaaactaatatcatgaaacatctctgctgcttaggaatatgatgaaattcaagcaaaaaaagctgtagcgccaaggttaatacattgaatatagcacattgaaagcaggggttgattcagcagctaaaatggctcacaatatactgaggctcactgaagaggaaaatgaattcctccttcagtgatgatagagtgtacctcaaagacagatttggggaaatattaacaaataaaaatgggacacaccaggcattttttatgtttaagcataaaagatgcctgggttcaggaaccccacagggtcaaaccaaggttggaggttggaatggggaatgtatgatgtgatttcctggctgtttctggtgcaagcttctagttgattagcaactttccctgaggcctttgggcggagacaatgagaccagagctggcagtagaaaggatgtgacgagccacacccagctaccggagtgcagacacctgggagccaaagggaaaggtgactacaaggacaaaggggaagggacagaacctgtgatgcagtctcaaaaagtgacagcatatcaatgtgtttgtcctggtgtgtactggagcattttcaggttcttattggtgagcagctagcagggtcgggtggggggcagcagtggacagattaagggaagatcagcaaatcagtaagtgctggccagagtatatgtatctgctttgtttctaggtagaatgaatttagtgccttggtttctgagtgcctgactggctgctcttgtgaatactcggtttgaagctctgggtgagccaaaggagtaacactttatttttgctctttgcagcctgccagttgccatctctttgtaggaagacataagaataatggtttgtaggatgatgcatattgtgtcaggaagatttatcccggaggactctgggacaggaactttagtgtggggcataaacatatttcagtattaaagtacggtaaaattctcctttcgtcatatttctgacagttaggtttctgtgtactaactgggactggcgtaactctgacctacataatagcaggacccctgtgaaagaatctattttatttggtgataggatagcatttcctatttcatgtagagcctataatctctaatctgaaaagcaaagcaggaactcggggatgagcttagcgcacattcaaatttgtcattcacattttttcaaatttgtgactgtgaactgtgtgcctgccccaaactctaatcacaatttaaattccctggcaatgccactactattcttccgatttactatacacagctgacattggggaacctgaaagtgttagtagcccacaaccataaggcctgggctagatgagaatggtcttctacattacataaatgaattgctaaaactacattatgtgtgtgtgtgtgtgtgtgtgtgtgtgtgtgtgtgtgtgtgtatacacatacatagatacgaacatgaaattttttaaaggttgtttttaaaattataagtgttggtgtttgtgtctctgtgtggctatgtgcacatgagcgctagcacccttagaggccagaggggggtcggattctctggagctaaagttataggcagttgtgacccccctgatgtgggtgctggaaactgaactcaggtcctttgggaggtcagcaactgttcttaactactgagaattttagtgtacctatatttagctcctatgaattttagtgtacctatatttagctcctatgaattttagtgtacctatatttctgacagaatctggggtaccagaagttcctagtttgtctcacatcttagtttgtcttattttttcctcagtggtattaaaagaggaaaaaaaatggaaataaaattcaagaaatgggtatttgtgaaataagctgtggattcactagtcagaactaggaaattagtattgatcctcatgtcaggggaaaagggctattggccgtggttcatgttcactccgagaatgacatttcctttagtgatcctgattcctagctcctcttatacaggacccctgtagggaaggctagtcagatatgaatgatagcccactagagaggaaggcatttaaatatattttgttttcacagtgcacagaaacgtttgactttttcgcactattttcttgtacgttgaaaagttgtgtctgtagctgaggtcacagtatgatatatgcatggtatggaatgatgaaatcaagagaacgaacttatctgactcctaaaatactggtggtttctgatatgagcatttgaaatattcctctagcaattttgaaacatgtagcaccctgtcgttggtagtagtcccccatgcattgcagtgatctcaaacattcctcccatgtaattgaagattcagcctactttgattactgtctttcctttctccttaatctccattctccataccctgcaggtacagcattcagctctgctcccatgaatatggctggcttagagaacattgaaattttgtccttctgtgtaggcctggctgttttcacttcacacaagtttcttgtatgctgttgcaaatggaagtttccttcctttggtgtgtggcagggtaagtgcatatgtgcaggtgggtacgtgtccgcatgggatcccatacactgtaggcatatatgcaccttttgttttatgtggtggtttcctccaaaaggaaacatgtccaggagggtgtgggacgtctcgtgagccgcaaatgtctgagagaacaggaaattagaagatttttttttgagggcctccctagccgtatgaaaaggagtacacaagtctaggtgtggagactgggaaagccagcttcacagcgatgagacgtttggatgatgaagctatctgcaagccggccggcaagtgccccagggttagcagtagtagcctttgtgtggaggtgggctttggtgatggagctgctcttgagtcacttctgctccttgtaagcacctcctcactcatgttgctgtcagtaggtccggtaaaaactggttcaccaagtctgactttggtgtagtggttactctagactgttgtaagttccctttctgaggtgactagacctgtggttgtgcctccttagtaaaaaaaacctctggctgtaaaaaagtaaaagtctc
